United States Patent 8,119,385 (NUCLEIC ACIDS AND PROTEINS AND METHODS FOR MAKING AND USING THEM) - sequence listing, part 5

SEQ ID NO: 21258 - protein, 155 aa, Unknown
  Obtained from environmental sample
  DOMAIN (11)...(155): Pyridoxal-phosphate dependent enzyme
  misc_feature (1)..(155): Xaa is any amino acid
MEQNKQVFDSVLDLIGNTPMIKLKKITSGFKGNYLAKVEAFNPGHSSKDRIALYILEQAEKQGILKPGDTIIETTSGNTGFSIAMVSVIKGYDCILAVSSKSSADKIDMLKNMGAKVYVCPANVSADDPRSYYQVAKRLHEEIKGSVYINHTLST

SEQ ID NO: 21259 - DNA, 717 bp, Unknown
  Obtained from environmental sample
  misc_feature (1)..(717): n is a, c, g, or t
atgtgtaaccaagtttgcgaacattgtcatgtagatgctggtccagacagaaaagaaattatgactattgaaactatgcaacagtgtttggaggttatcaaaaaaacagaagcgcatactttagatttaacaggtggagctccagaaatgaacccaaattttagatggtttgtggaagaagcatcaaaagcaggaattaaagattttattgtaagatctaatttaaccattattagagccaataaaaaataccacgatttaccagaattctttaaaaaacatggtgttcacgtggtttcttcaatgcctcattggactcgtggaaaaaccgataaacaacgtggagaaggtgtttttgataaatcaattaaagctttacaagaattaaatgctgttggttatggaatgccaggttctgatttaaaattagatttggtgtataatccttctggtgcatttttacctggagatcagcaagcattagaaaatgatttcaaaaaagctttaaaagaagattttgatattgattttcacagtctttttgccattacaaatttacctattagtcgttttttagattatttaattgcatccgataattacgaagattacatgcattctttgttagatgcttacaatcctaaagctgtagaaagtgtaatgtgtacaaacacaatttcaattagttggatctcgagccgattcttgatcacgtag

SEQ ID NO: 21260 - protein, 238 aa, Unknown
  Obtained from environmental sample
  misc_feature (1)..(238): Xaa is any amino acid
MCNQVCEHCHVDAGPDRKEIMTIETMQQCLEVIKKTEAHTLDLTGGAPEMNPNFRWFVEEASKAGIKDFIVRSNLTIIRANKKYHDLPEFFKKHGVHVVSSMPHWTRGKTDKQRGEGVFDKSIKALQELNAVGYGMPGSDLKLDLVYNPSGAFLPGDQQALENDFKKALKEDFDIDFHSLFAITNLPISRFLDYLIASDNYEDYMHSLLDAYNPKAVESVMCTNTISISWISSRFLIT

SEQ ID NO: 21261 - DNA, 591 bp, Unknown
  Obtained from environmental sample
  misc_feature (1)..(591): n is a, c, g, or t
atgggtggatgttttaggattcttggcgtaaaagaggagttttttttatcaaaatatttacgcaaagcaaaaaaagtacctttaagagatttagaaccatatttttcagataatccatggtctcaagctttaaaagataaaaacgttttggtaatacatccttttagtgatacaattaaaagccaatacaataacaaccgacaatatttgtttgcagataaaaatgtattaccaacttttaaaagtttgcaaactataactgctgttcaaacaattgcaggcgaaccatctaaatttaacacttggtttgatgctttaaattatatgaaaagtcagattgacgctttggattttgatgttgctattataggttgtggtgcttatggatttccattagctgctcatataaaaagaaaaggtaaaaaagctatacatatgggtggagcaactcaaatattatttggaattaagggaaaaagatggattgaaagcgacagttttaacaatattattaacgactactttgtttcaccttcaaaaaaagatacgcctataaaagcaaaggatattgagaatggctgctattggtaa

SEQ ID NO: 21262 - protein, 196 aa, Unknown
  Obtained from environmental sample
  misc_feature (1)..(196): Xaa is any amino acid
MGGCFRILGVKEEFFLSKYLRKAKKVPLRDLEPYFSDNPWSQALKDKNVLVIHPFSDTIKSQYNNNRQYLFADKNVLPTFKSLQTITAVQTIAGEPSKFNTWFDALNYMKSQIDALDFDVAIIGCGAYGFPLAAHIKRKGKKAIHMGGATQILFGIKGKRWIESDSFNNIINDYFVSPSKKDTPIKAKDIENGCYW

SEQ ID NO: 21263 - DNA, 726 bp, Unknown
  Obtained from environmental sample
  misc_feature (1)..(726): n is a, c, g, or t
atggttcgcggtgttggaaatccagagtttaaaaatgaaaatccctatgctaacatgccatatccagatgatggttttagattattatcggtttataaatactggaatatgattaattatttttttccttataaacatataatggataaagactggaatgaaagtttaaaagaaaatattccaccatttattaatgctaaaaacgaattagaatatgaattagcagctttaaagatgattgcagacattaaagacactcatgctaatctttggggaggaaaagataaaattaacgaaatacttggtgacaactatccaaatttccatgtttcatttattgaaaacaagctggttatagacaacttttataatgaagacagtcctagaaacggtttaaaaataggagatattattacgcgtattaacggaaaaaaagttgaagacatcgttacagataatcaagatttttatccagcgtcaaaccagccaactcgtttaagagatattagttttaatttattacgtactacaagcaatagcttagatattgaggtagaagataatggtatcaaattaattaaaacaatacctgtatacaacaaaaaagacattaaggacttttacaaatggtacacaaaagaagaaaacattagtagttatagactacttaaaaataacattggatatgtttcacttaaaaaacttaaagatgaggacgtgaattnt

SEQ ID NO: 21264 - protein, 242 aa, Unknown
  Obtained from environmental sample
  misc_feature (1)..(242): Xaa is any amino acid
MVRGVGNPEFKNENPYANMPYPDDGFRLLSVYKYWNMINYFFPYKHIMDKDWNESLKENIPPFINAKNELEYELAALKMIADIKDTHANLWGGKDKINEILGDNYPNFHVSFIENKLVIDNFYNEDSPRNGLKIGDIITRINGKKVEDIVTDNQDFYPASNQPTRLRDISFNLLRTTSNSLDIEVEDNGIKLIKTIPVYNKKDIKDFYKWYTKEENISSYRLLKNNIGYVSLKKLKDEDVNX

SEQ ID NO: 21265 - DNA, 714 bp, Unknown
  Obtained from environmental sample
  misc_feature (1)..(714): n is a, c, g, or t
atgataaccaaactcaaccttgaaaacatcttatttctagacatagaaaccgttccggaaacacaatatttttcagatttagacaaaactaagcaagatctttgggacgctaaatcacgttaccaacgcaaggaagagtttacagcagaagagttttacgatcgtgctggtatttgggctgagtttggcaaaatagtatgtatttcggttggatattttaccattaaaggcgacacacgcctgtttagaacaacatccttttatggagaagaacgtaaacttttagtcgaatttaaaaaccttttaatttctcattttagtcaaacaaagcatttactttgtgcacataacggtaaggagtttgactttccatacatcgctagacgtatgattattcataacatagaattaccttataaattaaatctttttggtaaaaaaccttgggaaattccgcacttagacaccatggaattatggaagtttggtgactacaaaacgtatacatcattaaagttaatgactaacgttttgggtattcctagtccaaaagatgatattgatggtagcgaagtttataaaacttactatgaagacaatgacattgatcgtattattatttattgcgaaaaagacaccattgcagtagcacaaatatttttacgtttacgtggcgactccattcttactgatgatgaaatcattcatatttaa

SEQ ID NO: 21266 - protein, 237 aa, Unknown
  Obtained from environmental sample
  misc_feature (1)..(237): Xaa is any amino acid
MITKLNLENILFLDIETVPETQYFSDLDKTKQDLWDAKSRYQRKEEFTAEEFYDRAGIWAEFGKIVCISVGYFTIKGDTRLFRTTSFYGEERKLLVEFKNLLISHFSQTKHLLCAHNGKEFDFPYIARRMIIHNIELPYKLNLFGKKPWEIPHLDTMELWKFGDYKTYTSLKLMTNVLGIPSPKDDIDGSEVYKTYYEDNDIDRIIIYCEKDTIAVAQIFLRLRGDSILTDDEIIHI

SEQ ID NO: 21267 - DNA, 783 bp, Unknown
  Obtained from environmental sample
  misc_feature (1)..(783): n is a, c, g, or t
atgttagattattttataaaagtactcatttttcaaacgctgtttttagcagtttatgacctcttattgaaacgggaaaccttttttcaatggaacagagcttatttaatttttacttcattattggcgtatttaatcccgttagtgaaaataaatcgagttagtgaaattatccctgaagactatataatactattaccagaagttgtgctttcaccgacggctacaattgaacagaaactacaagaacctgaagttgtttttagctttgttcaatttatttttgtgatagggataattcttgcagcatctcttttctcgtttaaattatttagaattattcaattgatctacaataatgaaaaagagcgaaaaggaaattattttttggtattcttaaaaaatagtagtgcattttcattcttcaattatatctttctgggaaaattcaattccagcaacagtaaacaacagatcatagaccacgaattaatacacgtaaagcaaaaacacagtatagatctgttggtttttgaacttcaaaaaattgtatgctggttcaatccttatagttatctatttcaacatagaatctcagagttacatgaatttatagctgatacaaaagtcatcaaagaaaaagataaaaccagttatttcaataagttattatccgaaagttttggcgtgcaaaacatgtcattcactaatccattttttaaacattcattgatcaaaaaacgaatagtcatgttacacaaaaaaagattcaaacagtattaa

SEQ ID NO: 21268 - protein, 260 aa, Unknown
  Obtained from environmental sample
  DOMAIN (140)...(224): BlaR1 peptidase M56
  misc_feature (1)..(260): Xaa is any amino acid
MLDYFIKVLIFQTLFLAVYDLLLKRETFFQWNRAYLIFTSLLAYLIPLVKINRVSEIIPEDYIILLPEVVLSPTATIEQKLQEPEVVFSFVQFIFVIGIILAASLFSFKLFRIIQLIYNNEKERKGNYFLVFLKNSSAFSFFNYIFLGKFNSSNSKQQIIDHELIHVKQKHSIDLLVFELQKIVCWFNPYSYLFQHRISELHEFIADTKVIKEKDKTSYFNKLLSESFGVQNMSFTNPFFKHSLIKKRIVMLHKKRFKQY

SEQ ID NO: 21269 - DNA, 825 bp, Unknown
  Obtained from environmental sample
  misc_feature (1)..(825): n is a, c, g, or t
ttgntgaacatcagtgatcaaaaacgaatagttatgttacgaaaagacaattcaaagcgagtattgaagctaaagtatttattgctaattcctgtattgctaggtatgctggtatatacttcttgtgataaatcagatacggaacagctaaataaaaatgaaaaaagattgataacattttatatgggtgttgaaggtaaaatagacaagcaagaaatcaaaacaaaaaaggaaggctattttgatttatatatgggagatgctcccaaaggaaaaacaataacttataatatgctctcaaatcaagagaaaattgaatatgataaaactgttagttcttttaataaagatggagaaaattttcacacatttgaaatttttgaaatgagagatggaaagagagctttattacagattgttgattggaaaggcatgaaaaaaagtggtgaatcaaaagactattcaaatgcagatgaggttccctttgctgtaatcgaccaaactcctgtcttccccggttgtgaagacgctgtagatcaaaaaaaatgtttacaggaaagtattagtaatcacatagcagaaaattttgataaatctattgcaaaacctttagcgttagaagctggtaaaaaaaaggtttacgtgcaattcacaattgataaaaatggaatgattaccgatgccaaagcacgaggaccacatgaagcattagagaaagaagcaatgaaagctatcaatgatctacccaaaatgcaacccggtgaacaaaatggtaaaaaagtaggtgtgaaatatacggtacccattagttttgaagtagaataa

SEQ ID NO: 21270 - protein, 274 aa, Unknown
  Obtained from environmental sample
  misc_feature (1)..(274): Xaa is any amino acid
MXNISDQKRIVMLRKDNSKRVLKLKYLLLIPVLLGMLVYTSCDKSDTEQLNKNEKRLITFYMGVEGKIDKQEIKTKKEGYFDLYMGDAPKGKTITYNMLSNQEKIEYDKTVSSFNKDGENFHTFEIFEMRDGKRALLQIVDWKGMKKSGESKDYSNADEVPFAVIDQTPVFPGCEDAVDQKKCLQESISNHIAENFDKSIAKPLALEAGKKKVYVQFTIDKNGMITDAKARGPHEALEKEAMKAINDLPKMQPGEQNGKKVGVKYTVPISFEVE

SEQ ID NO: 21271 - DNA, 816 bp, Unknown
  Obtained from environmental sample
  misc_feature (1)..(816): n is a, c, g, or t
ttgttggctgaaacttttggtgttcaaaacatttcattccgtaatccattttttaaacattcattgatcaaaaaacgaatagttatgttacaaaaaaacaaatcaaagcgagtattgaagctaaagtatttattgctaattcctgtattgctaggtatgctggtatatacttcttgtgataaatcagatacggaacagctaaataaaaatgaaaaaagattgataacattttatatgggtgttgaaggtaaaatagacaagcaagaaatcaaaacaaaaaaggaaggctattttgatttatatatgggagatgctcccaaaggaaaaacaataacttataatatgctctcaaatcaagagaaaattgaatatgataaaactgttagttcttttaataaagatggagaaaattttcacacatttgaaatttttgaaatgagagatggaaagagagctttattacagattgttgattggaaaggcatgaaaaaaagtggtgaatcaaaagactattcaaatgcagatgaggttccctttgctgtaatcgaccaaactcctgtcttccccggttgtgaagacgctgtagatcaaaaaaaatgtttacaggaaagtattagtaatcacatagcagaaaattttgataaatctattgcaaaacctttagcgttagaagctggtaaaaaaaaggtttacgtgcaattcacaattgataaaaatggaatgattaccgatgccaaagcacgaggaccacatgaagcattagagaaagaagcaatgaaagctatcaatgatctacccaaaatgcaacaccggtga

SEQ ID NO: 21272 - protein, 271 aa, Unknown
  Obtained from environmental sample
  misc_feature (1)..(271): Xaa is any amino acid
MLAETFGVQNISFRNPFFKHSLIKKRIVMLQKNKSKRVLKLKYLLLIPVLLGMLVYTSCDKSDTEQLNKNEKRLITFYMGVEGKIDKQEIKTKKEGYFDLYMGDAPKGKTITYNMLSNQEKIEYDKTVSSFNKDGENFHTFEIFEMRDGKRALLQIVDWKGMKKSGESKDYSNADEVPFAVIDQTPVFPGCEDAVDQKKCLQESISNHIAENFDKSIAKPLALEAGKKKVYVQFTIDKNGMITDAKARGPHEALEKEAMKAINDLPKMQHR

SEQ ID NO: 21273 - DNA, 306 bp, Unknown
  Obtained from environmental sample
  misc_feature (1)..(306): n is a, c, g, or t
atgaaactacaaactcaaattccactaaaaaaacaaccacataatcaaatagattataactcaaaattgtttttagtaggttcgtgtttttcagaaaatattggtaacaaattaaactattttaaatttagagtaactcaaaatccgtttggaattctttttaatccaaaagcaattgaaatttttattacgaatgctattaacaaaaaagtatattcagaaagtgatctagttttccaaaatgaacgttggcattgttttgatgcacattctagtttaagttcatccaacaaaaatgacttttag

SEQ ID NO: 21274 - protein, 101 aa, Unknown
  Obtained from environmental sample
  misc_feature (1)..(101): Xaa is any amino acid
MKLQTQIPLKKQPHNQIDYNSKLFLVGSCFSENIGNKLNYFKFRVTQNPFGILFNPKAIEIFITNAINKKVYSESDLVFQNERWHCFDAHSSLSSSNKNDF

SEQ ID NO: 21275 - DNA, 717 bp, Unknown
  Obtained from environmental sample
  misc_feature (1)..(717): n is a, c, g, or t
atgagttttataaaagaaattaacagacgacgaacttttggaattatttcacacccagatgctggtaaaacgaccttaacagaaaaactacttttatttggtggtgctatccaagaagctggtgctgtaaaaagtaataagataaaaaaaggagcaaccagtgattttatggaaatagagcgtcagcgtggaatctctgtagccacttctgtattagcttttgaatataatggtattaaaattaacattttagatacgcctggtcacaaagactttgcagaagacacttttagaactttaactgcagtagacagtgttattgttgttattgatgttgccaaaggtgttgaggagcaaactgaaaagttagtagaagtctgtagaatgcgtaacatacctatgattgtattcattaacaaaatggatagagaagggaaagatgcatttgatttgttagatgaaattgaacagaaattaggactcacggttgtgcctttaagttttcctataggcatgggctatgattttaaaggtatttataatatctgggaaacaaatatcaatttattttctggcgataatagaaaagatattgaagaaaccattgaaatctccgatttagcctcaccggagttagacaaattagttggagaaaaagccgnaaacacattacgcgaagaactcgaatcagtagatggtatatatccacacttttaa

SEQ ID NO: 21276 - protein, 238 aa, Unknown
  Obtained from environmental sample
  DOMAIN (8)...(232): Elongation factor Tu GTP binding domain
  misc_feature (1)..(238): Xaa is any amino acid
MSFIKEINRRRTFGIISHPDAGKTTLTEKLLLFGGAIQEAGAVKSNKIKKGATSDFMEIERQRGISVATSVLAFEYNGIKINILDTPGHKDFAEDTFRTLTAVDSVIVVIDVAKGVEEQTEKLVEVCRMRNIPMIVFINKMDREGKDAFDLLDEIEQKLGLTVVPLSFPIGMGYDFKGIYNIWETNINLFSGDNRKDIEETIEISDLASPELDKLVGEKAXNTLREELESVDGIYPHF

SEQ ID NO: 21277 - DNA, 765 bp, Unknown
  Obtained from environmental sample
  misc_feature (1)..(765): n is a, c, g, or t
atggatataaaattagcagtacttattgatggagacaatattccctcagcatatgtaaaggagatgatggaagaaattgctaaatatggtaatccaacaattaaacgtatttatggagattggaccaaaccaaatcttaataaatggaaaagtttgctattagaaaatgctataactccaatccaacaatatggctatactactggtaaaaatgctacagattctgccatgattattgatgcaatggatattttatattcagagaaagtagatggcttttgcttagtatctagtgatagcgattttacacgtcttgcaacgcgtttacgtgaagctggaatgaaagtctatggtattggagaaaagaaaacgccaaacccttttatagtcgcttgtgataagtttatttacatagaaatacttaaaaacctaaccgaagacagtacattagaaccttcaaccaaatcttctaagtccaaaaataattacgacaccatcacacaaaaagaaattaagcttattgctacaactattgacgatgttgcagatgacgatggttgggcatttttaggtgatgttggaagtttattacaaaaaaagcaacctaattttgattctagaaattatggttttcaaaaactaacacctttaattaatagtattccagcgtttgaaatagatagtcgtgaggacactagaggtcgcatgaagctaatttatgtcagaattaaagaggtaaaacctaaaggtcgaaagcgatnataa

SEQ ID NO: 21278 - protein, 254 aa, Unknown
  Obtained from environmental sample
  DOMAIN (2)...(143): Protein of unknown function DUF88
  misc_feature (1)..(254): Xaa is any amino acid
MDIKLAVLIDGDNIPSAYVKEMMEEIAKYGNPTIKRIYGDWTKPNLNKWKSLLLENAITPIQQYGYTTGKNATDSAMIIDAMDILYSEKVDGFCLVSSDSDFTRLATRLREAGMKVYGIGEKKTPNPFIVACDKFIYIEILKNLTEDSTLEPSTKSSKSKNNYDTITQKEIKLIATTIDDVADDDGWAFLGDVGSLLQKKQPNFDSRNYGFQKLTPLINSIPAFEIDSREDTRGRMKLIYVRIKEVKPKGRKRX

SEQ ID NO: 21279 - DNA, 432 bp, Unknown
  Obtained from environmental sample
  misc_feature (1)..(432): n is a, c, g, or t
atgcatataaaacacatcagtagcgttcaaaacccattaataaaacacgttattttattaacagagaaatctcgtgaacgcaaaaaatcgggtctttttattgttgaaggtcttcgagaaattgaacttgctgcaaaaggaccttatgacattgaaactattttattttatgctgatttgtttccggaagaccaccttgacagtttacatttaaacgcgtttcaatacatcgaactttctaaagacatctatcaaaaaatagcgtatcgagaaactactgaaggtattattgctattgccaaaagtaaagaaaacactattgaaaaattaaacttcaaaaacaacaatcctttaattcttgatgctgaagctcctgaaaaaacctggaaatatcggagctattttacgttacggcgatgcggacaacgttga

SEQ ID NO: 21280 - protein, 143 aa, Unknown
  Obtained from environmental sample
  misc_feature (1)..(143): Xaa is any amino acid
MHIKHISSVQNPLIKHVILLTEKSRERKKSGLFIVEGLREIELAAKGPYDIETILFYADLFPEDHLDSLHLNAFQYIELSKDIYQKIAYRETTEGIIAIAKSKENTIEKLNFKNNNPLILDAEAPEKTWKYRSYFTLRRCGQR

SEQ ID NO: 21281 - DNA, 576 bp, Unknown
  Obtained from environmental sample
  misc_feature (1)..(576): n is a, c, g, or t
ttgagtagccttttttatgtttgtatttaccttattagtattagaataaaatatttttatatttgcggtgttatgagaaaaaagaggctgcttttattacttactattttccctattgttttattttcacaatcaactcttaggggtatggcaatgatatacgaaaatggaaaagccggtggattaccaggggcaacagtatattggttaaacacagatatcggtacaacaaccgatgaaaaagggtggtttactataaaatacaaacccgaatacaaaaaaatcgtatttagttttgtggggtataaaacagatactgtagaattgagttctaataaagaattacatcattttctaaaaagagagggggaattagatgaagttgaaattatatcaaaaagtaacacaacatcaatatcctataatgcagctgctaatattattaatgtaagtagtgaagaattacttaaagctgcctgctgtaatttgtccgaaagttttgaaacaaacccttctattgatgttaatttttctgatgcagttacaggtaggaaacagattatatgcttggactaa

SEQ ID NO: 21282 - protein, 191 aa, Unknown
  Obtained from environmental sample
  misc_feature (1)..(191): Xaa is any amino acid
MSSLFYVCIYLISIRIKYFYICGVMRKKRLLLLLTIFPIVLFSQSTLRGMAMIYENGKAGGLPGATVYWLNTDIGTTTDEKGWFTIKYKPEYKKIVFSFVGYKTDTVELSSNKELHHFLKREGELDEVEIISKSNTTSISYNAAANIINVSSEELLKAACCNLSESFETNPSIDVNFSDAVTGRKQIICLD

SEQ ID NO: 21283 - DNA, 423 bp, Unknown
  Obtained from environmental sample
  misc_feature (1)..(423): n is a, c, g, or t
atggatgatataagtattttcacaaataaaggaacaatatccacagatcaagacctggttcaaaatttaggcgcatcctatgccctttggcaacagatacaagagtttgtgcttgatcaatatccgacaggaattaaagaatggaattatccgggaaaaaaatatggatatagttatagaattaaagataaaaaacgagctatactttattttttaccaagaaaaggttatttcaaagtagcctttgttttcgggcaaaaagctaccgacattataatggaaagtgatattgctcccaaaattaaaaatgaattggcacaagccagaaaatatgctgaagggcgtggcgtcaggatagatgtaacaaataacttaaatatacccgatatcaaaaagcttgttgaaattaaattggctaattaa

SEQ ID NO: 21284 - protein, 140 aa, Unknown
  Obtained from environmental sample
  misc_feature (1)..(140): Xaa is any amino acid
MDDISIFTNKGTISTDQDLVQNLGASYALWQQIQEFVLDQYPTGIKEWNYPGKKYGYSYRIKDKKRAILYFLPRKGYFKVAFVFGQKATDIIMESDIAPKIKNELAQARKYAEGRGVRIDVTNNLNIPDIKKLVEIKLAN

SEQ ID NO: 21285 - DNA, 717 bp, Unknown
  Obtained from environmental sample
  misc_feature (1)..(717): n is a, c, g, or t
atgttagataaaaaaggggaggtaataaaagattatgaatatgttgaggactttatccccggttctacctctggaaatggcgatgtgaaagctgaagttgtatatgttggttatggaatatctgctcctgagttaggttatgatgattatagtggtgttgacgtaaaaggtaaaattgttctagtggaacgggaagttcctgttaaagagaatgatgagagttttcttaaatggagaccctactcttttcatcaatataaattattaaatgcagtaaaacatggggccgtcggatttctttataattaccatattgctaatcctaatatggaatacaataaagggattgtattatcatatgttggagcagaagttgtgaaagaaatttttgaaggtacgctcaaagaacatgattcaatagtgaaaaaatttaaagaaaccttaaaaccccaatcatttaatacaggaaaagttttttatattaaaaataacacgaaatatcaccccgatgggataggctcaaatgtaattggctatatagaaggttccgancccaaacttaaagatgaatatctcattttaggagctcatttagatcatttaggtaagtgctacactattatgcctggtgcacatgataatgcttcagcagttagtgtatccttaggaattgcacatgctatgtcaaaacttgattacaaactaaagcggctgtaa

SEQ ID NO: 21286 - protein, 238 aa, Unknown
  Obtained from environmental sample
  DOMAIN (24)...(133): PA domain
  misc_feature (1)..(238): Xaa is any amino acid
MLDKKGEVIKDYEYVEDFIPGSTSGNGDVKAEVVYVGYGISAPELGYDDYSGVDVKGKIVLVEREVPVKENDESFLKWRPYSFHQYKLLNAVKHGAVGFLYNYHIANPNMEYNKGIVLSYVGAEVVKEIFEGTLKEHDSIVKKFKETLKPQSFNTGKVFYIKNNTKYHPDGIGSNVIGYIEGSXPKLKDEYLILGAHLDHLGKCYTIMPGAHDNASAVSVSLGIAHAMSKLDYKLKRL

SEQ ID NO: 21287 - DNA, 891 bp, Unknown
  Obtained from environmental sample
  misc_feature (1)..(891): n is a, c, g, or t
atgttagataaaaaaggggaggtaataaaagattatgaatatgttgaggactttatccccggttctacctctggaaatggcgatgtgaaagctgaagttgtatatgttggttatggaatatctgctcctgagttaggttatgatgattatagtggtgttgacgtaaaaggtaaaattgttctagtggaacgggaagttcctgttaaagagaatgatgagagttttcttaaatggagaccctactcttttcatcaatataaattattaaatgcagtaaaacatggggccgtcggatttctttataattaccatattgctaatcctaatatggaatacaataaagggattgtattatcatatgttggagcagaagttgtgaaagaaatttttgaaggtacgctcaaagaacatgattcaatagtgaaaaaatttaaagaaaccttaaaaccccaatcatttaatacaggaaaagttttttatattaaaaataacacgaaatatcaccccgatgggataggctcaaatgtaattggctatatagaaggttccgaccccaaacttaaagatgaatatctcattttaggagctcatttagatcatttaggtaagtgctacactattatgcctggtgcacatgataatgcttcagcagttagtgtatccttaggaattgcacatgctatgtcgaaacttgattacaaacctaagcggtctgtaattttcataatgattggagcagaagaggctgncctaaaaggagtgcagtattttcttaaaaatccgacgatacctcttgacaatattgtgggatatatcaatatggatggcgtaggaattggaaattcaattaaggttggcttcggcagaaaattatccaattttttattccag

SEQ ID NO: 21288 - protein, 297 aa, Unknown
  Obtained from environmental sample
  DOMAIN (191)...(260): Peptidase family M20/M25/M40
  misc_feature (1)..(297): Xaa is any amino acid
MLDKKGEVIKDYEYVEDFIPGSTSGNGDVKAEVVYVGYGISAPELGYDDYSGVDVKGKIVLVEREVPVKENDESFLKWRPYSFHQYKLLNAVKHGAVGFLYNYHIANPNMEYNKGIVLSYVGAEVVKEIFEGTLKEHDSIVKKFKETLKPQSFNTGKVFYIKNNTKYHPDGIGSNVIGYIEGSDPKLKDEYLILGAHLDHLGKCYTIMPGAHDNASAVSVSLGIAHAMSKLDYKPKRSVIFIMIGAEEAXLKGVQYFLKNPTIPLDNIVGYINMDGVGIGNSIKVGFGRKLSNFLFQ

SEQ ID NO: 21289 - DNA, 825 bp, Unknown
  Obtained from environmental sample
  misc_feature (1)..(825): n is a, c, g, or t
gtgacttctacaagtcacatgcccatggttgagttattgaatgaagaaaactcgataattggttttccttattctaaatatgtatcatcagcaaaaacaagagctttaattgatgcaggaaaaatacaagagattggaaaagaaagttcgctaaacacagaaatcttattggatttacaaccagaattagtgnttggttatagtgtttcttctgctgataaatctctaacaaccattcaaaaatctggcataaaagtaatttataatggagattggctagaagaaactcctctaggaagagctgaatggattaagttttttggagttttgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgacacaggtggcgcaatttactatgaattagcaggaacaagaccagatttggttttaaaagatttgattaaattacaagtcctgaatattaccaaattttag

SEQ ID NO: 21290 - protein, 274 aa, Unknown
  Obtained from environmental sample
  DOMAIN (8)...(238): Periplasmic binding protein
  misc_feature (1)..(274): Xaa is any amino acid
MTSTSHMPMVELLNEENSIIGFPYSKYVSSAKTRALIDAGKIQEIGKESSLNTEILLDLQPELVXGYSVSSADKSLTTIQKSGIKVIYNGDWLEETPLGRAEWIKFFGVLFDKEKQADSIFKVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGDTGGAIYYELAGTRPDLVLKDLIKLQVLNITKF

SEQ ID NO: 21291 - DNA, 384 bp, Unknown
  Obtained from environmental sample
  misc_feature (1)..(384): n is a, c, g, or t
atgagaaactcaaaaattttattctttttatcgattttatcaattctaatttcttgtaaaaaagaagatgtaaaagttgatgaacaaaatcaatctgacagcactataaaatatgctaaaggttttgatattgttgatgaaaatggagttaaaaagttgattataaaatctgcatatcaaaattctgatgaattttttgagtatatcattaacaatcaaagtgatcaaaaagaagatattgaaaataccctctttactcctattcaaaaaattgttgtgacttctaacactcacattccaatggttgagttattgaatgaagaaaactcgatagttggttttccttattctaaatatgtatcatcagacaaaacaagnnnnggg

SEQ ID NO: 21292 - protein, 128 aa, Unknown
  Obtained from environmental sample
  misc_feature (1)..(128): Xaa is any amino acid
MRNSKILFFLSILSILISCKKEDVKVDEQNQSDSTIKYAKGFDIVDENGVKKLIIKSAYQNSDEFFEYIINNQSDQKEDIENTLFTPIQKIVVTSNTHIPMVELLNEENSIVGFPYSKYVSSDKTXXG

SEQ ID NO: 21293 - DNA, 399 bp, Unknown
  Obtained from environmental sample
  misc_feature (1)..(399): n is a, c, g, or t
ttgatctcagaaaatagaggccacctcatacttcagaatgctttcataccctcctctctagaagacaagtataagttaatattagcaagtcttgatgtcttatcaaatgcagaatatacctatgaggtttttactcaagacatagacgtgaatgacccaacagttgatcttgagtcaataccagaaatatcacatagaactaaaattatagagaacatgaaagatgcatggagtaaaatctcggcgagcaacaagaacgaagatttaagtgaagtcaggatatataagaaaaatcaagatcaattggattctatcatcaaagctaaaggaacgactgccaacaaggttataagtcaaatcattgaaaatgaatataaaaaagttttcaacaaagactag

SEQ ID NO: 21294 - protein, 132 aa, Unknown
  Obtained from environmental sample
  misc_feature (1)..(132): Xaa is any amino acid
MISENRGHLILQNAFIPSSLEDKYKLILASLDVLSNAEYTYEVFTQDIDVNDPTVDLESIPEISHRTKIIENMKDAWSKISASNKNEDLSEVRIYKKNQDQLDSIIKAKGTTANKVISQIIENEYKKVFNKD

SEQ ID NO: 21295 - DNA, 624 bp, Unknown
  Obtained from environmental sample
  misc_feature (1)..(624): n is a, c, g, or t
ttgaataatatgataaaagcagttttctttgacatgaacgaaaccttattaaatttaagccttttaaaggaacagtttgataagcactttgatgacaaatatgctttgaaatattggttcacaaaattattgtatagttctacaattatgggaattatggacgagtacaagaattttggagagttagcagatgtggctttagaaagtttattttttgaaagtaataaaccattaagcacaaaaactaaagatgagattcttggcgaattcaaaaagttacctgcttatgaggatgttcaaccagctatacaattattaaaggataaaaatattcgcgtaattgctgtatcaaactcatctttatcaatgattaaagaacagctaaccaatgcaggtattatagacctttttgattcttattattctgtagatgatgtaaaaaaatacaaaccctttaaagatatttatcaatcagttgccaaacaagaagatttaaaaactgaaaatattgtaatggtagcaactcatgattgggatttatttggagcaaaaaaggctggacttagaacagcttatataaaaagaaaggaaacaatttatcatccttatctcgagccgatctga

SEQ ID NO: 21296 - protein, 207 aa, Unknown
  Obtained from environmental sample
  DOMAIN (5)...(196): haloacid dehalogenase-like hydrolase
  misc_feature (1)..(207): Xaa is any amino acid
MNNMIKAVFFDMNETLLNLSLLKEQFDKHFDDKYALKYWFTKLLYSSTIMGIMDEYKNFGELADVALESLFFESNKPLSTKTKDEILGEFKKLPAYEDVQPAIQLLKDKNIRVIAVSNSSLSMIKEQLTNAGIIDLFDSYYSVDDVKKYKPFKDIYQSVAKQEDLKTENIVMVATHDWDLFGAKKAGLRTAYIKRKETIYHPYLEPI

SEQ ID NO: 21297 - DNA, 339 bp, Unknown
  Obtained from environmental sample
  misc_feature (1)..(339): n is a, c, g, or t
ttgaattcgccaagaatctcatctttagtttttgtgcttaatggtttattactttcaaaaaataaactttctaaagccacatctgctaactctccaaaattcttgtactcgtccataattcccataattgtagaactatacaataattttgtgaaccaatatttcaaagcatatttgtcatcaaagtgcttatcaaactgttcctttaaaaggcttaaatttaataaggtttcgttcatgtcaaagaaaactgcttttatcatattattcaatttttatatagcgttgctacttattatttctattttaagaataaaaataataactaaaaaggagtaa

SEQ ID NO: 21298 - protein, 112 aa, Unknown
  Obtained from environmental sample
  misc_feature (1)..(112): Xaa is any amino acid
MNSPRISSLVFVLNGLLLSKNKLSKATSANSPKFLYSSIIPIIVELYNNFVNQYFKAYLSSKCLSNCSFKRLKFNKVSFMSKKTAFIILFNFYIALLLIISILRIKIITKKE

SEQ ID NO: 21299 - DNA, 750 bp, Unknown
  Obtained from environmental sample
  misc_feature (1)..(750): n is a, c, g, or t
ttggaaatcgaaaagacaacaacgattgacgaagctttaatcgtctatgaaaaccanaaaagactatattccaattctccgtacttttttttggatgtggcaaaatcgattaagaataagtacaagaatcaggaaaaagcggatttcatattaaatgaaatgaaagttttatatgccaagaatgcggaagctttaaaggcattggcatatgtacttgaatctgaaaaaagacattcagatgctttgattatttataaggacattttcaggcttagaactagatatgcccaatcatatagggatcttgctaatatgtatgtgcttaataaggagtataaaaaagcattagggctgcacgctagatatcaccaattaagaaaattggattccataacattgacgtttgatgggatagatgcaatcttggagttggaatccacgaatttgattgcgagaaaaggggaagaactaaagattgaaaaaggggatgtcagtgattcagatattggtggcacccgagttcttatagaatggaacaataccgaggcggaatttgatctacaattcgtaaatcccgataaacattatttcgtttggagccatactttggagaatgaatctgagcgaatctatgatgaaaaaataaaagggtattcctgtgaacatttcttgattgataaagtcttcttggtgaatggaaaattaacatcaaatattttggtaataaagcgtacaatccaacctatatga

SEQ ID NO: 21300 - protein, 249 aa, Unknown
  Obtained from environmental sample
  misc_feature (1)..(249): Xaa is any amino acid
MEIEKTTTIDEALIVYENXKRLYSNSPYFFLDVAKSIKNKYKNQEKADFILNEMKVLYAKNAEALKALAYVLESEKRHSDALIIYKDIFRLRTRYAQSYRDLANMYVLNKEYKKALGLHARYHQLRKLDSITLTFDGIDAILELESTNLIARKGEELKIEKGDVSDSDIGGTRVLIEWNNTEAEFDLQFVNPDKHYFVWSHTLENESERIYDEKIKGYSCEHFLIDKVFLVNGKLTSNILVIKRTIQPI

SEQ ID NO: 21301 - DNA, 312 bp, Unknown
  Obtained from environmental sample
  misc_feature (1)..(312): n is a, c, g, or t
atgccagaacaccaatttaaaaacgaggacgaccatgctgttttggcactaaaaaatgccaatacacaagcaaaaatattagccaatcatttagggtataaaattgaaactattctaaatattgatgacgaaaccacctatgcaaacccaatatatgacaccattgattttgatagtagtaaaggacaaaggatgttaaggtttcttgagttattaagtaacagagacgtaacctatgacactaaaagtaatagtccatcaaaatctggaggctataatatatgggtaacatacagactaacaaaaacataa

SEQ ID NO: 21302 - protein, 103 aa, Unknown
  Obtained from environmental sample
  misc_feature (1)..(103): Xaa is any amino acid
MPEHQFKNEDDHAVLALKNANTQAKILANHLGYKIETILNIDDETTYANPIYDTIDFDSSKGQRMLRFLELLSNRDVTYDTKSNSPSKSGGYNIWVTYRLTKT

SEQ ID NO: 21303 - DNA, 354 bp, Unknown
  Obtained from environmental sample
  misc_feature (1)..(354): n is a, c, g, or t
ttgagtcgtgaggcgggaccccagtttatttatgataaaagaactgaagataatgtaaaatcagccgcctttataaaacaactcgctgaagatattatagaacaacataatgtccctgcggagggtcttttaattgaaggatcaatgattaaatctataaaaaagatagtcaaagagcacaatattgaccttatagtagcaggtcatagaaagcgaaatttggtcttggaactgtttactgaagacaagaaaaaagatttgattgatggaattgcaaattcctttactagcgattccgctagcatgatttatggaataattccattacgnngagttttcaagcaccacgtgtag

SEQ ID NO: 21304 - protein, 117 aa, Unknown
  Obtained from environmental sample
  misc_feature (1)..(117): Xaa is any amino acid
MSREAGPQFIYDKRTEDNVKSAAFIKQLAEDIIEQHNVPAEGLLIEGSMIKSIKKIVKEHNIDLIVAGHRKRNLVLELFTEDKKKDLIDGIANSFTSDSASMIYGIIPLRXVFKHHV

SEQ ID NO: 21305 - DNA, 399 bp, Unknown
  Obtained from environmental sample
  misc_feature (1)..(399): n is a, c, g, or t
ttgaaaaaagttgcaatttacggtcagtcttattcaatttctgcagagaaagaaatgcagattttactagaagttttgaatgaaaataatattgtaagttttattgaacataaattttacgatttattagtagaaggcaatattttagataaaaaatacccaacattttctcatttttcagatttaaatgattcttttgatgccatgtttacccttggtggagatggaacaattttaagagctgtaacctatattagagatttaaaaatccctattttaggaattaatactgggagattaggttttttggcgactatcaacaaaaaaaatattacagaaagcatcaanctaattttaaatggagagtttccattcaagaaagaacgttactttccgtaa

SEQ ID NO: 21306 - protein, 132 aa, Unknown
  Obtained from environmental sample
  misc_feature (1)..(132): Xaa is any amino acid
MKKVAIYGQSYSISAEKEMQILLEVLNENNIVSFIEHKFYDLLVEGNILDKKYPTFSHFSDLNDSFDAMFTLGGDGTILRAVTYIRDLKIPILGINTGRLGFLATINKKNITESIXLILNGEFPFKKERYFP

SEQ ID NO: 21307 - DNA, 624 bp, Unknown
  Obtained from environmental sample
  misc_feature (1)..(624): n is a, c, g, or t
atgcgcaaaattatactatcaatcttaggtgttttatttattattgctgccatttttatttctaaatctttagtagataataaaaataaaccaaagcccatagcagctaaagttattaaaactgtatttacagatacggtcaacaatacgactatacctattgtaattgctgcaaatggaaacttaacagctaagcaacgtgtagagctttactcggaagtacaaggtatatttcgtaatggtagttacctttttaaaccaggtcaaaactatcgcaaagggcaaaccttaattcgggtggatgctgcagagtattatgctagtgtacaatcttcaaaaagtaatttatacaactcgatagctgcaataatgccagatttacgtttggattttccagatgtgttccaaaaatggcaaagctatttgactagttttgacttaaacaaaaccacaccaaaattaccagaaatatcatctgataaagaaaactactttattactggtcgtggtattatcacaaattactacaatgtaaaaaatttagagcaacgtttgtctaagtatactataactgcgccttttaatgggattttaacagaggctttggcaacagaaggatcttga

SEQ ID NO: 21308 - protein, 207 aa, Unknown
  Obtained from environmental sample
  SIGNAL (1)...(16)
  misc_feature (1)..(207): Xaa is any amino acid
MRKIILSILGVLFIIAAIFISKSLVDNKNKPKPIAAKVIKTVFTDTVNNTTIPIVIAANGNLTAKQRVELYSEVQGIFRNGSYLFKPGQNYRKGQTLIRVDAAEYYASVQSSKSNLYNSIAAIMPDLRLDFPDVFQKWQSYLTSFDLNKTTPKLPEISSDKENYFITGRGIITNYYNVKNLEQRLSKYTITAPFNGILTEALATEGS

SEQ ID NO: 21309 - DNA, 696 bp, Unknown
  Obtained from environmental sample
  misc_feature (1)..(696): n is a, c, g, or t
ttgaagaagacgatgataaaaacgacttgtatccaggaatacgttttaaatacgattacgagctgtttagaaaatggttacacgttaaaagacatttgtattatagttagaaaaaaagatgaaggggttgctattgctcaatatttaagcgctcaaggcataaaaatcacatcttcgcaaacgatgttgattaacaattcgccagaagttaaagtggttaatagtatattaacgttacttaccaacccaaataacgacgaagcacgcgttactattctcgattttattacacataaatatgagattaacgacaagcacaaatactatagacaccacgttaaactgcctataaacgaatttttcaaaagttttgagtatttcaatatcattgtagatcctaaacaaatcagccaacttgggctttttgatgtggctgaatctattgtgcggacttttaaattagccgaaaaatctaatgcctatattcagttttatttggataccgttttagaatacacacaaaaaaacatctcggacatttcgggatttttggagtatttcgaaagtaaaaaagacaaactaagtattgtttctccagataaccaggacgcggtgcagattatgactattcacgtgtntaaaggattagatttccgtgttatttttccgtatctcgagccgattcttgtccactag

SEQ ID NO: 21310 - protein, 231 aa, Unknown
  Obtained from environmental sample
  misc_feature (1)..(231): Xaa is any amino acid
MKKTMIKTTCIQEYVLNTITSCLENGYTLKDICIIVRKKDEGVAIAQYLSAQGIKITSSQTMLINNSPEVKVVNSILTLLTNPNNDEARVTILDFITHKYEINDKHKYYRHHVKLPINEFFKSFEYFNIIVDPKQISQLGLFDVAESIVRTFKLAEKSNAYIQFYLDTVLEYTQKNISDISGFLEYFESKKDKLSIVSPDNQDAVQIMTIHVXKGLDFRVIFPYLEPILVH

SEQ ID NO: 21311 - DNA, 402 bp, Unknown
  Obtained from environmental sample
  misc_feature (1)..(402): n is a, c, g, or t
ttgatgtcacagcgtctccccaataatatcaatgctctgaattgtataaaggtatatttcaagtttcagaatttactgaaaggaaggagtgatttttataagaagaaatatggacttgttcctttttttaaagctgggttgaacgagggtgacgtaaccatagttgaggtcggacaaataaaacgagagatagcattccatggtgatacgctcaacactacatcaaggatcgagggaatgtgcaattcatatgagaaaggccttcttttatctcaggcactaaaagagttgatagaggaaagaaccaaacttcaaattaacctggtaggagaagctcagcttagaggtaaaagcgaacctttaaaaatttatagtattgatgaaattgatttgaatgtttaa

SEQ ID NO: 21312 - protein, 133 aa, Unknown
  Obtained from environmental sample
  misc_feature (1)..(133): Xaa is any amino acid
MMSQRLPNNINALNCIKVYFKFQNLLKGRSDFYKKKYGLVPFFKAGLNEGDVTIVEVGQIKREIAFHGDTLNTTSRIEGMCNSYEKGLLLSQALKELIEERTKLQINLVGEAQLRGKSEPLKIYSIDEIDLNV

SEQ ID NO: 21313 - DNA, 852 bp, Unknown
  Obtained from environmental sample
  misc_feature (1)..(852): n is a, c, g, or t
ttggtagaaagtcagtttccaagcaattattatgtttgggaaaaactggcaaatacatttgatgcaaagctaaaaattatagccatgccaaaatccacagaaaatcgtggtaaaatttggaatgaatcaattttgaatggaatttctgagaataccaaagttgttgctcttggaaatattcattgggcaaatggaactttgttcgatttaaaatctatcagaaaaaaaacgaccaaaaataatgctttattaattattgatggaaatcaatctgttggagctttgcctttttctgtaaaagaaatacaaccagatgctttaatttgtgctggttacaaatggctttttggtccttatggttgtggttacgcttattttggtgagtattttgataatggaaatccgctagaagaaaattggtctaatcgtttatatagtgaaaacatggctggtttaacttcatatcaaccagaatacaaacctttggcaaacagatatgctgctggtgaacatgcaagttttattcatataaaaatgcaaattgcagcattagaacaagttttgatatggactccaaaagccattcaagattattgtaaggaaattacttcagaggctgttatcactttaaaagaaaatggttgtcttgttgaaaatgatacttttagaacacatcatttatttggagtagaattaccaaaacaaatagatattgatgttttaaaatcaaccttaaaagaagcaaatatatttatttcatttcgaggaaattacattcgcctttcttgccatttgtacaatactaaaaatgattttaagaagttaacggattgtttcataaaatgcttataa

SEQ ID NO: 21314 - protein, 283 aa, Unknown
  Obtained from environmental sample
  misc_feature (1)..(283): Xaa is any amino acid
MVESQFPSNYYVWEKLANTFDAKLKIIAMPKSTENRGKIWNESILNGISENTKVVALGNIHWANGTLFDLKSIRKKTTKNNALLIIDGNQSVGALPFSVKEIQPDALICAGYKWLFGPYGCGYAYFGEYFDNGNPLEENWSNRLYSENMAGLTSYQPEYKPLANRYAAGEHASFIHIKMQIAALEQVLIWTPKAIQDYCKEITSEAVITLKENGCLVENDTFRTHHLFGVELPKQIDIDVLKSTLKEANIFISFRGNYIRLSCHLYNTKNDFKKLTDCFIKCL

SEQ ID NO: 21315 - DNA, 414 bp, Unknown
  Obtained from environmental sample
  misc_feature (1)..(414): n is a, c, g, or t
ttgggcttaggacaaactattaaaagttttctacttggttttgttgatctcgaaagggacgttggcaaagataacgtattcaaccagaaaattagattagagatctattttgaagatgctgaaggaacaccttataaaaactctttagatatagatttttccgatattaaaggtatatctacacttggtggagctacagatccaatgtattcagtgtttaaagaaattgaaaagttaagaaaggtatttgaaccagttttcaaatcaggaaataaacgacttgaaatcgattcttataacaccggtgacagagtcattgaacgcgaacagcaactagaaagaaacaaagagttattggctcaaatagaaaaacgtaatagtgtagtggtcaataaaatttggccacagttttag

SEQ ID NO: 21316 - protein, 137 aa, Unknown
  Obtained from environmental sample
  misc_feature (1)..(137): Xaa is any amino acid
MGLGQTIKSFLLGFVDLERDVGKDNVFNQKIRLEIYFEDAEGTPYKNSLDIDFSDIKGISTLGGATDPMYSVFKEIEKLRKVFEPVFKSGNKRLEIDSYNTGDRVIEREQQLERNKELLAQIEKRNSVVVNKIWPQF

SEQ ID NO: 21317 - DNA, 897 bp, Unknown
  Obtained from environmental sample
  misc_feature (1)..(897): n is a, c, g, or t
atgacccctcccgaccctaaagagctggaagcaagcatcacaagcatcgtggagcagaaacaaaaggctataaaggatcaggattttgaaaaagctgctcaattgcgagacaaggaaaaacagctgctaaaggaaaagaaggaaatagaagagcaaaaaagccgttcaaaaaagacaaataaagagatcgttgacgaaaatgaaatagccgaggtcctttcaaactggaccggtgttcctgtctataagcttacttcagcagaatcatcaaagcttatgaatatggaaaatgaccttcacaagagggttgtaggtcaggaccaggcaataaagacagtatccaaagctatcaggagatcgcgttcaggactgaaggaccctaaaaggccgattggttcatttatgttcctggggccctcaggtgttggaaagacagagcttgcaaagaccattgcagaatttctttttgagaaggaagaaacactcatacaggtggatatgtctgaatatatggaaaagcattctgtttccaagcttgtaggttcacctcccggatatgtgggttatgatgagggcggtcagctgactgagatggtaagaagaaaaccttatagcgtgatactgcttgatgagatcgaaaaagctcatcctgatgtttttaatattcttcttcaaatatttgaagacggacaccttactgattcacagggcaaaagagtcgattttaaaaatactgtgataatcatgacttcaaatctcggagcaagggagatacagaagaacacacctatgggatttaagaagatagatactgaagatctttcttatgaggagataaagggaaaggtcatgagtgagttaaaagagggtattcaggccggaattttaaaccgatag

SEQ ID NO: 21318 - protein, 298 aa, Unknown
  Obtained from environmental sample
  DOMAIN (133)...(295): ATPase family associated with various cellular activities (AAA)
  misc_feature (1)..(298): Xaa is any amino acid
MTPPDPKELEASITSIVEQKQKAIKDQDFEKAAQLRDKEKQLLKEKKEIEEQKSRSKKTNKEIVDENEIAEVLSNWTGVPVYKLTSAESSKLMNMENDLHKRVVGQDQAIKTVSKAIRRSRSGLKDPKRPIGSFMFLGPSGVGKTELAKTIAEFLFEKEETLIQVDMSEYMEKHSVSKLVGSPPGYVGYDEGGQLTEMVRRKPYSVILLDEIEKAHPDVFNILLQIFEDGHLTDSQGKRVDFKNTVIIMTSNLGAREIQKNTPMGFKKIDTEDLSYEEIKGKVMSELKEGIQAGILNR

SEQ ID NO: 21319 - DNA, 396 bp, Unknown
  Obtained from environmental sample
  misc_feature (1)..(396): n is a, c, g, or t
ttgaataatagacaagaatatcaaattcaattttattcttattttgaaagcaatactgatagaaaaatcgaccttaaaaaaaatattttagaaaatgaactttggaatcaacttagaatttctccagaaaatttgcctattggtgaattaaaaataattccatcttttgagtttttagggttacatcacaaagaatttaaagcatttgatgcaattgcttctctaaaagagaaaggaaacattttaatatacactataaattatccgaagttagaaagaatactttctatacaagcaantaaagattttccacatacaattgaatcttggaaagaactttttctagtcgtggaaaacataacaacaaaagctctcgagccgattcttgtccactag

SEQ ID NO: 21320 - protein, 131 aa, Unknown
  Obtained from environmental sample
  misc_feature (1)..(131): Xaa is any amino acid
MNNRQEYQIQFYSYFESNTDRKIDLKKNILENELWNQLRISPENLPIGELKIIPSFEFLGLHHKEFKAFDAIASLKEKGNILIYTINYPKLERILSIQAXKDFPHTIESWKELFLVVENITTKALEPILVH

SEQ ID NO: 21321 - DNA, 819 bp, Unknown
  Obtained from environmental sample
  misc_feature (1)..(819): n is a, c, g, or t
atgaaacgaatgttacgaatatacataccaattatgtttagctttttattatttttttgttcaaatcctgaacttaaaaaaaacgttaaaattgataacaataacgtaaagagttttgaaaaaaatccagcatttaatcaatattggtattcaggaaaagcagaaataacttcttacaaattatctcaagtaaggtatggagaaattcatgaaggaacagctgtaaacatttttgtgacagaagattttttaccagaaaaacaagtaaaagcagatcatcagaataaaaataatgtacccattttaaaactaaacagtactaaaaattttacaacaggaatatatccttattctttaatgacgagcaccttctctcctatcaacattaataataatgcaattaaaatttctttctcttctcaagaatggtgtggaaatacttttgttcagttgaataatagacaagaatatcaaattcaattttattcttattttgaaagcaatactgatagaaaaatcgaccttaaaaaaaatattttagaaaatgaactttggaatcaacttagaatttctccagaaaatttgcctattggtgaattaaaaataattccatcttttgagtttttagggttacatcacaaagaatttaaagcatttgatgcaattgcttctctaaaagagaaaggaaacattttaatatacactataaattatccgaagttagaaagaatactttctatacaagcaactaaagattttccacatacaattgatcttggaagaacttttctagtcgtggaaacatacaacaaactctag

SEQ ID NO: 21322 - protein, 272 aa, Unknown
  Obtained from environmental sample
  misc_feature (1)..(272): Xaa is any amino acid
MKRMLRIYIPIMFSFLLFFCSNPELKKNVKIDNNNVKSFEKNPAFNQYWYSGKAEITSYKLSQVRYGEIHEGTAVNIFVTEDFLPEKQVKADHQNKNNVPILKLNSTKNFTTGIYPYSLMTSTFSPININNNAIKISFSSQEWCGNTFVQLNNRQEYQIQFYSYFESNTDRKIDLKKNILENELWNQLRISPENLPIGELKIIPSFEFLGLHHKEFKAFDAIASLKEKGNILIYTINYPKLERILSIQATKDFPHTIDLGRTFLVVETYNKL

SEQ ID NO: 21323 - DNA, 519 bp, Unknown
  Obtained from environmental sample
  misc_feature (1)..(519): n is a, c, g, or t
atgacgtttaatattatgagttacttggtgttttcgttaacgtctaaaggaaattatagagaacgtaattatgctgagatgtttgtggatagtaataattttactacacttcaggatagtgctttggtctggaaaggtgaagcacatgtcgcagatattaaaaatgtattaattcgttttttaggtgaaaaaagagccactcgagcattaaatattttcttcacaaaatataagttgcctcaagacacccaattggcagatgcaagattaattaatttttcagaaaaactgttaacaggaagtattggttcggcttcagctaaaatattaattgccagcgttgtaaaagaagaacaaattagcttagtagaagtattgaagattttggaagagtctaaagaaaacattgttagcaacaaggtacttctagaaaaatctaacgaattgtctcaactgtcttcaaaattaaaagatgcaaatccagaattaataagcaaagacaaacacagaccgttttaa

SEQ ID NO: 21324 - protein, 172 aa, Unknown
  Obtained from environmental sample
  misc_feature (1)..(172): Xaa is any amino acid
MTFNIMSYLVFSLTSKGNYRERNYAEMFVDSNNFTTLQDSALVWKGEAHVADIKNVLIRFLGEKRATRALNIFFTKYKLPQDTQLADARLINFSEKLLTGSIGSASAKILIASVVKEEQISLVEVLKILEESKENIVSNKVLLEKSNELSQLSSKLKDANPELISKDKHRPF

SEQ ID NO: 21325 - DNA, 411 bp, Unknown
  Obtained from environmental sample
  misc_feature (1)..(411): n is a, c, g, or t
atgaaaaaaagtaactctataatttatttattaagcttaactttattattttttagctcggtaagctttgcccagcaaacatgtaaattacctgctcaagcaacaccagaggttactaagcgttacattcagtgcctagatgatcagttaaatacagctaaacaactgcaaaacacttggatccaaaagcgcaaatttgagttaaataaattagaatttgaaactggcaatacgcaaattttacagctgtttataaaaagcattgccagtaacgaaaattatattaagcatagttgccaatggcgctactcattaaagttgcctaatgctttaactgctgcaataacctataaaacctgcgagttatcactagtagagcaatttactttagacttaaagcggcctctttaa

SEQ ID NO: 21326 - protein, 136 aa, Unknown
  Obtained from environmental sample
  misc_feature (1)..(136): Xaa is any amino acid
MKKSNSIIYLLSLTLLFFSSVSFAQQTCKLPAQATPEVTKRYIQCLDDQLNTAKQLQNTWIQKRKFELNKLEFETGNTQILQLFIKSIASNENYIKHSCQWRYSLKLPNALTAAITYKTCELSLVEQFTLDLKRPL

SEQ ID NO: 21327 - DNA, 411 bp, Unknown; identical to SEQ ID NO: 21325
  Obtained from environmental sample
  misc_feature (1)..(411): n is a, c, g, or t

SEQ ID NO: 21328 - protein, 136 aa, Unknown; identical to SEQ ID NO: 21326
  Obtained from environmental sample
  misc_feature (1)..(136): Xaa is any amino acid

SEQ ID NO: 21329 - DNA, 645 bp, Unknown
  Obtained from environmental sample
  misc_feature (1)..(645): n is a, c, g, or t
ttgggattgttttcattatttgaaaatgatacaacgattatagaaacaggctttggagaccataaaactattgtacttttagatggttctgaagttatccttaactctaaatctaaaattacttacgacaaaaacgactgggaaaataatagagttttaaccttagaaggggaggcttattttaaagtcgaaaaaggaaatacatttacggttaaaacagcaaatggttcagtatctgttttaggtacacagtttaatgtgaattctacaagtgatttttttgatgtggtttgttatgaaggaaaagtaagtgtaaagactaatgcttcagagcatattttattgccaactaatagtgttaggaaaattaatggaaactcgttagaatcctcagtgacacaacttataaaaccaacatggatcgctggagaaagcacctttaaaagtgtgccaattaagtatgttatttcagatttagaagaccagtataatgttagagttaatgctgaagctattgatgatacaacaatatttacaggtagttttcctcataataaccttaatgtcgctttaaaaattgtttttgaacccctcaatataaagtattctgaaaaagaagaacgtaacattaaactcagatattaa

SEQ ID NO: 21330 - protein, 214 aa, Unknown
  Obtained from environmental sample
  DOMAIN (12)...(104): FecR protein
  misc_feature (1)..(214): Xaa is any amino acid
MGLFSLFENDTTIIETGFGDHKTIVLLDGSEVILNSKSKITYDKNDWENNRVLTLEGEAYFKVEKGNTFTVKTANGSVSVLGTQFNVNSTSDFFDVVCYEGKVSVKTNASEHILLPTNSVRKINGNSLESSVTQLIKPTWIAGESTFKSVPIKYVISDLEDQYNVRVNAEAIDDTTIFTGSFPHNNLNVALKIVFEPLNIKYSEKEERNIKLRY

SEQ ID NO: 21331 - DNA, 375 bp, Unknown
  Obtained from environmental sample
  misc_feature (1)..(375): n is a, c, g, or t
atgacaaatcaagaaaaatggcaagaaaacataagtccgatatacaaaccatcttatacttataaagcgggaattgcccatggagttttaagctacttcgaaccaggaatacgcactttaacaaaaggatttcagttagattctcaatttttaccattacaggtagatataatatttgaaaaggatgttgaagttatcttgcgtgatggcacaaaaatttacaccgatatatttcgtccggcaaatagtgaaaaagttccggcaattgtagtgtggagcccttatggaaaaagtggcggttccgcaccaaaaacaacaggggtattcaatgtgtggcgtattgataacagcaagtttcaggttagccaattttga

SEQ ID NO: 21332 - protein, 124 aa, Unknown
  Obtained from environmental sample
  misc_feature (1)..(124): Xaa is any amino acid
MTNQEKWQENISPIYKPSYTYKAGIAHGVLSYFEPGIRTLTKGFQLDSQFLPLQVDIIFEKDVEVILRDGTKIYTDIFRPANSEKVPAIVVWSPYGKSGGSAPKTTGVFNVWRIDNSKFQVSQF

SEQ ID NO: 21333 - DNA, 630 bp, Unknown
  Obtained from environmental sample
  misc_feature (1)..(630): n is a, c, g, or t
atggcttttattgagcgttttaaagggacttactctaaaaccaaccaagtcacatcacgagagcgtatgcttgaaaagctacaaattatagagattgatgaagttgataactcagctttaaaacttagttttccgccagcaccaagatcaggagattatccagtatctgtacaaaatttgacaaaaaaatatgacgatgtcgttgtgtttagtgacgctaatatgtctattaaaagaggcgaaaaagttagttttgttggacgtaatggagaaggtaaatctactatgattaaagctattttagggcaaattgattatgatggagcgtgtagtcttggacaaaacgtgcaagtcggttattttgcacaaaaccaggcagctttgttagataatgatttaacagtttttcaaactgtagatgaggtagctaaaggtgacgctaggactggaattaaaaatattttaggtcgttttatgtttaaaggcgatgatattgataaaaaagtaggtgtgctatctggaggagaaaaaacaagattagcaatggttaagttattattagagcctgttaatttactaatactagatgagcctacaaaccacttagatttaaatntaatacgtctttga

SEQ ID NO: 21334 - protein, 209 aa, Unknown
  Obtained from environmental sample
  DOMAIN (80)...(209): ABC transporter
  misc_feature (1)..(209): Xaa is any amino acid
MAFIERFKGTYSKTNQVTSRERMLEKLQIIEIDEVDNSALKLSFPPAPRSGDYPVSVQNLTKKYDDVVVFSDANMSIKRGEKVSFVGRNGEGKSTMIKAILGQIDYDGACSLGQNVQVGYFAQNQAALLDNDLTVFQTVDEVAKGDARTGIKNILGRFMFKGDDIDKKVGVLSGGEKTRLAMVKLLLEPVNLLILDEPTNHLDLNXIRL

SEQ ID NO: 21335 - DNA, 780 bp, Unknown
  Obtained from environmental sample
  misc_feature (1)..(780): n is a, c, g, or t
atgagtaaacaccccattggtatttttgattctggagtaggtggaacatccatctggaaagccattcatggattacttccaactgaaaatacaatttatcttgcagatagtaaaaatgcaccatatggtccaaaaggaaaagaggccattatagcgctttctgagaaaaatacagagtatctacttaatcaaaacagtaagctaattgtagtggcttgtaatacagctacgaccaatgccattaaacaccttagacaaaaatataagacgcctattattggtatagaacctgctataaaaccagcagctttaaatacaaaaactaaatccataggtattttggctactagaggtaccttaagtagtgagttgtttcacaacacctctttgttgtatagtgatggtattacaattattgagcaagaaggcgaaggtattgtacaattaatagaaagcggtaatatcgtatctagtcaaatgacagatttgcttaaaacgtatcttaaacctatgatacaagcaaatattgattatctagttttagggtgtacacattatccttatttagtccctcagcttttaaaacttctaccaagtcatgttaagattatagattctggtgctgcagttgctagacaaactaaaacggtgttggaacaacacggtttactaaatcaagtagttagtaaacctgctttaaaattttattctaacggtaatcctattataatgaaaggtttgttagatggtgattttgaagttgaatttttaagcttttga

SEQ ID NO: 21336 - protein, 259 aa, Unknown
  Obtained from environmental sample
  DOMAIN (5)...(219): Asp/Glu/Hydantoin racemase
  misc_feature (1)..(259): Xaa is any amino acid
MSKHPIGIFDSGVGGTSIWKAIHGLLPTENTIYLADSKNAPYGPKGKEAIIALSEKNTEYLLNQNSKLIVVACNTATTNAIKHLRQKYKTPIIGIEPAIKPAALNTKTKSIGILATRGTLSSELFHNTSLLYSDGITIIEQEGEGIVQLIESGNIVSSQMTDLLKTYLKPMIQANIDYLVLGCTHYPYLVPQLLKLLPSHVKIIDSGAAVARQTKTVLEQHGLLNQVVSKPALKFYSNGNPIIMKGLLDGDFEVEFLSF

SEQ ID NO: 21337 - DNA, 444 bp, Unknown
  Obtained from environmental sample
  misc_feature (1)..(444): n is a, c, g, or t
atgaaatcagaaaaagaaaaaatgctttctggaaaagcttacaaagcttttggagaagaattgttaaatgagagacaagaggcaaaaaacctggtgtttaaattcaataaattacatccgaagaaaataaaaaagcgaaataaaattataaaaaaactatttggtaaagtagcagaaaacttttttatagaaccaccttttagatgcgattatgggtataatataaaagttggtaataatttttacgctaattataatcttacaattttagattgtgccaaagtttctattggtaataattgttttattgcgccaaatgtgagtattttaactgcaggtcatcccattcatttcgaaattagaaatcaagaatatgaatatgcttttcctattactattgaagataatgtttggttaggggcaaatgtggtaatcaatccataa

SEQ ID NO: 21338 - protein, 147 aa, Unknown
  Obtained from environmental sample
  misc_feature (1)..(147): Xaa is any amino acid
MKSEKEKMLSGKAYKAFGEELLNERQEAKNLVFKFNKLHPKKIKKRNKIIKKLFGKVAENFFIEPPFRCDYGYNIKVGNNFYANYNLTILDCAKVSIGNNCFIAPNVSILTAGHPIHFEIRNQEYEYAFPITIEDNVWLGANVVINP

SEQ ID NO: 21339 - DNA, 498 bp, Unknown
  Obtained from environmental sample
  misc_feature (1)..(498): n is a, c, g, or t
atggaaattccaaacgaatttaaaatcacgtcacttgtaaatcaaaatacttatttggttggtggcgaattaaaagaatggaaaggtgaaacagctgaagtattttcaacaatttcatcaaccaaagaatacaaaccaactctattaggttctgtgccaaatttaactggagatgaagccatagaagctttaaatgcagcagtaaaagcctatgatagaggccaaggtttatggccaactatgaaagtagaaggtagaattgcagctatggaaaagtttgttgttcagatgaaaaccaaaagagaagaaattgtaaaattattaatgtgggaaataggtaaaaccctaggtgactcacaaaaagaattcgatagaactgtagaatatatttacgatactatagaagattaccagcaaatggatagaaattctgccaagtttgaaaaaaaccgnggagttcctgcccatattagaagaagaaccttaagcgtagtttaa

SEQ ID NO: 21340 - protein, 165 aa, Unknown
  Obtained from environmental sample
  misc_feature (1)..(165): Xaa is any amino acid
MEIPNEFKITSLVNQNTYLVGGELKEWKGETAEVFSTISSTKEYKPTLLGSVPNLTGDEAIEALNAAVKAYDRGQGLWPTMKVEGRIAAMEKFVVQMKTKREEIVKLLMWEIGKTLGDSQKEFDRTVEYIYDTIEDYQQMDRNSAKFEKNRGVPAHIRRRTLSVV

SEQ ID NO: 21341 - DNA, 558 bp, Unknown
  Obtained from environmental sample
  misc_feature (1)..(558): n is a, c, g, or t
atggaaattccaaacgaatttaaaatcacgtcacttgtaaatcaaaatacttatttggttggtggcgaattaaaagaatggaaaggtgaaacagctgaagtattttcaacaatttcatcaaccaaagaatacaaaccaactctattaggttctgtgccaaatttaactggagatgaagccatagaagctttaaatgcagcagtaaaagcctatgatagaggccaaggtttatggccaactatgaaagtagaaggtagaattgcagctatggaaaagtttgttgttcagatgaaaaccaaaagagaagaaattgtaaaattattaatgtgggaaataggtaaaaccctaggtgactcacaaaaagaattcgatagaactgtagaatatatttacgatactatagaagattacaagcaaatggatagagattctgccaagtttgaaaaaaacagcggagttcatgcacatattagaagaggacctttaggcgtagttttatgtttaggtccttacaattatcctttaaatgaaacttttgcattgttgattcctgcttnc

SEQ ID NO: 21342 - protein, 186 aa, Unknown
  Obtained from environmental sample
  misc_feature (1)..(186): Xaa is any amino acid
MEIPNEFKITSLVNQNTYLVGGELKEWKGETAEVFSTISSTKEYKPTLLGSVPNLTGDEAIEALNAAVKAYDRGQGLWPTMKVEGRIAAMEKFVVQMKTKREEIVKLLMWEIGKTLGDSQKEFDRTVEYIYDTIEDYKQMDRDSAKFEKNSGVHAHIRRGPLGVVLCLGPYNYPLNETFALLIPAX

SEQ ID NO: 21343 - DNA, 558 bp, Unknown
  Obtained from environmental sample
  misc_feature (1)..(558): n is a, c, g, or t
ttgtgtatttgccaaggtttaatattacatagtaattacaattattataaatatagtcaaaggaatgaatatatgaattatgcgtcacatgtcgacaggattaaatcttttattatcagtgcatcaaacgacgttgattttaaagatttgcttgccagtacatcaaccgatttaaaaaaatcggcttactacctttttaatcaaataattaaagttacaccaccttattcatatcaagatccacatcctatatctgagctatttaggcttacagagcaatcgcttagtttaaataatcaagcacaaaaagcgatattaacacgcttagaaaaatggtggcttgaatggcactttgtcgccattatgaatgctaaactagcaaatgagtacagtgatacacaaaaaaagtatataaccaatagtacccatcatccaatgcgaaaacttgagctgagccattatgcaaagttattcactattttacctatgcctatattgtatgtgtgttgtgacccaggtgatcttctaaagttatcagcgattaatgatgtttgnngg

SEQ ID NO: 21344 - protein, 186 aa, Unknown
  Obtained from environmental sample
  misc_feature (1)..(186): Xaa is any amino acid
MCICQGLILHSNYNYYKYSQRNEYMNYASHVDRIKSFIISASNDVDFKDLLASTSTDLKKSAYYLFNQIIKVTPPYSYQDPHPISELFRLTEQSLSLNNQAQKAILTRLEKWWLEWHFVAIMNAKLANEYSDTQKKYITNSTHHPMRKLELSHYAKLFTILPMPILYVCCDPGDLLKLSAINDVXX

SEQ ID NO: 21345 - DNA, 336 bp, Unknown
  Obtained from environmental sample
  misc_feature (1)..(336): n is a, c, g, or t
atggatatctggagcactaactatcatttagtggtaaagcaatgccaaattactgcgtttgatcatgacaatgttatttaccgctgtcaaaatagttacaaagagcaagtagctgctgtaacagatcatcaaaaagcagtggcttttactcgccaatgtttgcttgaaagcaattggcatgaaagccaaaaagagtcaaaaaactcgattcgtactactttcgtacttgatgaaaacacccctgttatttcaatctacaccggtaaaacgttatctagtttaaaatcgtggtctacctcattagaaattggcaaatcagtagctactaaacaataa

SEQ ID NO: 21346 - protein, 111 aa, Unknown
  Obtained from environmental sample
  misc_feature (1)..(111): Xaa is any amino acid
MDIWSTNYHLVVKQCQITAFDHDNVIYRCQNSYKEQVAAVTDHQKAVAFTRQCLLESNWHESQKESKNSIRTTFVLDENTPVISIYTGKTLSSLKSWSTSLEIGKSVATKQ

SEQ ID NO: 21347 - DNA, 705 bp, Unknown
  Obtained from environmental sample
  misc_feature (1)..(705): n is a, c, g, or t
ttggtccgggaaaaaccatttttttaccgggcgggttcataccttgaatctccaggagaaaattcttccggggccaacaaaaacaatagcggaagttatgagccaccatcccatgatttttcaattgaaaaagatggtgaggattttactcaagacatcctaacgcgaccaaacgtattattggtagttaattacaatttagcaaaatctgaaagtgatggtttagtggctgtaaaacaaattacagacaaagcaatcgcaaatggttatgatgttattggattaacagcatctggtccagatgaggcaaatggtgttatctcaaattacaaattaggttttgagtattatttttgtgacgagactgctttaaaaacaatcatccgttctaatccaggattattaaaattagaaaaagggaccattatccaaaaagtacattggaatgatattgatcaattagaactgcctaaagtagatagaccagcacctaaggttatagatgatggaacagcacatgtagttgatgataaagttttaaataaagaaacgtttgaagctttacagttaagtgaggatcaaattgaaaaggtatctgtttttaaaggagcttcagaggttaaaacggttattgactcaataaacacagctactggtaaaaattacacaagtattgtaaaaattgaaacaaaaaaaacaaaataa

SEQ ID NO: 21348 - protein, 234 aa, Unknown
  Obtained from environmental sample
  misc_feature (1)..(234): Xaa is any amino acid
MVREKPFFYRAGSYLESPGENSSGANKNNSGSYEPPSHDFSIEKDGEDFTQDILTRPNVLLVVNYNLAKSESDGLVAVKQITDKAIANGYDVIGLTASGPDEANGVISNYKLGFEYYFCDETALKTIIRSNPGLLKLEKGTIIQKVHWNDIDQLELPKVDRPAPKVIDDGTAHVVDDKVLNKETFEALQLSEDQIEKVSVFKGASEVKTVIDSINTATGKNYTSIVKIETKKTK

SEQ ID NO: 21349 - DNA, 678 bp, Unknown
  Obtained from environmental sample
  misc_feature (1)..(678): n is a, c, g, or t
atgaaaaagaaagcccatatcactagaaaagtaaaaatcccttggccaactaaggcggctatggaacaggtgtatgccatgaaactgtggggcagtcaccattctggtttttattcaggtgaagggtcgcatcacccagaactagtgaacccgtatattgatgttttaaaaaggtttttaattgcttttgaaactccgctggtggtatgcgatttaggctgtggcgattttaatgttagtaaggacttggttaagtttactgataaatatattgcggtagacatcgtagcagcccttattgaacataataaagaacagtttaaagaagataatttggactttctgtgtctggatatcgccgtagatgctttgcccgttgcggattgtgctatagtaagacaggtactgcaacatttatccaatgctgaaatacagcgtatcgtacccaaattagctaattttaaatatgttgttgttgcagaacatctgccggaaggggatttcatccccaataaggacattatttcaggacaaggcacgcgactcaaaaaaggaagtggtctgaacctggtggtctcaccatttaattttaaggttaagacagaaaacatattgagttctgtaaagttaaatcagggtagaggggtgattgtaaccacactgtatactgttttttag

SEQ ID NO: 21350 - protein, 225 aa, Unknown
  Obtained from environmental sample
  misc_feature (1)..(225): Xaa is any amino acid
MKKKAHITRKVKIPWPTKAAMEQVYAMKLWGSHHSGFYSGEGSHHPELVNPYIDVLKRFLIAFETPLVVCDLGCGDFNVSKDLVKFTDKYIAVDIVAALIEHNKEQFKEDNLDFLCLDIAVDALPVADCAIVRQVLQHLSNAEIQRIVPKLANFKYVVVAEHLPEGDFIPNKDIISGQGTRLKKGSGLNLVVSPFNFKVKTENILSSVKLNQGRGVIVTTLYTVF

SEQ ID NO: 21351 - DNA, 636 bp, Unknown
  Obtained from environmental sample
  misc_feature (1)..(636): n is a, c, g, or t
ttgagtttgatcggcgagacacttcgagcatattggtcatctttaaataatcaaccacctttcaaaatcctttantggtacaccattaaagacgaattaaaccgaccagaattggaattatttcaacttaaaagggaagaaatagaaagcaacgaagctttattagctaaacaaaattctccaaaactactcggttttgcaactggtggttatggtaatccaggactaaacatgttggataattcctttcaatcattttatactgtgggaattaaattgaattggaatgtattcgattggcattccaacaaaaagcaacgtcaatccttagccattaataaagatattgttgaaactgaaactgaagcttttaagttaaatactaacatagaactgaatcagcaacaaaaagaaattaataaaattgaaggctttattgaatcagatttagaaattattaaccttagaaaagacgtgcttgaatcggcagattcgcaacttaaaaatggtgtgataacttcttcagcatatataacagaattgacccatttatacgaggacgaaaacactttggttacccataaaattcaattacaactcgcaaaagcaaattacaacgtcattaaaggacaataa

SEQ ID NO: 21352 - protein, 211 aa, Unknown
  Obtained from environmental sample
  misc_feature (1)..(211): Xaa is any amino acid
MSLIGETLRAYWSSLNNQPPFKILXWYTIKDELNRPELELFQLKREEIESNEALLAKQNSPKLLGFATGGYGNPGLNMLDNSFQSFYTVGIKLNWNVFDWHSNKKQRQSLAINKDIVETETEAFKLNTNIELNQQQKEINKIEGFIESDLEIINLRKDVLESADSQLKNGVITSSAYITELTHLYEDENTLVTHKIQLQLAKANYNVIKGQ

SEQ ID NO: 21353 - DNA, 318 bp, Unknown
  Obtained from environmental sample
  misc_feature (1)..(318): n is a, c, g, or t
gtgcctaccaaagcgctattagatnttttaaaagactacacaaaaaaaaatagtgtagagttatttttagtgggagaacctaaacaaatgaataatgaggccagcgaaagtgaagtgttaatagcacctttcgttagccagttacgcaccttttttcctgaaatcccaataaaacgtatcgatgagcgttttacctcaaaaatggcagttcaaaccttagtcgatagcggaatgaagaaaaaaaagcgtcagaataaagcattgttagacgaaattagcgccaccattatcttgcaaagttatttatacaataagtaa

SEQ ID NO: 21354 - protein, 105 aa, Unknown
  Obtained from environmental sample
  DOMAIN (4)...(104): Uncharacterised protein family (UPF0081)
  misc_feature (1)..(105): Xaa is any amino acid
MPTKALLDXLKDYTKKNSVELFLVGEPKQMNNEASESEVLIAPFVSQLRTFFPEIPIKRIDERFTSKMAVQTLVDSGMKKKKRQNKALLDEISATIILQSYLYNK

SEQ ID NO: 21355 - DNA, 402 bp, Unknown
  Obtained from environmental sample
  misc_feature (1)..(402): n is a, c, g, or t
atgaggtttataacgagatatagaggttttttaaaagaggatggctttgatacggtaaatcgtgaacttttctatttaatgctagaaaaagaagtcctttatgaaatacatagtttaaaagaaattaacagaaatgttgatggacataaattcactctactgtatgagggcaaatattattatttaaatcaagatattctaactgacctattccaaataatgaaaaatggtcttaacatcccaactcacgatagaataataaatgacccaattaataacatcgaccacaacgtctctgcaaaaacaacaaatgacgcaccctcaaaaaccttaaagaaacagcgtgagaatctagttaaaactatcgactggctaaaaagtttaaacaatctatacccggna

SEQ ID NO: 21356 - protein, 134 aa, Unknown
  Obtained from environmental sample
  misc_feature (1)..(134): Xaa is any amino acid
MRFITRYRGFLKEDGFDTVNRELFYLMLEKEVLYEIHSLKEINRNVDGHKFTLLYEGKYYYLNQDILTDLFQIMKNGLNIPTHDRIINDPINNIDHNVSAKTTNDAPSKTLKKQRENLVKTIDWLKSLNNLYPX

SEQ ID NO: 21357 - DNA, 558 bp, Unknown
  Obtained from environmental sample
  misc_feature (1)..(558): n is a, c, g, or t
atgaggtttataacgagatatagaggttttttaaaagaggatggctttgatacggtaaatcgtgaacttttctatttaatgctagaaaaagaagtcctttatgaaatacatagtttaaaagaaattaacagaaatgttgatggacataaattcactctactgtatgagggcaaatattattatttaaatcaagatattctaactgacctattccaaataatgaaaaatggtcttaacatcccaactcacgatagaataataaatgacccaattaataaaattgaaaaaaaagtttttgcaaaaacaacaaatgaagaaaaattaaaaaccttaaagaaacagcgtgagaatctagttaaaactatcgactgcataaaaagctttaaacaatttatacaggatcatgataacccaacatttgatttgaatcgagactggacggatcacgatgtnnnnagaagggtaagcagtatcatggaacaacttgaaccggatgaaaaaactatcatcaattatcttaacaaacagtcaaatttcctttataaaaccagtcgatga

SEQ ID NO: 21358 - protein, 185 aa, Unknown
  Obtained from environmental sample
  misc_feature (1)..(185): Xaa is any amino acid
MRFITRYRGFLKEDGFDTVNRELFYLMLEKEVLYEIHSLKEINRNVDGHKFTLLYEGKYYYLNQDILTDLFQIMKNGLNIPTHDRIINDPINKIEKKVFAKTTNEEKLKTLKKQRENLVKTIDCIKSFKQFIQDHDNPTFDLNRDWTDHDVXRRVSSIMEQLEPDEKTIINYLNKQSNFLYKTSR

SEQ ID NO: 21359 - DNA, 582 bp, Unknown
  Obtained from environmental sample
  misc_feature (1)..(582): n is a, c, g, or t
atgattgaagatatccaggcagcaattccattaggcttttttttaagttttatgattggccctgtattttttgtactccttgaaaccagtgttataaaaggttttagagcagctatagcattcgattttggcgttattattgctgatattttatttattgcattagcctatttttctagttttcagttgcttgaaaatttaagtaacgaacctgggctttatatttttggtggaacaattctcgcggtttacggtcttattatcttctttaaaagacctaaaaaagaaatagaaaccaaagaagaaattgttattaaacgtaccaattattataaattatttctaaaaggcttctttttaaactttataaatgttggtgttctcgtattttggctaggggttattattgtcgtgggacctaatttagataacgatgttaatagatttataacctttttcggggcaatggtaggtgcttattttgtaaccgatatttttaaaattttactcgccaaacaattaaaaagtaagccttactcccaagaattattattaaaattaaaaaaggttttaaggtcttaa

SEQ ID NO: 21360 - protein, 193 aa, Unknown
  Obtained from environmental sample
  DOMAIN (13)...(187): LysE type translocator
  misc_feature (1)..(193): Xaa is any amino acid
MIEDIQAAIPLGFFLSFMIGPVFFVLLETSVIKGFRAAIAFDFGVIIADILFIALAYFSSFQLLENLSNEPGLYIFGGTILAVYGLIIFFKRPKKEIETKEEIVIKRTNYYKLFLKGFFLNFINVGVLVFWLGVIIVVGPNLDNDVNRFITFFGAMVGAYFVTDIFKILLAKQLKSKPYSQELLLKLKKVLRS

SEQ ID NO: 21361 - DNA, 507 bp, Unknown
  Obtained from environmental sample
  misc_feature (1)..(507): n is a, c, g, or t
atgaaaaaatccttacttttctttacaatcattttttgtattctttttttatcacaaaagacaaaagcacaatttaaaaatgatacacaagctgctttttatgatatgggtttaggtgcaattgttggcggaattggagctatgatcaataaaaaagataatgaaaagttaggcaaagtttttgtaaaaggattttggcaaggagctgtaggtggttatgttgtttttgaatctaaaagattaattagggttggtgttaaccaaaatacttatggttatttttggccatccaaaattgtaaacagtgttggtaattctattttagaaaacgcatctgctaacagaaatttttgggaacaataccatataaacataggctttaatcgttttgagtttgatatgaataataaagggaaattttcttacaaaattatgccttttgcattatctgccactgttgttggttttgtaaatggtaatttagatgtaaataaatcgttaagtggt

SEQ ID NO: 21362 - protein, 169 aa, Unknown
  Obtained from environmental sample
  SIGNAL (1)...(19)
  misc_feature (1)..(169): Xaa is any amino acid
MKKSLLFFTIIFCILFLSQKTKAQFKNDTQAAFYDMGLGAIVGGIGAMINKKDNEKLGKVFVKGFWQGAVGGYVVFESKRLIRVGVNQNTYGYFWPSKIVNSVGNSILENASANRNFWEQYHINIGFNRFEFDMNNKGKFSYKIMPFALSATVVGFVNGNLDVNKSLSG

SEQ ID NO: 21363 - DNA, 696 bp, Unknown
  Obtained from environmental sample
  misc_feature (1)..(696): n is a, c, g, or t
atgaaaaaatccttacttttctttacaatcattttttgtattctttttttatcacaaaagacaaaagcacaatttaaaaatgatacacaagctgctttttatgatatgggtttaggtgcaattgttggcggaattggagctatgatcaataaaaaagataatgaaaagttaggcaaagtttttgtaaaaggattttggcaaggagctgtaggtggttatgttgtttttgaatctaaaagattaattagggttggtgttaaccaaaatacttatggttatttttggccatccaaaattgtaaacagtgttggtaattctattttagaaaacgcatctgctaacagaaatttttgggaacaataccatataaacataggctttaatcgttttgagtttgatatgaataataaagggaaattttcttacaaaattatgccttttgcattatctgccactgttgttggttttgtaaatggtaatttagatgtaaataaatcgttaagtgttggaacttttatttttaaatcaaaacaacctattttcgctaaaattttctataatgttagtgcaaatgcgtatgcttatacaaatcaaattgtttatgatgctgaattgttctcttttagaactttaagtcatgaaataatacatacgtaccaatatgaacaagcattaattttaattctttttttataa

SEQ ID NO: 21364 - protein, 231 aa, Unknown
  Obtained from environmental sample
  SIGNAL (1)...(19)
  misc_feature (1)..(231): Xaa is any amino acid
MKKSLLFFTIIFCILFLSQKTKAQFKNDTQAAFYDMGLGAIVGGIGAMINKKDNEKLGKVFVKGFWQGAVGGYVVFESKRLIRVGVNQNTYGYFWPSKIVNSVGNSILENASANRNFWEQYHINIGFNRFEFDMNNKGKFSYKIMPFALSATVVGFVNGNLDVNKSLSVGTFIFKSKQPIFAKIFYNVSANAYAYTNQIVYDAELFSFRTLSHEIIHTYQYEQALILILFL

SEQ ID NO: 21365 - DNA, 663 bp, Unknown
  Obtained from environmental sample
  misc_feature (1)..(663): n is a, c, g, or t
atgattacatggtataatcacgactactatgtcaaccattatcagtcacatggtttttctgttgagaaaaaatattctgaaagtcgttttccttttaaaaacgtaaaaaccgaatttttctacaaagcacaagaattaataaaaagacgctatcagcttaaagctttagacttaaaaaaaacatccgaagtcatgccttatgcagatcaaatgtttgatttatttaatgaaagctacgcctcactatcttcatttgttgcgattacagatattcaaaaagaatattttaaaaagaagtttataagttttattaatccagaatatatcaaatttgttattgacaaagacaacaaattggtagcatttgctgtagttatgcctagatttgcggatgcattacaacaaatgaaaggtaaattattaccatttggatttttaaaattattaaaagctaaaaaagaaagcaaagacgttatgttttacttgataggtgtccatcctgagtatcaaaataaaggtgtacatgctgttatttttaacgaatattacaacacgtttactgaaagaggaatacaaacctgttatagaacacctgaattagaggataacgaagctatacataaaatttggaaacactttgatccagaggtatatataagaccn

SEQ ID NO: 21366 - protein, 221 aa, Unknown
  Obtained from environmental sample
  misc_feature (1)..(221): Xaa is any amino acid
MITWYNHDYYVNHYQSHGFSVEKKYSESRFPFKNVKTEFFYKAQELIKRRYQLKALDLKKTSEVMPYADQMFDLFNESYASLSSFVAITDIQKEYFKKKFISFINPEYIKFVIDKDNKLVAFAVVMPRFADALQQMKGKLLPFGFLKLLKAKKESKDVMFYLIGVHPEYQNKGVHAVIFNEYYNTFTERGIQTCYRTPELEDNEAIHKIWKHFDPEVYIRP

SEQ ID NO: 21367 - DNA, 474 bp, Unknown
  Obtained from environmental sample
  misc_feature (1)..(474): n is a, c, g, or t
ttgattttacaattatcctataccattgtccaatttaatagtaaaagcaatcagtttattgtatttcataaaagtagaaacacactattaggtaaaaaacataacaatcaattagcaaccttttctacattaaaaacagcagaaacaaattctataattagaagctatgcagtcaaaaacgcattacaaacatcagcatcaaaacctgtaactaacatatacaaactggacaataaacatgtattagttattgatagtttgtccgtatttaatgtaaaaggaataacaatagattatgttgtattaacacaatctccaaaattaaacctagagcgattaattgacagcttaaaaccaaaggttataatagcagatggaaataattatagatcgtatgtaaatcgttgggaagctacttgtttaaaacaaaaactcccgttttaccacacaggtaaacaggagcttatattataa

SEQ ID NO: 21368 - protein, 157 aa, Unknown
  Obtained from environmental sample
  misc_feature (1)..(157): Xaa is any amino acid
MILQLSYTIVQFNSKSNQFIVFHKSRNTLLGKKHNNQLATFSTLKTAETNSIIRSYAVKNALQTSASKPVTNIYKLDNKHVLVIDSLSVFNVKGITIDYVVLTQSPKLNLERLIDSLKPKVIIADGNNYRSYVNRWEATCLKQKLPFYHTGKQELIL

SEQ ID NO: 21369 - DNA, 615 bp, Unknown
  Obtained from environmental sample
  misc_feature (1)..(615): n is a, c, g, or t
atggaaaaacttttagtggtcaacaatgtttccaaagtctatggtgattataaagcgcttaacaacgtttccatagaagtagaaaaaggaagcatctttgggctattggggccaaatggcgccggaaaaacgaccttaattagaattataaaccaaattacgatgccagacactggctcggttattttggatggcgaaccattacagccacatcacattcaatatataggttatctccctgaggaacgtggattatataaaacaatgaaagtaggggagcaggctctttacttggcacaacttaaaggtctttcaaaacaagaagcaaaagagcgattaaaatattggtttgatcgtttggatattggtgattggtgggacaaaaaaattcaggaactatccaaggggatggcccaaaaaattcaatttgtggttacggtacttcacaatccgaaattgttgatttttgatgaaccctttagtggtttcgaccctataaatgccaatcttattaaagatgaaatattaaaacttcgcgacgaaggggctactgttatattttctacacaccgcatggaatctgttgaagaaatgtgcgatcatattgctttgatt

SEQ ID NO: 21370 - protein, 205 aa, Unknown
  Obtained from environmental sample
  DOMAIN (30)...(205): ABC transporter
  misc_feature (1)..(205): Xaa is any amino acid
MEKLLVVNNVSKVYGDYKALNNVSIEVEKGSIFGLLGPNGAGKTTLIRIINQITMPDTGSVILDGEPLQPHHIQYIGYLPEERGLYKTMKVGEQALYLAQLKGLSKQEAKERLKYWFDRLDIGDWWDKKIQELSKGMAQKIQFVVTVLHNPKLLIFDEPFSGFDPINANLIKDEILKLRDEGATVIFSTHRMESVEEMCDHIALI

SEQ ID NO: 21371 - DNA, 882 bp, Unknown
  Obtained from environmental sample
  misc_feature (1)..(882): n is a, c, g, or t
gtgatatcctacagtgaagctgagaataataaattccgggctcatatttacaaggggcgaacatcaaacgaacaaacgcaaattttctatgcgctatgcttggctatcttctttatccgaaattcacaaaacaaggtaatttcggattatagtaaagcatggctggctctaaaagatgtatctccaagaataaaagttgggcaacaggcgcaaaaccctgatgtacgaaagcaaaatatcgacacatttaagggactaatcggtgactgttgcgtaccccgaccgaaagactatcagaacgcggtaatcaatcagcaggagttgaaaaacatcctctcttcgtcacgggttgaacttgaaattattgagtataaacagggttttgtgaacttacactcaaaggaatgggagggttctttcgatgccaaaatccctaagaccttatgtgccttggcaaactccaatccgaacaaccagtcttatctagtttttggagtttgcgacggcgttgcggatagagatgcaatcgaaaaagcgtttggaattactacatatgaatatcacggctggcatatttgtggtgttaacaaagatattgcttgcttgaagatcagtgctgataatctttttgtaaaaattagaaaactcattgatgcttcagatctgagcgagaacataaaaactgctgccgtttcaggactacgcgtgttcgactatgctgatcgtcttgtctttattgtcaacgtaccacctcaagacgagctatcatttttgggagatgattgcttcgttcgaagtggaaacgatataaagaagctaagccccaaagaagcgggtgggtggggaaagaaaatgactgggatgtttgtggaaggcgtttga

SEQ ID NO: 21372 - protein, 293 aa, Unknown
  Obtained from environmental sample
  misc_feature (1)..(293): Xaa is any amino acid
MISYSEAENNKFRAHIYKGRTSNEQTQIFYALCLAIFFIRNSQNKVISDYSKAWLALKDVSPRIKVGQQAQNPDVRKQNIDTFKGLIGDCCVPRPKDYQNAVINQQELKNILSSSRVELEIIEYKQGFVNLHSKEWEGSFDAKIPKTLCALANSNPNNQSYLVFGVCDGVADRDAIEKAFGITTYEYHGWHICGVNKDIACLKISADNLFVKIRKLIDASDLSENIKTAAVSGLRVFDYADRLVFIVNVPPQDELSFLGDDCFVRSGNDIKKLSPKEAGGWGKKMTGMFVEGV

SEQ ID NO: 21373 - DNA, 819 bp, Unknown
  Obtained from environmental sample
  misc_feature (1)..(819): n is a, c, g, or t
gtgcaaagagattccttaaaattacagaaaaaagattcattattaactctcaaaaaagatagcatcatttttaagaaagatagcttacttcttaaaaataatgactcaattgtaaacgattctataaaaccaaaggaaagtatagatgatataattacgcatattgctcaagattataccattcaaaatgcgaaagaaaaaaaggtaactttatataatgaggcaaatattacctacactgatatcgatttaaaagcaggtattattattatcgattacaaaaaaaacacactttttgcgaaaggaattaaagatagtacaggttatgtacaaagacctgtttttaaacaaggaggccaagagtcagaacaagattccattctttataactttaaaagtaaacgagctttaatttatggtttaaaaaccaaacaaggagaaatgtttacttatggagaaaaaacaaaacaggtaaatgattctactatttatatccgtaaaataagatttacaacttcagaaaaagaagttcctgattattatattagtacagataaagccaaattagtgcctggaaaaaagattattgtaggtcttagtaatttggttttggcagatgtacctacacctgtttttttaccttttgcctatttccctatgacagaaactagtgtttccggatttttaattcctgcttttgatactggaagtagttctagaggtgttggtttacaaatggtggtattacttgcaattaacgattatgtagatttaacttactggagatgctggggcaatggaagtggggttaagaganct

SEQ ID NO: 21374 - protein, 273 aa, Unknown
  Obtained from environmental sample
  misc_feature (1)..(273): Xaa is any amino acid
MQRDSLKLQKKDSLLTLKKDSIIFKKDSLLLKNNDSIVNDSIKPKESIDDIITHIAQDYTIQNAKEKKVTLYNEANITYTDIDLKAGIIIIDYKKNTLFAKGIKDSTGYVQRPVFKQGGQESEQDSILYNFKSKRALIYGLKTKQGEMFTYGEKTKQVNDSTIYIRKIRFTTSEKEVPDYYISTDKAKLVPGKKIIVGLSNLVLADVPTPVFLPFAYFPMTETSVSGFLIPAFDTGSSSRGVGLQMVVLLAINDYVDLTYWRCWGNGSGVKRX

SEQ ID NO: 21375 - DNA, 930 bp, Unknown
  Obtained from environmental sample
  misc_feature (1)..(930): n is a, c, g, or t
atgcatagatggctgagaactatatactacttttacctgctttactctaatataaagattggttttgcacaagatataaaatctacagataaaattgntaatccctctgtgcaaagagaatccttaaaattacagaaaaaagattcattattaactctcaaaaaagatagcatcatttttaagaaagatagcttacttcttaaaaataatgactcaattgtaaacgattctataaaaccaaaggaaagtatagatgatataattacgcatattgctcaagattataccattcaaaatgcgaaagaaaaaaaggtaactttatataatgaggcaaatattacctacactgatatcgatttaaaagcaggtattattattatcgattacaaaaaaaacacactttttgcgaaaggaattaaagatagtacaggttatgtacaaagacctgtttttaaacaaggaggccaagagtcagaacaagattccattctttataactttaaaagtaaacgagctttaatttatggtttaaaaaccaaacaaggagaaatgtttacttatggagaaaaaacaaaacaggtaaatgattctactatttatatccgtaaaataagatttacaacttcagaaaaagaagttcctgattattatattagtacagataaagccaaattagtgcctggaaaaaagattattgtaggtcttagtaatttggttttggcagatgtacctacacctgtttttttaccttttgcctatttccctatgacagaaactagtgtctccggatttttaattcctgcttttgatactggaagtagttctagaggtgttggttcacaaaatggtggctatcattttgccaataacgattatgtagatttaacattaactggagatgcttgggccactggacctcgccgttannnn

SEQ ID NO: 21376 - protein, 310 aa, Unknown
  Obtained from environmental sample
  misc_feature (1)..(310): Xaa is any amino acid
MHRWLRTIYYFYLLYSNIKIGFAQDIKSTDKIXNPSVQRESLKLQKKDSLLTLKKDSIIFKKDSLLLKNNDSIVNDSIKPKESIDDIITHIAQDYTIQNAKEKKVTLYNEANITYTDIDLKAGIIIIDYKKNTLFAKGIKDSTGYVQRPVFKQGGQESEQDSILYNFKSKRALIYGLKTKQGEMFTYGEKTKQVNDSTIYIRKIRFTTSEKEVPDYYISTDKAKLVPGKKIIVGLSNLVLADVPTPVFLPFAYFPMTETSVSGFLIPAFDTGSSSRGVGSQNGGYHFANNDYVDLTLTGDAWATGPRRXX

SEQ ID NO: 21377 - DNA, 594 bp, Unknown
  Obtained from environmental sample
  misc_feature (1)..(594): n is a, c, g, or t
atgcctttgacatctctgatgaggaggaaaattggtttaattgaaaaagatgtcaatcgcattttagagactttaggaatggaccttacagatgatagtcttaaaggtactcctaaacgtgttgctaaaatgtttgttcaagaaatttttggcggcttaaatccaaagcgtaaaccaaaagcttcagtatttgaaaataaatacaaatatggggaaatgttagtagaaaaaaatattaccgtttactctacttgcgaacaccatttgttacctatcgttgggagagctcatgtggcttatatttctaatggaactgttgtaggtctctctaaaatgaatcgtattgtcgactttttcgccaaacgtcctcaagtacaagaacgtatgaccatgcaaatcgttaatgaattgcaagaagttttaggaacaaaagatgttgcttgtgtaattgatgcaaaacacctttgcgtaaacagtagagggatacgtgatatagaaagcagcactgtcaccagtgaatttggaggaaaatttaaagaacccgctaccaaaagagagtttttagattacattaatatggatactgatttttaa

SEQ ID NO: 21378 - protein, 197 aa, Unknown
  Obtained from environmental sample
  DOMAIN (72)...(176): GTP cyclohydrolase I
  misc_feature (1)..(197): Xaa is any amino acid
MPLTSLMRRKIGLIEKDVNRILETLGMDLTDDSLKGTPKRVAKMFVQEIFGGLNPKRKPKASVFENKYKYGEMLVEKNITVYSTCEHHLLPIVGRAHVAYISNGTVVGLSKMNRIVDFFAKRPQVQERMTMQIVNELQEVLGTKDVACVIDAKHLCVNSRGIRDIESSTVTSEFGGKFKEPATKREFLDYINMDTDF

SEQ ID NO: 21379 - DNA, 717 bp, Unknown
  Obtained from environmental sample
  misc_feature (1)..(717): n is a, c, g, or t
atgggtaattgggcgtttaaaaagcaatctaaagacgcatttataaatacattactcgacggacaaccatttattccttcctattttggatttaatgtagacattaataaaactggagccgaaaatttagagtctgctataaatagagtaccatttcaaaaagaatcaactgcagagggattaatcgtagatatacgaaatgaagccgattttaaaaaagggcatcttaaagggagtataaatattcagggaaattctgaagaggataagtttgaaacatggttaggttccattatagaaccaaaagaaacgtttacagtagtgattgacaatgaaaagaataaagatttactattgaatagaattgcgaaaattggctatgaaaaacaacttaaagaagtcattactctaaaagaagaaaatcttaataaaactaaagctttagatgtaaacgattttaaaaagaatcctgataactatacgatagtagatattcgtaatacaagcgaagttgaagaggaacagttttttgaaaacgcactatcgcatccattaaataatttgcgtcatagtgctaatactattcctactaataaacctatcgttgtacattgtgctggtggctatagaagtgccgctggaagtagtattttagagactattttaaaatcggcaacggtttatgatttaggagatgctatagaaaactttaaatag

SEQ ID NO: 21380 - protein, 238 aa, Unknown
  Obtained from environmental sample
  misc_feature (1)..(238): Xaa is any amino acid
MGNWAFKKQSKDAFINTLLDGQPFIPSYFGFNVDINKTGAENLESAINRVPFQKESTAEGLIVDIRNEADFKKGHLKGSINIQGNSEEDKFETWLGSIIEPKETFTVVIDNEKNKDLLLNRIAKIGYEKQLKEVITLKEENLNKTKALDVNDFKKNPDNYTIVDIRNTSEVEEEQFFENALSHPLNNLRHSANTIPTNKPIVVHCAGGYRSAAGSSILETILKSATVYDLGDAIENFK

SEQ ID NO: 21381 - DNA, 852 bp, Unknown
  Obtained from environmental sample
  misc_feature (1)..(852): n is a, c, g, or t
atgatgtacgataccattacaactaaatttaaagacttaccagatcacgcacttgtttaccctgctcacggcgcgggttccttatgtggtaaaaatttaagtgatgataaaagcagtacgctaggaaatgaacgtatgggtaattgggcgtttaaaaagcaatctaaagacgcatttataaatacattactcgacggacaaccatgtattccttcctattttggatttaatgtagacattaataaaactggagccgaaaatttagagtctgctataaatagagtaccatttcaaaaagaatcaactgcagagggattaatcgtagatatacgaaatgaagccgattttaaaaaagggcatcttaaagggagtataaatattcagggaaattctgaagaggataagtttgaaacatggttaggttccattatagaaccaaaagaaacgtttacagtagtgattgacaatgaaaagaataaagatttactattgaatagaattgcgaaaattggctatgaaaaacaacttaaagaagtcattactctaaaagaagaaaatcttaataaaactaaagctttagatgtaaacgattttaaaaagaatcctgataactatacgatagtagatattcgtaatacaagcgaagttgaagaggaacagttttttgaaaacgcactatcgcatccattaaataatttgcgtcatagtgctaatactattcctactaataaacctatcgttgtacattgtgctggtggctatagaagtgccgctggaagtagtattttagagactattttaaaatcggcaacggtttatgatttaggagatgctatagaaaactttaaatag

SEQ ID NO: 21382 - protein, 283 aa, Unknown
  Obtained from environmental sample
  misc_feature (1)..(283): Xaa is any amino acid
MMYDTITTKFKDLPDHALVYPAHGAGSLCGKNLSDDKSSTLGNERMGNWAFKKQSKDAFINTLLDGQPCIPSYFGFNVDINKTGAENLESAINRVPFQKESTAEGLIVDIRNEADFKKGHLKGSINIQGNSEEDKFETWLGSIIEPKETFTVVIDNEKNKDLLLNRIAKIGYEKQLKEVITLKEENLNKTKALDVNDFKKNPDNYTIVDIRNTSEVEEEQFFENALSHPLNNLRHSANTIPTNKPIVVHCAGGYRSAAGSSILETILKSATVYDLGDAIENFK

SEQ ID NO: 21383 - DNA, 471 bp, Unknown
  Obtained from environmental sample
  misc_feature (1)..(471): n is a, c, g, or t
gtgtctaataaaacaaaatttgataaacgattagtagctggtcaaaaacatggtgcaatatcagataaagcaactataataaaacaattaaacaataaattagatattgatattgctagcgacaaacctattgtaattatttattatccaggaaaagatccttgcaattctagtgggtcagcaacaaaacaaacaagagtaaaagcacaacaagattttgaggttaaattatacaatttagtacaaatcaaacctatttatctatataaaagtatagacggattatcaaataattatgatctatctaaatggcatcaagatccagatggtttaatagaatctttattttttgaataccattatccttgctctagctatttagtcatttcaaaagatggcgaatttactagtaagtttggagagtctaattattctgaaattttagcaacaaccaaaaggcttaatcaatag

SEQ ID NO: 21384 - protein, 156 aa, Unknown
  Obtained from environmental sample
  misc_feature (1)..(156): Xaa is any amino acid
MSNKTKFDKRLVAGQKHGAISDKATIIKQLNNKLDIDIASDKPIVIIYYPGKDPCNSSGSATKQTRVKAQQDFEVKLYNLVQIKPIYLYKSIDGLSNNYDLSKWHQDPDGLIESLFFEYHYPCSSYLVISKDGEFTSKFGESNYSEILATTKRLNQ

SEQ ID NO: 21385 - DNA, 471 bp, Unknown; identical to SEQ ID NO: 21383
  Obtained from environmental sample
  misc_feature (1)..(471): n is a, c, g, or t

SEQ ID NO: 21386 - protein, 156 aa, Unknown; identical to SEQ ID NO: 21384
  Obtained from environmental sample
  misc_feature (1)..(156): Xaa is any amino acid

SEQ ID NO: 21387 - DNA, 321 bp, Unknown
  Obtained from environmental sample
  misc_feature (1)..(321): n is a, c, g, or t
gtgcagcaaagtcaataccaaaacctgatgcttcattttttaaaggcgtgtgctctctttaagcatataaggtccaacctcaagctgagccacatttttccgacagcaaaagcacttctagatacacctggtctattagagtttataacttcagtatattgtgcagtagcagtaaaacttgcaagtaacagtgtaaactgtaatattaattttgggttaagcatatatttttgtttaaagtcaaatataagattttatattttttttaagtatttaaaacttaatttaaaactgaagaattgtatttttgttaaagaataa

SEQ ID NO: 21388 - protein, 106 aa, Unknown
  Obtained from environmental sample
  misc_feature (1)..(106): Xaa is any amino acid
MQQSQYQNLMLHFLKACALFKHIRSNLKLSHIFPTAKALLDTPGLLEFITSVYCAVAVKLASNSVNCNINFGLSIYFCLKSNIRFYIFFKYLKLNLKLKNCIFVKE

SEQ ID NO: 21389 - DNA, 330 bp, Unknown
  Obtained from environmental sample
  misc_feature (1)..(330): n is a, c, g, or t
ttgcagcaatcaataagcattggaattatgcaatggataattattttgaagatttacaacacagcgttttaccataataattttaccaaacgacaatctactttattcactattgactccttatataatagtcaaaaaaattactttaacaccctagaaaacagtcttaaatataaaaaccatagtaacttttattatggtttttattattaccgcttaaacaattacgaagcagctaaaaatcgttttcaaaaaataattgataacacagcaaatgctgacaactcccaacttttaaaaaacaaaacggtttctttctgtagcttatag

SEQ ID NO: 21390 - protein, 109 aa, Unknown
  Obtained from environmental sample
  misc_feature (1)..(109): Xaa is any amino acid
MQQSISIGIMQWIIILKIYNTAFYHNNFTKRQSTLFTIDSLYNSQKNYFNTLENSLKYKNHSNFYYGFYYYRLNNYEAAKNRFQKIIDNTANADNSQLLKNKTVSFCSL

SEQ ID NO: 21391 - DNA, 582 bp, Unknown
  Obtained from environmental sample
  misc_feature (1)..(582): n is a, c, g, or t
ttggttactgctgaagagctttggaatccagataaaacaagagttaccattttgtttgatccaggccgtataaagcgtggtgtccaaccaaacctgcaattaggtttgccattgattgaaggatatacctataagttagtaatagatgaaaattggttagatgtaaatgatgtaaaacttactgaaggctttgaaaaaatatttgatgtgattactgttgatagagaatctccaagctttaaaaattggaggattgattttccgaatataaaaaataaatcatccataaaaattgattttaaagaagcaatggattttggcctattgcatagcgcaattgtaatagttgatgaaacaaacggctacgttaatggagttattgaactttctgaaaacgaaagtgaatggacgtttacaccaaaaaagaactggttaaaaggaaactataaaatgataattaatgcctggcttgaagatctatcaggtaataatttaaatagaaaatttgatataaatctaaatagcgagaatgatacacccaaaaatattgaagaggtaataattccttttgaaataaattaa

SEQ ID NO: 21392 - protein, 193 aa, Unknown
  Obtained from environmental sample
  misc_feature (1)..(193): Xaa is any amino acid
MVTAEELWNPDKTRVTILFDPGRIKRGVQPNLQLGLPLIEGYTYKLVIDENWLDVNDVKLTEGFEKIFDVITVDRESPSFKNWRIDFPNIKNKSSIKIDFKEAMDFGLLHSAIVIVDETNGYVNGVIELSENESEWTFTPKKNWLKGNYKMIINAWLEDLSGNNLNRKFDINLNSENDTPKNIEEVIIPFEIN

SEQ ID NO: 21393 - DNA, 375 bp, Unknown
  Obtained from environmental sample
  misc_feature (1)..(375): n is a, c, g, or t
gtgattactgttgatagagaatctccaagctttaaaaattggaggattgattttccgaatataaaaaataaatcatccataaaaattgattttaaagaagcaatggattttggcctattgcatagcgcaattgtaatagttgatgaaacaaacggctacgttaatggagttattgaactttctgaaaacgaaagtgaatggacgtttacaccaaaaaagaactggttaaaaggaaactataaaatgataattaatgcctggcttgaagatctatcaggtaataatttaaatagaaaatttgatataaatctaaatagcgaaaatgatacacccaaaaatattgaagaggtaataattccttttgaaataaattaa

SEQ ID NO: 21394 - protein, 124 aa, Unknown
  Obtained from environmental sample
  misc_feature (1)..(124): Xaa is any amino acid
MITVDRESPSFKNWRIDFPNIKNKSSIKIDFKEAMDFGLLHSAIVIVDETNGYVNGVIELSENESEWTFTPKKNWLKGNYKMIINAWLEDLSGNNLNRKFDINLNSENDTPKNIEEVIIPFEIN

SEQ ID NO: 21395 - DNA, 441 bp, Unknown
  Obtained from environmental sample
  misc_feature (1)..(441): n is a, c, g, or t
ttgatgaaaagagtaattgttggactttccggaggagttgattcaagcgttgctgcatatttattaaaagagcaaggttacgatgtcattggtctgtttatgaagaattggcatgatgactcagtaaccatatctaatgaatgtccttggctggaagatagtaatgatgctatgttggttgctgagaaattaggaattccttttcaggttgttgatctcagcgaacaatataaagaacgtattgtggattatatgtttagagagtatgaattaggaagaacacctaacccggatatcttatgtaatagacaaatcaaatttgatgtttttttaaaaacagccatggaattggcagcagattatgttggaccgggacattattgtaaaaaaggaactttgcataaaggcggacagaaatttatcacttacaagttgatctga

SEQ ID NO: 21396 - protein, 146 aa, Unknown
  Obtained from environmental sample
  SIGNAL (1)...(19)
  DOMAIN (3)...(146): tRNA methyl transferase
  misc_feature (1)..(146): Xaa is any amino acid
MMKRVIVGLSGGVDSSVAAYLLKEQGYDVIGLFMKNWHDDSVTISNECPWLEDSNDAMLVAEKLGIPFQVVDLSEQYKERIVDYMFREYELGRTPNPDILCNRQIKFDVFLKTAMELAADYVGPGHYCKKGTLHKGGQKFITYKLI

SEQ ID NO: 21397 - DNA, 909 bp, Unknown
  Obtained from environmental sample
  misc_feature (1)..(909): n is a, c, g, or t
ttgttgatctcaccggaacaatataaagaacgtattgtggattatatgtttagagagtatgaattaggaagaacacctaacccggatatcttatgtaatagagaaatcaaatttgatgtttttttaaaaccacccatggaattgggagcagattatgttggaacgggacattattgtagaaaaggaactttgcataaagncggaaagaaaatttatcaattactagctggatctgatgtgaataaagatcaatcgtattttttgtgtcagctttcacaaaagcaattagcaaaatctttatttccaataggtgaattaacaaaacctgaagtacgtcgaattgcagcgaaactagacttaattacggccgacaaaaaagattcacaaggattgtgttttattggaaaagtacgtttgcctgattttttacaacaaaaattgcatccaaaagaaggtagtattgtgcaaattcctgatgattctttgatctacaataaatcaaagcctaaatttgaaacaaaagaagatgaattagcatataagggcgccaaatatgaatataatttgtcagatggtaaaattgtaggtaaacatcaaggtgcacattattttacaaaagggcaacgtaaagggcttgcagttggcggtacagtagaacctctttttgtgattgatactgatgtagaagaaaatataatttataccggagaggggaaagatcacaaaggcttatacagaaacacattgtttgtaaaaaatgaagaaatccattggattcgtgaagatttgactcttaagaacggtggaagtatggatgttaaggcgagaattagatatagacaagccttagagaatgcaactctttttnagtatctgaagtttatacgtacatctctcggccgatcttga

SEQ ID NO: 21398 - protein, 302 aa, Unknown
  Obtained from environmental sample
  DOMAIN (1)...(295): tRNA methyl transferase
  misc_feature (1)..(302): Xaa is any amino acid
MLISPEQYKERIVDYMFREYELGRTPNPDILCNREIKFDVFLKPPMELGADYVGTGHYCRKGTLHKXGKKIYQLLAGSDVNKDQSYFLCQLSQKQLAKSLFPIGELTKPEVRRIAAKLDLITADKKDSQGLCFIGKVRLPDFLQQKLHPKEGSIVQIPDDSLIYNKSKPKFETKEDELAYKGAKYEYNLSDGKIVGKHQGAHYFTKGQRKGLAVGGTVEPLFVIDTDVEENIIYTGEGKDHKGLYRNTLFVKNEEIHWIREDLTLKNGGSMDVKARIRYRQALENATLFXYLKFIRTSLGRS

SEQ ID NO: 21399 - DNA, 831 bp, Unknown
  Obtained from environmental sample
  misc_feature (1)..(831): n is a, c, g, or t
gtggattatatgtttagagagtatgaattaggaagaacacctaacccggatatcttatgtaatagagaaatcaaatttgatgtttttttaaaaacagccatggaattgggagcagattatgttggaacgggacattattgtagaaaaggaactttgcataaaggcggaaagaaaatttatcaattactagctggatctgatgtgaataaagatcaatcgtattttttgtgtcagctttcacaaaagcaattagcaaaatctttatttccaataggtgaattaacaaaacctgaagtacgtcgaattgcagcgaaactagacttaattacggccgacaaaaaagattcacaaggattgtgttttattggaaaagtacgtttgcctgattttttacaacaaaaattgcatccaaaagaaggtagtattgtgcaaattcctgatgattctttgatctacaataaatcaaagcctaaatttgaaacaaaagaagatgaattagcatataagggcgccaaatatgaatataatttgtcagatggtaaaattgtaggtaaacatcaaggtgcacattattttacaaaagggcaacgtaaagggcttgcagttggcggtacagtagaacctctttttgtgattgatactgatgtagaagaaaatataatttataccggagaggggaaagatcacaaaggcttatacagaaacacattgtttgtaaaaaatgaagaaatccattggattcgtgaagatttgactcttaagaacggtggaagtatggatgttaaggcgagaattagatatagactagccttagagatgcacttaaactaa

SEQ ID NO: 21400 - protein, 276 aa, Unknown
  Obtained from environmental sample
  DOMAIN (1)...(276): tRNA methyl transferase
  misc_feature (1)..(276): Xaa is any amino acid
MDYMFREYELGRTPNPDILCNREIKFDVFLKTAMELGADYVGTGHYCRKGTLHKGGKKIYQLLAGSDVNKDQSYFLCQLSQKQLAKSLFPIGELTKPEVRRIAAKLDLITADKKDSQGLCFIGKVRLPDFLQQKLHPKEGSIVQIPDDSLIYNKSKPKFETKEDELAYKGAKYEYNLSDGKIVGKHQGAHYFTKGQRKGLAVGGTVEPLFVIDTDVEENIIYTGEGKDHKGLYRNTLFVKNEEIHWIREDLTLKNGGSMDVKARIRYRLALEMHLN

SEQ ID NO: 21401 - DNA, 900 bp, Unknown
  Obtained from environmental sample
  misc_feature (1)..(900): n is a, c, g, or t
gtgatggaacagttctttagaaacattcatgaaataggagaattgagtttagaaaatcttgttcgcacctggctcttccacgatgatatcgttagctttgaatacattgcaaaaaacaaagtaatagatttctacgttatagttcagaaaaaattctacgagctaatagaaaaacaaataacatcatactatccaagcgcagaagtctctgttgaagagcccattgatatccatccaaaaggaaacaaacttaaatgctactacgcataccaaaagaacgattactttttccctctaaaaacgtataaaaatcttgagaacgatcccctaaatgatcttacaaacattttttcaaaactagaagaaaccgatatagctgcaattcagataattattaggcccaaaaaaggtacgaaatggcaaaaaaagacagaacaagctggtattgcgatgttttcaggtaaaaaaccgggaggctttaaaataccaggattaagttttattggtggattcttttctatgatgataagcggaaaaccagatgcttctaaatcaagtgaaggaggtagcggcccatatggaggcggaggttatgttcgtatgctccagacacgtgaagaaattgcaaaaaagattggtgaacaagctggacatgtagtttacgatacaacaataagactagtaggatcagctgaaaaagccggacatgccgttgagataaccaataacatggcgctcgccttcaacatgtttaagcacgctcaaatgaactggttcaaaccagaagagcattccattcgcttcataaacacaagatcgttaatttcatttcacagacgatactctatccagatcttacaaattggagcaagatctcaatctaataagaagagtcgataa

SEQ ID NO: 21402 - protein, 299 aa, Unknown
  Obtained from environmental sample
  misc_feature (1)..(299): Xaa is any amino acid
MMEQFFRNIHEIGELSLENLVRTWLFHDDIVSFEYIAKNKVIDFYVIVQKKFYELIEKQITSYYPSAEVSVEEPIDIHPKGNKLKCYYAYQKNDYFFPLKTYKNLENDPLNDLTNIFSKLEETDIAAIQIIIRPKKGTKWQKKTEQAGIAMFSGKKPGGFKIPGLSFIGGFFSMMISGKPDASKSSEGGSGPYGGGGYVRMLQTREEIAKKIGEQAGHVVYDTTIRLVGSAEKAGHAVEITNNMALAFNMFKHAQMNWFKPEEHSIRFINTRSLISFHRRYSIQILQIGARSQSNKKSR

SEQ ID NO: 21403 - DNA, 600 bp, Unknown
  Obtained from environmental sample
  misc_feature (1)..(600): n is a, c, g, or t
atgaggcacccaatgcaatcaaacttagaaaaaaagcaccaagatgagaagctagaagctctaaaagaagggaaaacacaaaagactaaagatacacttgataaattgaacttaattttatctaattattttgagcaaggaaatgttgatttttcaataacaaatatcggaatgataagttataaaaatagcggtcccagttacgaaacgcttcgtgcaacaaaaaatgtgcactatagaaagctaattagttattgggctgaattaatcaaaagtcaatcggttgacaataaagtggtattaccagctacggataatgagcttttaaatacgatacccgatattgcggctcgcgcatactttgcaagaattttagctgaaagaaagaaatttaaaaccgagctgaatatcttaaaaagtcaatcggaaatagtaatcgataagcgtaatcaatatacccaaactacagactttattcctaacttaaaactaactaataatgagttatcagcgcttacttatgctgtatcggatgagtgtattaagctcaatggttggctaaaaactgaattagggcaaataaaaggaagtgaatatcan

SEQ ID NO: 21404 - protein, 200 aa, Unknown
  Obtained from environmental sample
  misc_feature (1)..(200): Xaa is any amino acid
MRHPMQSNLEKKHQDEKLEALKEGKTQKTKDTLDKLNLILSNYFEQGNVDFSITNIGMISYKNSGPSYETLRATKNVHYRKLISYWAELIKSQSVDNKVVLPATDNELLNTIPDIAARAYFARILAERKKFKTELNILKSQSEIVIDKRNQYTQTTDFIPNLKLTNNELSALTYAVSDECIKLNGWLKTELGQIKGSEYX

SEQ ID NO: 21405 - DNA, 705 bp, Unknown
  Obtained from environmental sample
  misc_feature (1)..(705): n is a, c, g, or t
atggaaaataaccacgccccgtttcatttaatcccgattaaaaaacagttgtttgtttttacttttttcatttcatttataggattttcccaaaagcaacctcaaccgttttcaacttttgcagatagtgttataaaagttaatcataaaacatttaacgacttagattttgccatttacaaaaaaaaatacgacacgctaaaaatgaaaatttttgcggctaaaagcttagaaaaaaactatccgcaaggtgaggcctttgcttatattatgttgggaaatcaatatagaaacaagtcgttatttaaaaaatcgaaagcaaatttaaacaaagccttagccatttctaaaaaaaaaggattaatagaattccacattgttagccttaatatgttgggtgttgtagagcgcagattagacaatattaaaagcgctttagcttaccatcaaaaagccttaaaactagcagaacaataccgtaataaaacaaaaagtatcgaaaaaagtattgcggtttgccataacagtgtgggaaatatttatttgagtttaaaacaatatgatttagcattaaaagagtttaacaactctttagaaattgacaaagacagttacaacattttaggtttagccataaattaccataatatagggtgcatttacgaaagaacaaaacaaattgaacgccgtattaaaaaattataa

SEQ ID NO: 21406 - protein, 234 aa, Unknown
  Obtained from environmental sample
  DOMAIN (126)...(159): TPR Domain
  misc_feature (1)..(234): Xaa is any amino acid
MENNHAPFHLIPIKKQLFVFTFFISFIGFSQKQPQPFSTFADSVIKVNHKTFNDLDFAIYKKKYDTLKMKIFAAKSLEKNYPQGEAFAYIMLGNQYRNKSLFKKSKANLNKALAISKKKGLIEFHIVSLNMLGVVERRLDNIKSALAYHQKALKLAEQYRNKTKSIEKSIAVCHNSVGNIYLSLKQYDLALKEFNNSLEIDKDSYNILGLAINYHNIGCIYERTKQIERRIKKL

SEQ ID NO: 21407 - DNA, 795 bp, Unknown
  Obtained from environmental sample
  misc_feature (1)..(795): n is a, c, g, or t
ttgaatatcattgctgtaaaaaagcttgatagtttattagcaaggagtattctcaagaaagtcattgaacagttggttcaacggtcttcaaaagggattattcaggaagcctaccatttaatggaatctcagacaggagcgaagcttaagatatcagattctgtaactttgattaataatagaaatcaactatgcgcaaaaaaagctatcccggaatttggtgaatatacaataaccaagaaaatggttactcaggggtttaatactgatgagatatgtttaacaattggcgaagatgctatttcagaactgtatatagatttagaatgtgtccagtttcccttgattttgaggcgatggaagtcaggagatagaattcagccacttggcatgaatggcacgcagaaaatttctaatcatttaacgaatcagaaagtttcaacaattatgagggaaaaatctttggtattaagcgctgcagatggtactatttacgcaattatttttgaaggaaaggaaaatggatcgggtactatttcagagatttgtaagagcaaccgattctacaaagcattatcttttggtaactacaaaaaagcaggcatgagtttttatttacccgaaaccgttgattgcaacggagacacatttaaagtattcatcaccaaagaagaaattgaagcgagagtttctcttctgggggaaaaaactggacaaagatttcgaaggaaagaggcctatttttattgggatattgaacggagcttttatctttgtagcagatataatgcgtag

SEQ ID NO: 21408 - protein, 264 aa, Unknown
  Obtained from environmental sample
  misc_feature (1)..(264): Xaa is any amino acid
MNIIAVKKLDSLLARSILKKVIEQLVQRSSKGIIQEAYHLMESQTGAKLKISDSVTLINNRNQLCAKKAIPEFGEYTITKKMVTQGFNTDEICLTIGEDAISELYIDLECVQFPLILRRWKSGDRIQPLGMNGTQKISNHLTNQKVSTIMREKSLVLSAADGTIYAIIFEGKENGSGTISEICKSNRFYKALSFGNYKKAGMSFYLPETVDCNGDTFKVFITKEEIEARVSLLGEKTGQRFRRKEAYFYWDIERSFYLCSRYNA

SEQ ID NO: 21409 - DNA, 825 bp, Unknown
  Obtained from environmental sample
  misc_feature (1)..(825): n is a, c, g, or t
ttgattgagcaaaaagtatcagaattaataacccgacatttttctgaacacccaaaattcgttgttggtgtaagtgggggtgctgactcaatggcacttttgtttgtgctgaagcaattgaatatccctacgtttgtagttcatatcaattatggattacgaggaactgagtctgataaagatcaggagttagttgaaggaatgtcatttgaatggggatttgaatgttgttctgtaagaattaactcagaagaatcaacgcaagaaaatttccaaaactgggcacgcaaagaacgctacagaatatttttagaattagtagacgaaatgaaagctgatggtttggcaattgcgcatcacaaaaatgatcaggtagaaacgattattcaaaaactgtttcgaggaagcagtccggaagcatggagcggaatgacgaattgggacggtagaatatttcgaccattacttgatttcagtaagaatgatattctcaactattgtaaagaaaaagctattccgtttcatacagatctaagtaatttggaatctaattacgctagaaattttataagaaatgatctttcgaaaaagttaaacggtctatttccaggctggcaagaaaatgtgttgaggttgcaagaatttggacagctaaacgaattcgctttggctgaactttcacagcattattttgatgaaacggctttgaatatcattgctgtaaaaaagcttgatagttcattagcaaagagtattctcaaaaaattcattgaacagtttgtcaaacgtcttcaaaagggattatccccgaaagctaccatttaa

SEQ ID NO: 21410 - protein, 274 aa, Unknown
  Obtained from environmental sample
  DOMAIN (19)...(215): PP-loop family
  misc_feature (1)..(274): Xaa is any amino acid
MIEQKVSELITRHFSEHPKFVVGVSGGADSMALLFVLKQLNIPTFVVHINYGLRGTESDKDQELVEGMSFEWGFECCSVRINSEESTQENFQNWARKERYRIFLELVDEMKADGLAIAHHKNDQVETIIQKLFRGSSPEAWSGMTNWDGRIFRPLLDFSKNDILNYCKEKAIPFHTDLSNLESNYARNFIRNDLSKKLNGLFPGWQENVLRLQEFGQLNEFALAELSQHYFDETALNIIAVKKLDSSLAKSILKKFIEQFVKRLQKGLSPKATI

SEQ ID NO: 21411 - DNA, 657 bp, Unknown
  Obtained from environmental sample
  misc_feature (1)..(657): n is a, c, g, or t
ttgctnaagcatgaagcccatagggttcgaatggaaaaaaaaggaataccagagatagatcttagtgattattcaggagtaatcatagggggcgggccaagtaatattagcgatgatgaaaataaaaaatatccgtaccagagaaaatttgaagaagacctcaataggttactcaataaggtttttgaaaatgattttccgacattaggaacctgctatggcattggtgctcttgtgaaacatcaaggtggcgaagtatcaaaagatagatattctgaaagcataggcgttgtcaagattaaacttacagaggtagggatgaatgatcagcttacaaataaactacctgttaattttaaagcttttggtggccataaggaggcttgtcaggagcttccgactaacgcgatcctacttgctacttcagaaaattgccttattcaaatgataagatttggtaacaatatctatgctacacaattccatacagaattagatcaagaaggaatacaattacgcataaatatttataaagactatggttatttttctccagaagatgccgataaattgataaagatcgctaaaaataatgaggtgaactttccatggattattctcaatcaattcattaaaagatacaaacgggaatactga

SEQ ID NO: 21412 - protein, 218 aa, Unknown
  Obtained from environmental sample
  DOMAIN (1)...(176): Glutamine amidotransferase class-I
  misc_feature (1)..(218): Xaa is any amino acid
MLKHEAHRVRMEKKGIPEIDLSDYSGVIIGGGPSNISDDENKKYPYQRKFEEDLNRLLNKVFENDFPTLGTCYGIGALVKHQGGEVSKDRYSESIGVVKIKLTEVGMNDQLTNKLPVNFKAFGGHKEACQELPTNAILLATSENCLIQMIRFGNNIYATQFHTELDQEGIQLRINIYKDYGYFSPEDADKLIKIAKNNEVNFPWIILNQFIKRYKREY

SEQ ID NO: 21413 - DNA, 861 bp, Unknown
  Obtained from environmental sample
  misc_feature (1)..(861): n is a, c, g, or t
ttgaacattattcagcgttacttcaaaaccaaagggctagatacagaggctaaaattaagcagttttgcgaatacctgttagataacgtcactatattgaaagtcgttgtgccaccgcaaaccgatcttaatcactactttgagatcatgaataaccgtggtgagcagctagaaaaacacgaagtattgaaagcgaaattcatggctacactgagtaatgatgaggaaagaaactgtttttcgaccatttgggatgcttgctcaaatatgacgcgttacacacagatgggttttcaatctgatttgcgtaaagaagtatttggtgacaattggcaaacaatgccaaaaagctttgatgcgattcaagcaaagcatacgagtatacagcaaaaacaagatgcaatgacactacgcgaaattatcgacaacaaaacacccagtgaaaataccgatgatgaagagcgcgagaaagaagaacgctttggcacggttatcgacttttcaaatttcttacttcatgtactcaagttgatgcctgagattaagggggtatcgcttgatgataaaaaattacttgatgcgtttattagtaaagataatggctttaaggtagaagccaaaacctttgtatatgagttgctcaagtaccgaattctacttgatagctacatcatcaagccagaccaacacaatgaaaagcgtaagtggagcctacaaacactcatagctaatacgagcggtactagcacaagctctaactataataactcttgtggtaaagacccagaccctttcaatgacaaattgcgcatgatattaggcatgttccatgtatcaagaccagtcttaagttataannan

SEQ ID NO: 21414 - protein, 287 aa, Unknown
  Obtained from environmental sample
  misc_feature (1)..(287): Xaa is any amino acid
MNIIQRYFKTKGLDTEAKIKQFCEYLLDNVTILKVVVPPQTDLNHYFEIMNNRGEQLEKHEVLKAKFMATLSNDEERNCFSTIWDACSNMTRYTQMGFQSDLRKEVFGDNWQTMPKSFDAIQAKHTSIQQKQDAMTLREIIDNKTPSENTDDEEREKEERFGTVIDFSNFLLHVLKLMPEIKGVSLDDKKLLDAFISKDNGFKVEAKTFVYELLKYRILLDSYIIKPDQHNEKRKWSLQTLIANTSGTSTSSNYNNSCGKDPDPFNDKLRMILGMFHVSRPVLSYXX

SEQ ID NO: 21415 - DNA, 705 bp, Unknown
  Obtained from environmental sample
  misc_feature (1)..(705): n is a, c, g, or t
atggataaattaatacgctattttacacctgtatttttggctttgttatttttagatatttatgtaaaaactaatttgcctataattccttacaggtattattctaaaatatttgtgctagtcactcttataatatttacgggttattgtgtttacaagaaaaataagttaaacaataggtatgttttttatggattaattattttttttataggtgatattttaattattgaccacttaaataaagtaaagtttattattagtttaatactttttgtagttggtaaattaatctacatttttaaatttacacacaaggaagactttaataataagcgtttgctaccatttttagtagtttgttttttgtttgttgcgtttttgtataatctaatttttgtaaaccttaaagggtattttataccagtaacgttgtatttttttatatccttagtcatgactctttttgcctatcttagaaaagatgtagcaagtaacaaaagctattatacagttttatctggtgtagttttatttgtattctctgaggctacaatggtagttaaaacattttatggagacatcctattccaagatttcatagtaatgtttggttatggatttggacaatatcttataattttaggtttaatgattgacaaacctaactatgttgaaaatagtgaacttatctctaaaatataa

SEQ ID NO: 21416 - protein, 234 aa, Unknown
  Obtained from environmental sample
  misc_feature (1)..(234): Xaa is any amino acid
MDKLIRYFTPVFLALLFLDIYVKTNLPIIPYRYYSKIFVLVTLIIFTGYCVYKKNKLNNRYVFYGLIIFFIGDILIIDHLNKVKFIISLILFVVGKLIYIFKFTHKEDFNNKRLLPFLVVCFLFVAFLYNLIFVNLKGYFIPVTLYFFISLVMTLFAYLRKDVASNKSYYTVLSGVVLFVFSEATMVVKTFYGDILFQDFIVMFGYGFGQYLIILGLMIDKPNYVENSELISKI

SEQ ID NO: 21417 - DNA, 552 bp, Unknown
  Obtained from environmental sample
  misc_feature (1)..(552): n is a, c, g, or t
ttgacaactattataactaacaaagcattacctatatatagctttatttttatttttacatttttagtatcttgtaaggatactaaaaacgtaaacaatgatcatttagtttttagatataacgaacacaaaaacataggatcactagatcctgcatttgcaaaagacaacgcggatatttgggcaatccatcaactatttaatggattgattcaaatggatgacagtttacatgttaaacccagcattgctaaaaactggacactatcagataatggtttaagctataattttgtactaaaaaacaatgtctattttcataaacataaattatttggtaaggattctaccagactagttactgcttctgactttgaatatagttttaaccgattgttggataaaaatatagcgtcgtcaggtcagtggatttttaataaagtagacacctttaaagcgataaacgacaccatttttaatattactttaaaacaaccttttcctgcatttttgggtttgttaacaatgaagtattgtagtgtggtcccctaa

SEQ ID NO: 21418 - protein, 183 aa, Unknown
  Obtained from environmental sample
  misc_feature (1)..(183): Xaa is any amino acid
MTTIITNKALPIYSFIFIFTFLVSCKDTKNVNNDHLVFRYNEHKNIGSLDPAFAKDNADIWAIHQLFNGLIQMDDSLHVKPSIAKNWTLSDNGLSYNFVLKNNVYFHKHKLFGKDSTRLVTASDFEYSFNRLLDKNIASSGQWIFNKVDTFKAINDTIFNITLKQPFPAFLGLLTMKYCSVVP

SEQ ID NO: 21419 - DNA, 303 bp, Unknown
  Obtained from environmental sample
  misc_feature (1)..(303): n is a, c, g, or t
atgaaattaattgccaaaattatttcgtatactttattaggagtactggctttggccattattttctttttttgggcatcttcatctaattattctaaaaatgattattcaaaacttattattaacgtacatttagaatcttttgataagccaacgagattaaaacaactttattttgtaattgaccttttcaataaatacaatgctaaatatcctactatactcctaagtgattttaacagcgatatcaattatgacaatccggcaattggcaagaccctttctttagacaatattggtaat

SEQ ID NO: 21420 - protein, 101 aa, Unknown
  Obtained from environmental sample
  misc_feature (1)..(101): Xaa is any amino acid
MKLIAKIISYTLLGVLALAIIFFFWASSSNYSKNDYSKLIINVHLESFDKPTRLKQLYFVIDLFNKYNAKYPTILLSDFNSDINYDNPAIGKTLSLDNIGN

SEQ ID NO: 21421 - DNA, 684 bp, Unknown
  Obtained from environmental sample
  misc_feature (1)..(684): n is a, c, g, or t
atgcaaatttcatttttaatagttacaaaaaatagaccagaagatttagcttttacgttaaataggttgaaatctttaatggatttttctattcatgaagtgttggtgtttattgatggttgttctaaaaccgaagccattattaataattttgagtgggttaaatggaccgtgtctaaaaaaagcatcagtgcttctccagcaagaagtaccctgtataaaaaggcagaaggacaaatttttatagggttagatgatgatgcacatccaataagtgaagcctttataaaatctatcgaagatgattttaatgctaacaccaaccttggtataatcgcttttcaagaagtaagaggattatacaaatccgataacgaggctttaagtttagcaaaatatattgaaccgtattatacaaatgattttattggttgtggatttgctattaagaaggaagcgtatgatgcctcaagagggtttcctttgtggattgatatttatggtgaagaaccagctttggctttagaggtttcagatttaggctatcaaatattttatgatcctaaaattatagtcaatcatcgtgtggatactgtaaacaggaagctacaaggtaaaaactattttaggtttgagcatcaattacaaaatacgattcgtttctatctggtgtattataaatcc

SEQ ID NO: 21422 - protein, 228 aa, Unknown
  Obtained from environmental sample
  DOMAIN (4)...(158): Glycosyl transferase
  misc_feature (1)..(228): Xaa is any amino acid
MQISFLIVTKNRPEDLAFTLNRLKSLMDFSIHEVLVFIDGCSKTEAIINNFEWVKWTVSKKSISASPARSTLYKKAEGQIFIGLDDDAHPISEAFIKSIEDDFNANTNLGIIAFQEVRGLYKSDNEALSLAKYIEPYYTNDFIGCGFAIKKEAYDASRGFPLWIDIYGEEPALALEVSDLGYQIFYDPKIIVNHRVDTVNRKLQGKNYFRFEHQLQNTIRFYLVYYKS

SEQ ID NO: 21423 - DNA, 759 bp, Unknown
  Obtained from environmental sample
  misc_feature (1)..(759): n is a, c, g, or t
atgcttgaagagcggttaaccaaagtacttgctggtttaccaaaacagtacgaaataaaaggcctcaatttgcagcttaactattctactggttttagttacttaaatgaaaatgacgattttgactactggttacagcatggctatttggcacttaaaaatgccaaatacagcattaacaaagtaagctcatcggtgcacgataaacaacaagtgatggacgtggctttggccgctaagctgcaacaggcaattaaaactaataaactggcgttatattatcaagcgcaacttaactttagtacaaataaagtaaacggcgccgaggcgctattgcgttggcccgatccgccctttaaaagcatttcaattgaaaaattaataattttagctgagcacaccggtattattaacgagcttactttgtgggttattgaacaagcttgccaagatattattaggttcacccaaaatgggcaccctgggcatactgttagtgtaaatttaagcgctaaaaatttaaccatcaataatttagccgaaaaagtagaaaacattttaattaagtaccaggttcctgcgcatctacttaaatttgagctgacagaatcagcctttgtagagagccaggagacgcttattaaattagtagagcaactgaacaccttgggagttaaagtagtacttgatgactttggtacaggctacgcgtcacttagttatctagtaactttcactttagtgaatnatcatcgatag

SEQ ID NO: 21424 - protein, 252 aa, Unknown
  Obtained from environmental sample
  DOMAIN (73)...(252): EAL domain
  misc_feature (1)..(252): Xaa is any amino acid
MLEERLTKVLAGLPKQYEIKGLNLQLNYSTGFSYLNENDDFDYWLQHGYLALKNAKYSINKVSSSVHDKQQVMDVALAAKLQQAIKTNKLALYYQAQLNFSTNKVNGAEALLRWPDPPFKSISIEKLIILAEHTGIINELTLWVIEQACQDIIRFTQNGHPGHTVSVNLSAKNLTINNLAEKVENILIKYQVPAHLLKFELTESAFVESQETLIKLVEQLNTLGVKVVLDDFGTGYASLSYLVTFTLVNXHR

SEQ ID NO: 21425 - DNA, 858 bp, Unknown
  Obtained from environmental sample
  misc_feature (1)..(858): n is a, c, g, or t
atggtatataaggatggaagcaaagggccatcttacattaaacgctttgcagtaacctctattacgcgcgataaagagtacgatttaactaacggcacaaaaaactcgaaagccctttatttctctgctaatccaaatggagaagccgaagtaattaccgtgtatttacgccaagtaggtagcgttaaaaagttaaaatgggatatcgattttgccgatatattaataaaaggaagagcctctaaaggtaatttagtaagcaaacatccagttaagaaaattgaacttaaggaaagaggtgtttcgactttaaaaccaaggaaaatttggtacgatgataatgtccaacgtttaaatgttgacgagcgtggggaattattaggcgagtttagaggtgaagaccgaattttaattatcactcaaaaagggatggctaaaactattattcctgaagtaaccacgcattttgataatgatatggttgtaatggaaaaatggattcctaaaaaaccaatttcagctatttattacgatggtgaaaaggaaatatattatgtaaaacgtttccttatagaaaatgaaaacaaagacgaacagtttatttctagtcacccgaattcgtttttagaaattgtatctaccgattggaaaccaatggcagaaatagaatttaaaaaagaaagaggaaaagaacgcaaggaaaatgaacctataaatttagaagaatttatttctattaaaggaattacagcacaaggaaatcaattaacaaaagagaaggtaaatgccatcaatttattagaatcaataccttatgaagcgcagaagaaatccaanttgagaattaaggttatggng

SEQ ID NO: 21426 - protein, 286 aa, Unknown
  Obtained from environmental sample
  misc_feature (1)..(286): Xaa is any amino acid
MVYKDGSKGPSYIKRFAVTSITRDKEYDLTNGTKNSKALYFSANPNGEAEVITVYLRQVGSVKKLKWDIDFADILIKGRASKGNLVSKHPVKKIELKERGVSTLKPRKIWYDDNVQRLNVDERGELLGEFRGEDRILIITQKGMAKTIIPEVTTHFDNDMVVMEKWIPKKPISAIYYDGEKEIYYVKRFLIENENKDEQFISSHPNSFLEIVSTDWKPMAEIEFKKERGKERKENEPINLEEFISIKGITAQGNQLTKEKVNAINLLESIPYEAQKKSXLRIKVMX

SEQ ID NO: 21427 - DNA, 315 bp, Unknown
  Obtained from environmental sample
  misc_feature (1)..(315): n is a, c, g, or t
atgagaaatagtgtaataattagcctgatttttgtgatgatttctaatcaattatcagcgcaacaaattgcttcggatgtaataaaggagcaaattactaagtataaaaacgatttacgtggtccttacaaggatattccgtggttttgtactgatggtagcgtaaggcaanccaaagatccttgtccagataatgttggaccacgaaatcaacattgtagatataaagatgaagtcgacaaattacgcttaagtaatcatatttgttcacgtccacttttggcctttcctaaactgaaagcgtttgggattntg

SEQ ID NO: 21428 - protein, 105 aa, Unknown
  Obtained from environmental sample
  SIGNAL (1)...(19)
  misc_feature (1)..(105): Xaa is any amino acid
MRNSVIISLIFVMISNQLSAQQIASDVIKEQITKYKNDLRGPYKDIPWFCTDGSVRQXKDPCPDNVGPRNQHCRYKDEVDKLRLSNHICSRPLLAFPKLKAFGIX

SEQ ID NO: 21429 - DNA, 339 bp, Unknown
  Obtained from environmental sample
  misc_feature (1)..(339): n is a, c, g, or t
ttgatgcaactattatggcgagttacacatgaagagttttggataatttatttaaataattcaaataaagtaattcacaaaagccaactaagtaaaggtggaataacaggtacattagtagacactagattggttttaaaaacagctttagaggttggagcagtaggcttaatattaacacacaatcatccttcaggaactttaaaacctagtcaagcagataaggatgtgaccttaaaattaaaattagcagcacaaagtttagatataaaagttttagatcatttaatcattacagagcaaagttattttagctttgcagatcaatctatactgtaa

SEQ ID NO: 21430 - protein, 112 aa, Unknown
  Obtained from environmental sample
  DOMAIN (1)...(112): RadC, DNA repair protein
  misc_feature (1)..(112): Xaa is any amino acid
MMQLLWRVTHEEFWIIYLNNSNKVIHKSQLSKGGITGTLVDTRLVLKTALEVGAVGLILTHNHPSGTLKPSQADKDVTLKLKLAAQSLDIKVLDHLIITEQSYFSFADQSIL

SEQ ID NO: 21431 - DNA, 870 bp, Unknown
  Obtained from environmental sample
  misc_feature (1)..(870): n is a, c, g, or t
ttgctaggtcaaaaaactggggcaaaactatatgcctggtgcttatttagattagatcaacctataatggctctgaataaaatcttagattttgagcatcctgaggtagttggctttgattacttgattgagttatataacgaaaatgaactattaagtacttttagggtcatcgatgatacgagagtaattacaaacattgagaatacagatacactcgttgaaaatttactaccctatctagaactagataagaagtttgatagatatttgctttcacagggctatcgcagtaagttatcaataccatccaaaattatcatcaacgatggaatagacagtattttacgtagtgctactaatggtcatgaaacatatggattgattgaaatactagcagagaaaagctttgaagaaaatcttgctgagcgagcactgttgcagttaactgaaggtttttcttgggataaattaagtaaatcggatacgcaggtactgattaatacggtaagtaaatatgtcgttgaaaacggcatcagtaacgtaactgataaaatcattcaagaaaatataaaggagaagttcctaaaatcagagatagcgcctaaggtaatggatttattaataggatggaatgttcatgtgaatgaatctgaagtaattaatattttaggtcaatatactgacaacaactggagacagtatggtaaaaatttaggagagttcataaactcaagtaaatggatatcaataactaaggctttatatacattgtatggaaataagaaggttgttaataatgcgctgaaatattgctacagtctattaccaaaaaaacaaaagtgggcctattcattaaatctaagataa

SEQ ID NO: 21432 - protein, 289 aa, Unknown
  Obtained from environmental sample
  misc_feature (1)..(289): Xaa is any amino acid
MLGQKTGAKLYAWCLFRLDQPIMALNKILDFEHPEVVGFDYLIELYNENELLSTFRVIDDTRVITNIENTDTLVENLLPYLELDKKFDRYLLSQGYRSKLSIPSKIIINDGIDSILRSATNGHETYGLIEILAEKSFEENLAERALLQLTEGFSWDKLSKSDTQVLINTVSKYVVENGISNVTDKIIQENIKEKFLKSEIAPKVMDLLIGWNVHVNESEVINILGQYTDNNWRQYGKNLGEFINSSKWISITKALYTLYGNKKVVNNALKYCYSLLPKKQKWAYSLNLR

SEQ ID NO: 21433 - DNA, 846 bp, Unknown
  Obtained from environmental sample
  misc_feature (1)..(846): n is a, c, g, or t
atgtctaagaaaaatatattggttattggtcgagctaacagtggtaaaacacacttttttggacaactttatggtcgtcttaaagagcctcgaagctcactaaatatcaatggaacaccagcaaatttagaaatgcttggtgaggtttttgaagcactaagcgaaggtaaagcttctgctcatactgtggctgagacttggaatagcctaaaaataccattaatagatgaaaatggtaaagagtttgatataaattggcctgaatacgcaggtgagcaatgggatactattttctctacacgctcgttagatgagaaatggaaaagccaattagatgatagtgataaatggcttatcgtgattagggtggaaagcgaacctacattcccagatttccttgaaaaattggccaataatgaaaaaccagaaaagaagcatgaatcacctaattccacaaattgggacgcaaatccttactgggtagaaaagttacagatactattacaattatcaaaaacgcaaatagctaacaaagttcaaagccctaaggtagccgttttgctttcctgttacgatgaagtaaatactgaaaatgccactccacatatgattttagagcaacgactaccaatgttagcttcgtatttggtctctaactgggacgaggataaattaagtatatgggggctttctgcattaggaaaggaattaacagaagcgtcaaaagatgaagattttattgatgaaggtccagagaaccagggctgggttatatcgccaaatgagactattgagcagaaaaatatcgacctaactttacctattaaatggttgcttaatgactga

SEQ ID NO: 21434 - protein, 281 aa, Unknown
  Obtained from environmental sample
  misc_feature (1)..(281): Xaa is any amino acid
MSKKNILVIGRANSGKTHFFGQLYGRLKEPRSSLNINGTPANLEMLGEVFEALSEGKASAHTVAETWNSLKIPLIDENGKEFDINWPEYAGEQWDTIFSTRSLDEKWKSQLDDSDKWLIVIRVESEPTFPDFLEKLANNEKPEKKHESPNSTNWDANPYWVEKLQILLQLSKTQIANKVQSPKVAVLLSCYDEVNTENATPHMILEQRLPMLASYLVSNWDEDKLSIWGLSALGKELTEASKDEDFIDEGPENQGWVISPNETIEQKNIDLTLPIKWLLND

SEQ ID NO: 21435 - DNA, 351 bp, Unknown
  Obtained from environmental sample
  misc_feature (1)..(351): n is a, c, g, or t
atgaagaacaaaatctttatgtacctgtttatttttacatcactaattgtggtgtttcaatatgtaaattctaaaaaaatattggatgacagtgcaaaacgaatggaaaaacttaaggagagatcagttgtattacaagactctttaaatcttcaaaacgaagaattatctgatttgacattatttgatttaagatatagtcaagaagctaaagattatttttataataaaaaattggatagcgatgttatgattccttatatcaaaaacgaattatacaaattaaatgaagctgaaggtgaccatcctttaataacctttgcagctttccgaagaagaaaatgccgttaa

SEQ ID NO: 21436 - protein, 116 aa, Unknown
  Obtained from environmental sample
  misc_feature (1)..(116): Xaa is any amino acid
MKNKIFMYLFIFTSLIVVFQYVNSKKILDDSAKRMEKLKERSVVLQDSLNLQNEELSDLTLFDLRYSQEAKDYFYNKKLDSDVMIPYIKNELYKLNEAEGDHPLITFAAFRRRKCR

SEQ ID NO: 21437 - DNA, 684 bp, Unknown
  Obtained from environmental sample
  misc_feature (1)..(684): n is a, c, g, or t
atgctgcaactctcacttaaaacaatacagaaaattaaaatcatttttaaggtgttttttattacaattgtagtgtttcaactttttaaaagtgcttttttatctctcccaaaggattggcttttctttttaacaagtgatgcggttgagcatttggtatgcgttttaatagtttgttttttatactattacatcttaaaactaaagaatatttggagaaaatctgggttattaattgtcttaataattcccttaatcttattagctttacttaaagattacagaatacacaatgtaattacgtttgagcaaacatttgaatatttcactagttttttaggacaaacgctgttattttacgcgcttctatattttataaatcgattagaattttttaataagtataagacgttagaacaggaattaaataaaacgaaagcacaattattgcaaaatcaattacatcctcattttttatttaatgccattaattcgctgtatagtttgtctctaaaaaaccatcccgaaacgtctgattctattttaaaattatctagtatgatgcgttatttaactgatgaatcgcaacgaaatacagtgccactaaacatagacttagattttattacaaactatagtgctattgaagacattagatttgggaaagattcccggattacttaa

SEQ ID NO: 21438 - protein, 227 aa, Unknown
  Obtained from environmental sample
  DOMAIN (146)...(227): Histidine kinase
  misc_feature (1)..(227): Xaa is any amino acid
MLQLSLKTIQKIKIIFKVFFITIVVFQLFKSAFLSLPKDWLFFLTSDAVEHLVCVLIVCFLYYYILKLKNIWRKSGLLIVLIIPLILLALLKDYRIHNVITFEQTFEYFTSFLGQTLLFYALLYFINRLEFFNKYKTLEQELNKTKAQLLQNQLHPHFLFNAINSLYSLSLKNHPETSDSILKLSSMMRYLTDESQRNTVPLNIDLDFITNYSAIEDIRFGKDSRIT

SEQ ID NO: 21439 - DNA, 609 bp, Unknown
  Obtained from environmental sample
  misc_feature (1)..(609): n is a, c, g, or t
ttggaaaacatatttacgaaacgaattgcacaaaacaacttttacaagttgcagaagaaaaagccgaatatagaagaacacttaataaatcacttcaaacacaataaaaatatgaatgtagtatcatttttcgcgggagctggcggactagatttaggatttcaaaaagcaggatttaatgttgtttgggcaaatgaatatgacaaagacatttgggaaacttacgagaaaaatcataaaaacacgatacttgacagacgaagtatcgtaaatatagaatctgacgaagttcctgaatgtgatggaattattggcggaccaccttgccaaagttggagtgaagctggctcattacgtggcataaatgacaaaagaggacaattattttatgatttcatccgaatattagaagcaaaacagccaaaattctttcttgccgaaaatgtgagcggtatgttattggaaagacatagcgaagctttaaaaaacattaaaaaaatgtttaaaaatgctggatacaaattatccttcaaattattaaacgcatcggactttgatgttccacaagacagaaaacgtgtcttttttgttgtatacgagaagacttga

SEQ ID NO: 21440 - protein, 202 aa, Unknown
  Obtained from environmental sample
  DOMAIN (38)...(202): C-5 cytosine-specific DNA methylase
  misc_feature (1)..(202): Xaa is any amino acid
MENIFTKRIAQNNFYKLQKKKPNIEEHLINHFKHNKNMNVVSFFAGAGGLDLGFQKAGFNVVWANEYDKDIWETYEKNHKNTILDRRSIVNIESDEVPECDGIIGGPPCQSWSEAGSLRGINDKRGQLFYDFIRILEAKQPKFFLAENVSGMLLERHSEALKNIKKMFKNAGYKLSFKLLNASDFDVPQDRKRVFFVVYEKT

SEQ ID NO: 21441 - DNA, 576 bp, Unknown
  Obtained from environmental sample
  misc_feature (1)..(576): n is a, c, g, or t
atgcaggttttcaaagaaaaaacccttttaaaagcggctattaatgccgaaaaatctaaagccaaaaccattggcctagtgcctacaatgggtgctttacaccacggccatttatctttggtaaaacaggctttacaaacttgtgaccgggtgattatcagcatctttgtaaacccaacccaatttgacaatcctgcagatcttgagaaatatccacgcactttagaccaggacattaagctcctggaagaagccagtaacaacctctggatttttgccccaactgctaaagaattatacggtgaaaatataagttctgagcagtttaattttgacggtttggagcacgtaatggaaggaaaataccgaaacggacattttgacggtgtgggaactatcgtaaaaagactatttaccatcgtnagcacaaacaaagctttttttggcgaaaaagactttcagcaactggcaattgcaagaaagttaccgaaaaagcgggattccggtagaaatagtggctgtcccatttacgggaagacaacggttagcaaggagtccaagaaaggaagatcggna

SEQ ID NO: 21442 - protein, 192 aa, Unknown
  Obtained from environmental sample
  DOMAIN (1)...(190): Pantoate-beta-alanine ligase
  misc_feature (1)..(192): Xaa is any amino acid
MQVFKEKTLLKAAINAEKSKAKTIGLVPTMGALHHGHLSLVKQALQTCDRVIISIFVNPTQFDNPADLEKYPRTLDQDIKLLEEASNNLWIFAPTAKELYGENISSEQFNFDGLEHVMEGKYRNGHFDGVGTIVKRLFTIVSTNKAFFGEKDFQQLAIARKLPKKRDSGRNSGCPIYGKTTVSKESKKGRSX

SEQ ID NO: 21443 - DNA, 402 bp, Unknown
  Obtained from environmental sample
  misc_feature (1)..(402): n is a, c, g, or t
ttgaattccaaagttactactgaaaagttagttaaaggacgccgcactgttaagcagtctgctttatttcctggttatgtatttgtgtgtttagaagctgagaatggtaacttttttgcggtaaaaaatacccgcggagtaagtggctttgtaacttatggtgctgcatatcagcgtgtgcccgttgagttaattaatcagcttaaagcagagcgttcgcactcacatgaatcgcaagttcctaaaagcggtgacttggtgagtgtaaacaatgagtcatttaaaaatattgacgctatttataaagagcctgatggcgatatgcgcagtattttgttcattaatttgcttaacaaacaaatagaaattagcgtgagtaatcaagcaataagcaaaatttaa

SEQ ID NO: 21444 - protein, 133 aa, Unknown
  Obtained from environmental sample
  misc_feature (1)..(133): Xaa is any amino acid
MNSKVTTEKLVKGRRTVKQSALFPGYVFVCLEAENGNFFAVKNTRGVSGFVTYGAAYQRVPVELINQLKAERSHSHESQVPKSGDLVSVNNESFKNIDAIYKEPDGDMRSILFINLLNKQIEISVSNQAISKI

SEQ ID NO: 21445 - DNA, 807 bp, Unknown
  Obtained from environmental sample
  misc_feature (1)..(807): n is a, c, g, or t
gtgatattgattcttcaatgccattggttttcagtcattcccgcatatttattatcaaagaaatataagtctaaactaatatttgaagtgcgtgatttatggcctcaaacccccattcatttaaaaggctattctagctatcatcctgtagttattataatggcattgattgaaaaattgggatatagaaaggcagatcatattgtttctgtattgccaaatgcatatcattatattaataaaatttcaaagagtccagataagtttaattatatacccaatggaattgattctaaatttgtaggtgatgaacaactttctgaaaaggttaaaaatagtattcctaagaataaatttattgttggttatgctggcactattggtttggcgaatgcaatggaatattttatagatgcagttaaattattgaaggataactctgaaattcactttgtagttgttggtgatggctatctaaaaactagttttatagaaggcaccaaagatttgcccaatattacttttatagataaaattaaaaaatctcaagtgcaatcaatgttatcattttttaatgtttgctatgtggggcgctatgatttgccattatatgaacatggtgtttcttacaataagtacttcgattatatgctggctaaaaaacctattttagaatcttcaaaaatgattaaagaccctgtagacatgtctgattgtggtctgatagtttctccagaaaatgccagttcacttaacgagggagtactgagaatgtataacttatcaacagacaaactgaataagttn

SEQ ID NO: 21446 - protein, 269 aa, Unknown
  Obtained from environmental sample
  DOMAIN (105)...(268): Glycosyl transferases group 1
  misc_feature (1)..(269): Xaa is any amino acid
MILILQCHWFSVIPAYLLSKKYKSKLIFEVRDLWPQTPIHLKGYSSYHPVVIIMALIEKLGYRKADHIVSVLPNAYHYINKISKSPDKFNYIPNGIDSKFVGDEQLSEKVKNSIPKNKFIVGYAGTIGLANAMEYFIDAVKLLKDNSEIHFVVVGDGYLKTSFIEGTKDLPNITFIDKIKKSQVQSMLSFFNVCYVGRYDLPLYEHGVSYNKYFDYMLAKKPILESSKMIKDPVDMSDCGLIVSPENASSLNEGVLRMYNLSTDKLNKX

SEQ ID NO: 21447 - DNA, 483 bp, Unknown
  Obtained from environmental sample
  misc_feature (1)..(483): n is a, c, g, or t
atgcaaaaattagaaggtggagatgcaaaagtgaagtttacaagagtagattcagattttattgataatttaatcaaaaaagatgaaactacaatttctaaattatctgatgaagaaaaagaaacgttaaagccaattattgaaggtggaatagcttctgaagcttacacagttcaattagaggcaatggattctgatgcttctcctttcttaattacggttccagaatttatgcgtagaatgaaagaaatgcaagcttctggtggtggaggaatgatgggaatgggtaattttcctgatatgtacaatttagtggtgaacacaaatagtccattaattgcaaacatcttaaatgaaaaagatgaagctgctcagaaacacttaatttctcaagcttttgatttagcaaaattatctcaaaaccttttacatggtaaagagttaacgagttttattaaacgttcttacgaattgattaagtaa

SEQ ID NO: 21448 - protein, 160 aa, Unknown
  Obtained from environmental sample
  misc_feature (1)..(160): Xaa is any amino acid
MQKLEGGDAKVKFTRVDSDFIDNLIKKDETTISKLSDEEKETLKPIIEGGIASEAYTVQLEAMDSDASPFLITVPEFMRRMKEMQASGGGGMMGMGNFPDMYNLVVNTNSPLIANILNEKDEAAQKHLISQAFDLAKLSQNLLHGKELTSFIKRSYELIK

SEQ ID NO: 21449 - DNA, 441 bp, Unknown
  Obtained from environmental sample
  misc_feature (1)..(441): n is a, c, g, or t
ttgcccactcacgcaattcctaaagcactagagagtatctttttagtgtttcagccaattagtaaaaaagagtacaaagaaacaattctaaatctagaaggcaatccagtggattacctgacggaaaaataccaaatgattgatgagttgtttggaatagaaaaaccaattttaattaacgattttaaagcaattgaagcagctattaaaaagaaagaaaattgggaatattttgaagatttaggaaaattagctagaaaagaatatccagatacattattaggaaattattatttaggacgcttttatgaagaaacaggagagcctaaaaaagcaatgaaaacataccagtcggcttatgtgctatcagaaatagcaggtattactaaagatcacgttttagaattatcagaacagattaaagcagattttggatattaa

SEQ ID NO: 21450 - protein, 146 aa, Unknown
  Obtained from environmental sample
  misc_feature (1)..(146): Xaa is any amino acid
MPTHAIPKALESIFLVFQPISKKEYKETILNLEGNPVDYLTEKYQMIDELFGIEKPILINDFKAIEAAIKKKENWEYFEDLGKLARKEYPDTLLGNYYLGRFYEETGEPKKAMKTYQSAYVLSEIAGITKDHVLELSEQIKADFGY

SEQ ID NO: 21451 - DNA, 684 bp, Unknown
  Obtained from environmental sample
  misc_feature (1)..(684): n is a, c, g, or t
ttgcagcacagcattaaggtgttaattggtggtggaatattaggtgatggaaaagggcgtttttctgataaattagtgaaaattccaagtaaaagaggcactgaagcgttgcgttttttattgaatgatattgaagaaaatcagcaagaaaaagaaacttttttagaatattatgacagacaaggaaaaacatatttctatgatttattaaaagaattgtctgatacttctgatttaaaaccaagcgattttgttgattgggggcataatgaaaactatgtaaaagcaattggagttggagaatgtgctggagttgtgatcgatttaattgcaacattgttgtttgaaagcgaagaaaaaataacagatgctgaaaatgctttgaaagaagatcaatattcagatagtatttattatgcatacacatctttagtaaatacagccaaggctttgtcgattgcagaaaatataaaaacaaatacacaagctggtattattgccgattttcaagaacattttgtagcaacacaaaaaatcgaaattgagggttcatttgaagatttggtatatcaaattaaaaatgaaaatccaaccaaaacgtttgcagaaaattatttattggatgcaagatcattctataaaaaagtagattcattcagaaaaaaagaagtaagtcatgtataa

SEQ ID NO: 21452 - protein, 227 aa, Unknown
  Obtained from environmental sample
  DOMAIN (107)...(220): Protein of unknown function DUF103
  misc_feature (1)..(227): Xaa is any amino acid
MQHSIKVLIGGGILGDGKGRFSDKLVKIPSKRGTEALRFLLNDIEENQQEKETFLEYYDRQGKTYFYDLLKELSDTSDLKPSDFVDWGHNENYVKAIGVGECAGVVIDLIATLLFESEEKITDAENALKEDQYSDSIYYAYTSLVNTAKALSIAENIKTNTQAGIIADFQEHFVATQKIEIEGSFEDLVYQIKNENPTKTFAENYLLDARSFYKKVDSFRKKEVSHV

SEQ ID NO: 21453 - DNA, 348 bp, Unknown
  Obtained from environmental sample
  misc_feature (1)..(348): n is a, c, g, or t
atgggagttcagaagtttgaagagttaatagtttggcaaaaagcacaagattattcagtgcttatttatgataattttaaaaacaatagagacttttctttttgtgatcaaataaaaagagcttcagtttcgatttcaaataatattgcagaaggctttgatagaagaacaaaccctgattttaaaagatttttatatatatctttggcatctaatagtgaaacaaggtcgatgttatatttagcagtaagattaaattttatttccgacgaagtttctaaagatttaattgaaaaatcaaatgaaaatgcaaaaatgttatttggtttaattaaatccttaaaatag

SEQ ID NO: 21454 - protein, 115 aa, Unknown
  Obtained from environmental sample
  DOMAIN (4)...(110): S23 ribosomal protein
  misc_feature (1)..(115): Xaa is any amino acid
MGVQKFEELIVWQKAQDYSVLIYDNFKNNRDFSFCDQIKRASVSISNNIAEGFDRRTNPDFKRFLYISLASNSETRSMLYLAVRLNFISDEVSKDLIEKSNENAKMLFGLIKSLK

SEQ ID NO: 21455 - DNA, 567 bp, Unknown
  Obtained from environmental sample
  misc_feature (1)..(567): n is a, c, g, or t
atggtgtctgaaatttttattcgaaataatgaaaaagactacagttatatcggatcttataacttgaaaatagcagatcatattaagcaattaaaagccattaaacaaagtggtgttgtaagaacattattaattcaaggtatggtaaatgtaatcttagcaagagaaattgaacaacattcatttgatcttaagagctctcaaaacccaacaggttcgcttacaggttttgaactgaaacaaataaaggaactgtcggattatatcaacaattttccagaaactaacttaagcgttatagagctagcggctaagatttctattagtccagctaaagtgcaagaaggatttaagttaatgcacggtaagactttaaataattacattagatatgtacgcgttaaaaagtcagaagagcttattaagaatacagatttaaatatttcggaaatagtgtattctctcggattctcaagtagaagttatttttctaaaatttttaaggaacaatataaatgctcaccaattgagtataaacaaaacattaagttagctgcaacagcataa

SEQ ID NO: 21456 - protein, 188 aa, Unknown
  Obtained from environmental sample
  DOMAIN (138)...(180): Bacterial regulatory helix-turn-helix proteins, AraC family
  misc_feature (1)..(188): Xaa is any amino acid
MVSEIFIRNNEKDYSYIGSYNLKIADHIKQLKAIKQSGVVRTLLIQGMVNVILAREIEQHSFDLKSSQNPTGSLTGFELKQIKELSDYINNFPETNLSVIELAAKISISPAKVQEGFKLMHGKTLNNYIRYVRVKKSEELIKNTDLNISEIVYSLGFSSRSYFSKIFKEQYKCSPIEYKQNIKLAATA

SEQ ID NO: 21457 - DNA, 432 bp, Unknown
  Obtained from environmental sample
  misc_feature (1)..(432): n is a, c, g, or t
atgcacaatcctttattacaaaaattcaataccagatatacaactgcacctttttcgcaaatcaaaaacgaacattttaaaccggcatttaaagaaggaatcaagagagcgaaggcggaaatcgatgctattattgaaaaccacgaaaaacccacttttaaaaatacaattgaagctttagatttttcaggttatacattagacagactttcctctgtcttttttaacttgaattcagccgaaacgagtgatgaaattcaaaaaatagctcaagaagtttctccttggttatcagagttttctaatgatataagattaaatgaaaagttatttcaacgcgtaaagagtctttatgaaaatcgcaaaaatttaaagttaacaattgaacaacaaacgctattagataaaaaatataaaagtttttcgagataa

SEQ ID NO: 21458 - protein, 143 aa, Unknown
  Obtained from environmental sample
  misc_feature (1)..(143): Xaa is any amino acid
MHNPLLQKFNTRYTTAPFSQIKNEHFKPAFKEGIKRAKAEIDAIIENHEKPTFKNTIEALDFSGYTLDRLSSVFFNLNSAETSDEIQKIAQEVSPWLSEFSNDIRLNEKLFQRVKSLYENRKNLKLTIEQQTLLDKKYKSFSR

SEQ ID NO: 21459 - DNA, 657 bp, Unknown
  Obtained from environmental sample
  misc_feature (1)..(657): n is a, c, g, or t
atgttaatttctgaaattcatgaacacgataatactaacgtatttaagcagttccaagaattagttggagatttatatacagcagaagtacatcatattcgtcacagagctgtaattttgttagatgatgaaggaaacgaaatcatattaccaaaagataagcaaatcccttctgacttttttagaaaaggagataatgtaaaaggtgttattgatagtgttgagcttaaaggtaataagccaacaattataatgtccagaacatcaccaaagttcttagaaaaactttttgaatcagaaataccagaagtatttgatggtttaattacaattaaaaatgtagttcgtattcctggagaaaaagctaaagtagcggttgactcttacgacgatagaattgatcctgttggagcatgtgtcggaatgaaaggatcgcgtatacatggtattgttcgtgaattaggtaatgaaaacattgatgtaatcaattacactaacaacttacaattgtatattaccagagctttaagtcctgcaagagtaacttcaatcaagattgatgaagcaaacaaacgtgcagaagcaatcttaaagccagaagaagtaagtaaagcaattggtagaggtggatacaacattagattagctggtcaataa

SEQ ID NO: 21460 - protein, 218 aa, Unknown
  Obtained from environmental sample
  misc_feature (1)..(218): Xaa is any amino acid
MLISEIHEHDNTNVFKQFQELVGDLYTAEVHHIRHRAVILLDDEGNEIILPKDKQIPSDFFRKGDNVKGVIDSVELKGNKPTIIMSRTSPKFLEKLFESEIPEVFDGLITIKNVVRIPGEKAKVAVDSYDDRIDPVGACVGMKGSRIHGIVRELGNENIDVINYTNNLQLYITRALSPARVTSIKIDEANKRAEAILKPEEVSKAIGRGGYNIRLAGQ

SEQ ID NO: 21461 - DNA, 882 bp, Unknown
  Obtained from environmental sample
  misc_feature (1)..(882): n is a, c, g, or t
ttgattcggctcgagaaatgcgatgtgtacgtttcagtgcattgcgattcgcactcttcagatgctaatggcgcagggacctttgtactcggcttacatgccaataaacaaaattttgaaatcgcaaagaaagaaaactcggtaatctatctcgaggataattatgaggatagatatgctgattacgatattaattcacctgagtccatcataggacttacgataatgcaggaagaatttttagaccagagtatagcattggccaaattggtgcaggacaatttttctgaggaattaaagcggaataatcgaaaagtaaagcaagctgggtttatcgtcttacatcagacattcatgcctagtgtcttgattgaaactggttttcttaccaataaagctgaaggggcttttttaaattcaaaagccgggcaatctcaaatgggtacggcaattgctgaagcaattttaaaatataaaaattccgtacaaagtagtattgcggaacagccgcaaaagccaactaaaatagaagtagttcaaaagaaggatgaaccaaaagaaaaagaagtagctcaaaaggaaattgagatgaaagttgaaagtacaacacctcctattcaagaggaactaaaagaaacgatacctgtggttgtcaaaaaggagccagaggagaaagaggttgacataaccgtgattgaggcaccagnccagaaaaccgaaggagagacagagattgttgtacctatcgcaaaaaccgataaaccagttagtgaaccaaaagtgatttttaaagtacaaattatggccagtgcaaaggatttggatcttaaaccacaaaacttccagggtttgggaaggatttccaaagagccctttaanntn

SEQ ID NO: 21462 - protein, 294 aa, Unknown
  Obtained from environmental sample
  DOMAIN (1)...(160): N-acetylmuramoyl-L-alanine amidase
  misc_feature (1)..(294): Xaa is any amino acid
MIRLEKCDVYVSVHCDSHSSDANGAGTFVLGLHANKQNFEIAKKENSVIYLEDNYEDRYADYDINSPESIIGLTIMQEEFLDQSIALAKLVQDNFSEELKRNNRKVKQAGFIVLHQTFMPSVLIETGFLTNKAEGAFLNSKAGQSQMGTAIAEAILKYKNSVQSSIAEQPQKPTKIEVVQKKDEPKEKEVAQKEIEMKVESTTPPIQEELKETIPVVVKKEPEEKEVDITVIEAPXQKTEGETEIVVPIAKTDKPVSEPKVIFKVQIMASAKDLDLKPQNFQGLGRISKEPFXX

SEQ ID NO: 21463 - DNA, 702 bp, Unknown
  Obtained from environmental sample
  misc_feature (1)..(702): n is a, c, g, or t
ttgacggataacttgaccaactacattaacgatatcccacagctatttttatataatgccttttgcatcctatctaatgcctcagatactaagatagggagctttaccgcagattgggaaaacttctatccttggctaagggtggataacgagaaagaaaaagtagataagcagcagattgaaactcatggtaatagcatcgagtacttgcttgcagggctgtttaggcctgaacggctattagactacatcgaaaactttattctataccaaaacgaaaaagtaaaaattgtcgcccagaaccatcagttcttaggcgttaagcatgcttttgagaacttcctaattagagatcaattgcaggggcgtttgggcgtattttggcatacgcaaggttcaggtaagagctttgctatggtgttctttatccgtaaagtatttcgtaaatgtgcaggcaactttagttttgtcgtcatcactgacagagatgatttagacaagcagatatccaaaaacttcttggcgacggaggcggtaaaagaaacggagattgccaaaccgaagaatagtcatcagatgcgtgaaatgctaggtcagaatctgaaaatcgtttttacactcattcagaagttccgttatgagaagggtgagaagacccattactctatgataaggatgaaagagaagtcatcgttatcgtag

SEQ ID NO: 21464 - protein, 233 aa, Unknown
  Obtained from environmental sample
  DOMAIN (85)...(233): Type III restriction enzyme, res subunit
  misc_feature (1)..(233): Xaa is any amino acid
MTDNLTNYINDIPQLFLYNAFCILSNASDTKIGSFTADWENFYPWLRVDNEKEKVDKQQIETHGNSIEYLLAGLFRPERLLDYIENFILYQNEKVKIVAQNHQFLGVKHAFENFLIRDQLQGRLGVFWHTQGSGKSFAMVFFIRKVFRKCAGNFSFVVITDRDDLDKQISKNFLATEAVKETEIAKPKNSHQMREMLGQNLKIVFTLIQKFRYEKGEKTHYSMIRMKEKSSLS

SEQ ID NO: 21465 - DNA, 342 bp, Unknown
  Obtained from environmental sample
  misc_feature (1)..(342): n is a, c, g, or t
ttggaagtctttaagaggttaatttcgttttatggtggtttaaaatatcctgaagtatttggtaaaattggagcattgtcaacttctttttggttttcttctgataaaataaatgattttgcaagagaaaatggcaatcagcaaaactcacaaatttattttttagttggtggaaaagaaggagattctatggttcctgatactgaaaatatggcaaaattattggtagatttaggttttccagcagagaacattaaaactaaaattgttgctgaaggaaaacacacagaagctttttggaaaacagaatttttagaagtaattaaatttttatataactag

SEQ ID NO: 21466 - protein, 113 aa, Unknown
  Obtained from environmental sample
  misc_feature (1)..(113): Xaa is any amino acid
MEVFKRLISFYGGLKYPEVFGKIGALSTSFWFSSDKINDFARENGNQQNSQIYFLVGGKEGDSMVPDTENMAKLLVDLGFPAENIKTKIVAEGKHTEAFWKTEFLEVIKFLYN

SEQ ID NO: 21467 - DNA, 330 bp, Unknown
  Obtained from environmental sample
  misc_feature (1)..(330): n is a, c, g, or t
gtggcagataataaagataaacagatcattaccgttgatgtcgagaaatacgctcactttctggaaaactctgagctgagcgaagagcaaaaggccgagttcctacaagccatgtggtcaattatcgtcaactttgttgatctcggctttggtgttcatccggtgcaacaagtgctggatttaccctgtggaaaagataaaaatatttccagtaaagacacactcacagccacaaatgaagtatatttggatgatagaaaactttgcgatagttttataaactctgttgatcttgaaaaagaaaaaatcaaagaaaggatcaaaccatga

SEQ ID NO: 21468 - protein, 109 aa, Unknown
  Obtained from environmental sample
  misc_feature (1)..(109): Xaa is any amino acid
MADNKDKQIITVDVEKYAHFLENSELSEEQKAEFLQAMWSIIVNFVDLGFGVHPVQQVLDLPCGKDKNISSKDTLTATNEVYLDDRKLCDSFINSVDLEKEKIKERIKP

SEQ ID NO: 21469 - DNA, 432 bp, Unknown
  Obtained from environmental sample
  misc_feature (1)..(432): n is a, c, g, or t
gtgattgagagtttacaaatagacagctcagaaaaaggagttactatacataatgctttaagaaaagatgaagtattattaactaacacctcttatttagaaagtgtgttttataatttaatttctaatggcataaaatactctgatccgaataaaaaatctcaaatcattattcagtctgttcatactaaagacaccgttaagattctaatttcggataatggtattggtatagatatgagtaagttcaaaaataaaatatttgaaatgtaccaaacatttcatggcactgaaagaaatgattctagaggtatcggactttacatcaccaagactcaagtagatgctttgcatggagaaattcaaatagaaagtgtacttaatgaaggtacagcattctctctaacctttaagaaacaaaaagcaatttag

SEQ ID NO: 21470 - protein, 143 aa, Unknown
  Obtained from environmental sample
  DOMAIN (28)...(140): Histidine kinase-, DNA gyrase B-, and HSP90-like ATPase
  misc_feature (1)..(143): Xaa is any amino acid
MIESLQIDSSEKGVTIHNALRKDEVLLTNTSYLESVFYNLISNGIKYSDPNKKSQIIIQSVHTKDTVKILISDNGIGIDMSKFKNKIFEMYQTFHGTERNDSRGIGLYITKTQVDALHGEIQIESVLNEGTAFSLTFKKQKAI

SEQ ID NO: 21471 - DNA, 372 bp, Unknown
  Obtained from environmental sample
  misc_feature (1)..(372): n is a, c, g, or t
atgaaccatagactagttatatcctacatggaatatcaagatagaatgtatccaaattatatctattacgaaactccaaacttggtcaatgttggttataagccagtaggtaaaattgataaagaagaggaagcgctttttaataaagaagaacggttttattatacagtacaagaaattttgtttactgagataattcaagatcaagaacaagtgcaagcagctttaaatcaagactgggattcggatattttttctataaaaccttacgataaaacattttgggaaaactacaatacattactagaaagtgaagaagatgaaaagttaattaaggatttaactaaacgttccacactttttaaacaataa

SEQ ID NO: 21472 - protein, 123 aa, Unknown
  Obtained from environmental sample
  misc_feature (1)..(123): Xaa is any amino acid
MNHRLVISYMEYQDRMYPNYIYYETPNLVNVGYKPVGKIDKEEEALFNKEERFYYTVQEILFTEIIQDQEQVQAALNQDWDSDIFSIKPYDKTFWENYNTLLESEEDEKLIKDLTKRSTLFKQ

SEQ ID NO: 21473 - DNA, 420 bp, Unknown
  Obtained from environmental sample
  misc_feature (1)..(420): n is a, c, g, or t
ttgactcggctcgagaaaacaaacgtagtttcgaacaagctatcgttagtctgtccaactttaatattgaagaaaatgaaacaagataatattgaagaacaagtgataggtagcattagctcagagctcggagagtttatgatatcttggaacaaacttgaaagtaatattagaggctgggtcgatagcaaatatacagataatgaaataaaaaagaacacccctttctatatacttcttaagtttttacacaatagtgaggctattgattcatcattattttataaattggttagtttaaaggatagtcgtaatcgaatcgtccattttactaacgattactcaaagaaagatattgaagaaataaatataaatttgaagaatatgctgatacagtttaatgaatttattaagcaatag

SEQ ID NO: 21474 - protein, 139 aa, Unknown
  Obtained from environmental sample
  misc_feature (1)..(139): Xaa is any amino acid
MTRLEKTNVVSNKLSLVCPTLILKKMKQDNIEEQVIGSISSELGEFMISWNKLESNIRGWVDSKYTDNEIKKNTPFYILLKFLHNSEAIDSSLFYKLVSLKDSRNRIVHFTNDYSKKDIEEININLKNMLIQFNEFIKQ

SEQ ID NO: 21475 - DNA, 774 bp, Unknown
  Obtained from environmental sample
  misc_feature (1)..(774): n is a, c, g, or t
atgccgaattgtagtttactgatgtgttatggccagattttagaaaagaagatttttttgaagcaattctcgattaccagcaacgtgagaggcgctttggaaaaattagtgaacaaattgaaactgataatggataaactaaaagtcaaccttttactcttactattaacctttacagcatttattagtaaagcccaagaattaatccccgagataataaaatctaacgattccttaaccatcaatcagtctatagatacaattcctaagaaagagatttctataagtgatattaacttcagaaaagttaacacctatattcttggtggaatttcagttaaaggaaaccagcaattttctgatcaatctattacggttttttctgaattgattgttgggcagccaataaaaatacctggagataagcttactgctgccataaaaaaattatggaattcaaaacttttcagtaatgtagatgtttatgtagttaaaattgatgataataccatatatcttgaatttgaagttcaagaattatctaaattaagtacggtaacatttgaaggaataaaaaagaataaagcagctgatcttcaaaaagaaactgagtttcaaaaaggagccatgctaactgaaaatttaattacaacaactaaaaattatattaaaaaggaatatgtagacaaaggttatttaaggaccaaagtaacaataaatactaaaagtgatacaaccagtaacaatctcgagccgaattcttggatccattag

SEQ ID NO: 21476 - protein, 257 aa, Unknown
  Obtained from environmental sample
  misc_feature (1)..(257): Xaa is any amino acid
MPNCSLLMCYGQILEKKIFLKQFSITSNVRGALEKLVNKLKLIMDKLKVNLLLLLLTFTAFISKAQELIPEIIKSNDSLTINQSIDTIPKKEISISDINFRKVNTYILGGISVKGNQQFSDQSITVFSELIVGQPIKIPGDKLTAAIKKLWNSKLFSNVDVYVVKIDDNTIYLEFEVQELSKLSTVTFEGIKKNKAADLQKETEFQKGAMLTENLITTTKNYIKKEYVDKGYLRTKVTINTKSDTTSNNLEPNSWIH

SEQ ID NO: 21477 - DNA, 522 bp, Unknown
  Obtained from environmental sample
  misc_feature (1)..(522): n is a, c, g, or t
ttggatactattgataaaaaagacacctatagtgtttccatgctaggaagatcgttttttaatatggatagtttagaattggcaaaaaaatattttaaaaaattatcgattaaagacagagaagattataaggctcatacatttttagggcatatttctatgatggagaaaaattataaggatgctggttttcgatatatgatagctacttatgtgggtaaagaaaagcgagatgaagaatattttgggttaggaaccatgtatgttgaaaccaataaaattccagaggcaattaatgcttttaaagaagcatatgcagaaaacagaaaaaattataaggcattgtatcaaatagcaaagctttctgatgattattataaggataaaaaaatagcttataaagagtataaaaaatatatggaaacattttatagcagagatgaaatgatttctgtgtttgtagaacgcagaattaaagagatcaaaaaagactattttttggagggtaaaaccttagattaa

SEQ ID NO: 21478 - protein, 173 aa, Unknown
  Obtained from environmental sample
  misc_feature (1)..(173): Xaa is any amino acid
MDTIDKKDTYSVSMLGRSFFNMDSLELAKKYFKKLSIKDREDYKAHTFLGHISMMEKNYKDAGFRYMIATYVGKEKRDEEYFGLGTMYVETNKIPEAINAFKEAYAENRKNYKALYQIAKLSDDYYKDKKIAYKEYKKYMETFYSRDEMISVFVERRIKEIKKDYFLEGKTLD

SEQ ID NO: 21479 - DNA, 804 bp, Unknown
  Obtained from environmental sample
  misc_feature (1)..(804): n is a, c, g, or t
ttgtatcaactacaaggagcacaacaaaattatattaccaataccaaggttactaatggtgaattttctttgacaattccggaaaaatcctcaaaaggaatttatcgtttaatatatgacgtggaaaatagattgtttgttgattttatttatgataatgaaaatgtaacactctcctttgatacgaaatatccaaatcaatttactgaatttacagcatcagaaaataataaactatttaactcctatataaaaactatttcatcacatcaaaaaaaattagattctttacaagtaaggtatttcagttcatcaaataaagctgaccaagaaaacattgtcagatcatattataaaaattatacgacgataaatactttgcaagcaacttttgaagagcaagctcaaaataaattggtttatcattttattaaagcaagtgccagatttaatgcaacgaccccaataaaaagttcttctgagtacctaagttttattaaaaatcatttttttgacaacattgattttacaaatgaagccttgttaaattcgaccttcattaatgataagatcaatgattttattttttacttaaacacttctgaagaccagaaaatgctaactcaattacaaaaagaagccattgccaaggtcattactaaattaagtgttaataaaactttagctaaaaatattgaaaaaggccttttatatactttttcaaaacaagaaaacatagttatggtaacttatatgctcaagcattacttacattacctaaagagttgcagaagctggcttann

SEQ ID NO: 21480 - protein, 268 aa, Unknown
  Obtained from environmental sample
  misc_feature (1)..(268): Xaa is any amino acid
MYQLQGAQQNYITNTKVTNGEFSLTIPEKSSKGIYRLIYDVENRLFVDFIYDNENVTLSFDTKYPNQFTEFTASENNKLFNSYIKTISSHQKKLDSLQVRYFSSSNKADQENIVRSYYKNYTTINTLQATFEEQAQNKLVYHFIKASARFNATTPIKSSSEYLSFIKNHFFDNIDFTNEALLNSTFINDKINDFIFYLNTSEDQKMLTQLQKEAIAKVITKLSVNKTLAKNIEKGLLYTFSKQENIVMVTYMLKHYLHYLKSCRSWLX

SEQ ID NO: 21481 - DNA, 858 bp, Unknown
  Obtained from environmental sample
  misc_feature (1)..(858): n is a, c, g, or t
atgatattggcaacagccggaattatcaatgattctactatcataaattatggtgttgatttattgaaaacttggggattgcatgtgaaattaggtaactatttatatgaacaaaaccatcattttgcaggaactgataagcatagactagaagattttcaaaaggccattgacgatgacaacattaaagcgatttggtgtgcccgaggaggatatggaaccgtaagaattattgatgatattgatttcacgaaatttaaacaacatccgaagtgggttattggtttttctgatgttacagtcctacataatgagattcataatatgggaattgaaaccatccatgctataatgccttcaactttaaaaccaggcaacgaagagcaaaaaaaggctcaaaaatccttaaagaaagcattatttggcaagaaaattagatacagagtttcagaatctgattataataaagaaggggaagcaacaggtcaattggtgggcggaaatttgtccattttatacagtttgctgggttcaaaatcaacaatttcgttagaaaataaaattttatttattgaagatgtaggcgaatacgaatatcacatagacaggatgttgttaaaccttaaacggaatggctatttcgacaaatgtcacggattacttattggtggaatatctgacataagagaacatgatgtagcatttggtaaaacagtagacgacattgtactcgactgccgtaaagaatatgatttcccggttacgtttgaattcccggcagggcacattagagataatagggccttaatttacgcgcggcagatctcattaatggtcaaaggcaagaacgccgtnnca

SEQ ID NO: 21482 - protein, 286 aa, Unknown
  Obtained from environmental sample
  DOMAIN (67)...(134): LD-carboxypeptidase
  misc_feature (1)..(286): Xaa is any amino acid
MILATAGIINDSTIINYGVDLLKTWGLHVKLGNYLYEQNHHFAGTDKHRLEDFQKAIDDDNIKAIWCARGGYGTVRIIDDIDFTKFKQHPKWVIGFSDVTVLHNEIHNMGIETIHAIMPSTLKPGNEEQKKAQKSLKKALFGKKIRYRVSESDYNKEGEATGQLVGGNLSILYSLLGSKSTISLENKILFIEDVGEYEYHIDRMLLNLKRNGYFDKCHGLLIGGISDIREHDVAFGKTVDDIVLDCRKEYDFPVTFEFPAGHIRDNRALIYARQISLMVKGKNAVX

SEQ ID NO: 21483 - DNA, 336 bp, Unknown
  Obtained from environmental sample
  misc_feature (1)..(336): n is a, c, g, or t
atgggttttattttacattttcctatgaaaatatgtctggcgaagatttgttggaaaggcttttattttatggtatctctgcaatctcattatccattacaggaagtgaaaaaacggaaggacttagagcttgtgtttcccagactgatagctcacaattcaaagagttggaatatagattacaggcatttaataagcattattcttaaattcttgctaattttaattcaggnattaaaatcatccctgaactatgatcttttctggcgcccgttacactctttaaacagtttacctgattttccattccaaagaattcctaaaaaaagcaaaaaa

SEQ ID NO: 21484 - protein, 112 aa, Unknown
  Obtained from environmental sample
  misc_feature (1)..(112): Xaa is any amino acid
MGFILHFPMKICLAKICWKGFYFMVSLQSHYPLQEVKKRKDLELVFPRLIAHNSKSWNIDYRHLISIILKFLLILIQXLKSSLNYDLFWRPLHSLNSLPDFPFQRIPKKSKK

SEQ ID NO: 21485 - DNA, 306 bp, Unknown
  Obtained from environmental sample
  misc_feature (1)..(306): n is a, c, g, or t
gtgctttatttacttggcaatttgaagggcttccgggaagacaatgcttatattggcggcgagatcattccggaggaaaaccgggttacaggggtacatttttataaaagcattaaagacatgcctggtttccaggatatttatgagaaagccgaaaacaaagtattcgatatttatgagcaaggcaagaagctgactttttgcattaataacaagctgagcgatgcccacaccggaatactaccaacatatctagtgtggtgtctgctgggtatgctgatactgttttttgtcctattgacgtag

SEQ ID NO: 21486 - protein, 101 aa, Unknown
  Obtained from environmental sample
  misc_feature (1)..(101): Xaa is any amino acid
MLYLLGNLKGFREDNAYIGGEIIPEENRVTGVHFYKSIKDMPGFQDIYEKAENKVFDIYEQGKKLTFCINNKLSDAHTGILPTYLVWCLLGMLILFFVLLT

SEQ ID NO: 21487 - DNA, 657 bp, Unknown
  Obtained from environmental sample
  misc_feature (1)..(657): n is a, c, g, or t
atggcgtatgtaaccaacgtgttgccgtattatattagtgaatatgccaacaatggcccttgggaggaggagatgaccctgtgntcggttccaatagaacaaaccagctcagaaaaagcagagcaatatattaataattataattcttatatccgcacaaataccgcatctatgggagatctcgtatttttttggggtcaaaaacaagaacatacgcatacttggtttagtatctttgatgaagaagggcgaaaatctaaagtatattatagtttaaaatcactttggggatctcctgaaaatgaaaatgaatggccacctcaaatagactatatgctaattgataattggggttcaaaagacacattgatctataatgctaaagagattaaaaccgctcagattattatggatggtaagatagacactacctatcaactgaagtgggagattttcaaggaagggtggaactataggcaaaaaaagagcgagaagaggccagaagagattccgatggatgttatagatatggagggaaattctttaacattccgtactcctgacaaagaaggtccctatcggatttttgtttatgtctatgatctaaaaggaaattttgcgaccacaaacatccctttctacgtgttaaataaatga

SEQ ID NO: 21488 - protein, 218 aa, Unknown
  Obtained from environmental sample
  misc_feature (1)..(218): Xaa is any amino acid
MAYVTNVLPYYISEYANNGPWEEEMTLXSVPIEQTSSEKAEQYINNYNSYIRTNTASMGDLVFFWGQKQEHTHTWFSIFDEEGRKSKVYYSLKSLWGSPENENEWPPQIDYMLIDNWGSKDTLIYNAKEIKTAQIIMDGKIDTTYQLKWEIFKEGWNYRQKKSEKRPEEIPMDVIDMEGNSLTFRTPDKEGPYRIFVYVYDLKGNFATTNIPFYVLNK

SEQ ID NO: 21489 - DNA, 609 bp, Unknown
  Obtained from environmental sample
  misc_feature (1)..(609): n is a, c, g, or t
atgattggtaaaatgagaaaaaacggtactgataatgcttataaatgctctacaaaacaacgagatataaaaatttgtactaaatctagaggcttgtctatacctaaattagaaacctttgttattaaacatctatttgaaaatgttgggttaaaagaacttctattatcacttccacaagatgatgaccaaattcaaaccattaaaaacgaattaaagtatcatactaatcaattagaagatttaaaagttaaaaaagataactttataagagttatagatagtccgaaaaagctagatgatgctagttcaatagttcaacttttaaataagaatactagcaatattgaaacaaaaaaaagtgatataaacgctttaaataaacagctagaattattaaataaggaaaagcaaaaacaacatataaaagacactattgaaagctattcaaaagattataattttgaaactttacaaagagctgtaagagcattaatagagagtattaacattacatatgctggtagtaatattagagaatattatatttttattaagtatgttggaacctcaactataacacagtttaaacagaccataaggcactag

SEQ ID NO: 21490 - protein, 202 aa, Unknown
  Obtained from environmental sample
  misc_feature (1)..(202): Xaa is any amino acid
MIGKMRKNGTDNAYKCSTKQRDIKICTKSRGLSIPKLETFVIKHLFENVGLKELLLSLPQDDDQIQTIKNELKYHTNQLEDLKVKKDNFIRVIDSPKKLDDASSIVQLLNKNTSNIETKKSDINALNKQLELLNKEKQKQHIKDTIESYSKDYNFETLQRAVRALIESINITYAGSNIREYYIFIKYVGTSTITQFKQTIRH

SEQ ID NO: 21491 - DNA, 321 bp, Unknown
  Obtained from environmental sample
  misc_feature (1)..(321): n is a, c, g, or t
atgttagaaatagaacgtaaatttttggttaattcttcaagttataagtccgaagcttttaaacaaacccaaattatacaaggatttttaaatacccacaaagcgcgaactgttcgggttagagtaaaaggggataagggctatttaacggttaaaggtgagtcgtctagtaatgggctaacccgttttgaatgggagaaggaaataactaaaaaagaagccgaatcacttttgaatttatgtgagcctggtgtgattagcaaaataagatatgaggttaaagtagaggatcacatctttgaaatcgatgattttcagtga

SEQ ID NO: 21492 - protein, 106 aa, Unknown
  Obtained from environmental sample
  misc_feature (1)..(106): Xaa is any amino acid
MLEIERKFLVNSSSYKSEAFKQTQIIQGFLNTHKARTVRVRVKGDKGYLTVKGESSSNGLTRFEWEKEITKKEAESLLNLCEPGVISKIRYEVKVEDHIFEIDDFQ

SEQ ID NO: 21493 - DNA, 324 bp, Unknown
  Obtained from environmental sample
  misc_feature (1)..(324): n is a, c, g, or t
atggcaattgtcttcaataaaccacaaactattgtgcagttgttagcgcaacaacttacgattcctgaataccaaaggccctataaatggcagcctaagcacgttaatcagttaattgatgatatttttaatcaccgcactaagccgtgttatcgccttggtactgttgtattgcatcaagataaagaatcagtgaatgagaataaaaaacagacactgaatatcgttgatggccagcagcggctgctcactttaacgctgctttgcaccattcttgatggggctgagaaagctattgcatccactttactgaacataagttga

SEQ ID NO: 21494 - protein, 107 aa, Unknown
  Obtained from environmental sample
  misc_feature (1)..(107): Xaa is any amino acid
MAIVFNKPQTIVQLLAQQLTIPEYQRPYKWQPKHVNQLIDDIFNHRTKPCYRLGTVVLHQDKESVNENKKQTLNIVDGQQRLLTLTLLCTILDGAEKAIASTLLNIS

SEQ ID NO: 21495 - DNA, 519 bp, Unknown
  Obtained from environmental sample
  misc_feature (1)..(519): n is a, c, g, or t
atgaattctttgatttcattacagcagttaatttcaaaagacaccttttacgccaagataatgatcgaagccttgtctgaagaatttcatttgctgaccacgatgagtcgtaaaaaatttgttggtattcttgaagaaattgacatgtgtaagacacaccttcaaataatgagtatacaacataaagcagtttataaaatggtttgcaaaggtattagcggggatgaattaattcccccgccggttatccataccttggtagaaaacggtattactcatggctattcgggaactcaaaatgcttattttgagttaagtaaggttgaaaccaatactgaaattcaataccgcctatttaatgatagcatgctagaagatgctgtaagcaaaccaacaacaggtaccgggctcaagtacgttgaggcgcggttggaagaatgttaccccgacaggtggcaactgttttcaaacagaacagaaggaggttgggaagcgatcataaaaattgagaaacaatga

SEQ ID NO: 21496 - protein, 172 aa, Unknown
  Obtained from environmental sample
  misc_feature (1)..(172): Xaa is any amino acid
MNSLISLQQLISKDTFYAKIMIEALSEEFHLLTTMSRKKFVGILEEIDMCKTHLQIMSIQHKAVYKMVCKGISGDELIPPPVIHTLVENGITHGYSGTQNAYFELSKVETNTEIQYRLFNDSMLEDAVSKPTTGTGLKYVEARLEECYPDRWQLFSNRTEGGWEAIIKIEKQ

SEQ ID NO: 21497 - DNA, 300 bp, Unknown
  Obtained from environmental sample
  misc_feature (1)..(300): n is a, c, g, or t
atgaacagtacttcaatcaaaaaaaaggatgaaactaaaactttgctattgtcgaaatggcaattgttttggcattattttcttgggtttattccattgagtgttggaattatgaacctttattggctgattgaaatacataatactgaaaattataggggaatacggactgaaaaggaaatcataacttctattatagtttggttttcactagcattattagtttttataataaaaaaaagacgactgaattttgtgcgaattgacatttcccttgacgaatctgaattaagcacctga

SEQ ID NO: 21498 - protein, 99 aa, Unknown
  Obtained from environmental sample
  misc_feature (1)..(99): Xaa is any amino acid
MNSTSIKKKDETKTLLLSKWQLFWHYFLGFIPLSVGIMNLYWLIEIHNTENYRGIRTEKEIITSIIVWFSLALLVFIIKKRRLNFVRIDISLDESELST

SEQ ID NO: 21499 - DNA, 657 bp, Unknown
  Obtained from environmental sample
  misc_feature (1)..(657): n is a, c, g, or t
atgataggcatttttatagccgcacatgtatttttaaagccgagatcagatgaaaaagttcttaaaaagttaaataatttacatcataagccacacatttactataatttatataaagaatttacctataggntagtgggtatgcaaaaaaagttagatactactttgcctaccttagtttttgttcatggatcaccgggctcagtattagattatagccgttattttaaagattctttaataaatacaaaagcgaatatattggggtatgacagaataggttatggtgtaaataatgccggtgaagttaatggaacaatagcttttgaattagaaattttgcatgatgtaactaaagatataccttctgacaaaattatgttaataggatattcatatggtggtcctgtgatattagcttccccaaaacaatataagtacaaagtatctttagcaagttctataagtgcagatctggaacctatgttttggttgctaaacctttataaatggaagttaacaagaccgctacttccgaaattantaaaggcggcttctgaagaaaaatatgctcatttgtccgatttaccaaaatatgaagataaatggaatgtaagcccgtcacccattgtgatattcatggagatgatgacatga

SEQ ID NO: 21500 - protein, 218 aa, Unknown
  Obtained from environmental sample
  misc_feature (1)..(218): Xaa is any amino acid
MIGIFIAAHVFLKPRSDEKVLKKLNNLHHKPHIYYNLYKEFTYRXVGMQKKLDTTLPTLVFVHGSPGSVLDYSRYFKDSLINTKANILGYDRIGYGVNNAGEVNGTIAFELEILHDVTKDIPSDKIMLIGYSYGGPVILASPKQYKYKVSLASSISADLEPMFWLLNLYKWKLTRPLLPKLXKAASEEKYAHLSDLPKYEDKWNVSPSPIVIFMEMMT

SEQ ID NO: 21501 - DNA, 342 bp, Unknown
  Obtained from environmental sample
  misc_feature (1)..(342): n is a, c, g, or t
atgcaaccaagtgcattaatgtttatttctgttttagtcattggaagtttaagtgctattctgttttttacttatcaaagaaaatctgtatttcctaaaaaaacgaaaaatgagatatcggaaatgagtgacagaatggaaaattggaataaaaatttaggaaaatacccaactgaactaaatgaattaatcggaaatagtcctttaagacaaggttggaaaaaagacgcttggaatcgagaatatgaatttaagattacggaaaatagacaaggttttttaatcacttctgctggctctgacggaaaatttggaaccgaagatgatattaaatctaattaa

SEQ ID NO: 21502 - protein, 113 aa, Unknown
  Obtained from environmental sample
  misc_feature (1)..(113): Xaa is any amino acid
MQPSALMFISVLVIGSLSAILFFTYQRKSVFPKKTKNEISEMSDRMENWNKNLGKYPTELNELIGNSPLRQGWKKDAWNREYEFKITENRQGFLITSAGSDGKFGTEDDIKSN

SEQ ID NO: 21503 - DNA, 321 bp, Unknown
  Obtained from environmental sample
  misc_feature (1)..(321): n is a, c, g, or t
atggaagttatgatagaagaagcaaagaaaacatcttctggaacaagtatagatttgggaggagaaaaaagaacaaccaaagaattagaattgtttgatactaatagaaaaataaatactgatttaaaatatattgcgaacgaaaaatctagaaaatacgaagtcataaatgtaatttctaattttcagccaattggttatgagataaaaggagttacaaaaaattatgcgtttttattaggattattaggtgcaggtttaatggttggttttttactattgttacagttaaatagatatttagataattataaaaaataa

SEQ ID NO: 21504 - protein, 106 aa, Unknown
  Obtained from environmental sample
  misc_feature (1)..(106): Xaa is any amino acid
MEVMIEEAKKTSSGTSIDLGGEKRTTKELELFDTNRKINTDLKYIANEKSRKYEVINVISNFQPIGYEIKGVTKNYAFLLGLLGAGLMVGFLLLLQLNRYLDNYKK

SEQ ID NO: 21505 - DNA, 411 bp, Unknown
  Obtained from environmental sample
  misc_feature (1)..(411): n is a, c, g, or t
atggattacgcttttggtgagcaagcttttgaaactatggatgaattgttaaagccttatgaagctgataatgataaagttcatttggatgtgaaatcggtttcgattatgggtaaagctggtattttagaaggtggaaaaggagacattatgattcctactgcacatatttttgaaggaacagcagataattatccatttaaaaacgaattgaaaaaggaagatttagaaggttttggcgtaaaatcttttgatggttctatgatttctgttttaggaacatccttacaaaataaagatttgttgaaattttttcacgattctacttggaatgtaattggtcttgaaatggaaggagcacattatcaaaaagcaatacaatctgcctcaaacattagaggaaatatttct

SEQ ID NO: 21506 - protein, 137 aa, Unknown
  Obtained from environmental sample
  misc_feature (1)..(137): Xaa is any amino acid
MDYAFGEQAFETMDELLKPYEADNDKVHLDVKSVSIMGKAGILEGGKGDIMIPTAHIFEGTADNYPFKNELKKEDLEGFGVKSFDGSMISVLGTSLQNKDLLKFFHDSTWNVIGLEMEGAHYQKAIQSASNIRGNIS

SEQ ID NO: 21507 - DNA, 414 bp, Unknown
  Obtained from environmental sample
  misc_feature (1)..(414): n is a, c, g, or t
ttgttcgttgatatggtaaagtaccctaagtatatttttacaccagagacattggggtattatgatttttcctttgacacatcgactcgtgtaaatgaccaattaatttatgttatcgactttaaacagaagccaggaattattgacccagtatacaatggcaaactatatatagatgcagaaaaccaaattctaacaagcgccatttattctcttaacattacagataaaaaactagcttctcaaatgttcgtacgtagaaaaccaaagaatgcagaggtgtgtccgacagaagtatcttaccgagtagattatagagaaaaggacgggaaatggtactatggttacagtaatgtattgttagaatttaaatcaactgggataaacgtctgtttaattctgtttatagtatga

SEQ ID NO: 21508 - protein, 137 aa, Unknown
  Obtained from environmental sample
  misc_feature (1)..(137): Xaa is any amino acid
MFVDMVKYPKYIFTPETLGYYDFSFDTSTRVNDQLIYVIDFKQKPGIIDPVYNGKLYIDAENQILTSAIYSLNITDKKLASQMFVRRKPKNAEVCPTEVSYRVDYREKDGKWYYGYSNVLLEFKSTGINVCLILFIV

SEQ ID NO: 21509 - DNA, 828 bp, Unknown
  Obtained from environmental sample
  misc_feature (1)..(828): n is a, c, g, or t
ttgaacggaaaagaattcatttataaatcagataattcaaagatcttagaagctgatagttttacgtggaaagcaccaagtaatatcgccttggtgaaatattgggggaaacgtgatgtacaaatacctggaaacccttcgataagctttaccttatctaattgctttacggaaactaccttagaatttaaaaagagggaaaaatcggctgaagtttccgaactatattgtgacgatgatttgaaacaaattcttactcaaagagaatgtaaatgggatatttttttagatggcaaaagaaaaccagaatttagaaaaaagataagtgaatttataataagaattgctaggctagtctcttttcttaatgattacgacttagtcattaagacgcataactcttttccacatagcagtggtattgcttcttcggcgagcggtatggctgcgttagcattgtgtataatgagtatggaaaaagcactgaatccatcaattactgacgaattattttataaaaaagcttcttttttagcgcgcttaggttctggcagcgctgctagaagtataaaaggcgaattggttgtttggggagagcataaagaaattaaagctagttctgattggtacggtgttaaattcccacacaaaattcatgataattttaaaaattatcacgatactattttattagttgatgaaggtgaaaaacaagtgtcgagtactgttggtcataatttaatgcatgaacatcctttttcagaaaaacgatttgagcaagctaatgaaaacctgtcaaaaatctcgagccgatctgtngaccactag

SEQ ID NO: 21510 - protein, 275 aa, Unknown
  Obtained from environmental sample
  misc_feature (1)..(275): Xaa is any amino acid
MNGKEFIYKSDNSKILEADSFTWKAPSNIALVKYWGKRDVQIPGNPSISFTLSNCFTETTLEFKKREKSAEVSELYCDDDLKQILTQRECKWDIFLDGKRKPEFRKKISEFIIRIARLVSFLNDYDLVIKTHNSFPHSSGIASSASGMAALALCIMSMEKALNPSITDELFYKKASFLARLGSGSAARSIKGELVVWGEHKEIKASSDWYGVKFPHKIHDNFKNYHDTILLVDEGEKQVSSTVGHNLMHEHPFSEKRFEQANENLSKISSRSVDH

SEQ ID NO: 21511 - DNA, 423 bp, Unknown
  Obtained from environmental sample
  misc_feature (1)..(423): n is a, c, g, or t
atgagaaatttaaaaaactatacgactatactttttagcttagttttacttgtaagcattacgtcttgtaaaaaagaaaaggaagctattgctcctgttgaagtaaactttaaaaaggaaggagagttaactttgtttaaagggactacagatactattattaaggtttttaacatagaggttgctaaaacagattacgaaatccaaacaggcttgatgtatcgtgatagtatgaaagatgatcaaggtatgttgtttgcttttaatgacgtacaaatgcgatcattttacatgaaaaacacgcgtataccattggaccttatcttttttgatcataataaaactattgttagttttcaggaaaacgcaaaaccaatggatcaaagcagcttaccatctaatactcctgcacaatttgtgctn

SEQ ID NO: 21512 - protein, 141 aa, Unknown
  Obtained from environmental sample
  DOMAIN (47)...(141): Uncharacterized ACR, COG1430
  misc_feature (1)..(141): Xaa is any amino acid
MRNLKNYTTILFSLVLLVSITSCKKEKEAIAPVEVNFKKEGELTLFKGTTDTIIKVFNIEVAKTDYEIQTGLMYRDSMKDDQGMLFAFNDVQMRSFYMKNTRIPLDLIFFDHNKTIVSFQENAKPMDQSSLPSNTPAQFVL

SEQ ID NO: 21513 - DNA, 615 bp, Unknown
  Obtained from environmental sample
  misc_feature (1)..(615): n is a, c, g, or t
atgaagactttatttcaagaagttattttgccaaacctttgttatattggaggtggaggagaaatggcttattggttggaactcaaagattattttaacaaagttgatgttccttttcctattttattgttgagaaattctgtgcaaattatatcagaaaaacaagctggtaaattagaaaaactaaacattacaaaagaagagattttcttgaatcagtttgaattattatcgcaaaaagtaattgaaaattctgatattgaaactgattttagtggtaaaattgattttttgaaaaatcaatttaaggacttaaaagtagttgctgaaaaaacggatgtttcttttataaacgctgtaaatgcacaagaaagaaagcaaataaaaggtttagagaatcttgaaaaacgtttgttaaaagccgagaaaaagcgtcaaaaagatttagtagatcgaattacaatcattcaaaatgagttgttacctaatgaatctttagaagagcgtcagcgaaatttttctgaatattatttagaatatggccgtaattttatcatcaacctaaaagaagctttaaaaccattagagctggagtttactattttagaattgtaa

SEQ ID NO: 21514 - protein, 204 aa, Unknown
  Obtained from environmental sample
  misc_feature (1)..(204): Xaa is any amino acid
MKTLFQEVILPNLCYIGGGGEMAYWLELKDYFNKVDVPFPILLLRNSVQIISEKQAGKLEKLNITKEEIFLNQFELLSQKVIENSDIETDFSGKIDFLKNQFKDLKVVAEKTDVSFINAVNAQERKQIKGLENLEKRLLKAEKKRQKDLVDRITIIQNELLPNESLEERQRNFSEYYLEYGRNFIINLKEALKPLELEFTILEL

SEQ ID NO: 21515 - DNA, 333 bp, Unknown
  Obtained from environmental sample
  misc_feature (1)..(333): n is a, c, g, or t
ttgattctaaagtgtcttgagcctctgtttctgacaatctttgttttcataatcataaaaatttatcaactggaagcaattattttaagcgcacaacagtacaaggaattagtaaatcgtttagatgttctaaacaagaaactagaagaaaaacaaaagtcaccaaacgacacatttctagacaatcaagagtttctacagctaatgaatcattcagcaaaagaacagcacaatcctggagagatgaaggaaaagtgtcatctttctcaaataggttcaaaaatttattcacagaatgagcgatgtacaaaagcttttagacaaaaactataa

SEQ ID NO: 21516 - protein, 110 aa, Unknown
  Obtained from environmental sample
  misc_feature (1)..(110): Xaa is any amino acid
MILKCLEPLFLTIFVFIIIKIYQLEAIILSAQQYKELVNRLDVLNKKLEEKQKSPNDTFLDNQEFLQLMNHSAKEQHNPGEMKEKCHLSQIGSKIYSQNERCTKAFRQKL

SEQ ID NO: 21517 - DNA, 522 bp, Unknown
  Obtained from environmental sample
  misc_feature (1)..(522): n is a, c, g, or t
atgaattgcggttatcatctaaatccctataaaaatggatatgctaaagacaatacgattaagagtgattttaactatcaaacaattaaaccaacagtgaaaccaaaacgagtatgtattccaaaggatgtattttacaaaacaagaaaagaatatgaaataaatacctttatacaaaatttactaaacaatatcgcattcccatttgagtcagaagatattgaaaaaataatagcacaatatcatctaggtacaataacaaaaggctatcgtaaaggagcaacaacatttccatttattgatatagataataatgtaagggcaatccaagtaaagcaatttgataagcacaaccatacaataggtacagattttttacactcaataatagaaaagcattacaagcgtaataatcaacaaatccctaattggctaaagggttacaataaaaacgaaactaaagtttcttgtttattcggagagcatctattaagtaaatatcctttaatcctgttgcattag

SEQ ID NO: 21518 - protein, 173 aa, Unknown
  Obtained from environmental sample
  misc_feature (1)..(173): Xaa is any amino acid
MNCGYHLNPYKNGYAKDNTIKSDFNYQTIKPTVKPKRVCIPKDVFYKTRKEYEINTFIQNLLNNIAFPFESEDIEKIIAQYHLGTITKGYRKGATTFPFIDIDNNVRAIQVKQFDKHNHTIGTDFLHSIIEKHYKRNNQQIPNWLKGYNKNETKVSCLFGEHLLSKYPLILLH

SEQ ID NO: 21519 - DNA, 636 bp, Unknown
  Obtained from environmental sample
  misc_feature (1)..(636): n is a, c, g, or t
ttgaatttatttttagatgaagtcggtaatctatcatacgagaatcaaatacagctattacgggcattgcacgaaagaaagattaacagaataggaagtaatactgaaatagatgtagatgttagaattttatctgctaccaacgaggatttaaaagtagcggtagagaagggtacttttcgggaagatctgtatcaccggttaaatgaattttcattacaaatacccgcattaaaaaacagacatggagatttacctatattggcatcacactttttagaaaagttcaataagaagttaaataaacaaataaccgatttttcagatgaggtttgggacattttcaatgcatatcattggccaggaaatataagggagctacagaatgtaattcagcgtgcagtactattaacgacaaccagtaaaattgaggcaaaggcattgccgtcagagttcatgaatccagttttagaatctgtggaaataggaagtctttcaaaagcagattttgagaaagagcagattataaatgctttaaaacgtaccaattacaataagtctaaagcggctaagctattacaagtaactagaaaaacactctataacagaatcaactattaccatttggatttataa

SEQ ID NO: 21520 - protein, 211 aa, Unknown
  Obtained from environmental sample
  DOMAIN (167)...(207): Bacterial regulatory protein, Fis family
  misc_feature (1)..(211): Xaa is any amino acid
MNLFLDEVGNLSYENQIQLLRALHERKINRIGSNTEIDVDVRILSATNEDLKVAVEKGTFREDLYHRLNEFSLQIPALKNRHGDLPILASHFLEKFNKKLNKQITDFSDEVWDIFNAYHWPGNIRELQNVIQRAVLLTTTSKIEAKALPSEFMNPVLESVEIGSLSKADFEKEQIINALKRTNYNKSKAAKLLQVTRKTLYNRINYYHLDL

SEQ ID NO: 21521 - DNA, 642 bp, Unknown
  Obtained from environmental sample
  misc_feature (1)..(642): n is a, c, g, or t
atgattataaaaaacaaaatcactacactttttgcttttgtgttaataacgtgtatgccgctaactacaacggcacaagacaaggtaaaacccatatttgaaaatggagaagctcaaattgttaaagaattcggcactttaaaagactggattcgtcacgatctttgggtagaaaccgaaaccaataccgatggcgacgaccaactagaccgcgtgcacgtgtcggtaacacgaccacaacaaacagaaactgaaggtttaaaactacctgtcgtttatgttacaagtccttattttgcaggtgttgcaccagatatcgatggtattatgtgggatgtaaaacacgaattgggagaacaacctacaaaaaaacgtgtgcatccagaagttaaacgcttagggcaacgcccaataatttctaattctcacattttaaaatgggtaccacgcggttatatcgtcgtgcattcgtcttcaccgggaacaggtttatcgcaaggtgcacccacgttaggaggagaaaatgaagccttagctccaaaagctgtgatacaatggcttaacggtaaagcaaacggctatacaacgccagacggtgatgaaaaagttgaagcatattggtctaccggaaaagtggtatga

SEQ ID NO: 21522 - protein, 213 aa, Unknown
  Obtained from environmental sample
  misc_feature (1)..(213): Xaa is any amino acid
MIIKNKITTLFAFVLITCMPLTTTAQDKVKPIFENGEAQIVKEFGTLKDWIRHDLWVETETNTDGDDQLDRVHVSVTRPQQTETEGLKLPVVYVTSPYFAGVAPDIDGIMWDVKHELGEQPTKKRVHPEVKRLGQRPIISNSHILKWVPRGYIVVHSSSPGTGLSQGAPTLGGENEALAPKAVIQWLNGKANGYTTPDGDEKVEAYWSTGKVV

SEQ ID NO: 21523 - DNA, 825 bp, Unknown
  Obtained from environmental sample
  misc_feature (1)..(825): n is a, c, g, or t
atggtgcctaatggttgggaggttaaaaagctagaagatgtagtctctaagactagaaaaataacatacggaatagttgtgccaggtccttatgaacctaatggaaatttgatgattcgggcgaaagattattcttttggatggcaacctatagagagcatctatcgtgtttctgaccaaatgcatcagtcttataaaagatctaaagttcgaaaaggagatgtgctactaactatagttggtagtattgggaatacagctatagtgcctgaagatttagaaggtgcgaatataacgcaacagacagctagactatcttttgacgaacacgatgctaattttttctactcggtaatgagttcaggaattggtaaaaaagaaatttatcgttatgcaaaatctggcgtacaaccttctttaaatttggctgatattgctaaatttaaagtaccagttccacccttttcaagaaccaacaaaaaatcgntaaaatcctatccacttgggataaagcgattaagcaccaccgagcgcctgatcgataaccagcactcaggcagaaaaaagcttggaatgccgcaattactaccgggtaaaaagcgtttgtttgatgatgatcagaaccggtttgaaggtgcatgggcacacggtcaattggccagcagtgcctcaatcaccatgggttcctctccaaaatcccgagttctaatgacgttaaggacggttacccttggtcaccagggtatcgccattttcaaattcaaaaccgtcccaagagtgttaccccccaaatactcaaaacttgccttggccacaattatngtn

SEQ ID NO: 21524 - protein, 275 aa, Unknown
  Obtained from environmental sample
  DOMAIN (6)...(159): Type I restriction modification DNA specificity domain
  misc_feature (1)..(275): Xaa is any amino acid
MVPNGWEVKKLEDVVSKTRKITYGIVVPGPYEPNGNLMIRAKDYSFGWQPIESIYRVSDQMHQSYKRSKVRKGDVLLTIVGSIGNTAIVPEDLEGANITQQTARLSFDEHDANFFYSVMSSGIGKKEIYRYAKSGVQPSLNLADIAKFKVPVPPFSRTNKKSXKSYPLGIKRLSTTERLIDNQHSGRKKLGMPQLLPGKKRLFDDDQNRFEGAWAHGQLASSASITMGSSPKSRVLMTLRTVTLGHQGIAIFKFKTVPRVLPPKYSKLALATIXV

SEQ ID NO: 21525 - DNA, 546 bp, Unknown
  Obtained from environmental sample
  misc_feature (1)..(546): n is a, c, g, or t
ttgcctaaagttgttgaaaatattagagagaatattattaaatatggaggtgaagttcattttgaaagtcgggtaacagatttcactattaaaaataaaaacattacggctattcaattgcaagatggtaacgagttacaggtagataaagtaattttagccacgggccattctgctagagatattttctatttactaaacgataaaaaaataaagcttaaggcaaagtcgtttgccatgggtgtacgtgtagaacatcctcaagacattatagatggtattcagtaccattgcaaaggacagcaacgcgatgaattattacctgcagcatcttatagcttggtggagcaaattaatcacagaggtgtgtattccttttgcatgtgtcctggtggttttattgtaccagcagcaactgcaaatggtgaagttgtagtcaatggtatgtcaccttctaagcggaataataagttcgcgaattcaggcatcgttacagaaattaatgtcgataaagacctctataaatatgagcaatttggccctttn

SEQ ID NO: 21526 - protein, 182 aa, Unknown
  Obtained from environmental sample
  misc_feature (1)..(182): Xaa is any amino acid
MPKVVENIRENIIKYGGEVHFESRVTDFTIKNKNITAIQLQDGNELQVDKVILATGHSARDIFYLLNDKKIKLKAKSFAMGVRVEHPQDIIDGIQYHCKGQQRDELLPAASYSLVEQINHRGVYSFCMCPGGFIVPAATANGEVVVNGMSPSKRNNKFANSGIVTEINVDKDLYKYEQFGPX

SEQ ID NO: 21527 - DNA, 363 bp, Unknown
  Obtained from environmental sample
  misc_feature (1)..(363): n is a, c, g, or t
gtgccctcaatacatgaggttatccaattgaatatgaaatatgatttagtcataatagatggggcgaatgataatttagtcgacctcaaaaatcaattaagtaggaatgcaatttttgtaatagaaggtgatagaaaaccacaagaattagagattaaatctatttttccttcttcgcgatttgtaagtatgttaagttatcgaaaaaatcatgcattgagtaatcgtgaccctttacattggcaaggcggtattaaggtcttttttatagaaccttcaatgaagcaggagttattttgggttatagaaaagatcaaaactaaatatgcttatttttatcgtagaaatatttatggaaagtga

SEQ ID NO: 21528 - protein, 120 aa, Unknown
  Obtained from environmental sample
  misc_feature (1)..(120): Xaa is any amino acid
MPSIHEVIQLNMKYDLVIIDGANDNLVDLKNQLSRNAIFVIEGDRKPQELEIKSIFPSSRFVSMLSYRKNHALSNRDPLHWQGGIKVFFIEPSMKQELFWVIEKIKTKYAYFYRRNIYGK

SEQ ID NO: 21529 - DNA, 618 bp, Unknown
  Obtained from environmental sample
  misc_feature (1)..(618): n is a, c, g, or t
ntnagcccaattagagatgtcttcgcaagttttacacaattaaataattttcaagcctacaaaggtccaggattaggattagcaattgccaagcatttagtaagcttaacacatagcaaaattagtgtagacagtacagaaggggaaggtagcacgttttctaccaatatcaattttagcttagatgaaaaccatacactaaagactcaaaagaaagacgctataacttcaccacgatcaaatgaaaaatacagtattttattagttgaagattcagaaattactcgattatccatactaaaaatattagcctctagaggtaattactttttagacatagtaacaaaaggagaagacgttattccaagaatagaaaactctgagtttgacctaatacttatggatataaaattacctaatagttatggtgacgagattaccaaactaattagaagaatgccagaacgcgaacataaaaaaatcccagtaattgcgttaaccgctcgtgttatgaaagacgacttaaaacgctataaaaaagcaggaattaacgatgttatccaaaaaccatttgacgaaaacgccttaattaccaaaatagaagaatatttaaaataa

SEQ ID NO: 21530 - protein, 205 aa, Unknown
  Obtained from environmental sample
  DOMAIN (84)...(205): Response regulator receiver domain
  misc_feature (1)..(205): Xaa is any amino acid
MSPIRDVFASFTQLNNFQAYKGPGLGLAIAKHLVSLTHSKISVDSTEGEGSTFSTNINFSLDENHTLKTQKKDAITSPRSNEKYSILLVEDSEITRLSILKILASRGNYFLDIVTKGEDVIPRIENSEFDLILMDIKLPNSYGDEITKLIRRMPEREHKKIPVIALTARVMKDDLKRYKKAGINDVIQKPFDENALITKIEEYLK

SEQ ID NO: 21531 - DNA, 642 bp, Unknown
  Obtained from environmental sample
  misc_feature (1)..(642): n is a, c, g, or t
nnagcagattatgtattaaccattaacaatctagaaaactttaaaagtaacataaccaataatcattttatagatcaattatctaacacaaggtcttataaaaacatttgtgagaaactagaattattaaaccaaataaaaagcaaacaaaaggtttacgtcaatctgtttaaagataaaaaggatagtttacaatatagttttgttactaaattaaatgatactgtttttaatcttgatagtttaaagattaaacgagagcctataaagttaaaagggttatctgctgaaaaaatcacaaataaaaatcaaataatttatgtttctacagttggaaacctacttataggagctaataatcttgatcatttgcaacacttaataaatagtaaacctgacaaaaattcgattaaaaaaataatagctactcaagataaagaggcatcgttttcagtatacacaaacaccaaaattggcttaaacagcatgtttgttaacaaaaacgtgctatctaaaaactttacggattacttgacgtttgatacagaaataggtcaaaaccaattaattttaaacggaatcactaaagcttctgacacgacaaacaagttgcaaacgctcgaccgattcttgatccactag

SEQ ID NO: 21532 - protein, 213 aa, Unknown
  Obtained from environmental sample
  misc_feature (1)..(213): Xaa is any amino acid
MADYVLTINNLENFKSNITNNHFIDQLSNTRSYKNICEKLELLNQIKSKQKVYVNLFKDKKDSLQYSFVTKLNDTVFNLDSLKIKREPIKLKGLSAEKITNKNQIIYVSTVGNLLIGANNLDHLQHLINSKPDKNSIKKIIATQDKEASFSVYTNTKIGLNSMFVNKNVLSKNFTDYLTFDTEIGQNQLILNGITKASDTTNKLQTLDRFLIH

SEQ ID NO: 21533 - DNA, 318 bp, Unknown
  Obtained from environmental sample
  misc_feature (1)..(318): n is a, c, g, or t
gtggtttcaggcaagttaccggccaattttcttctagatcttgctgaattttgtcgttcatccagtaacaacttgtttaacccttttaacgaggaggtaattcccataatagtatgtgcaaaaggaacccctacgttccttaatacagtagagtcagttagatctcgctgcaaacgagaaataggtagtctagctgataaatgttcaaaaattgcattcgctattcccaaattacttcagaatttcaaagtcgatcggattcacttatgtggcatagctgaagaactacttcactttttaattttctgtttaaagtag

SEQ ID NO: 21534 - protein, 105 aa, Unknown
  Obtained from environmental sample
  misc_feature (1)..(105): Xaa is any amino acid
MVSGKLPANFLLDLAEFCRSSSNNLFNPFNEEVIPIIVCAKGTPTFLNTVESVRSRCKREIGSLADKCSKIAFAIPKLLQNFKVDRIHLCGIAEELLHFLIFCLK

SEQ ID NO: 21535 - DNA, 318 bp, Unknown
  Obtained from environmental sample
  misc_feature (1)..(318): n is a, c, g, or t
atgacaccaggaatacaattagttattgctagaaaaggtaaagtgatttataataaaacctttggtaaacatacttatgaaggttcgactaaagtagaatctgatgatatttatgacattgcgtctttaactaaaattgtagctacattaccattattaatggagttagaagagcaaggtattgtgtctttagatactaaactttcagagattataccgtcttataaaaattcaaataaaaaaaatgtgactttaaaaaagatgttgtcacattacgcccaattaaaaccatggattcctttttattataaactttag

SEQ ID NO: 21536 - protein, 105 aa, Unknown
  Obtained from environmental sample
  misc_feature (1)..(105): Xaa is any amino acid
MTPGIQLVIARKGKVIYNKTFGKHTYEGSTKVESDDIYDIASLTKIVATLPLLMELEEQGIVSLDTKLSEIIPSYKNSNKKNVTLKKMLSHYAQLKPWIPFYYKL

SEQ ID NO: 21537 - DNA, 609 bp, Unknown
  Obtained from environmental sample
  misc_feature (1)..(609): n is a, c, g, or t
ttgcatattatagaatttgaccacgacaaaaaagcagataaaatagtatttaatgtggtgtcttcaaaccttaaagacctaaaattcagcaaaaaagaattattatcattttctgaagacaacatgcaaaagtattttggaataggcatttttcccatttttataaataacttttctcaaatggatggaaaccatatgggagaagtaattatgtctaaaaacaatgcgttttttgctatcaactttgactttaacaataaagataaagagacccacaaaatatttgttttcaatactaattttgaaagcgtttatgataaattaatagaaaaagatattaaggacaaattgtttgaatacaatagtattgatgtcgatgacaaagacggaaccgtttactttttagggaaagcttttgaaaacaactccagaaagtctaagaaaaaaggtgaagctaattaccactttgaattactaaaagtaaatgcagatggacaaaaaacaacagcgtttaaaaaggcagataaatttatctcgtcaatggagttaatcaaaacagaggacagattatcatgtgtcgttttctcgagccgattcttggatccatga

SEQ ID NO: 21538 - protein, 202 aa, Unknown
  Obtained from environmental sample
  misc_feature (1)..(202): Xaa is any amino acid
MHIIEFDHDKKADKIVFNVVSSNLKDLKFSKKELLSFSEDNMQKYFGIGIFPIFINNFSQMDGNHMGEVIMSKNNAFFAINFDFNNKDKETHKIFVFNTNFESVYDKLIEKDIKDKLFEYNSIDVDDKDGTVYFLGKAFENNSRKSKKKGEANYHFELLKVNADGQKTTAFKKADKFISSMELIKTEDRLSCVVFSSRFLDP

SEQ ID NO: 21539 - DNA, 321 bp, Unknown
  Obtained from environmental sample
  misc_feature (1)..(321): n is a, c, g, or t
atggttattaaagtaccaaacaccattgggtctcacgttgcaacgtatgttacagactacaaactaaaaggaaaagatacacgtgtaacatctgcagacatcagtcctgatggctctaccattatactattaaatcatgatagaatttggaaacttacaagctttaaatccgatgctttttttgatggtaatgtagagagcatctcattaaatcatgatagtcaaaaagaaggtgtttgctttataaataacacgtctatttatattacagacgaagactctggtaaagaagataataacatttataagtttaaattatag

SEQ ID NO: 21540 - protein, 106 aa, Unknown
  Obtained from environmental sample
  misc_feature (1)..(106): Xaa is any amino acid
MVIKVPNTIGSHVATYVTDYKLKGKDTRVTSADISPDGSTIILLNHDRIWKLTSFKSDAFFDGNVESISLNHDSQKEGVCFINNTSIYITDEDSGKEDNNIYKFKL

SEQ ID NO: 21541 - DNA, 696 bp, Unknown
  Obtained from environmental sample
  misc_feature (1)..(696): n is a, c, g, or t
gtgattggaactgaccctgatgcagacaggttaggaatcgcagttcgtgacctgaatggaaacatgaaattgctgaacggtaatcaatccatgagtgtgatgactaattttttgataaagcaatggtatgaaagtggcaggctgaatggtaatcaatttgtaggatcgacaattgtttcaacaaatttggtaaatgatatagcaaaaaattataatgttgaaaccaaagtaggtctgactggctttaagtggatcgccaaaatgattcgtgatgcagaaggtaaacaagagtttattggaggcggtgaagaaagtttgggatacatggtgggtgattttattcgtgacaaagatgctattacagctacccttttggcttgtgaaattgcgatagacgccaagaacaacaattctaccatatataaggtttggttaaatctctataggaaatatggtttttataaagagcatctaatctctttagtgaaaaaaggaattgacggtgctgagcagatcaaacaaatgatgatcgatcttagaaaaaacccgatagaagaaatctacggatcaccggtaaatttggtatatgattatgatacttctgtctgccataatttattgacaggtgaaaagactgatatagacataccaaaatctaattgtctgatatatcaaacagtgatggtaccaaagtaa

SEQ ID NO: 21542 - protein, 231 aa, Unknown
  Obtained from environmental sample
  misc_feature (1)..(231): Xaa is any amino acid
MIGTDPDADRLGIAVRDLNGNMKLLNGNQSMSVMTNFLIKQWYESGRLNGNQFVGSTIVSTNLVNDIAKNYNVETKVGLTGFKWIAKMIRDAEGKQEFIGGGEESLGYMVGDFIRDKDAITATLLACEIAIDAKNNNSTIYKVWLNLYRKYGFYKEHLISLVKKGIDGAEQIKQMMIDLRKNPIEEIYGSPVNLVYDYDTSVCHNLLTGEKTDIDIPKSNCLIYQTVMVPK

SEQ ID NO: 21543 - DNA, 702 bp, Unknown
  Obtained from environmental sample
  misc_feature (1)..(702): n is a, c, g, or t
ttgaccgataagagatatgccattgaaaaactaagttttgaaactaatataaactttcagaatatctcatttaaatatgaagacgaatacgtattaaaagacttttctctcaaaattcctaaaggaaaaactgtagccttagtagggcaatctggaagtggaaaatctaccctggcaaatttaattacacgtttttatgatatcaatagcggtgagattttaattgatggaattgatatacgtgatttaacgaaaaaatctctaagaaatcaattaggtattgtaacacaagatgccattctatttaatgatactgtaaaaaacaatgtgttattaggtatgcaagacgccacagatgaacaagtgatcgaagccctgaaaattgccaacgcgtatgaatttgttgaaaatttaccaaaaggtattgataccaatatcggtgacagcggtaataagttgtctggagggcaaaaacagcggttaagtattgccagagctgtactcaaaaatccgccaattatgattttagacgaagcgacctctgccttagataccgaatcagaacaattagtacaaaaagccctagagcatctaatggaaaatagaacatcattagttattgcgcatcgcttatcaaccattcaaaaagccgataccatagtggtgatacaaaagggaacaatagtagacaaggaaacatga

SEQ ID NO: 21544 - protein, 233 aa, Unknown
  Obtained from environmental sample
  DOMAIN (42)...(226): ABC transporter
  misc_feature (1)..(233): Xaa is any amino acid
MTDKRYAIEKLSFETNINFQNISFKYEDEYVLKDFSLKIPKGKTVALVGQSGSGKSTLANLITRFYDINSGEILIDGIDIRDLTKKSLRNQLGIVTQDAILFNDTVKNNVLLGMQDATDEQVIEALKIANAYEFVENLPKGIDTNIGDSGNKLSGGQKQRLSIARAVLKNPPIMILDEATSALDTESEQLVQKALEHLMENRTSLVIAHRLSTIQKADTIVVIQKGTIVDKET

SEQ ID NO: 21545 - DNA, 618 bp, Unknown
  Obtained from environmental sample
  misc_feature (1)..(618): n is a, c, g, or t
ttggcttattgtctaagtgcagatagtgttaccatctggaaagatgtacctggtgttttaaatgcagatcctagacactttaaaaatgcacaattattaaacgccatatcatatacagaagctattgagctggctttttatggtgcttcagtaatacatcctaaaacattacaaccactgcaacgtaaagaaataccgttgtacgttaaatcgtttttacaaccaaatgaagatggaacaatagttagtaaaattaaaggaattgagccaaaagtaccctgttttatagtaaagcaaaaccaagtcttattatcattatctactttagacttttcctatattgtagaagataatattagcgaaatatttaatttgctatcaaaatataaaatgaaagttgatgttatccaaaactctgcgattagtttttctgtttgttttgataataattacaataatttagaacctttattgttacatttaaaagctaaatttaaacgtgacatgctaatggataacgtatctttgtacacgattaggcattacaatcaaaaagcaattgccgatttagaagtcggaaaaacagttttattaaaaaaatgtttcaagaaacactaa

SEQ ID NO: 21546 - protein, 205 aa, Unknown
  Obtained from environmental sample
  misc_feature (1)..(205): Xaa is any amino acid
MAYCLSADSVTIWKDVPGVLNADPRHFKNAQLLNAISYTEAIELAFYGASVIHPKTLQPLQRKEIPLYVKSFLQPNEDGTIVSKIKGIEPKVPCFIVKQNQVLLSLSTLDFSYIVEDNISEIFNLLSKYKMKVDVIQNSAISFSVCFDNNYNNLEPLLLHLKAKFKRDMLMDNVSLYTIRHYNQKAIADLEVGKTVLLKKCFKKH

SEQ ID NO: 21547 - DNA, 756 bp, Unknown
  Obtained from environmental sample
  misc_feature (1)..(756): n is a, c, g, or t
gtgaaacgacagacataccgtaagcaaaggcaattgatgacagtttactacagcttgtatgggcaattattagatattaataacctgtacaagggattcaaaaaagtgaaagcagcgaaaggagccgccggaatagataggcagtccatagccgcgttcgccttgaatttagaagaaaacttgaaacaactgcaaggtgaactgcaaagcaagcagtatcgcgcacagccagtcaaacggatagaaataccgaaagatgatggtggtgtgagactgctgggaattccaacagttcgcgaccgcatagtacaacaaacactattgaacattctccaaccgctcttcgacatcgactttcacccatcaagttatgggtacaggccgaaacgaagttgtcatgacgccatcagcaaagccacggtatttattcgtaaatatcaccgtgagtgggtggttgatatggatctgtcgaagtgttttgacctactcgatcacgacttgatcataagcagcgtcaaacgcaaagtgacagacggtagcatcttaaaactgctcaaacagtttttaaaaagcggagtaatgataggcaataattgggaagcgagtgagctaggaagtccacaaggtggtgttatcagtccattgttggcgaatatctacctagatgcatttgatcaagaaatgaaaaagcgaaatcacagaatagtgaggtacgccgacgacatattgatcttatgctgcacagaaaaagcaggn

SEQ ID NO: 21548 - protein, 252 aa, Unknown
  Obtained from environmental sample
  DOMAIN (74)...(252): Reverse transcriptase (RNA-dependent DNA polymerase)
  misc_feature (1)..(252): Xaa is any amino acid
MKRQTYRKQRQLMTVYYSLYGQLLDINNLYKGFKKVKAAKGAAGIDRQSIAAFALNLEENLKQLQGELQSKQYRAQPVKRIEIPKDDGGVRLLGIPTVRDRIVQQTLLNILQPLFDIDFHPSSYGYRPKRSCHDAISKATVFIRKYHREWVVDMDLSKCFDLLDHDLIISSVKRKVTDGSILKLLKQFLKSGVMIGNNWEASELGSPQGGVISPLLANIYLDAFDQEMKKRNHRIVRYADDILILCCTEKAG

SEQ ID NO: 21549 - DNA, 642 bp, Unknown
  Obtained from environmental sample
  misc_feature (1)..(642): n is a, c, g, or t
gtggtttcttttaatttagaagcttttaaaaaagatttagaagatggtatgtatttcgattcttctattccacaaggttatggagttggtagttctggagcattagtagcatctatctatgataattatgctgatgataaaattacagttctagagaatttaaccagagaaaagttattaaaactgaaggaaatattctctttaatggaatctttttttcacggtaaaagttctggtttagatcctttaaattcttatttaagtttaccaatattaattaactctaaagaaaatatagagccagcaggaattccatctcaaaaaagaggaaaaggagccgtctttttattagattctgagcaagttggtgaaactgaacctatggtaaacatctttatgaataagatgaaaaacgaaggttttagaaaaatgattagcgaagaatttgctttacacacagatgcttgtatagaaaactttttgcaaggtgatgtaaaatcgttatttggtaacgtaaaaagtttatcgaaagttgttttacagaattttaaaccaatgattcctgatgcttttcataaagtttgggaaaatggaattgctactaacgattattattttaagccttgtggttctggaagttga

SEQ ID NO: 21550 - protein, 213 aa, Unknown
  Obtained from environmental sample
  misc_feature (1)..(213): Xaa is any amino acid
MVSFNLEAFKKDLEDGMYFDSSIPQGYGVGSSGALVASIYDNYADDKITVLENLTREKLLKLKEIFSLMESFFHGKSSGLDPLNSYLSLPILINSKENIEPAGIPSQKRGKGAVFLLDSEQVGETEPMVNIFMNKMKNEGFRKMISEEFALHTDACIENFLQGDVKSLFGNVKSLSKVVLQNFKPMIPDAFHKVWENGIATNDYYFKPCGSGS

SEQ ID NO: 21551 - DNA, 390 bp, Unknown
  Obtained from environmental sample
  misc_feature (1)..(390): n is a, c, g, or t
atgttaggtgaaaatttaacggttgaagccttagatgaaaaacaactttttattggtgatatttataaattgggtaatgctttagttcaaattacacaaccaagagaaccttgttttaaatttgctcataagtttggttcagatactgttttgcaacaatttattacacatggttattcagggacttatgtgagagtattaaaagaaggagaggtaaaaactggtgatacttttgagttggtagaacgcgcaaaagatagcattactatttttcaattgtttgaattgctctacgctgaaaacaaaaatataaaccatattaatttactacttaataatgatgctttaccaaaacggttaagaaaacgcttgaagtttttcgcacgctag

SEQ ID NO: 21552 - protein, 129 aa, Unknown
  Obtained from environmental sample
  DOMAIN (1)...(80): MOSC domain
  misc_feature (1)..(129): Xaa is any amino acid
MLGENLTVEALDEKQLFIGDIYKLGNALVQITQPREPCFKFAHKFGSDTVLQQFITHGYSGTYVRVLKEGEVKTGDTFELVERAKDSITIFQLFELLYAENKNINHINLLLNNDALPKRLRKRLKFFAR

SEQ ID NO: 21553 - DNA, 405 bp, Unknown
  Obtained from environmental sample
  misc_feature (1)..(405): n is a, c, g, or t
ttgcgctataaatatgtaagttttatgagtaccgttttaaatgtaatacaatgtaaatgtcctaattgtaaaaaaggaaaaatgtttagcactcgtggtaatatattgttttttaaaattcctgaaatgaaaactaggtgtgaagaatgtgattttaaatttgaaaaagaaccaggttttttctttggagctatgtttgttagttacgcacttgctgtaggacaaatgattgtaagtttagttgtattctggcacctaatagacttttcgccattaaaagtctttttaataatagcattaatcacgttattattaagcaccttaaattataaaatttctagagctatttgggttcatatattttataaaaaacctatagaaagtacatataaccagctagactaa

SEQ ID NO: 21554 - protein, 134 aa, Unknown
  Obtained from environmental sample
  misc_feature (1)..(134): Xaa is any amino acid
MRYKYVSFMSTVLNVIQCKCPNCKKGKMFSTRGNILFFKIPEMKTRCEECDFKFEKEPGFFFGAMFVSYALAVGQMIVSLVVFWHLIDFSPLKVFLIIALITLLLSTLNYKISRAIWVHIFYKKPIESTYNQLD

SEQ ID NO: 21555 - DNA, 417 bp, Unknown
  Obtained from environmental sample
  misc_feature (1)..(417): n is a, c, g, or t
ttgttttatgtaaataactgtacaattcaaataaaaatcataacaatgaaaacctttactatcactcttcttcttttaatttcattcgtattcaatcaatctattaatgctcaatgttctgaaatttatttttacaggaccaatggctttcagagtaaaaggcctgtaaatatttaccttaacggaaaagaattagcgatcattaaagctggagagcgttataaaactaatgtttgctctaatgataatttagagtttgttgtaagaactagtgaaaatgatatggttcctagtaaaataaacataaaacctgaaagtggcaataattattatctaaaggtttcttgtgcagtaggtgttgaaattgcttcaattaagaaacaagaatcattaaaaggaaaaaaagacataaacana

SEQ ID NO: 21556 - protein, 139 aa, Unknown
  Obtained from environmental sample
  misc_feature (1)..(139): Xaa is any amino acid
MFYVNNCTIQIKIITMKTFTITLLLLISFVFNQSINAQCSEIYFYRTNGFQSKRPVNIYLNGKELAIIKAGERYKTNVCSNDNLEFVVRTSENDMVPSKINIKPESGNNYYLKVSCAVGVEIASIKKQESLKGKKDINX

SEQ ID NO: 21557 - DNA, 804 bp, Unknown
  Obtained from environmental sample
  misc_feature (1)..(804): n is a, c, g, or t
atgaaaaaaaaanncccgtcgcccttccgcagttttgacttcggctcgagggggaaacctttaagaattgtcaaccagaacatcaaagacagtgaacttcctgagggacttgcagtttattttgatcaggccatcatcaatatgaaggaacatccaaaaaagaccaacaatgaactcaccattccaattcatgcaggagaaagatcgcttgacaggatcatgagcatggatgcaatacctgaatataatgagaaggaactggaaacaatccttattgttggacatgatataacagaagccaagagcatcgaaaaagagatccaggtaaagaaccgcaaaatcgaggatagtatcaattatgcggaaaggatacagagcagtatcctgccgggcatccgccagatccaggaactttttcccaaatgctttatctattataaaccccgtgatgtgatttccggggatttcccatggttcttcccggatggcgacctggtttacttggccgcagttgattgtaccggccatggtgttcccggtgcattattgtcctttataggttacttcctgttaaacaatattgtagatcatcaacccgggtttacagcaggtcagatatgcgataagttgcattcaggagtgagaaaaaccctgaaacaggaatcagaagatgccgatgcaagggatggcatggatatagcgttctgcaagatcgatcttaaatcacgtgaaatacaatattcaggagcccaccgtccactgtacctgcttcatgatggtgagctgatagagtttacaggtgna

SEQ ID NO: 21558 - protein, 268 aa, Unknown
  Obtained from environmental sample
  misc_feature (1)..(268): Xaa is any amino acid
MKKKXPSPFRSFDFGSRGKPLRIVNQNIKDSELPEGLAVYFDQAIINMKEHPKKTNNELTIPIHAGERSLDRIMSMDAIPEYNEKELETILIVGHDITEAKSIEKEIQVKNRKIEDSINYAERIQSSILPGIRQIQELFPKCFIYYKPRDVISGDFPWFFPDGDLVYLAAVDCTGHGVPGALLSFIGYFLLNNIVDHQPGFTAGQICDKLHSGVRKTLKQESEDADARDGMDIAFCKIDLKSREIQYSGAHRPLYLLHDGELIEFTGX

SEQ ID NO: 21559 - DNA, 516 bp, Unknown
  Obtained from environmental sample
  misc_feature (1)..(516): n is a, c, g, or t
gtgcctcaattctatttgcgaaacttcgctgatgaaaatgaaaagttttttgtatttgatgtaaatagagaaaataaatatcaaacttccccaaaaaaagaatgttacgaaaaacttctttatgatataaatcctgatattctgaataaatttagtgaccattcagaaaattacgaagaaattgttgatgacaatattagaatcttaaacgaagaagtttctgctattttattgaacttcctagatagaactataaaatctgaaaaagactttaaatttgaaagacctgaaagagaaaaattatatgacttcatattgttacaaacttttaggacaccattttacagggaaagactaggatatttaggtgtctcatttgctttaaaaactggtgttaacgatttagaagacaaagagttttcagatgtaatccataatctactaattttcggaattattgagcaactttatggtttagacttcaaactaaacaaaaacttagcacctgttttttga

SEQ ID NO: 21560 - protein, 171 aa, Unknown
  Obtained from environmental sample
  misc_feature (1)..(171): Xaa is any amino acid
MPQFYLRNFADENEKFFVFDVNRENKYQTSPKKECYEKLLYDINPDILNKFSDHSENYEEIVDDNIRILNEEVSAILLNFLDRTIKSEKDFKFERPEREKLYDFILLQTFRTPFYRERLGYLGVSFALKTGVNDLEDKEFSDVIHNLLIFGIIEQLYGLDFKLNKNLAPVF

SEQ ID NO: 21561 - DNA, 516 bp, Unknown
  Obtained from environmental sample
  misc_feature (1)..(516): n is a, c, g, or t
gtggcaaataaaccatttcaaaatttccttcagcgtttgattgatgatcgacttgaaaatacaaatacacttgtgcagcacattccctcattagtatcaagatacggttatgaagaaatgctaccaatacaaaaaaacaaaactggtaaattacgtattggaatcattaaaccaactgaagaagatttgctatctcttaaggaagttctttttcttttgagaaaaacttttgaagataaaattgagattatttactttggaaagcctcactcctccaaagaagcagcaaaacttttgaaggaaatagactgtgaaattcacaactcagtttcatttcttaactattttgaaaagcttaatagtttacaacttgatgtagtgttgcttcctagtagagaaagtctttttagtccgtcatccaaaataatcacgttatattttggcagctttcctgttatctcgcggattcccacgtctatttgccctcggaattccatccatcctgggcgaaactaa

SEQ ID NO: 21562 - protein, 171 aa, Unknown
  Obtained from environmental sample
  misc_feature (1)..(171): Xaa is any amino acid
MANKPFQNFLQRLIDDRLENTNTLVQHIPSLVSRYGYEEMLPIQKNKTGKLRIGIIKPTEEDLLSLKEVLFLLRKTFEDKIEIIYFGKPHSSKEAAKLLKEIDCEIHNSVSFLNYFEKLNSLQLDVVLLPSRESLFSPSSKIITLYFGSFPVISRIPTSICPRNSIHPGRN

SEQ ID NO: 21563 - DNA, 414 bp, Unknown
  Obtained from environmental sample
  misc_feature (1)..(414): n is a, c, g, or t
atgataagattaataacgattctactcttaataataagtacaaatatctatagccaacaaactatctactttgataaagattggaaggaaactgataaaatgaatgcgctttattataggcaaattcacccttctaataacaaatttattgtaaaagattatttaatggatgataagttgcaatttgatggtgtttctagcactgctaaagagcctcttatactagaaggagaagctatttggtataatgaaaatggaattgtaacacaaaaaggaaacttcaaaaataatactctaaatggtaaactcataacatactatttaaatggaaaaataaagagtacagaaacttatgaaaatggtaaattagaaggactatatacagaattcttttcctactggagaaataagtaa

SEQ ID NO: 21564 - protein, 137 aa, Unknown
  Obtained from environmental sample
  SIGNAL (1)...(18)
  DOMAIN (75)...(96): MORN repeat variant
  misc_feature (1)..(137): Xaa is any amino acid
MIRLITILLLIISTNIYSQQTIYFDKDWKETDKMNALYYRQIHPSNNKFIVKDYLMDDKLQFDGVSSTAKEPLILEGEAIWYNENGIVTQKGNFKNNTLNGKLITYYLNGKIKSTETYENGKLEGLYTEFFSYWRNK

SEQ ID NO: 21565 - DNA, 654 bp, Unknown
  Obtained from environmental sample
  misc_feature (1)..(654): n is a, c, g, or t
ttgggttttgagcgtgagtttttgagattgttagaaggtggttgtacagctccaattggtgctttagcttatgtaaactcaaaaactgaagaggttaattttaaaggagttttattaagtaaagatggttctaagaaaattaaagtagaaaaaacggccaaacttggtaatcacaaatttttagcaaaagattgtgcagattatgtgattaatagaggaggaaaagaattgatgttagaagataatgaaaatcaatctaagatcgcttcaatttattctacaaagaaactttcagaacttcaaaaagaaactttatcagaggcaattggtatagaagatagcgattttattaaaatacgttttaatagaattcctgctaaagtgatgaaaactgaaattgaaaacgtaattattacgagtcaaaatggagtagaagcaattttaaattcatttactaaaaacgaattaaaattcaaaaatatctattgtgtaggtagaagaacaaaaaaattaatcgaaaatagaatagggaaagttaccaaggttgcaaaaaatgcaaaaacattagctgaatatttatcaaaagaactagaaaacaaagaggttacttacttctgtagtaacttaaggatggaattttaccagcgtatttaa

SEQ ID NO: 21566 - protein, 217 aa, Unknown
  Obtained from environmental sample
  DOMAIN (4)...(73): Porphobilinogen deaminase, C-terminal domain
  misc_feature (1)..(217): Xaa is any amino acid
MGFEREFLRLLEGGCTAPIGALAYVNSKTEEVNFKGVLLSKDGSKKIKVEKTAKLGNHKFLAKDCADYVINRGGKELMLEDNENQSKIASIYSTKKLSELQKETLSEAIGIEDSDFIKIRFNRIPAKVMKTEIENVIITSQNGVEAILNSFTKNELKFKNIYCVGRRTKKLIENRIGKVTKVAKNAKTLAEYLSKELENKEVTYFCSNLRMEFYQRI

SEQ ID NO: 21567 - DNA, 306 bp, Unknown
  Obtained from environmental sample
  misc_feature (1)..(306): n is a, c, g, or t
atgacttactccctagattatcgcaaacaagtcttaaaaagcttagatgagggcatgacctttgctgaagctgctgttttctatgatatcagtccaacgactatccagaagtggaaaaagcgtcttcatagtaaaaccactcgatatattaagccctacaaaatagaggatgaagccttagctcaagatgtcaaagaccaccctgacgattatcactatgagcgagcacagcgttttgattgtagcccaacaggcatcagtaaagccttaaagcgtattggtgttagcaaaaaaaaagacacttga

SEQ ID NO: 21568 - protein, 101 aa, Unknown
  Obtained from environmental sample
  DOMAIN (1)...(101): Transposase
  misc_feature (1)..(101): Xaa is any amino acid
MTYSLDYRKQVLKSLDEGMTFAEAAVFYDISPTTIQKWKKRLHSKTTRYIKPYKIEDEALAQDVKDHPDDYHYERAQRFDCSPTGISKALKRIGVSKKKDT

SEQ ID NO: 21569 - DNA, 549 bp, Unknown
  Obtained from environmental sample
  misc_feature (1)..(549): n is a, c, g, or t
ttgatgaaactgatagagaaactgtatctgtttcaatttctcggtcaagagcaatttactgctggagatttacagaaatttatttcaggttttcaagtattgaatcctgatttagtaatttgtaatatggataaatctgtgaagttaaacgcagaaattacaattgaaaaaggtagaggatttgttcctgctgaagaaaataaaaaagcatctgcacctataggtacaatttttacagattctatttacactcctataaagaatgtaaaatatgcaatcgaaaattatcgtgtagaacaaaaaacagattatgagaaattagtattcgatatcgacactgatggatcaattaatcctaaagatgcattaactgaagcagcaaaaatcttaattcatcactttatgttattctctgatgagcgtatcactttagaagcagatgacattgcacaaacagaaacatatgatgaggaatcattgcatatgcgtcaattattaaaaactagattaatcgatatggatttatcttgtaagagctttaaattgtga

SEQ ID NO: 21570 - protein, 182 aa, Unknown
  Obtained from environmental sample
  DOMAIN (2)...(84): RNA polymerase Rpb3/RpoA insert domain
  misc_feature (1)..(182): Xaa is any amino acid
MMKLIEKLYLFQFLGQEQFTAGDLQKFISGFQVLNPDLVICNMDKSVKLNAEITIEKGRGFVPAEENKKASAPIGTIFTDSIYTPIKNVKYAIENYRVEQKTDYEKLVFDIDTDGSINPKDALTEAAKILIHHFMLFSDERITLEADDIAQTETYDEESLHMRQLLKTRLIDMDLSCKSFKL

SEQ ID NO: 21571 - DNA, 483 bp, Unknown
  Obtained from environmental sample
  misc_feature (1)..(483): n is a, c, g, or t
atgtcttttttaaagctaaaagttaaagtaagagataagatagtggcagacggattaaacgacgctacttttgatgttaccaataaaggtgtacacttatccgctaaagagtttaacgacatgttagcaaatccaaacacagtatgtgtagatatgcgtaaccattatgaaagtgaaattgggcattttgatggtgcagtaactccagatgtagatacttttagagaatctttggatataatcgaagcggatttacgcgagcataaagaagaaaaaaacctactaatgtattgtacaggaggcatccgttgcgaaaaagcaagtgcttactacaaacataaaggatttaaaaatgtctatcagctagaaggtggtattattgaatacactagacaggttaatgaagaaggtatagataataagtttataggaaaaaactttgtatttgacgagcgacgctcagaaaaaattagtgatgacgtn

SEQ ID NO: 21572 - protein, 161 aa, Unknown
  Obtained from environmental sample
  DOMAIN (34)...(132): Rhodanese-like domain
  misc_feature (1)..(161): Xaa is any amino acid
MSFLKLKVKVRDKIVADGLNDATFDVTNKGVHLSAKEFNDMLANPNTVCVDMRNHYESEIGHFDGAVTPDVDTFRESLDIIEADLREHKEEKNLLMYCTGGIRCEKASAYYKHKGFKNVYQLEGGIIEYTRQVNEEGIDNKFIGKNFVFDERRSEKISDDV

SEQ ID NO: 21573 - DNA, 510 bp, Unknown
  Obtained from environmental sample
  misc_feature (1)..(510): n is a, c, g, or t
ttgatagtccaaaaagcaataaaaaacgtaaaaacaatagaagtagaaacaaaaagcctgttcataacaaagctgaggttaaaactactgataacaaaaaagctaaacctaacaaaagggttaatacaaataataaaaatcaggctaatagcaaagcgcaaccaaataaaaaccaaccaaataaaagtcaggcaaatagtgctaagccaaaacctaaacctaggccaaaacgtaagccaaacaaaaaaagacctgaaaacaataacaattcaactaatgaaaataagtaaaattctagttgtcttattgctagtattgctatcgtcatgcgatgataaagcggtgtttgatcagtataaaagtgtttcaacatcttggaacaaaaaagatgtagttaattttaaaataaacgcgccagactctatcaatccttataatttatttgttaacgttagaaatacagatgattataatttagtaatttgtattaatcgtcgaaatgatttctga

SEQ ID NO: 21574 - protein, 169 aa, Unknown
  Obtained from environmental sample
  misc_feature (1)..(169): Xaa is any amino acid
MIVQKAIKNVKTIEVETKSLFITKLRLKLLITKKLNLTKGLIQIIKIRLIAKRNQIKTNQIKVRQIVLSQNLNLGQNVSQTKKDLKTITIQLMKISKILVVLLLVLLSSCDDKAVFDQYKSVSTSWNKKDVVNFKINAPDSINPYNLFVNVRNTDDYNLVICINRRNDF

SEQ ID NO: 21575 - DNA, 645 bp, Unknown
  Obtained from environmental sample
  misc_feature (1)..(645): n is a, c, g, or t
atgaagaaaatagatttagagaaaaaatcattagaaattcaaaaaataatctctcgttatacaaaagagagctttgtatgtttttttgctgattttattagacaccatccagaaagaagcaatattggattttcaaaaaaattcaagtcaaaattaaaagattctttatatctgataatgttaaggctctctacaccattgacaggcaaggaagaacttcattattcagaaaaaaatgatttagtacttcagcaagttgctgacattcttttagagatagttagtttctatttatcagaaaattatgagggaaatgaatttgatgagatttctgataaaagacaaaaattacttgttcacgaattagcattcaaaaattactttcaaaacggaatattaaattatagagaacaagaggtaaataaggttattaggatgtttaaaccttatcaagataaaatacaggaaagattagaaatcgatttaaaaaccttaattaatttatgcaatcattctgaattaatttatcgtgcaaagtcaataaattcaaagtcatttatattggacaaaggctttgacaaactggctcggcaatctgncaatggattattagcagagaatgagtctacagatataagctgttag

SEQ ID NO: 21576 - protein, 214 aa, Unknown
  Obtained from environmental sample
  misc_feature (1)..(214): Xaa is any amino acid
MKKIDLEKKSLEIQKIISRYTKESFVCFFADFIRHHPERSNIGFSKKFKSKLKDSLYLIMLRLSTPLTGKEELHYSEKNDLVLQQVADILLEIVSFYLSENYEGNEFDEISDKRQKLLVHELAFKNYFQNGILNYREQEVNKVIRMFKPYQDKIQERLEIDLKTLINLCNHSELIYRAKSINSKSFILDKGFDKLARQSXNGLLAENESTDISC

SEQ ID NO: 21577 - DNA, 843 bp, Unknown
  Obtained from environmental sample
  misc_feature (1)..(843): n is a, c, g, or t
ttggccaaacaagattttcacccctcttttgaagaaaaacatattgatgttttctgtggcttattttcaattgatattaaagataatcatagtaatttattttattcccaacaaaatcctttagaaaataaaccgattataaaaattagtgataatcagtatttaaacgtatatcaaaaacaattgccttcagctctatatgatttactttataccacgcttactcaaacaaaaaaggaaaaagaacaaataaatttccgtagaggaaaagttgttttggaaagccatactttggatatatttaaaaaattcttcaaaaaatcaaaaaggattaaaattttcaccaactattacataaacaacgagccagaagaaaaagatatattaatccttgtggataataacgcctatatcattgaatgtaaggcttcaagatatagagaaccacgaagggttacggaacaagcataccaaagaatcaaatctgactttaacgactgtattcaaaaaggttatgaccaatgctatcaggttgaacaggaattgttaaacaatgaaaaggttattgttagcttgaaaaataaatcggaggtaattatcacgaatgaaattcacgagattttttgcattgtagtcacttcagaaagatttgcttccatacaaaccgatttaggattaatgcttaaaaggaaaaataatgaagacccttacccttggtcaatatatgtcgatgatttagaaacttttttgaaagtgctttacaatagtttcagtaatccgtccagaaagatttttgactttttggagcatagatatactctcgaccgattcttgatccactag

SEQ ID NO: 21578 - protein, 280 aa, Unknown
  Obtained from environmental sample
  misc_feature (1)..(280): Xaa is any amino acid
MAKQDFHPSFEEKHIDVFCGLFSIDIKDNHSNLFYSQQNPLENKPIIKISDNQYLNVYQKQLPSALYDLLYTTLTQTKKEKEQINFRRGKVVLESHTLDIFKKFFKKSKRIKIFTNYYINNEPEEKDILILVDNNAYIIECKASRYREPRRVTEQAYQRIKSDFNDCIQKGYDQCYQVEQELLNNEKVIVSLKNKSEVIITNEIHEIFCIVVTSERFASIQTDLGLMLKRKNNEDPYPWSIYVDDLETFLKVLYNSFSNPSRKIFDFLEHRYTLDRFLIH

SEQ ID NO: 21579 - DNA, 687 bp, Unknown
  Obtained from environmental sample
  misc_feature (1)..(687): n is a, c, g, or t
gtgggttgtggggcgatattttttcatttaaatccaaaaggtcccgtctatttgaatgatttaaataaagaattgataaatgcatgtattgagattcagaaggctccaaaaaatgtcattgcaagcttaaaaaaactaaagaactccgaaaaggatttctatagaattagatctttgaaatgtcgatctgcacatacaaaagccgcgaggtttatctatttaaatcgaacctcctttaacggaatttatagggttaatcccagaggagattttaatgttccgtatggaaaaagagaaaatgtggatatcgtcactgaatcgaatctgataaaagtacatgagttacttcagggagtacaattaacttccaacgatttctttagtcaaatagataatattaagaaaggtgatttggtatatcttgaccctccatatacagtggcgcatgagaacaatggattcatagcgtacaatagcaaattattctcattagaagaccaagaaaggctatcgcaaatggtaaaagagattaattccacaggtgcatactatgttttatccaatgcggaacatccaactattaggtcttattataagaatattggagaaattcattcagtttctagacccagcatagtaggagggaagacactaaaacgcgcaggacttattactgaggtattataa

SEQ ID NO: 21580 - protein, 228 aa, Unknown
  Obtained from environmental sample
  DOMAIN (1)...(212): D12 class N6 adenine-specific DNA methyltransferase
  misc_feature (1)..(228): Xaa is any amino acid
MGCGAIFFHLNPKGPVYLNDLNKELINACIEIQKAPKNVIASLKKLKNSEKDFYRIRSLKCRSAHTKAARFIYLNRTSFNGIYRVNPRGDFNVPYGKRENVDIVTESNLIKVHELLQGVQLTSNDFFSQIDNIKKGDLVYLDPPYTVAHENNGFIAYNSKLFSLEDQERLSQMVKEINSTGAYYVLSNAEHPTIRSYYKNIGEIHSVSRPSIVGGKTLKRAGLITEVL

SEQ ID NO: 21581 - DNA, 627 bp, Unknown
  Obtained from environmental sample
  misc_feature (1)..(627): n is a, c, g, or t
atgataaatacaggtgctctttttcatcatcatcctagtgaacattgtaagcaaaagcttggtgatgaagacaagattgttctcggagccgaacttatggacatactaaatgaaaacaagtttgatttagtcattcatggacataaacaccatccttgnttgaggtatgctcctggaaacgggaacagaacccctattttttctgctggtagtttcgccgctacaagtgcggctatggttacggggtcaaaaaacactttccataaaatatctattcgaaaaaaggcagggcaaaggggttgtggtaaaatagagacttgggaatatttgcctaacaatggatggcgtttggccgaatcaggtgatgatttttttcctatgtacacgggttttggttatggcggggcgatagatattcttgttgataaaacaaagcaaattattgatgatggcaatggggaatttattgattggaatcagtttattgtccaagttgatgaaataaattatctcacgcctgacgaaacaactgaattaagaaagaaattgtcacgacaaggaataataactaacccagaattacctaaactgccaactgtgataggaaggccctataaaggaaagtaa

SEQ ID NO: 21582 - protein, 208 aa, Unknown
  Obtained from environmental sample
  misc_feature (1)..(208): Xaa is any amino acid
MINTGALFHHHPSEHCKQKLGDEDKIVLGAELMDILNENKFDLVIHGHKHHPXLRYAPGNGNRTPIFSAGSFAATSAAMVTGSKNTFHKISIRKKAGQRGCGKIETWEYLPNNGWRLAESGDDFFPMYTGFGYGGAIDILVDKTKQIIDDGNGEFIDWNQFIVQVDEINYLTPDETTELRKKLSRQGIITNPELPKLPTVIGRPYKGK

SEQ ID NO: 21583 - DNA, 702 bp, Unknown
  Obtained from environmental sample
  misc_feature (1)..(702): n is a, c, g, or t
ttgcattgtcaagtttcgtatgacaatgtaaatattaagcgaaacatactaaataaaaatgtgttccctgctgaaattttaattccctcagcgcaagccaaatttggagtcgctagcgatattgatgatactattttacataccggagtagtttcctttttaaaatggcgtcttataattaatagtatttttaagtcggcactctcgcgtttacctttggaaggagcttcagaattttatcatttgttacatcgtggtgtgtcgggtgaagaggcaaatcctattttttatgtaagtcatagtccgtggaatttataccgctacctcaagctctttttgaagcaaaatgattttccgaaagggcctattttactacggaattttgatagtttatttagaaagagagccatcgatgaaaaacctcaaaagcaaaaagaaattataaatttacttacaatctatcccgatttaccgtttattttaattggggatagcggcgaacacgatcccgacatttatattgaaatagcagaattatatcccgatagaattaaagcgatttatttacgcagtgtaaatcataaaaaacgaatgcaacgggttacaggaattcttgaaaattataaatcgactcccgtgcttttggtggagaaaagcgagcaagccattgaacacgcaagagttagagggtttattaagtag

SEQ ID NO: 21584 - protein, 233 aa, Unknown
  Obtained from environmental sample
  misc_feature (1)..(233): Xaa is any amino acid
MHCQVSYDNVNIKRNILNKNVFPAEILIPSAQAKFGVASDIDDTILHTGVVSFLKWRLIINSIFKSALSRLPLEGASEFYHLLHRGVSGEEANPIFYVSHSPWNLYRYLKLFLKQNDFPKGPILLRNFDSLFRKRAIDEKPQKQKEIINLLTIYPDLPFILIGDSGEHDPDIYIEIAELYPDRIKAIYLRSVNHKKRMQRVTGILENYKSTPVLLVEKSEQAIEHARVRGFIK

SEQ ID NO: 21585 - DNA, 651 bp, Unknown
  Obtained from environmental sample
  misc_feature (1)..(651): n is a, c, g, or t
ttggtcactggtgaatccaataaaaccgtcggggtagagtatataaataatgctgttaaacttcttaaaaaaaagtttgcaaacattactattgaagtccaacccttagaccaaaacgagtatgaattattagtagagaatggcttatatgcggtgttggtatatcaagaaacttaccatagagaagaatacaaaaaacaccatcctaaaggcaaaaaatctaattttaattaccgattagaaacccccgaccgtttaggaaaagcaggagtacataaaattggtttaggtgccttatttggtttagaggattggcgagcagacagtttttttacagctttacacttacagtatttacaaaaaacatattggcaaaccaaatactctatttcattccctaggttacgaccacattctggaggattagaccccaaagtggttatggaggatgccgatttagcccaattaatttgtgcttatcgcttgttagacgaagatatagagttatcgatttctacaagagaaagcgagacgtttagaaacaatattatcaactttggcattacctctataagtgctgaatctaaaacaaatccaggtggctatgttgtaaaaccgcaatctttagagcagtttgaaatttcccgatga

SEQ ID NO: 21586 - protein, 216 aa, Unknown
  Obtained from environmental sample
  DOMAIN (129)...(214): Biotin and Thiamin Synthesis associated domain
  misc_feature (1)..(216): Xaa is any amino acid
MVTGESNKTVGVEYINNAVKLLKKKFANITIEVQPLDQNEYELLVENGLYAVLVYQETYHREEYKKHHPKGKKSNFNYRLETPDRLGKAGVHKIGLGALFGLEDWRADSFFTALHLQYLQKTYWQTKYSISFPRLRPHSGGLDPKVVMEDADLAQLICAYRLLDEDIELSISTRESETFRNNIINFGITSISAESKTNPGGYVVKPQSLEQFEISR

SEQ ID NO: 21587 - DNA, 537 bp, Unknown
  Obtained from environmental sample
  misc_feature (1)..(537): n is a, c, g, or t
ttggtagttttacttttaatttatttgttttacaaatggcgacaagtttccatgaaaaagctaaagaaggatttgctcatcaatcagcaaaattcgcttcgtgcacaagcagaaaagtatcaaaacaggctaaaacgaattgaagatgaaaagttacaagccgaatatgaacagcttaaaactcagctcaaagataaaacgattgagctcgctactaaagccaaagagaacgaagaaataagcaaggtacttcagacattaaaagataagtttaaaaaacttgagcaaaatcctgattcgttaaaaactaggtcaaatgagatacaacaaattattgattcccatcttaatgcagacgaccatacttttgagattcaaatggatcaattacatcaggaattttttgaaaaactaagaaatgactttcatgatttaaccagctatgatctacgtttgtgtgcctacctaaagctaggtttcaattcgaaagaaatagcaaatatgctaaactattatgccatncaagtgtgtatataa

SEQ ID NO: 21588 - protein, 178 aa, Unknown
  Obtained from environmental sample
  misc_feature (1)..(178): Xaa is any amino acid
MVVLLLIYLFYKWRQVSMKKLKKDLLINQQNSLRAQAEKYQNRLKRIEDEKLQAEYEQLKTQLKDKTIELATKAKENEEISKVLQTLKDKFKKLEQNPDSLKTRSNEIQQIIDSHLNADDHTFEIQMDQLHQEFFEKLRNDFHDLTSYDLRLCAYLKLGFNSKEIANMLNYYAXQVCI

SEQ ID NO: 21589 - DNA, 405 bp, Unknown
  Obtained from environmental sample
  misc_feature (1)..(405): n is a, c, g, or t
atgcgtaacaaaacaacattaaagcaattagctgctgaacttaacctttcaatctctactgtttctaaagcactaaaaaacagctatgaaattaatgaaaaaactatagccagggttcaagctcttgcaaaaaaatacaattataggcctaatagaatggctttaagtcttaaaagtaatgagactaaaattataggtgtaatcattcctaatattttaaattattttttctctaaagtccttttggggatagaagaagaagccaatagcaacgggtatcaaattatcatttgtctttcaaataatcaattccaaaaggaggcagatagtttacaactattaagtgacggaagtgtggatggatttatctttcaattgcgaaggaaatccagcaaaatcttatag

SEQ ID NO: 21590 - protein, 134 aa, Unknown
  Obtained from environmental sample
  misc_feature (1)..(134): Xaa is any amino acid
MRNKTTLKQLAAELNLSISTVSKALKNSYEINEKTIARVQALAKKYNYRPNRMALSLKSNETKIIGVIIPNILNYFFSKVLLGIEEEANSNGYQIIICLSNNQFQKEADSLQLLSDGSVDGFIFQLRRKSSKIL

SEQ ID NO: 21591 - DNA, 453 bp, Unknown
  Obtained from environmental sample
  misc_feature (1)..(453): n is a, c, g, or t
ttgatttttgtaaatatattaatttatttttgtgatatgcaaaatttaccaaacgacaaatcgcttattctttttgatggtgtatgcaacctttgcaacacatcaatacaatttgttataaaacacgatacaaaaaacaagtatctatttgctcctttacaaagtaatattggtcaatccattatccagaaatataacttggatacaagcaaaacagactctatactactctattccaatactaaaggcttaaaggtaaaatctactgctgcaatagtaatagccacacacttgggatttccgataaatatgttaggtgttttttttatagtgcctacatttattagaaattgggtgtacgactttgtagctaaaaaccgttatagatggtatggcaaaaaagaagcttgtatgattcctactccagaattaaaagctaaatttttaaattaa

SEQ ID NO: 21592 - protein, 150 aa, Unknown
  Obtained from environmental sample
  DOMAIN (16)...(134): Protein of unknown function, DUF393
  misc_feature (1)..(150): Xaa is any amino acid
MIFVNILIYFCDMQNLPNDKSLILFDGVCNLCNTSIQFVIKHDTKNKYLFAPLQSNIGQSIIQKYNLDTSKTDSILLYSNTKGLKVKSTAAIVIATHLGFPINMLGVFFIVPTFIRNWVYDFVAKNRYRWYGKKEACMIPTPELKAKFLN

SEQ ID NO: 21593 - DNA, 360 bp, Unknown
  Obtained from environmental sample
  misc_feature (1)..(360): n is a, c, g, or t
atgaaaatctttattaaattcgattttacgcaattctgttcgacaatactcgacgagaaattggatgaacttaacattaaatacaggatgttaaattttggagaaattgaatttttagaacctgttccgccagataagttgaaggcctttgacgctatcctcgacacctatggcattgaaaaaatagaaaatcagaaggttattttagtgcagagaataaaggatactttaattgatatggtattcaacaccaatgacgctattaacgtgaaaagctccgtgtatctatcggacaaattggggcacagttatggttatttatcaaatctattttctgaggttacctacacttacgcttga

SEQ ID NO: 21594 - protein, 119 aa, Unknown
  Obtained from environmental sample
  misc_feature (1)..(119): Xaa is any amino acid
MKIFIKFDFTQFCSTILDEKLDELNIKYRMLNFGEIEFLEPVPPDKLKAFDAILDTYGIEKIENQKVILVQRIKDTLIDMVFNTNDAINVKSSVYLSDKLGHSYGYLSNLFSEVTYTYA

SEQ ID NO: 21595 - DNA, 429 bp, Unknown
  Obtained from environmental sample
  misc_feature (1)..(429): n is a, c, g, or t
atgaattattcaaaattagtagctatcattttcttcattgctatgttaagtgcttgtggaaataatgaaaacaaaaagaaagaagttaataaagaaacagagattaaacaagaagttaaaaccatcgaattccaaaataaaggacatgagttaatttacaaaatgacacaaaaaacaggagattatcaagatttactgaatttaaaagatgttgtctttaaatatacctacagaactccagatcaaaaagaagatgtttctacagaatcttacatttttaacggagaactttctcatggagattatataaaacacgaaagaacattaccagaattagaaggtaaaatgcaacaagcatataatggttcagatttttggatcactataaatggcaaagaagtaaaaactgataatgctattgaaggtact

SEQ ID NO: 21596 - protein, 143 aa, Unknown
  Obtained from environmental sample
  SIGNAL (1)...(18)
  misc_feature (1)..(143): Xaa is any amino acid
MNYSKLVAIIFFIAMLSACGNNENKKKEVNKETEIKQEVKTIEFQNKGHELIYKMTQKTGDYQDLLNLKDVVFKYTYRTPDQKEDVSTESYIFNGELSHGDYIKHERTLPELEGKMQQAYNGSDFWITINGKEVKTDNAIEGT

SEQ ID NO: 21597 - DNA, 819 bp, Unknown
  Obtained from environmental sample
  misc_feature (1)..(819): n is a, c, g, or t
gtgaatatgcgcaccattcaaaaagatcagacggatttttttggcagcaaagaaaccattacagaagctctgatgttcttaaaccctgaaaatggtgaacaatatctcccagactgttacaatgttctagcaaccaatcatcgaaaactactgaattacccagatgcaatttcctattatttaaaatctattgagactacaaataccaaaacggataggcttatctataaaaataacttggccgtcagttatgttgataatacacaatacaatgaggccattgccttattaaaatcgattaccaaagaccccttgtccgtcaaaaatcaaaaggaacatgctaggtcattggataatctggcttacgctcaatggcttttaggaatcaatagcaaggtagggacttttcttattccgttaagactacgccaaaagaatgatgataaacgtggccagatttccaattacacgcatctaggggaattttatagtgaaagcaatccgcgaaaagcaaaaacgtattttgactcagtcatacaattatcaaatacactcaaaataccacgggcggaaaaggatgtccttaaatttttaatgcaattacaacctaaaaacgtacctcttagagatcgctacatatttttgcaagatagcctgtatgcccaagagttgaaagttaagacacaatttgccaagtacaaatatgatcacaaactcaagcaagagtcaattttgcgtttggcaaaagaaaatattgataaagaactagaaaccagtcaacaacgtaatcagaagattattacctcgaccgattcttga

SEQ ID NO: 21598 - protein, 272 aa, Unknown
  Obtained from environmental sample
  misc_feature (1)..(272): Xaa is any amino acid
MNMRTIQKDQTDFFGSKETITEALMFLNPENGEQYLPDCYNVLATNHRKLLNYPDAISYYLKSIETTNTKTDRLIYKNNLAVSYVDNTQYNEAIALLKSITKDPLSVKNQKEHARSLDNLAYAQWLLGINSKVGTFLIPLRLRQKNDDKRGQISNYTHLGEFYSESNPRKAKTYFDSVIQLSNTLKIPRAEKDVLKFLMQLQPKNVPLRDRYIFLQDSLYAQELKVKTQFAKYKYDHKLKQESILRLAKENIDKELETSQQRNQKIITSTDS

SEQ ID NO: 21599 - DNA, 729 bp, Unknown
  Obtained from environmental sample
  misc_feature (1)..(729): n is a, c, g, or t
gtgtcttttaatcctcttgttcaatctgtagttttaatagcagatatgataattagtaccgataaaaatgaacaaataaaaattgctaaacttgcgcttgataatgccccaacaattgaatacaaaactgaattatacagatggctgtatcatagcgaaaatgaaaaccctaaacctaactgttttagcttggaagaaagaaaagagttaggtgaacacctaggaaacaaaatcttttctgagattgagtctattgacatcacttctgaaaaccccgacttagtatcacgtattttctggatattaagtgaatatgtggacaaaaaccgtttgaatgattatgtaaagtcattagttagctccgacccatcaactgtttataaaatccttaataattacgttcctactttcacgagtcttacagatggaactacgggtaaagaaggttttaatgaagctaactataaaagtttatccaaagttatcgatgtttcaattttatttgaatcaattgaacggcactatcctgacttggtagttaacataaatgaatatccaacattgcaaagtcgtgatgaagatagagagtcaattatttctcaacaatttgtatggtggtatagaaaagatcttaataaaaagacttttacaaaaattactcaagtaaataatttgaatagcccttatatcgaaaatctgaaaaaagtttgtaatatagtggataattaa

SEQ ID NO: 21600 - protein, 242 aa, Unknown
  Obtained from environmental sample
  misc_feature (1)..(242): Xaa is any amino acid
MSFNPLVQSVVLIADMIISTDKNEQIKIAKLALDNAPTIEYKTELYRWLYHSENENPKPNCFSLEERKELGEHLGNKIFSEIESIDITSENPDLVSRIFWILSEYVDKNRLNDYVKSLVSSDPSTVYKILNNYVPTFTSLTDGTTGKEGFNEANYKSLSKVIDVSILFESIERHYPDLVVNINEYPTLQSRDEDRESIISQQFVWWYRKDLNKKTFTKITQVNNLNSPYIENLKKVCNIVDN

SEQ ID NO: 21601 - DNA, 414 bp, Unknown
  Obtained from environmental sample
  misc_feature (1)..(414): n is a, c, g, or t
ttgcggaacatttacgatgctgtagataggtttactggtgtgcagctgggattgagcattccgctatgggcaaaaccacataccgctaaaattacggctgctaaaatttataaacaggaaactgaggctcaactagaggtcatcgaaaatcaaaccaaatctaaacttcaatcgctgtttaccgaacttcaaaagaatttaaaaaatattgaatactatcgcaagagtggcctgccacaatcagatgtgctgtttaaaaccgcgcaacgtgggtttgaagaaggcgagatcgggtacattgaatatgtacaaggtctcaaccgtgcgttgactattcaggtaacctatttggattttttaaaccaatacaatcaaacactcatcaacattgagcaacttataaaagatatttaa

SEQ ID NO: 21602 - protein, 137 aa, Unknown
  Obtained from environmental sample
  misc_feature (1)..(137): Xaa is any amino acid
MRNIYDAVDRFTGVQLGLSIPLWAKPHTAKITAAKIYKQETEAQLEVIENQTKSKLQSLFTELQKNLKNIEYYRKSGLPQSDVLFKTAQRGFEEGEIGYIEYVQGLNRALTIQVTYLDFLNQYNQTLINIEQLIKDI

SEQ ID NO: 21603 - DNA, 363 bp, Unknown
  Obtained from environmental sample
  misc_feature (1)..(363): n is a, c, g, or t
atgaggttgaatattaaaataccaaaacatctaaaacaggcatatagtaaagagttagagttataccgcaataacttagaaatggaagaatttgctattgcttggtatcatttagaaagaagtcacattataggtcaatcgtatccaatggagcatacctattcacattggttaatgttgaaatttgggttgatgcaaaagaatactaaagaagtatttggtcaaataattagattaatcgttggtggttggaagtcgtttattaatcacgtgccattaggtaatacaggaggttcaaatgtgccaccattaaaacgtatgcctataccaaatgacataattaacttattcaatatcaaatga

SEQ ID NO: 21604 - protein, 120 aa, Unknown
  Obtained from environmental sample
  misc_feature (1)..(120): Xaa is any amino acid
MRLNIKIPKHLKQAYSKELELYRNNLEMEEFAIAWYHLERSHIIGQSYPMEHTYSHWLMLKFGLMQKNTKEVFGQIIRLIVGGWKSFINHVPLGNTGGSNVPPLKRMPIPNDIINLFNIK

SEQ ID NO: 21605 - DNA, 378 bp, Unknown
  Obtained from environmental sample
  misc_feature (1)..(378): n is a, c, g, or t
atgattctatatcacttgctgaaagctggtatacgcttagtaatggaagcacaagaaattgcttggaacaatcatgatttagaaggttttatgcaagggtattggaaaagtgatttcctaaaattttacggcagtagtgggctgacatatgnttgggatcaaactttagccaattataaaaaggggtatcctacaaaagcagaaagcggcactctaaaatttgtaattaatgatatttcaaaaattgaaggtgataattattgggtgatgggtgaatatcatttgaaccgcgaagttggagatgccaacggagtctttatgataatttttaaaaagatacaaggtgaatggaaaattatcgctgatatgtcttgttaa

SEQ ID NO: 21606 - protein, 125 aa, Unknown
  Obtained from environmental sample
  misc_feature (1)..(125): Xaa is any amino acid
MILYHLLKAGIRLVMEAQEIAWNNHDLEGFMQGYWKSDFLKFYGSSGLTYXWDQTLANYKKGYPTKAESGTLKFVINDISKIEGDNYWVMGEYHLNREVGDANGVFMIIFKKIQGEWKIIADMSC

SEQ ID NO: 21607 - DNA, 561 bp, Unknown
  Obtained from environmental sample
  misc_feature (1)..(561): n is a, c, g, or t
atgagcgtattacctaccaaccttgagaccttgaaacgtcgggccaagcaaagcatcatgccattgctgacaccgcatttattaaagctgcgccttaatacttatgcaccatacattggcgcaggtatcaaaatcgatcatatcagtctcgatcagggtttgtgcgtggtaagcatgggactaaatactctgaacaaaaatatcgtcggtactcagttcggtggtagcttatattcgatggttgaccctttttatatgctcatgctgatgcaccaactgggtagcaattacgtagtgtgggacaaaagctcacacattgattttgttgcgcctggcagtagcaaagtcactgcacgcatgaaaatacctagttctgaaattattactattcaagagttggcaaaagaaggcgaagcggtattccgtgagtataaagtcgatatcgttgatgagcagcaaaagctcattgcgaccgtcaccaagactttatacattagactgcgcaaatacagtaagtccaaagagcaagtaaatcgcatcgatacatttgatgctcaataa

SEQ ID NO: 21608 - protein, 186 aa, Unknown
  Obtained from environmental sample
  misc_feature (1)..(186): Xaa is any amino acid
MSVLPTNLETLKRRAKQSIMPLLTPHLLKLRLNTYAPYIGAGIKIDHISLDQGLCVVSMGLNTLNKNIVGTQFGGSLYSMVDPFYMLMLMHQLGSNYVVWDKSSHIDFVAPGSSKVTARMKIPSSEIITIQELAKEGEAVFREYKVDIVDEQQKLIATVTKTLYIRLRKYSKSKEQVNRIDTFDAQ

SEQ ID NO: 21609 - DNA, 303 bp, Unknown
  Obtained from environmental sample
  misc_feature (1)..(303): n is a, c, g, or t
atgacaataaaacaacaacttctgcaaatttgtaacgaacaggtagaaaaacgcattacagattataaaaacgaaatagaccttataaaagagtctatagagagtaatgataaaggaggctctgatgatgatgattctggaaacggtaaacttttaaatgatttagaaaaaaatatgggttatctaaacgatgctagaaaaacccaagattatttaaaattagtaaaagctaatttattaagtactagtgcagctttaggaagcttagttaagacggacagtcttcacttttttaatccatag

SEQ ID NO: 21610 - protein, 100 aa, Unknown
  Obtained from environmental sample
  misc_feature (1)..(100): Xaa is any amino acid
MTIKQQLLQICNEQVEKRITDYKNEIDLIKESIESNDKGGSDDDDSGNGKLLNDLEKNMGYLNDARKTQDYLKLVKANLLSTSAALGSLVKTDSLHFFNP

SEQ ID NO: 21611 - DNA, 306 bp, Unknown
  Obtained from environmental sample
  misc_feature (1)..(306): n is a, c, g, or t
atgcagttcttgacgaaacaaaacttcctgcacacggcgcgcagtacccacaataaaaaaataagtgccctgctattatgtgtgggcactttacttccaactagccttattgccggcgaattgacacagtacgaagctaagtatgatattttacgcaaaggtaaaaatcatggtgaagccgtgcgtgaactcaaaaagataagtgacgataactacgagttaacctatcacagcaatattgagtggatgattttttctgactcacgccaggaacctctaaatttacctttaaagatggcaaagtga

SEQ ID NO: 21612 - protein, 101 aa, Unknown
  Obtained from environmental sample
  misc_feature (1)..(101): Xaa is any amino acid
MQFLTKQNFLHTARSTHNKKISALLLCVGTLLPTSLIAGELTQYEAKYDILRKGKNHGEAVRELKKISDDNYELTYHSNIEWMIFSDSRQEPLNLPLKMAK

SEQ ID NO: 21613 - DNA, 540 bp, Unknown
  Obtained from environmental sample
  misc_feature (1)..(540): n is a, c, g, or t
atgaaagaagaaacatatactatatcagtttattcagaaaataacctaggattattaaacagaatatcgaccatatttttaaagcgtcatatcaatgttgagagcttgacagtttcgaatacagaaattgaaaatgtatcacgatttattattgtcgtgaatatgactgaagaaaaggtaaagaaaattattggtcaaattgagaagcaaattgaggtgattaaagcatattaccataccaatgatgagtctatttatattcagtcggcattgttcaaaataaaatctaacttgcttttcgatgaacgtcaaattcaaaatagtattaaaaatagcaatgctcaaatcgtaacggtttctccagatttttttgtgatacaaaaatcaggaagaaaagaggaaatcgaagcattatacaatgaattattacctttcggaatcatgcaatttgtaaggtctggaagaatatcagtatcaaaagaagaaatgaaaatttcagaaatattaaacaatcagttaaattcaaaagataaaaattaa

SEQ ID NO: 21614 - protein, 179 aa, Unknown
  Obtained from environmental sample
  DOMAIN (6)...(79): ACT domain
  misc_feature (1)..(179): Xaa is any amino acid
MKEETYTISVYSENNLGLLNRISTIFLKRHINVESLTVSNTEIENVSRFIIVVNMTEEKVKKIIGQIEKQIEVIKAYYHTNDESIYIQSALFKIKSNLLFDERQIQNSIKNSNAQIVTVSPDFFVIQKSGRKEEIEALYNELLPFGIMQFVRSGRISVSKEEMKISEILNNQLNSKDKN

SEQ ID NO: 21615 - DNA, 465 bp, Unknown
  Obtained from environmental sample
  misc_feature (1)..(465): n is a, c, g, or t
ttgcaaggagaacatgaaattcgatttatactaagcgactattatataattagaacttcttggttatattctgaatttaaaaataattttgtaaaaacgatgctaaatctagcatcaaaaagaagtgaattaagtattgttaatgatcaaaaagggactcctacaaatgcaaacgatttatcagaagctattgtaaaggtaattaatagcgataaaaaagcatttgggctatatcattttagtaacttaggtgaaacaacgtggtttaattttgcgaataagatatttgaattaactaataccaaaatcaaacttataccagtaaactcttcggaatatgtaaccaaagcactcagaccaaagtacagtgtaatggataaaacaaaaataatagacacctttgatttaaaggttttagattgggcaaaaagtttaaaaaatcatttaaataaccatggatcttaa

SEQ ID NO: 21616 - protein, 154 aa, Unknown
  Obtained from environmental sample
  DOMAIN (12)...(145): RmlD substrate binding domain
  misc_feature (1)..(154): Xaa is any amino acid
MQGEHEIRFILSDYYIIRTSWLYSEFKNNFVKTMLNLASKRSELSIVNDQKGTPTNANDLSEAIVKVINSDKKAFGLYHFSNLGETTWFNFANKIFELTNTKIKLIPVNSSEYVTKALRPKYSVMDKTKIIDTFDLKVLDWAKSLKNHLNNHGS

SEQ ID NO: 21617 - DNA, 354 bp, Unknown
  Obtained from environmental sample
  misc_feature (1)..(354): n is a, c, g, or t
atggtaactaatgatattactatcaaaaacgcaaaagttttaatgttgggtataacctttaaagagaattgcccagatattagaaatacaaaagcaattgatgtatataacgctttaacaaactttaatatgaatgttgatgtctatgatccgtgggcaaatacaaatgaagtaaaaagcgaatacggaattaatacaattgaaacactttcaggagaatatgatgctatagtccatgttgtagcacacaaagagttttcagaaattaatttagacagcttaaagcatcgtaactcaatagtgtatgatgttaaaggtagcttagatataaataaaataaataaaagattataa

SEQ ID NO: 21618 - protein, 117 aa, Unknown
  Obtained from environmental sample
  DOMAIN (14)...(110): UDP-glucose/GDP-mannose dehydrogenase family, UDP binding domain
  misc_feature (1)..(117): Xaa is any amino acid
MVTNDITIKNAKVLMLGITFKENCPDIRNTKAIDVYNALTNFNMNVDVYDPWANTNEVKSEYGINTIETLSGEYDAIVHVVAHKEFSEINLDSLKHRNSIVYDVKGSLDINKINKRL

SEQ ID NO: 21619 - DNA, 363 bp, Unknown
  Obtained from environmental sample
  misc_feature (1)..(363): n is a, c, g, or t
atgatttcgaaaattacacctttatctaaagatttaaaagaacaacttcaaaaaaaaatagattttaaaacaaaacctttaggttctttaggtatgttagagccaattgctattcaaattggtagcattcaaaatactttatcgccaaaaattacaaaaccaactattgttgtctttgcaggagaccatggtattgtaaactcaaaagctgtaagtccgtacccacaagaagttacacaacaaatggtgtttaactttttacatggtggcgcttgcattaatgttttttgcaaacaaaattacatccatttaacaattgtagatgccggtgtaaatgccaattctgagaaaaatgaccattga

SEQ ID NO: 21620 - protein, 120 aa, Unknown
  Obtained from environmental sample
  DOMAIN (1)...(119): Phosphoribosyltransferase
  misc_feature (1)..(120): Xaa is any amino acid
MISKITPLSKDLKEQLQKKIDFKTKPLGSLGMLEPIAIQIGSIQNTLSPKITKPTIVVFAGDHGIVNSKAVSPYPQEVTQQMVFNFLHGGACINVFCKQNYIHLTIVDAGVNANSEKNDH

SEQ ID NO: 21621 - DNA, 483 bp, Unknown
  Obtained from environmental sample
  misc_feature (1)..(483): n is a, c, g, or t
atgccaagaatcagtactattgataagcttcaagctaaaatagaaaaggatatcgcttggagaaagaaagagtgtgcagatatcttcgctatcaactctctccaaacagagtataaccagaaggtgagtataaaagcttcagtagttattttatactcacattgggaaggctttgtgaagaaggcctcagcattttacttagactttctatctagtcaacgattgaagtacagggacttagacgagaggtttattatccattacattagtcaagcatactgcgatataaatactaagttcacaaagtctcttatatacgatatccatttccaagataagattggtcatgcagaggatgtctttaaagtcgacggcttcacagagctgaataagttttctaacataaacagcgagcaattctttgacatacttagaaccatttgcatagacgagagtagtccagcagtcaagtacttgacctaa

SEQ ID NO: 21622 - protein, 160 aa, Unknown
  Obtained from environmental sample
  misc_feature (1)..(160): Xaa is any amino acid
MPRISTIDKLQAKIEKDIAWRKKECADIFAINSLQTEYNQKVSIKASVVILYSHWEGFVKKASAFYLDFLSSQRLKYRDLDERFIIHYISQAYCDINTKFTKSLIYDIHFQDKIGHAEDVFKVDGFTELNKFSNINSEQFFDILRTICIDESSPAVKYLT

SEQ ID NO: 21623 - DNA, 360 bp, Unknown
  Obtained from environmental sample
  misc_feature (1)..(360): n is a, c, g, or t
atgaaaaccaaggagctagccaataatcctaatttggactatgaaaaagaagcgctgatattctctaaaacctttaaggttattaacgatacgctgggggaggattcgtttagaaaatatgatggcagtagatataaaggaccattctcattatcaatatacgaagtgattgcactgggtgtaggttacctatttagtgaagaccctgacttagataagcagcaattggctgataaaattaccactgtctcagaagagctacgcactaatgcagaatatattgctaacagtggttctggttatagagcaaaccaaagattaccaaagttaattcctttaggaagacatatcttaagctaa

SEQ ID NO: 21624 - protein, 119 aa, Unknown
  Obtained from environmental sample
  misc_feature (1)..(119): Xaa is any amino acid
MKTKELANNPNLDYEKEALIFSKTFKVINDTLGEDSFRKYDGSRYKGPFSLSIYEVIALGVGYLFSEDPDLDKQQLADKITTVSEELRTNAEYIANSGSGYRANQRLPKLIPLGRHILS

SEQ ID NO: 21625 - DNA, 402 bp, Unknown
  Obtained from environmental sample
  misc_feature (1)..(402): n is a, c, g, or t
atgagccaacattcctcaccgtttagtaagcagcaattactgcctcaagaagagactttagaaatcttaaggcaaaaaggagagctttttatagggattccaagagaaaatcaatatcaagaaaaacgcatttgtcttaccccggatgcagtaaatgcaattacagccaacggacataggatacttatagaatctggagcgggggatggtgccaattattcagatttggaatttaccaaagctggagctgaaattaccagggataccaagaaagtctttgcctgccctataattttaaaggtagaaccccctacaattcaggaggttcagatgataaatccacaaaccacgatcatatctgccctgcagatcaaaacccaaagtaagaagtattttgagtaa

SEQ ID NO: 21626 - protein, 133 aa, Unknown
  Obtained from environmental sample
  DOMAIN (32)...(131): Alanine dehydrogenase/PNT, N-terminal domain
  misc_feature (1)..(133): Xaa is any amino acid
MSQHSSPFSKQQLLPQEETLEILRQKGELFIGIPRENQYQEKRICLTPDAVNAITANGHRILIESGAGDGANYSDLEFTKAGAEITRDTKKVFACPIILKVEPPTIQEVQMINPQTTIISALQIKTQSKKYFE

SEQ ID NO: 21627 - DNA, 357 bp, Unknown
  Obtained from environmental sample
  misc_feature (1)..(357): n is a, c, g, or t
atgtggttgtttatggccaaattggtacccctgctacttttggtcctgtgtttttttacctgtaaacattggtggtatcatgtgttattgattcctatatccatgtttacttttcagattgtctccttaatttacgaggatcggtttatagatgaggtagaaattttttggttgctacctataatgaccgtgataataccctttgtttacttcattcgtttaaagttatttgacaagcatgttcttggaattgatttggaggccatggacagagaattgaaagcttataaggaaaaggagaccaaggaaaaagagggccttcaaaaagaagaaatggcaaaagaaaaaatatcgtaa

SEQ ID NO: 21628 - protein, 118 aa, Unknown
  Obtained from environmental sample
  misc_feature (1)..(118): Xaa is any amino acid
MWLFMAKLVPLLLLVLCFFTCKHWWYHVLLIPISMFTFQIVSLIYEDRFIDEVEIFWLLPIMTVIIPFVYFIRLKLFDKHVLGIDLEAMDRELKAYKEKETKEKEGLQKEEMAKEKIS

SEQ ID NO: 21629 - DNA, 546 bp, Unknown
  Obtained from environmental sample
  misc_feature (1)..(546): n is a, c, g, or t
atggagaccatacaagaagtgaaaacaagagtatacaaatttggaaataaaactgctgatggaaataccaccatgaaaaatcttttaggtggtaaaggagcaaatttagcagaaatgagtgcaattggaataccggttcctccgggatttacaataactacagaagtctgtacagaatacaaccttcttggtaaagatgccgtagtaaaaatgattacaaaagaagttgaagatgctatagaaaatcttgaagatataatgggcgctaaatttggcgataaggaaaatccattattagtatctgttcgttcaggtgcaagagtttctatgccaggtatgatggatactgttttaaacttaggattaaatgataaagttgtggctggtatcgccaaaaaaactggaaatgaacgttttgcctgggattcatatcgtcgttttattcaaatgtatggagacgttgtattgggtatgaaacctgaatcaaaagaagatattgatccttttgaagaaataatggaagctttaaagcataaacgcacatag

SEQ ID NO: 21630 - protein, 181 aa, Unknown
  Obtained from environmental sample
  DOMAIN (9)...(180): Pyruvate phosphate dikinase, PEP/pyruvate binding domain
  misc_feature (1)..(181): Xaa is any amino acid
METIQEVKTRVYKFGNKTADGNTTMKNLLGGKGANLAEMSAIGIPVPPGFTITTEVCTEYNLLGKDAVVKMITKEVEDAIENLEDIMGAKFGDKENPLLVSVRSGARVSMPGMMDTVLNLGLNDKVVAGIAKKTGNERFAWDSYRRFIQMYGDVVLGMKPESKEDIDPFEEIMEALKHKRT

SEQ ID NO: 21631 - DNA, 414 bp, Unknown
  Obtained from environmental sample
  misc_feature (1)..(414): n is a, c, g, or t
atgtttaaaaaaggaactaaaatctatagtattatcaataacaaatgtccaaaatgcaatgagggtaatttttttgaagataataatccgtttcatttaaaaaaggtaatgaaaatgggtgctaattgcacaaattgcggatttaaatattcgattgagccttcttttttctatggcgccatgtatgtttcctatggcttaacggtaggtttatctattataacatttataattctttatgtaatagggttggatctattaactatatttatagggatttttattggcttagtgttatttactccttttaccttgagactggccaggttgatttacattaatatctttgtaagctatgatgccaattacaggaatgaagacaagataaaggcagttaataaaaacgagttatag

SEQ ID NO: 21632 - protein, 137 aa, Unknown
  Obtained from environmental sample
  misc_feature (1)..(137): Xaa is any amino acid
MFKKGTKIYSIINNKCPKCNEGNFFEDNNPFHLKKVMKMGANCTNCGFKYSIEPSFFYGAMYVSYGLTVGLSIITFIILYVIGLDLLTIFIGIFIGLVLFTPFTLRLARLIYINIFVSYDANYRNEDKIKAVNKNEL

SEQ ID NO: 21633 - DNA, 606 bp, Unknown
  Obtained from environmental sample
  misc_feature (1)..(606): n is a, c, g, or t
atgaacgaggtagaaaatattttaataattaattctgaagctaacaaattatatattcaagtgaatactactatcaattacaaaactgtttcagggatagattttgatagttattattttattgatgatgatttttatcaaaatgatgctattgcttacaaaagattaaaagttggtgaacctgaatttttaaaaaaatataaaggaagatttaaagctgatgaagctttgaaactttaccaagaaacgtatgaagctgaaaaaaataatacaaattatcatttaggcatctatcagcattttaaagatgaaaaatatgataaaaacaccttagtaaaagtgttggcagattttgaaaaattctccaacaatccagaagatttaaaggctattgcttataagtaccaagaattaggtgaaaatgaaaaagccctttctgtgtataaaaatattttagaattaagaccaaattatagtcaatcttatagagatattgccaatgttttattggatttagaacaatataatgaagctaataaagcgtatcaatattacttgcataaggattttaatattgaagatcatgatattggagaaattttaatn

SEQ ID NO: 21634 - protein, 202 aa, Unknown
  Obtained from environmental sample
  DOMAIN (125)...(158): TPR Domain
  misc_feature (1)..(202): Xaa is any amino acid
MNEVENILIINSEANKLYIQVNTTINYKTVSGIDFDSYYFIDDDFYQNDAIAYKRLKVGEPEFLKKYKGRFKADEALKLYQETYEAEKNNTNYHLGIYQHFKDEKYDKNTLVKVLADFEKFSNNPEDLKAIAYKYQELGENEKALSVYKNILELRPNYSQSYRDIANVLLDLEQYNEANKAYQYYLHKDFNIEDHDIGEILX

SEQ ID NO: 21635 - DNA, 354 bp, Unknown
  Obtained from environmental sample
  misc_feature (1)..(354): n is a, c, g, or t
gtgtatcaatcttcggataaatttttgaacccaacaaatcaatatggatatggcattccagattttgaacaagcgttatacatatatcaaacttctttatcattagaaaattttagcttagataatttaaaaatttatccaaatcctgcaaaaactttctttgagttttcttttagtgttgataatttaatagattacaaacttcaggtttataatgttcttggaaaaaaaaatttggagaaatatagttttacatcaaaaaaaatagatgtttcaaatttagaagcaggaatttatttagttaaaattcaaaaagaaaatcagcaaaaaataataaagttgatcaaacaataa

SEQ ID NO: 21636 - protein, 117 aa, Unknown
  Obtained from environmental sample
  misc_feature (1)..(117): Xaa is any amino acid
MYQSSDKFLNPTNQYGYGIPDFEQALYIYQTSLSLENFSLDNLKIYPNPAKTFFEFSFSVDNLIDYKLQVYNVLGKKNLEKYSFTSKKIDVSNLEAGIYLVKIQKENQQKIIKLIKQ

SEQ ID NO: 21637 - DNA, 429 bp, Unknown
  Obtained from environmental sample
  misc_feature (1)..(429): n is a, c, g, or t
ttgataagaaagtctgacttggagaataaagtatcggattatgggtatgtttctcatcaggtatcggttgcaaatataatgaaagctgatatcttgtggatgatttctaatttttcaaaaaatttgaaacagattaaaacagggaaactctttgagtatataggaacagaaaagccaattttgggattggtttataaaggacagtcatatgagctattaaaaaaatataaagcggggttcactgcttcaccaaataatgaagaagaaatatcagtagttatttgtgcaatttatcaattatggaagaattcgaaacttcccaaagcatctattcaacttgttcaacagtttgatagaaaaaaattaacaggtgaactagctgcattttttgatagtattttagaacaaaggcttaaaagcgaacaatga

SEQ ID NO: 21638 - protein, 142 aa, Unknown
  Obtained from environmental sample
  misc_feature (1)..(142): Xaa is any amino acid
MIRKSDLENKVSDYGYVSHQVSVANIMKADILWMISNFSKNLKQIKTGKLFEYIGTEKPILGLVYKGQSYELLKKYKAGFTASPNNEEEISVVICAIYQLWKNSKLPKASIQLVQQFDRKKLTGELAAFFDSILEQRLKSEQ

SEQ ID NO: 21639 - DNA, 540 bp, Unknown
  Obtained from environmental sample
  misc_feature (1)..(540): n is a, c, g, or t
ttgaaggctttaccatcttgtgtatacaanngcacgcataatccgaatttactgaaggaaacacggaaaggagaaagngtagaagattggggtagatcatggtatttatatgatggagaacaacagcaatttgtgaaatctatggagctctcgtctgaatttatccaagaaattattgacgggcttcttccaaatatcgacgtaaaccgaatttgtctgtttgggtattcaatgggcggttatttagctgggtattttatgctctcaagatggaaacatgtgaacgaggctattataataggggctcgaattaagacagaagtgtttgaagatcgattggaagaagcaaagcatataaaagtattagcattacatggtattaaggacgttagtgtgcttcctaagccacaaatgaaggagatagaggctttgaaaaaagcgggctttaatgctgaatttataggcattgaagatgggcataagctaacaataccattcattaaagcggcttctaaatggcttacaagtatgggctattaa

SEQ ID NO: 21640 - protein, 179 aa, Unknown
  Obtained from environmental sample
  misc_feature (1)..(179): Xaa is any amino acid
MKALPSCVYXXTHNPNLLKETRKGEXVEDWGRSWYLYDGEQQQFVKSMELSSEFIQEIIDGLLPNIDVNRICLFGYSMGGYLAGYFMLSRWKHVNEAIIIGARIKTEVFEDRLEEAKHIKVLALHGIKDVSVLPKPQMKEIEALKKAGFNAEFIGIEDGHKLTIPFIKAASKWLTSMGY

SEQ ID NO: 21641 - DNA, 720 bp, Unknown
  Obtained from environmental sample
  misc_feature (1)..(720): n is a, c, g, or t
gtgtttcctggaaaacatgacgatttggaagaanttgggtatgatacttatcaccatactttattcgaaatgttaggaaattggtcatttggagattattttaagaaagaagcaattgcttgggcttgggaattattaaccgaagtttataaaattgataaggacatcttgtatgtaactgtttttgaaggttcagaagatgctgataaccttaaaatggatacagaagcttttgatatttggaaacaatatattgctgaagacagaattttaaaaggcaataaaaaagataatttttgggaaatgggcgaacaaggaccttgtggaccttgctctgaaattcatgtggatattagatctgcagaagaaaaagcaaaagttgatggacgtactttaatcaacgaagatcatcctcatgttgtggaaatctggaacttggtttttatgcaatataacaggaaagctaatggttctttagaagaattaccaaacaaacatattgatactggaatggggtttgaacgcctttgtatggttttacaaaacgttcaatctaattatgatactgatgttttcacaccaattattagagaaattggtacaattacaaacacaaaatatggttcagacaccaaacaagatattgcaactcgtgtaatttcagatcatgttagagcagttgctttttctattgcagatggtcttaaacccaagcaatag

SEQ ID NO: 21642 - protein, 239 aa, Unknown
  Obtained from environmental sample
  DOMAIN (2)...(239): tRNA synthetases class II (A)
  misc_feature (1)..(239): Xaa is any amino acid
MFPGKHDDLEEXGYDTYHHTLFEMLGNWSFGDYFKKEAIAWAWELLTEVYKIDKDILYVTVFEGSEDADNLKMDTEAFDIWKQYIAEDRILKGNKKDNFWEMGEQGPCGPCSEIHVDIRSAEEKAKVDGRTLINEDHPHVVEIWNLVFMQYNRKANGSLEELPNKHIDTGMGFERLCMVLQNVQSNYDTDVFTPIIREIGTITNTKYGSDTKQDIATRVISDHVRAVAFSIADGLKPKQ

SEQ ID NO: 21643 - DNA, 498 bp, Unknown
  Obtained from environmental sample
  misc_feature (1)..(498): n is a, c, g, or t
ttgatatttttatcaaaacaaatggtggtacaatctaaatctttagatgaaattgtagctttagcaaaagaaaaagaagatatgttagcttcgattcctgcaattttaccaatcaaaaaaggagaattttatgtggcttctggttacaaaatgagaatgcatcccattttaaaaattaataaatttcataaaggaatggattttacagccccaaaaggaacacctgtttatgcctctggaaatggaaaagttaccatagctcaaagaagtagtacttttggaaatgttgtttatattgaacatggttatggctacaaaacaatttatgcacatttaagtaaaattgaagttaaaaaatataacgaagtaaaaagaggagatttaatagggtttgttggtaatactggtttgtctgtagcttcacatttgcattatgaagtgcataaaaatggtatcgctttaaatccaatcaatttttattatgtgatttatctttag

SEQ ID NO: 21644 - protein, 165 aa, Unknown
  Obtained from environmental sample
  DOMAIN (61)...(156): Peptidase family M23
  misc_feature (1)..(165): Xaa is any amino acid
MIFLSKQMVVQSKSLDEIVALAKEKEDMLASIPAILPIKKGEFYVASGYKMRMHPILKINKFHKGMDFTAPKGTPVYASGNGKVTIAQRSSTFGNVVYIEHGYGYKTIYAHLSKIEVKKYNEVKRGDLIGFVGNTGLSVASHLHYEVHKNGIALNPINFYYVIYL

SEQ ID NO: 21645 - DNA, 588 bp, Unknown
  Obtained from environmental sample
  misc_feature (1)..(588): n is a, c, g, or t
ttgatgcaaaattttttaaaatatatactaacctttttgatattacttttatgttttcctgtatcttcatttgggtatgaacgttacaatagagtgaccaaatatgattcatattttaaaaaatatacgaaacactgttttggaccaggttttgactggagatactttaaatcccaagccattgctgaatccaatctgaaccctgatgcaaaatctcatgtaggcgcaaaaggtattatgcagataatgccaagaacgtttgaagagattaagtataaaaacccttcaataaaaggtagtgccttacaaccgaaatggaatattgcagcaggtatttattatgatcgagctatctggaagctatggaaggcaaaaaggcctttctctgacaagctttcatttatgtttggttcatataatgcaggaaaaggtaatattcttaaaacccaaaaaattgctaaaagcaaaggtatggatcccaatatatggtcatccattgaaaaaaatctaattaatgtaacaggaaaacacagtaaagaaactattggttatgttgataaaaaaataagtaaaggagtgttaatatga

SEQ ID NO: 21646 - protein, 195 aa, Unknown
  Obtained from environmental sample
  DOMAIN (37)...(162): Transglycosylase SLT domain
  misc_feature (1)..(195): Xaa is any amino acid
MMQNFLKYILTFLILLLCFPVSSFGYERYNRVTKYDSYFKKYTKHCFGPGFDWRYFKSQAIAESNLNPDAKSHVGAKGIMQIMPRTFEEIKYKNPSIKGSALQPKWNIAAGIYYDRAIWKLWKAKRPFSDKLSFMFGSYNAGKGNILKTQKIAKSKGMDPNIWSSIEKNLINVTGKHSKETIGYVDKKISKGVLI

SEQ ID NO: 21647 - DNA, 363 bp, Unknown
  Obtained from environmental sample
  misc_feature (1)..(363): n is a, c, g, or t
ttgaagcctgaatttaaatcgaagactatggaaaatccttttgaaattatcaatcaaagattagaacgtattgaaactttacttgaaaacatttacagagcaagtaatatcaacgaaacaggaattgccacgactccaattatgaatataaagcaagtttcagcttatttagacctatctgtatcggctttataccaaatgacaagtactaaagagattccgcacgcaaaacgtggtaaaaggctttattttgataaaaaagatatagatgcttgggtattggaaaacaaagtaactacttcaagtgatattgaaagaatggctactgagtatattctcaaaaaccctgttaagtttccttga

SEQ ID NO: 21648 - protein, 120 aa, Unknown
  Obtained from environmental sample
  misc_feature (1)..(120): Xaa is any amino acid
MKPEFKSKTMENPFEIINQRLERIETLLENIYRASNINETGIATTPIMNIKQVSAYLDLSVSALYQMTSTKEIPHAKRGKRLYFDKKDIDAWVLENKVTTSSDIERMATEYILKNPVKFP

SEQ ID NO: 21649 - DNA, 492 bp, Unknown
  Obtained from environmental sample
  misc_feature (1)..(492): n is a, c, g, or t
gtgagagttcgngcggtgaaggaagatggtagtgtttatgatcttcctgttcatttttttgcaccttatgactatcaatttacattaggcaatttcaaatttttaagtccaaataagatattaccaattacagctggtgtggcaggaataaatactggtcggttttttaataaggaattaaatgaaaatgaaatattaattctagagaaaaatgagggtcaggttcatttagacacaaaaaaaaacgaatcatttaattactttttgaaacaatatgtacgtaactggaataataaggacgaagtgtgcaacttcttgcatatgctgcagcctccaaggttactattaacattttcgacgaacaccattcctaggaatgaaaagaaaatcacaagaatcagcataaccgaagtcacttccttctattcaaaaaaaatgggatatcaggtgttaagaactcaggaattaaagagtatttcaattgaagattga

SEQ ID NO: 21650 - protein, 163 aa, Unknown
  Obtained from environmental sample
  misc_feature (1)..(163): Xaa is any amino acid
MRVRAVKEDGSVYDLPVHFFAPYDYQFTLGNFKFLSPNKILPITAGVAGINTGRFFNKELNENEILILEKNEGQVHLDTKKNESFNYFLKQYVRNWNNKDEVCNFLHMLQPPRLLLTFSTNTIPRNEKKITRISITEVTSFYSKKMGYQVLRTQELKSISIED

SEQ ID NO: 21651 - DNA, 642 bp, Unknown
  Obtained from environmental sample
  misc_feature (1)..(642): n is a, c, g, or t
atgtcattggttatagactccgaaattaatccagaaaacaagcatattgctgtagagctggacgaacattattttatctgtgccaataacggaattatgagcatgatagctaatgagattgcacattctaaattagtagaaattaatatacatgataaaatagaaaccagttttcctgttttagatgtctttgtaaaagtagcatgccacatagcacgtggtggaacattagaagttataggcaaagctattgataaaataaaaccaattaaaaatctagtgccttacgttaatgaggagcaaacgcaaataattggcagcataatctacattgacaattatggtaatgtcgttactaatattagaaaaaacttttttgaaacgctgcaaaaaggacgttcttacgaagtgtctgcaagaaattataagttcaaaaaaatacaatccaaatatagcgatattgttaactttgacacaccagaagacaaacgtaatgacgaaggacgtggtttagtcgtctttaacagttccaactatctagaaatagccatatataaaagtaataaccaaacggttggtagtgcaagtagcctaatgggattaggactgcgagatacagtaaccattaatttttttaaataa

SEQ ID NO: 21652 - protein, 213 aa, Unknown
  Obtained from environmental sample
  DOMAIN (2)...(211): Protein of unknown function DUF62
  misc_feature (1)..(213): Xaa is any amino acid
MSLVIDSEINPENKHIAVELDEHYFICANNGIMSMIANEIAHSKLVEINIHDKIETSFPVLDVFVKVACHIARGGTLEVIGKAIDKIKPIKNLVPYVNEEQTQIIGSIIYIDNYGNVVTNIRKNFFETLQKGRSYEVSARNYKFKKIQSKYSDIVNFDTPEDKRNDEGRGLVVFNSSNYLEIAIYKSNNQTVGSASSLMGLGLRDTVTINFFK

SEQ ID NO: 21653 - DNA, 885 bp, Unknown
  Obtained from environmental sample
  misc_feature (1)..(885): n is a, c, g, or t
gtggatcaagaatcggctcgagatattttcattggaaaaatcggaaaaattacttatctggataacaattcggttactgttcaatgtcctgaagatgattttgaaatagaaacaacgtctgaaatttgggaaaatgtaagttattctatcaataaagacacgaaagaaatatctgaaaatattacgggttctttttcacaaataccgttacgattggcttgggctattaccattcataaaagtcagggcttaactttcgaaaaagctattattgatgccggagcatcatttgctcacggtcaaacatatgttgccttgagtagatgtacatctttagaaggagttattttaaaaacacaaattaaggatagtagtattattaatgataatcgtgtagcaaagtttactaaagatgtagaagagaacctcccaaatgaaacagaattaactaattctcaaaaagaatatcaattaaatttgattgaagatctgtttagttatcaatcgtttttatatcctgtacaacggttaattaaaatttattatgaaaataaaacaagttttaaaggaaatataattgaacctctgaaccaaattaaggacaaagggattgttcttttaatgcaagtagtgacatcttttaaaaaccaactagtaaaattaagcgaaactattgccaatcctgaagaagataaagcaatccaagaacgcattgatcaaggaattcattattttattgagcgaactgttgacgatcttcagaaaccactagatgcaattactttttcatctgataatccagctgtacataaggattttacgaaacagattgatattctcgaagaattattagcacataaattgacttgttatcaggttggctaa

SEQ ID NO: 21654 - protein, 294 aa, Unknown
  Obtained from environmental sample
  misc_feature (1)..(294): Xaa is any amino acid
MDQESARDIFIGKIGKITYLDNNSVTVQCPEDDFEIETTSEIWENVSYSINKDTKEISENITGSFSQIPLRLAWAITIHKSQGLTFEKAIIDAGASFAHGQTYVALSRCTSLEGVILKTQIKDSSIINDNRVAKFTKDVEENLPNETELTNSQKEYQLNLIEDLFSYQSFLYPVQRLIKIYYENKTSFKGNIIEPLNQIKDKGIVLLMQVVTSFKNQLVKLSETIANPEEDKAIQERIDQGIHYFIERTVDDLQKPLDAITFSSDNPAVHKDFTKQIDILEELLAHKLTCYQVG

SEQ ID NO: 21655 - DNA, 471 bp, Unknown
  Obtained from environmental sample
  misc_feature (1)..(471): n is a, c, g, or t
ttgttcaatcggttcaaggccaatgagtttgtacattacaataaaattgttcgggtcaatggacaactctgctatctgtcaggttgcaggctcaacaacagaaatgcgaaacaagattttctgattatcgtatcgtttaacaaacctgaacaggcacaaacagattacaaacagcgatggcagatagagatgtgttttaaagcaatgaaatctagcggatttgatattgaaaagacacatctgcaagatattcagagaatagaaaaactggtattactggtaatgattgcttttgtttggtgctataaagttggaatttatttgcaccagattaagccaattacgataaaaaaacatggtagaaaagccaaaagcatctttaaatatgggctttacttcttggctaatgtgttgctaaactctgaaaatcaaaaaaatatagatgtatttcattttttgtcatgtacttag

SEQ ID NO: 21656 - protein, 156 aa, Unknown
  Obtained from environmental sample
  misc_feature (1)..(156): Xaa is any amino acid
MFNRFKANEFVHYNKIVRVNGQLCYLSGCRLNNRNAKQDFLIIVSFNKPEQAQTDYKQRWQIEMCFKAMKSSGFDIEKTHLQDIQRIEKLVLLVMIAFVWCYKVGIYLHQIKPITIKKHGRKAKSIFKYGLYFLANVLLNSENQKNIDVFHFLSCT

SEQ ID NO: 21657 - DNA, 306 bp, Unknown
  Obtained from environmental sample
  misc_feature (1)..(306): n is a, c, g, or t
ttgcaaataaaaacaatggcacagaccaaaatatccatagtcaatacttctaacgatactattaagaagtttgaagcagaccgattcctaactaaccataacagttttgaattcaacaacatagacgaagcanagcactcacccttagctcagcaattattctatcttccgtttgtaaaaaaagtatatatcgcatctaattttatagccatagaacgctataatattgtagaatggaaagatgtagaaaatggagttgctaaacaaaatgaagattacttatctaatgatggtattggtggttag

SEQ ID NO: 21658 - protein, 101 aa, Unknown
  Obtained from environmental sample
  misc_feature (1)..(101): Xaa is any amino acid
MQIKTMAQTKISIVNTSNDTIKKFEADRFLTNHNSFEFNNIDEAXHSPLAQQLFYLPFVKKVYIASNFIAIERYNIVEWKDVENGVAKQNEDYLSNDGIGG

SEQ ID NO: 21659 - DNA, 450 bp, Unknown
  Obtained from environmental sample
  misc_feature (1)..(450): n is a, c, g, or t
atgagcaatatcgtattaaaaacaatttattttgagactggacacgcactttatggttatgacggaaagtgcaaaaacgtccatggacacagttacaaactagatgtaacagtaataggtacaccaatttctgatagcaacaatgtaaaatttggaatggtaatagactttacagatctaaaaaaaatagtaaaagaagaaattgtagacgtttttgatcacgccacagtatttaacaaaaacacaccacatgtccaactagccaaagagcttcaggacagagaccacaacgtgttactggtagattatcaaccaaccagcgaaatgatggtcatcgattttgcacaaaaaatacaagaccgtttaccaaacaacatcaaactgcactctttaaaactatccgaaaccgcaaccagctacgcacaatggtacgccagcgataaccaataa

SEQ ID NO: 21660 - protein, 149 aa, Unknown
  Obtained from environmental sample
  DOMAIN (1)...(146): 6-pyruvoyl tetrahydropterin synthase
  misc_feature (1)..(149): Xaa is any amino acid
MSNIVLKTIYFETGHALYGYDGKCKNVHGHSYKLDVTVIGTPISDSNNVKFGMVIDFTDLKKIVKEEIVDVFDHATVFNKNTPHVQLAKELQDRDHNVLLVDYQPTSEMMVIDFAQKIQDRLPNNIKLHSLKLSETATSYAQWYASDNQ

SEQ ID NO: 21661 - DNA, 654 bp, Unknown
  Obtained from environmental sample
  misc_feature (1)..(654): n is a, c, g, or t
gtgagcgaaaagatggtggatttgggcgattatgttgaacgtgggatgcctatttatgagatttcggatctttccaaagtttgggtgctcttcgatttatatgaaagtgaacttgcctggatcaaggaaggcagtgaaattgaatataccgtcaattcgttgccgggagaaaccttcacaggaaaaatcagttttatagatccgctgatcaatcctcaaacccgggtagcttcggctcgtgttgaggtaagtaataaagacggtcggttaaaacccgaaatgtttgtttcgggaatagtaaaaaataaaatcggaaaagtagattccaaagaaatcgtaattccgaaatcggcagtattgtggaccggaaaacgctcagtggtttatataaaagaaggttcgggtttcaaaatgcgcgaaattactttgggaccagcccttggtgatgcatatatcgttaaggatggattggaaattggggaagaaattgtgtctaatggaacctttaccgttgacgccgcagttcaactttccggcaggcccagtatgatgaacccagagggtggagctgtggctactggccatgcaggtatggatatgggtggcgataaaaacgaaaaaagttctaagacggaaatgagcgctgagaaatga

SEQ ID NO: 21662 - protein, 217 aa, Unknown
  Obtained from environmental sample
  misc_feature (1)..(217): Xaa is any amino acid
MSEKMVDLGDYVERGMPIYEISDLSKVWVLFDLYESELAWIKEGSEIEYTVNSLPGETFTGKISFIDPLINPQTRVASARVEVSNKDGRLKPEMFVSGIVKNKIGKVDSKEIVIPKSAVLWTGKRSVVYIKEGSGFKMREITLGPALGDAYIVKDGLEIGEEIVSNGTFTVDAAVQLSGRPSMMNPEGGAVATGHAGMDMGGDKNEKSSKTEMSAEK

SEQ ID NO: 21663 - DNA, 564 bp, Unknown
  Obtained from environmental sample
  misc_feature (1)..(564): n is a, c, g, or t
atggcacgaaaaaaattccaaattcctgatatgtacaagtcgcccattatccgaaaggttaaagaggcaactaaaattactgatccaatgaaaaaagatctgaagccgaccgttctagattttggttcggttcagttttatatcccgcgattttttggattttgttacggtgtagagaatgctatcgatattgcttatcgagcagtggagaagaatcctgacaagaatatttatttacttagtgagatgattcataaccccacggtgaatgaagatttgttggccaaaggcgtgcggtttttattcgatacagatggcacagaacgtatttcaatttcttcattgaatccagaagatattgtaattgtaccggcttttgggacaactgtcgagattcaagaagagttaaaacaagtaggaattgatccttatgagtttaacacaacctgtccgtttgtagagaaagtttggaaacgtgggaagcaactgggcaagaaagatacagttgggttgtgcttgggaaacatcaggccgaggaaaacagaggctactttttcgcattna

SEQ ID NO: 21664 - protein, 188 aa, Unknown
  Obtained from environmental sample
  misc_feature (1)..(188): Xaa is any amino acid
MARKKFQIPDMYKSPIIRKVKEATKITDPMKKDLKPTVLDFGSVQFYIPRFFGFCYGVENAIDIAYRAVEKNPDKNIYLLSEMIHNPTVNEDLLAKGVRFLFDTDGTERISISSLNPEDIVIVPAFGTTVEIQEELKQVGIDPYEFNTTCPFVEKVWKRGKQLGKKDTVGLCLGNIRPRKTEATFSHX

SEQ ID NO: 21665 - DNA, 645 bp, Unknown
  Obtained from environmental sample
  misc_feature (1)..(645): n is a, c, g, or t
atgaacatagattttactaaaaataacgacggattagtggcagccataatacaagatagtaccaccaaaaatgtattaatgttggggtatatgaatgaagatgcttttaatacgactgaaaaaactaagacagtcactttttacagccgatcgaaccaaagactctggatgcaaggtgaagaaagcggaaacgttttaaacgtggttgatataaaattagattgtgataatgatacattattaattctagtaaaacctgaagggcctacccgtcataaaggatcttatacgtgttggaacactaaaaacgaagaacattacgggtttatttctattttagaaaacaccatagaatcccgtattaaatctggtaattctgaatactcatatgtcgcttcactttttgaaaaaggaataaataaaatagcccaaaaagtaggagaggaggctattgaagtggttattgaagctaaagataataacgatgaattatttttaagcgaaagtgccgatttactatttcattacttattattactgcaagcaaaggggtttaaaattaacgatgtggtttcagttttacaagaacagagaccaatgatttttcaagatttcacaaacatatcattccataagtcaggttga

SEQ ID NO: 21666 - protein, 214 aa, Unknown
  Obtained from environmental sample
  DOMAIN (137)...(202): MazG nucleotide pyrophosphohydrolase domain
  misc_feature (1)..(214): Xaa is any amino acid
MNIDFTKNNDGLVAAIIQDSTTKNVLMLGYMNEDAFNTTEKTKTVTFYSRSNQRLWMQGEESGNVLNVVDIKLDCDNDTLLILVKPEGPTRHKGSYTCWNTKNEEHYGFISILENTIESRIKSGNSEYSYVASLFEKGINKIAQKVGEEAIEVVIEAKDNNDELFLSESADLLFHYLLLLQAKGFKINDVVSVLQEQRPMIFQDFTNISFHKSG

SEQ ID NO: 21667 - DNA, 666 bp, Unknown
  Obtained from environmental sample
  misc_feature (1)..(666): n is a, c, g, or t
atgccgatcataacctcgacatacaagccgccattgttttctaaaaatgcccatttagcgaccatttattctggtttgatgagacgtgtaaaaggtgtgcaacaaaaacgcgaacgcattacgctatccgatagtgattttatggatttagattggagtttttccaaagaaaaatcagataaactcatcgttattcttcacggtttggaaggcgatgcacaacgccattatatgttggggtctgcaaaactttttaatgaacacgaaggcgatgccgtttgcgtaaactttagaggctgtagtggcgaggaaaatactaaattcaggtcttaccattctggaattactgaagatttagaggaagtgattcaatatattcttcaacaaaaagagtatagcgaaatttatcttaacggttttagtttaggaggcaatgtaattttgaagtacttaggcacacacgctaatttaccttccgaaataaagggagcagtggcaatttcggtacctgtgcatttaaaaggatcgatgttgcaattgcatacatttaaaaacattttgtataatattcggtttaagcgtcatttaatagataaacttaagcgtaaacgcgattatttccccgacgaactctcagtagaaactattaaaagtgtaaaacgctaa

SEQ ID NO: 21668 - protein, 221 aa, Unknown
  Obtained from environmental sample
  misc_feature (1)..(221): Xaa is any amino acid
MPIITSTYKPPLFSKNAHLATIYSGLMRRVKGVQQKRERITLSDSDFMDLDWSFSKEKSDKLIVILHGLEGDAQRHYMLGSAKLFNEHEGDAVCVNFRGCSGEENTKFRSYHSGITEDLEEVIQYILQQKEYSEIYLNGFSLGGNVILKYLGTHANLPSEIKGAVAISVPVHLKGSMLQLHTFKNILYNIRFKRHLIDKLKRKRDYFPDELSVETIKSVKR

SEQ ID NO: 21669 - DNA, 402 bp, Unknown
  Obtained from environmental sample
  misc_feature (1)..(402): n is a, c, g, or t
atgatgaccaatgagtcgtttttactgatttacgactccagggagaccgaaaattggattccagaaattaaaaattcgaagtttaaacgaaatttcggaaaaacgggtagtgtttatgatattgttgtagaaaatcaagatcaagaaattaaaatgactcaaaaagtgatggcttatgtgcctaatgaaaaagttaccttattttttgatgctgaaaatatgttaaaaaaagacgattacactttttctgaaaatgatggtgtaaccactataaatttgaattcagcttgtaatagtaaatcgtacataatgtcttgtatgttgcctttttttgctgataaattagaagctcaaagtcaaacgtatttagataactttaaagagtatattgaaaaggagtag

SEQ ID NO: 21670 - protein, 133 aa, Unknown
  Obtained from environmental sample
  misc_feature (1)..(133): Xaa is any amino acid
MMTNESFLLIYDSRETENWIPEIKNSKFKRNFGKTGSVYDIVVENQDQEIKMTQKVMAYVPNEKVTLFFDAENMLKKDDYTFSENDGVTTINLNSACNSKSYIMSCMLPFFADKLEAQSQTYLDNFKEYIEKE

SEQ ID NO: 21671 - DNA, 381 bp, Unknown
  Obtained from environmental sample
  misc_feature (1)..(381): n is a, c, g, or t
ttgtttttaactgctatttatacaatcgcatttttaatattttctaatttcgaaatcttttattctactattttaataataccaatggttgtatttttgatcttgaaaaaagtaaagaaacgtttctataaaatttctgatgatatgttattagttggtaaaggattgttagaaacgcatgttacttatttagaaatctttaaagttcaaaacataaaattacagcaaactattttccaaaaaagaagcaatgttgcaaatttaattttacaaacagcatcaggaaaaataaaaattccttgtatcaattttaaagaagccatcaacatttataatcatactttgtacaaagtagaaacgagccaaacttcatggatgtaa

SEQ ID NO: 21672 - protein, 126 aa, Unknown
  Obtained from environmental sample
  DOMAIN (37)...(114): Bacterial membrane flanked domain
  misc_feature (1)..(126): Xaa is any amino acid
MFLTAIYTIAFLIFSNFEIFYSTILIIPMVVFLILKKVKKRFYKISDDMLLVGKGLLETHVTYLEIFKVQNIKLQQTIFQKRSNVANLILQTASGKIKIPCINFKEAINIYNHTLYKVETSQTSWM

SEQ ID NO: 21673 - DNA, 540 bp, Unknown
  Obtained from environmental sample
  misc_feature (1)..(540): n is a, c, g, or t
ttgttagaaacaaaggacaatggattgaagttgaaaaataaaagtttcccacgaaagtggtatttttttaatactaaaactatgaattttaaagaagtgcaaagattgaaccaatggtggctttgggtgttgttaattggcattggattgataccaatatatggtatttataaacaattaattattggtcaaagttttggagataaacctttatctaatcaaggcttaattgcttttacaataatcctttttttagttattgggctttttggattaattcgtttaaaaacagaaattgaccattccgaaattagaatgtcttttaatccgtttgtaaaaaagaaggttaaattaaacgatgttaaaaccatggaagttgtaaactatggttttgttgttggttggggaattagattatggactaaatacggaacagtttataacataaaaggtaataaaggactatctatcacacttaaagatggaagtaatttattattgcacgcaaaaagaaccgacttaagtctgtataaaacttaa

SEQ ID NO: 21674 - protein, 179 aa, Unknown
  Obtained from environmental sample
  misc_feature (1)..(179): Xaa is any amino acid
MLETKDNGLKLKNKSFPRKWYFFNTKTMNFKEVQRLNQWWLWVLLIGIGLIPIYGIYKQLIIGQSFGDKPLSNQGLIAFTIILFLVIGLFGLIRLKTEIDHSEIRMSFNPFVKKKVKLNDVKTMEVVNYGFVVGWGIRLWTKYGTVYNIKGNKGLSITLKDGSNLLLHAKRTDLSLYKT

SEQ ID NO: 21675 - DNA, 330 bp, Unknown
  Obtained from environmental sample
  misc_feature (1)..(330): n is a, c, g, or t
ttgcagaaaaggttggtaaagtgtaaaaaatccttaaatttgcacctcgaaattagaatacaattaaagcatttagcgatgaaaaaagatatacatccagaaaattatagattagtagcatttaaagacatgtctaatgaagacgtttttttaactaagtctacggcaaacacgagcgaaacaattgagttcgaaggtgcagaatacccgttaataaaaatggagatttctagaacatctcacccgttttatacaggtaagtctaaattaattgataccgcaggtcgtatcgataaattcaaaaacaaatacgcgaaattcaaaaaataa

SEQ ID NO: 21676 - protein, 109 aa, Unknown
  Obtained from environmental sample
  DOMAIN (27)...(107): Ribosomal protein L31
  misc_feature (1)..(109): Xaa is any amino acid
MQKRLVKCKKSLNLHLEIRIQLKHLAMKKDIHPENYRLVAFKDMSNEDVFLTKSTANTSETIEFEGAEYPLIKMEISRTSHPFYTGKSKLIDTAGRIDKFKNKYAKFKK

SEQ ID NO: 21677 - DNA, 309 bp, Unknown
  Obtained from environmental sample
  misc_feature (1)..(309): n is a, c, g, or t
atgtataatgctaaaactttaggtaaaataaaagctcctaacctacgtaaacgacaggattggttattgtggttgtcagccatcaaaaagtctggtaaacctgctctaggtatccaagagccattagcatattatcgtgtcagagcaaactctatctcttctaataaattagagttattaaaacataactattgggtgtataaaaaaggcttaggcttttcaacaataaaatccatatacagcatggttatttttatttacgaacatttttttgtaaagtctagattaattgtatctactaaacaatag

SEQ ID NO: 21678 - protein, 102 aa, Unknown
  Obtained from environmental sample
  misc_feature (1)..(102): Xaa is any amino acid
MYNAKTLGKIKAPNLRKRQDWLLWLSAIKKSGKPALGIQEPLAYYRVRANSISSNKLELLKHNYWVYKKGLGFSTIKSIYSMVIFIYEHFFVKSRLIVSTKQ

SEQ ID NO: 21679 - DNA, 819 bp, Unknown
  Obtained from environmental sample
  misc_feature (1)..(819): n is a, c, g, or t
ttgcagaccatttcggatagattaaatcagaccgaccttaccaaacggaacgaaaagattattgtggagaatccaagtgaggaaattgggaaattgattacctcttataacgaaatgatagacgagctggaaattagtgctgcaaaattggccaaaggggaaagggagcaggcatggcgagaaatggcaaaacaggtggctcatgaaattaaaaatccacttacgcctatgcgtctaagcgtgcagagttttgaacgtaagttcgatcctaattacccagacattgcaagaaaggtttcggaatattcaaaaacattgattcagcagatcgatactatgagcagtatcgcctctgctttttccaactttgccaatatgcctgcccagcagaacgaaaccttaaatgtggtgaaaatcgtgaaaatggcagtggatatttttgatgaaaactatattcatttttcatccgatgaagaggaaataatagccaaattagatcgtacacaattaataagggttgttaccaatctagtcaaaaatgccactcaggccattgtaaatgtcgatactcccaatgttttggtaaccgtttccaaagatggggatttcgtaaaaatgacggtggaggataatggtatgggaatctcaatggaatcaaaggacaaggtgttcgaacctaagttcaccaccaagactagcggtatgggccttggtcttgggatggtcaagaatatcgtgcaaaactataaacgaaccatcaactttaataccgaacccggtaaggtaccgcttttacggtgcggttcccatcgnacatga

SEQ ID NO: 21680 - protein, 272 aa, Unknown
  Obtained from environmental sample
  DOMAIN (58)...(129): His Kinase A (phosphoacceptor) domain
  misc_feature (1)..(272): Xaa is any amino acid
MQTISDRLNQTDLTKRNEKIIVENPSEEIGKLITSYNEMIDELEISAAKLAKGEREQAWREMAKQVAHEIKNPLTPMRLSVQSFERKFDPNYPDIARKVSEYSKTLIQQIDTMSSIASAFSNFANMPAQQNETLNVVKIVKMAVDIFDENYIHFSSDEEEIIAKLDRTQLIRVVTNLVKNATQAIVNVDTPNVLVTVSKDGDFVKMTVEDNGMGISMESKDKVFEPKFTTKTSGMGLGLGMVKNIVQNYKRTINFNTEPGKVPLLRCGSHRT

SEQ ID NO: 21681 - DNA, 360 bp, Unknown
  Obtained from environmental sample
  misc_feature (1)..(360): n is a, c, g, or t
ttgatcggccgagggttattacgccgcattattgttatcggtttggtactcttccccaccgtcaatgatttactggctagttacggatatgcagtcgtagaagatgataacagtctattcttaggctttatctccttcttttggattaatgtcattgcttttgtattgtctattactgcacaagccgcaatgattctgcgttattcttttagctggtggctatggattatcgttaattttgtttggctgattgtgaacctcatgtcaggcaactatatctttgccattcaaaccatcatctaccaagtcaactctttcgttggtctttatgaatggtatcgcagcgagcaacactattag

SEQ ID NO: 21682 - protein, 119 aa, Unknown
  Obtained from environmental sample
  misc_feature (1)..(119): Xaa is any amino acid
MIGRGLLRRIIVIGLVLFPTVNDLLASYGYAVVEDDNSLFLGFISFFWINVIAFVLSITAQAAMILRYSFSWWLWIIVNFVWLIVNLMSGNYIFAIQTIIYQVNSFVGLYEWYRSEQHY

SEQ ID NO: 21683 - DNA, 318 bp, Unknown
  Obtained from environmental sample
  misc_feature (1)..(318): n is a, c, g, or t
gtgcatgattttttaaacgaaaattatgcacgaaaaatctctttacatgaaatttctgatttggtaaatatgagtcaaagctcttttaatcgctttataaaaaaaagaacaggaaaaacgtttatcgagtttacaaatgatacaagaattagttacgcaacaaaatttttagtagaaacagatttatcaattggagaaatagggtataaatgtggttttaatagcattgcaaattttaatcgattttttaaaaaatctaaaaacattacaccaagtaaatttaaatcagaatttaaatcaatacaacgattcaaataa

SEQ ID NO: 21684 - protein, 105 aa, Unknown
  Obtained from environmental sample
  DOMAIN (2)...(46): Bacterial regulatory helix-turn-helix proteins, AraC family
  misc_feature (1)..(105): Xaa is any amino acid
MHDFLNENYARKISLHEISDLVNMSQSSFNRFIKKRTGKTFIEFTNDTRISYATKFLVETDLSIGEIGYKCGFNSIANFNRFFKKSKNITPSKFKSEFKSIQRFK

SEQ ID NO: 21685 - DNA, 357 bp, Unknown
  Obtained from environmental sample
  misc_feature (1)..(357): n is a, c, g, or t
atggaaaaatttaaaaaacgttgggaaatccaacaaaattggcaactattatttcctgtattaggatttttagcactagcatattctagctataagcttgctaataaaatgattgacaacaacatattcttagttattacttttactataataaccacttcagtattattaaagtttgtattatttctgtttaaaaaactagaaaacaagtgggaaagtccttataactgggaaatgatacgcatatttatagtatttgcggttactggtagttcttctttattcgtaggaagaccaataatatattggttaggaattactaaagaaaacttaactattgtggtcaattggatttaa

SEQ ID NO: 21686 - protein, 118 aa, Unknown
  Obtained from environmental sample
  misc_feature (1)..(118): Xaa is any amino acid
MEKFKKRWEIQQNWQLLFPVLGFLALAYSSYKLANKMIDNNIFLVITFTIITTSVLLKFVLFLFKKLENKWESPYNWEMIRIFIVFAVTGSSSLFVGRPIIYWLGITKENLTIVVNWI

SEQ ID NO: 21687 - DNA, 309 bp, Unknown
  Obtained from environmental sample
  misc_feature (1)..(309): n is a, c, g, or t
gtgaatagnattcggntcgagcggagtatttgtttaaaaaataggttgttcgttataagtaattcaggcctttcgggagtgatatcccttctgttttaccaggatttatattcagaattctccctggcattcaaagaatcgtttaaaattataaacctgaagggcgcgggagcttcaaactccttattgtattttgcgattctatctaatggcgaagcaattagcttaatattcccggttactaaaagtcctaaaatcaatactactggaaataaggcgtattttaaatatttcctgttctccttataa

SEQ ID NO: 21688 - protein, 102 aa, Unknown
  Obtained from environmental sample
  misc_feature (1)..(102): Xaa is any amino acid
MNXIRXERSICLKNRLFVISNSGLSGVISLLFYQDLYSEFSLAFKESFKIINLKGAGASNSLLYFAILSNGEAISLIFPVTKSPKINTTGNKAYFKYFLFSL

SEQ ID NO: 21689 - DNA, 636 bp, Unknown
  Obtained from environmental sample
  misc_feature (1)..(636): n is a, c, g, or t
atgcgtggaaaacataaaagcactccaatagaaaatttagttactgaagcagaaaagttggccgctaatggagtaaaagaacttattcttattgcccaagatttaacgtattatggtttagatctctataaaaaacgaaaccttgctgagttattagaaaacttggtaaaggtagaaggtatcgagtggattcgtttgcattatgcgtttcctacaggtttccctatggatgttttagatgtaatgaatcgtgagcctaagatttgcaactatttggatattccgttacaacatatttctgatgacctattaaaatcgatgcgtcgtggaacgacaaaagaaaaaaccacaaaactgattaaagagtttagagctattgttccagaaatgacgattagaacgacgcttattgtgggttaccctggagaaacagaagctcattttgaagaacttaaaaattgggtctcagagatgcgttttgaacgtttaggatgctttacctactcgcatgaagaaaatacacatgcttataatttagaagatgatgtgccagaagacgttaaaatacaacgtggcttaattgaaggatctatgggcaaaatttcaaattcttcaggaatttttctttgggggaan

SEQ ID NO: 21690 - protein, 212 aa, Unknown
  Obtained from environmental sample
  misc_feature (1)..(212): Xaa is any amino acid
MRGKHKSTPIENLVTEAEKLAANGVKELILIAQDLTYYGLDLYKKRNLAELLENLVKVEGIEWIRLHYAFPTGFPMDVLDVMNREPKICNYLDIPLQHISDDLLKSMRRGTTKEKTTKLIKEFRAIVPEMTIRTTLIVGYPGETEAHFEELKNWVSEMRFERLGCFTYSHEENTHAYNLEDDVPEDVKIQRGLIEGSMGKISNSSGIFLWGX

SEQ ID NO: 21691 - DNA, 432 bp, Unknown
  Obtained from environmental sample
  misc_feature (1)..(432): n is a, c, g, or t
ttgtcgccaccacaaacgaaaaaaataaaatttgttaaatacaacatagaaccaaaaaaatatgatagtctaatcgaaaataaagagccatatacattaattctaaaaaagaaatggttgtggaataaaaaaagaatttggaataataaaatgctttatgctgacttcgttgaaagttggaaaatggacgacaaaatcaattctgaagaaacagtttattatcatttttccaaacctctattttcagaaaataaaaaatatgctatactttctgtttttaaacaaagacgttgcaacggaaatggatttacaggactttatagaaatgacaacggaatttggaataaggtaatggaatttaatccaatctgttctgaaactatttcaacgcacataaggtgtgaagaaattaaaatgattgactatgaataa

SEQ ID NO: 21692 - protein, 143 aa, Unknown
  Obtained from environmental sample
  misc_feature (1)..(143): Xaa is any amino acid
MSPPQTKKIKFVKYNIEPKKYDSLIENKEPYTLILKKKWLWNKKRIWNNKMLYADFVESWKMDDKINSEETVYYHFSKPLFSENKKYAILSVFKQRRCNGNGFTGLYRNDNGIWNKVMEFNPICSETISTHIRCEEIKMIDYE

SEQ ID NO: 21693 - DNA, 393 bp, Unknown
  Obtained from environmental sample
  misc_feature (1)..(393): n is a, c, g, or t
ttgagggaaaaggctatcagaggaaatgaagagaagtgtaaacattctagtaacatggaatatttagcaactaaagcagaacgtgactcgattaaatacatgcaaattagatttatgcaagaccatcaagacgaggaatttgttggtgtaatttctggtgtaaccgattggggaatttatgtagagattatctctaataaatgtgaaggtatggttagaattagagatattaatgacgatcattatgattttgatcaagagcaatttgcattagttggacgtaatactaaaaaagtatatcaacttggagatgaggtgattgttaaagtaaaacaagcggatttagtaaaacgtcatcttgactttaacttaattggtaagcacgaaagttaa

SEQ ID NO: 21694 - protein, 130 aa, Unknown
  Obtained from environmental sample
  DOMAIN (40)...(125): S1 RNA binding domain
  misc_feature (1)..(130): Xaa is any amino acid
MREKAIRGNEEKCKHSSNMEYLATKAERDSIKYMQIRFMQDHQDEEFVGVISGVTDWGIYVEIISNKCEGMVRIRDINDDHYDFDQEQFALVGRNTKKVYQLGDEVIVKVKQADLVKRHLDFNLIGKHES

SEQ ID NO: 21695 - DNA, 681 bp, Unknown
  Obtained from environmental sample
  misc_feature (1)..(681): n is a, c, g, or t
gtggttgttattcaggtattatattatgctgtgttatttggtagctttgctttttctaaaagtattacaacctctttaaacagaaactatccaatttctgtaattatctgtgccaaaaacgaagcacaaaatcttaaaaaatttctacctagtatattaaatcaatcgtatcccaattttgaagtggtactaataaatgactcatctcacgatgagactttagatgtttttgaagattttaaatctaaacatagcaatattaaaattgtagatgtcaaaaatattgaagccttttggggaaataaaaaatacgcactctcactaggcataaaagctgccacacacaatcatttattgtttattgatgcagattgtcaaccggtttcaaaccaatggatcgacaaaatgagtcaaagttttaatgacgagaacaccattattttaggttatggtgcgtataacaaaataaaaaactcatttttaaataaactaatcagatttgaaaccttgctgactgcaacacaatatttttcgtttgcaaaagttgggaatttccatttatgcggtgtaggtcgtaatttagcttaccatagagatgagttttttaaaactaatggttttattaaacacatgaaaattagatctggagatgatgatctttttgtcaaccgaagctggtaa

SEQ ID NO: 21696 - protein, 226 aa, Unknown
  Obtained from environmental sample
  DOMAIN (33)...(202): Glycosyl transferase
  misc_feature (1)..(226): Xaa is any amino acid
MVVIQVLYYAVLFGSFAFSKSITTSLNRNYPISVIICAKNEAQNLKKFLPSILNQSYPNFEVVLINDSSHDETLDVFEDFKSKHSNIKIVDVKNIEAFWGNKKYALSLGIKAATHNHLLFIDADCQPVSNQWIDKMSQSFNDENTIILGYGAYNKIKNSFLNKLIRFETLLTATQYFSFAKVGNFHLCGVGRNLAYHRDEFFKTNGFIKHMKIRSGDDDLFVNRSW

SEQ ID NO: 21697 - DNA, 762 bp, Unknown
  Obtained from environmental sample
  misc_feature (1)..(762): n is a, c, g, or t
gtgcccaatcttgaaaaagaagcaattaaaaatgtagatgaaaaatacagttattataccgttttaccaaaagaaggcttttacagattgaaagtaaaaacaggactagagcaagacgaattagaacaattaaatcctggtttagctgaaacaggtttaaaagaaggaatggtgttaaaagttccttatgataaagtattggctgccgaaaataattctgaagatacacaaacctcattaagcgaattgtcttctacagatttagcagcgcaattacactctaaaaaagcagggacaaaagaaatagcaattatgcttccgtttagattaaataaagtaggtgaagatgctaaagaatccataaaaaatgataaaacgttaagtatttcattagatttttattctggagccttaatcgctttagattcacttaaaaagttaggcgccgatattaaggtaaatgtctacgatactcagaatatgaacagcgaattgttatctattttagataataataattttaaaaacacagatgctgttatagggccgttaatgccaaagaactttaatactgtggctttagcattacgaggagataatattgctgtaatatcgccaattactaaaacggttactttaggtaataatgtgtttcaatctagagcatcagacgaagacttagaaaaagctattatcactcattttaaaaatcaatctggaacaaattttgttttcatatccgatcaaaaacaccgctcttaa

SEQ ID NO: 21698 - protein, 253 aa, Unknown
  Obtained from environmental sample
  misc_feature (1)..(253): Xaa is any amino acid
MPNLEKEAIKNVDEKYSYYTVLPKEGFYRLKVKTGLEQDELEQLNPGLAETGLKEGMVLKVPYDKVLAAENNSEDTQTSLSELSSTDLAAQLHSKKAGTKEIAIMLPFRLNKVGEDAKESIKNDKTLSISLDFYSGALIALDSLKKLGADIKVNVYDTQNMNSELLSILDNNNFKNTDAVIGPLMPKNFNTVALALRGDNIAVISPITKTVTLGNNVFQSRASDEDLEKAIITHFKNQSGTNFVFISDQKHRS

SEQ ID NO: 21699 - DNA, 429 bp, Unknown
  Obtained from environmental sample
  misc_feature (1)..(429): n is a, c, g, or t
atgaaactattcaaaaaagaaccaaatttcacatttatgaataaacggtttatcgcttttaccatatcgggaatcgtcatcctcgccggtgtaggactcttcttcggcaagggtttcaacctgggcattgattttaccggtggaactctggtagacgtaatttttaaagactcaaaaaccgtggaagaggtccggaagtctctgggtgaagtcaatctttccagctccatgattcaaaagatgtgngagggggacaaccgcttcatcataaaatcctcttccctcgtggaaactgcagaggagacggagtcggcagctggagaggagaccgaagagagtctcaagaatatccggaaaaccgtcaatctgatatcccaatcactgatgagtcccgatgaggtcgaactgagcaaactcaaaaggatttga

SEQ ID NO: 21700 - protein, 142 aa, Unknown
  Obtained from environmental sample
  DOMAIN (33)...(61): SecD/SecF GG Motif
  misc_feature (1)..(142): Xaa is any amino acid
MKLFKKEPNFTFMNKRFIAFTISGIVILAGVGLFFGKGFNLGIDFTGGTLVDVIFKDSKTVEEVRKSLGEVNLSSSMIQKMXEGDNRFIIKSSSLVETAEETESAAGEETEESLKNIRKTVNLISQSLMSPDEVELSKLKRI

SEQ ID NO: 21701 - DNA, 468 bp, Unknown
  Obtained from environmental sample
  misc_feature (1)..(468): n is a, c, g, or t
atgagtcaccttcacgtcgatagtgttaccaagtcatataataataaaatgatattaagtgacgtgtttctttcttgtaaaaaaggagaagtaaaagggttgataggtagaaacggttcagggaaatctactcttcttaaaattatatttggaacggaaaaagcagaatataaatttgtaaaaataggagagaacgttattaatgcgatttctgatggccgccatttaattaattatttacctcaagataattttttgccaaataacatttctattcgggcgttaattaaattatttctcgaaaaagaaaacaggcaagtaatgtttcaaaatgagtatgtcaaacctttgttacataaaaagaatcaagaattatcaggaggacacgaaagaattattgagatattattactcattcattccaaagcagaatccatttatcagatgacctttcaatggaataagttn

SEQ ID NO: 21702 - protein, 156 aa, Unknown
  Obtained from environmental sample
  DOMAIN (29)...(152): ABC transporter
  misc_feature (1)..(156): Xaa is any amino acid
MSHLHVDSVTKSYNNKMILSDVFLSCKKGEVKGLIGRNGSGKSTLLKIIFGTEKAEYKFVKIGENVINAISDGRHLINYLPQDNFLPNNISIRALIKLFLEKENRQVMFQNEYVKPLLHKKNQELSGGHERIIEILLLIHSKAESIYQMTFQWNKX

SEQ ID NO: 21703 - DNA, 546 bp, Unknown
  Obtained from environmental sample
  misc_feature (1)..(546): n is a, c, g, or t
atgaaaacaataatattcagtcttccgggaaatcaagaactcacggaattgttagcaaaaaaaatgaaagcggaaataggggaatgtaccatacgaaaatttcccgatggggaatcctatacgcgtatcctatcagatgttaagggtaaatgcgtggttatggtctgcaccttgcacaagccagacgaaaaattattgcctttatattttttgagccatacggccaagtcattgggagccatgtgtacctgcttagtagccccctatttggcttacatgcggcaagacaaggtgtttcacgaaggggaaggggtaacctccacttttttcggaaaattgatttctggatttgcggatagcattaccaccattgaccctcatttgcacagaataagttctttgggcgaggtatatgatattccgaatagggtcatccatgcatcgaacgaaatagccaaatacattaatcaaaatatacataatccagttttaatcggtcccgacgctgaaagtgagcaatgggtttccgatgtggcgaacaaagca

SEQ ID NO: 21704 - protein, 182 aa, Unknown
  Obtained from environmental sample
  misc_feature (1)..(182): Xaa is any amino acid
MKTIIFSLPGNQELTELLAKKMKAEIGECTIRKFPDGESYTRILSDVKGKCVVMVCTLHKPDEKLLPLYFLSHTAKSLGAMCTCLVAPYLAYMRQDKVFHEGEGVTSTFFGKLISGFADSITTIDPHLHRISSLGEVYDIPNRVIHASNEIAKYINQNIHNPVLIGPDAESEQWVSDVANKA

SEQ ID NO: 21705 - DNA, 621 bp, Unknown
  Obtained from environmental sample
  misc_feature (1)..(621): n is a, c, g, or t
atgaaacaaatttctgaaaccattcaaactaaggaagcggatctttttaaagattatgtaatggctatggacaatagtttagatgaaattgaaatcacttacgaaatgcctgttaccattagtggagatacaataacctataatgcagattcttttaaaaacggaacagaacgtaaacttggtgatgtattagagaaaatgccaggcgttgaggttaatgatgatggtgaggtagaaatagaaggtaaaaaggttggtaaagtcatgattgatggtaaggagttttttgatggtgatactaaattagcgacaaaaaatattcctgcaaatgctattgataaagtacaagtgttaaaaaactattctgaagttggacagttaagtggtgtgactaataatcaagataatattgctattaatattaaattaaaagaaggtaagaaaaacttttggtttggaacagtaacagctggagcaggagactctagtagtggcgagttgtacttagcacaacctaagttattttactatagccctaaaaaaagtatcaactttattggtgacttaaataacattggagagttggccttatctagacgagatattttaaatctctcaagn

SEQ ID NO: 21706 - protein, 207 aa, Unknown
  Obtained from environmental sample
  misc_feature (1)..(207): Xaa is any amino acid
MKQISETIQTKEADLFKDYVMAMDNSLDEIEITYEMPVTISGDTITYNADSFKNGTERKLGDVLEKMPGVEVNDDGEVEIEGKKVGKVMIDGKEFFDGDTKLATKNIPANAIDKVQVLKNYSEVGQLSGVTNNQDNIAINIKLKEGKKNFWFGTVTAGAGDSSSGELYLAQPKLFYYSPKKSINFIGDLNNIGELALSRRDILNLSX

SEQ ID NO: 21707 - DNA, 789 bp, Unknown
  Obtained from environmental sample
  misc_feature (1)..(789): n is a, c, g, or t
ttgacttcgctcagcaaacctaggcttgcaagagcagttgcatggatcaagataggtctatataacgattatggtaaaaatattgctattccaatagatttaaatctaaccgattttttctttaaatatggtatacgtattaatccacttatagtaagctctatgtactctgctcctataactttagcgtcaggagaaggtagtgatagtcaatttcaaagctatccttggacctattcgcctttagcaaaaggaaacagcaatcatcctattgtcaataatttatatttcttaaaatttgattttgccaatcctatggatactattaaaagtagtacaaaaaaaacaatattgcttcaaactgcgcctttacctaaattagaaggtacacctcgcgaaatcagcttggatatggtcaataataagttagaccctaaaacctttaataaaggccaacaaacattagctgtgttactagaaggcacctttacgtcggcatataataaccgagtaaaacctgttgctatttcaaactctaaaaacagcagtataccaaccaaaatggtagtcctctctgatggtgacgtcatcaaaaacgaagttggaagattaggtcctgaagagctaggttttgacaattaccaggaaaaacctttgggtattaaaaattttggtaactgtggtaataatctttacatgaccaagacttttaaaattagatcaaagaatggagttgcctttaaatctgaaaattccgaggacaaacattggattatgaactttttatna

SEQ ID NO: 21708 - protein, 263 aa, Unknown
  Obtained from environmental sample
  misc_feature (1)..(263): Xaa is any amino acid
MTSLSKPRLARAVAWIKIGLYNDYGKNIAIPIDLNLTDFFFKYGIRINPLIVSSMYSAPITLASGEGSDSQFQSYPWTYSPLAKGNSNHPIVNNLYFLKFDFANPMDTIKSSTKKTILLQTAPLPKLEGTPREISLDMVNNKLDPKTFNKGQQTLAVLLEGTFTSAYNNRVKPVAISNSKNSSIPTKMVVLSDGDVIKNEVGRLGPEELGFDNYQEKPLGIKNFGNCGNNLYMTKTFKIRSKNGVAFKSENSEDKHWIMNFLX

SEQ ID NO: 21709 - DNA, 351 bp, Unknown
  Obtained from environmental sample
  misc_feature (1)..(351): n is a, c, g, or t
gtgaatacggttgaacactcggtgatgaaaaaagaagaaatgccaatattctataatgctattgatgtctttttattccgtactaaaagaatgggagaaagtctggggtcagttggccttgaggctatgtcttgtggcgttcccgtcttaggaactaatgattttgctataaaagaatatgttattcctggttttaacggcgaattatttaaaaaggataattaccagtcgttcgaagataatttaattatttgtgttaataatttagagaattataattcccgagagactatattaaaagaatattccaaggaggcggtcgttaataaatacaaacaaattctaggatga

SEQ ID NO: 21710 - protein, 116 aa, Unknown
  Obtained from environmental sample
  misc_feature (1)..(116): Xaa is any amino acid
MNTVEHSVMKKEEMPIFYNAIDVFLFRTKRMGESLGSVGLEAMSCGVPVLGTNDFAIKEYVIPGFNGELFKKDNYQSFEDNLIICVNNLENYNSRETILKEYSKEAVVNKYKQILG

SEQ ID NO: 21711 - DNA, 597 bp, Unknown
  Obtained from environmental sample
  misc_feature (1)..(597): n is a, c, g, or t
ttgcatgatagtactacggttgattctaaaaaccaattaagtagcgctataaatctttcagcgaaagcgaaacatataaaaatagtagagaaagctattgccgaaattgaagatggtagttttaaaaaagtagtgatatctcgagttgaaaccgaagcttttcctgtagacaatacacttttactatttaaaaaactgttagcgacttataaaacagcaatggtgtattgttggtatcatccaaaagtagggctgtggctaggcgcaacgcctgaaaccttattaaaagtagaaggtaaccgctttttaaccatgtctcttgcaggtacgcaacaatacaaaaatacagttgatgtccagtggcaatccaaggaacaagaggagcagcaattagtcacggattttatagtaagtagtttagagtcgtcagtcagtagtattaatttgggcactacagaaattatcaaagcggggaatttattgcatttgcaaactaagatttctggactgttaaggctgaaaatggcttgcagtctgtcattgctacattacatccaaggcctgcaggttaccggtttacttacagaaaaacgctaa

SEQ ID NO: 21712 - protein, 198 aa, Unknown
  Obtained from environmental sample
  misc_feature (1)..(198): Xaa is any amino acid
MHDSTTVDSKNQLSSAINLSAKAKHIKIVEKAIAEIEDGSFKKVVISRVETEAFPVDNTLLLFKKLLATYKTAMVYCWYHPKVGLWLGATPETLLKVEGNRFLTMSLAGTQQYKNTVDVQWQSKEQEEQQLVTDFIVSSLESSVSSINLGTTEIIKAGNLLHLQTKISGLLRLKMACSLSLLHYIQGLQVTGLLTEKR

SEQ ID NO: 21713 - DNA, 795 bp, Unknown
  Obtained from environmental sample
  misc_feature (1)..(795): n is a, c, g, or t
atggttgagcaatgtatgagcaatgcttttagagacattaaactctctaaaagtaattggtatgacacagtgcttaacattatggcaagctataaaacaagcactaattatggacaaaaagaagtacaaccctatattgataaattatataaaagcttaaaaaaagaacgaaaaaatctagaaagtctcaacaatttaattttacaaaaggaacttaaaattaccgacttagaaattaaaaaattaaaaaaagatttaagtaaaacaaaaaatagagatgatcgtggtattcaaactttatttagaaatacctcaaaaaatcattatacattaaataagatggtagatggtaaagcaaaaattatgattaccataaactctattatcttatccttaattttaggaggagttataggtaaatattcgaccgaaataaccaatcatattccttcggttatttttgccttcgccaatttaatatctgtaacctttgctataatatctattgctcccaacaaaacacaagtaaattttactgaagaagaaataagaaataaaaaagggaacttactctattttggaaactttcataatatgcattatcgcgattttgaatgggcatttttacaaatgttgaatgataaagattacttatacacgtctatgattagggatttgtactatcaagggcaaaccttacaaaaaaagcatataagtataaggatttctctttattctttcctattaggattaggaatggcaatactatcacattttttaatctattggatttaa

SEQ ID NO: 21714 - protein, 264 aa, Unknown
  Obtained from environmental sample
  misc_feature (1)..(264): Xaa is any amino acid
MVEQCMSNAFRDIKLSKSNWYDTVLNIMASYKTSTNYGQKEVQPYIDKLYKSLKKERKNLESLNNLILQKELKITDLEIKKLKKDLSKTKNRDDRGIQTLFRNTSKNHYTLNKMVDGKAKIMITINSIILSLILGGVIGKYSTEITNHIPSVIFAFANLISVTFAIISIAPNKTQVNFTEEEIRNKKGNLLYFGNFHNMHYRDFEWAFLQMLNDKDYLYTSMIRDLYYQGQTLQKKHISIRISLYSFLLGLGMAILSHFLIYWI

SEQ ID NO: 21715 - DNA, 624 bp, Unknown
  Obtained from environmental sample
  misc_feature (1)..(624): n is a, c, g, or t
ttgaaacggatttggtataacattgttaaaatatatattcgtacaggtttattttttttcttcaaaaaaataattgttaacgatgaagataatatcccaaaaaagggtgctgttctcttagtttctaaccataaaaatgccttattagaccctttattaattgctacaactaccgaaaggaatatcaactttttgacgagagccagcgcttttaaaatacgacttataagatggttgctttctacggtaaatatgcttcctatctatagaatgcgcgacggcaaagaaacattggcaaaaaatgaagaaatatttaatcaatgctatgatattttaaataatcaaaagtgcttattgatcttccctgagggaactcatgacattaaacggtgggttagaccattaagtaaaggctttatcagaattacttttggagctttagaaaaaaatccaacgcttgacctacatattgttccgattggattgaattttacaaatgcaactgattttgctgaaagcgtttcaatttattatggtcaacctattttagcaaacccgttttacaataaaaatgatctaaatgcgtcgaccctagaattaaaaacttcatacgagataaaatga

SEQ ID NO: 21716 - protein, 207 aa, Unknown
  Obtained from environmental sample
  DOMAIN (23)...(163): Acyltransferase
  misc_feature (1)..(207): Xaa is any amino acid
MKRIWYNIVKIYIRTGLFFFFKKIIVNDEDNIPKKGAVLLVSNHKNALLDPLLIATTTERNINFLTRASAFKIRLIRWLLSTVNMLPIYRMRDGKETLAKNEEIFNQCYDILNNQKCLLIFPEGTHDIKRWVRPLSKGFIRITFGALEKNPTLDLHIVPIGLNFTNATDFAESVSIYYGQPILANPFYNKNDLNASTLELKTSYEIK

SEQ ID NO: 21717 - DNA, 705 bp, Unknown
  Obtained from environmental sample
  misc_feature (1)..(705): n is a, c, g, or t
atgctatcaaaaacccaaataaaagtaattacgcgtttaaagcaaaaaaaatatagagttcaagatggtttttttgttgctgaaggattaaaagtaattaatgaacttttagaatctgatttagaattacaccaattatttacaaccgttagttttggaagtcatttaaacagtgagcaacttattaccgaagcagaattaaaaaaaataagctttttaactacaccaaataaagcattagcgctttttaaaattccggaagctaaaaccatagctagtaataaatttattgtggctttagataatgtacgcgatccaggaaatttgggtacaattataagattgtgcgattggtttggtgttaaggagttagtttgtaatttcgaaactgtagattgctataaccccaaagtaatacaagcgacaatgggttctattacgcgcgtaaatgtgagttatgtaaatttggaaaactatttaaaagaaacaaaaactccagtttttggtgcttttatggatggtgataacgtgtataaaaaccatctgcctacatcaggcactttagtcttaggtaatgaagccaatggtatttctcctgagattgaagcattaattacaaagtcgcatctccatacctcgttttggagctttgcaagccaccgaaagcttaaatgttgcaaccgcaaccgctattttattaagtga

SEQ ID NO: 21718 - protein, 234 aa, Unknown
  Obtained from environmental sample
  DOMAIN (95)...(220): SpoU rRNA Methylase family
  misc_feature (1)..(234): Xaa is any amino acid
MLSKTQIKVITRLKQKKYRVQDGFFVAEGLKVINELLESDLELHQLFTTVSFGSHLNSEQLITEAELKKISFLTTPNKALALFKIPEAKTIASNKFIVALDNVRDPGNLGTIIRLCDWFGVKELVCNFETVDCYNPKVIQATMGSITRVNVSYVNLENYLKETKTPVFGAFMDGDNVYKNHLPTSGTLVLGNEANGISPEIEALITKSHLHTSFWSFASHRKLKCCNRNRYFIK

SEQ ID NO: 21719 - DNA, 417 bp, Unknown
  Obtained from environmental sample
  misc_feature (1)..(417): n is a, c, g, or t
gtggtcgacgctaactttacccctgttacattgagtgcgtataaaggccaagccgttttgattagcgtagtacctagtttagataccggtatttgcagcctacaaactaaacactttaacgaaaaagtagcacaacaatttccaaacataaccatgttgaccattagtagcgatttaccttttgcgcaaaaacgtttttgcaaagctgagaacatagataaggtaattgtgctttctgattcggtatggcacgactttggtcagaagtatggatttataattaaagatatggggctactaacacgcgctgtacttattttagataaaaaccataacgtggtttataagcaattagtgagtaaccttgcaactgaaccagaatacgccagcgtgattgaaaaactaaaggcactttaa

SEQ ID NO: 21720 - protein, 138 aa, Unknown
  Obtained from environmental sample
  DOMAIN (2)...(134): AhpC/TSA family
  misc_feature (1)..(138): Xaa is any amino acid
MVDANFTPVTLSAYKGQAVLISVVPSLDTGICSLQTKHFNEKVAQQFPNITMLTISSDLPFAQKRFCKAENIDKVIVLSDSVWHDFGQKYGFIIKDMGLLTRAVLILDKNHNVVYKQLVSNLATEPEYASVIEKLKAL

SEQ ID NO: 21721 - DNA, 480 bp, Unknown
  Obtained from environmental sample
  misc_feature (1)..(480): n is a, c, g, or t
atgaatttaagttttaaaaatagggttgcgttacattatatgatcgccacagcagttataatggctgtagcatttacagttgtattctttgtggtaaaaggtgtggtgtatcaaaatatagatagtgacctttcttttgaagctgaaaagcataccgaagaaataaaaattgttggtgacagcatcaaaattaaaaacaaaaaagagtgggaagaacgcgaacatagagaggttcaagtaaatcctgtttttatccaaattttggatagaaacggttcttttatggataaatcccctaatcttaaagaaaacgaacttgcatacaattctgaagccaattttggcggaagctataacgaaactctcaatagtaaacccataagacagattcaattacccattgaacaagatggtaaaataaaaggttttattgtggcggctatgccattagaatcctctctaatggtgttattgaattaa

SEQ ID NO: 21722 - protein, 159 aa, Unknown
  Obtained from environmental sample
  misc_feature (1)..(159): Xaa is any amino acid
MNLSFKNRVALHYMIATAVIMAVAFTVVFFVVKGVVYQNIDSDLSFEAEKHTEEIKIVGDSIKIKNKKEWEEREHREVQVNPVFIQILDRNGSFMDKSPNLKENELAYNSEANFGGSYNETLNSKPIRQIQLPIEQDGKIKGFIVAAMPLESSLMVLLN

SEQ ID NO: 21723 - DNA, 591 bp, Unknown
  Obtained from environmental sample
  misc_feature (1)..(591): n is a, c, g, or t
ttggacatactaaagcaggcttcaacgtttactctgtntaagtttgttaagcaacattacaaatgggtttgggtatattttttaagttttggattattgatttttgaaaaaaaaataacgctattaccattaatcagaagcctatttgtaaaaaaactcagcacaacatttaatttagaagcaataccaattcagtccaccaaaactgtaattactaaacacgagattgatgttatcatccctaccattggtagaaaacaatatttatacgatgttttaaaagatttagctgcccaaacgctaatgcctaaaaatgtgattattgtagagcaaaatcctttagagggatctgtgtcagaattaaattatttaaacaatcaagagtggccttttacaattaaacacacctttacacatcaatcaggtgtttgtaatgcacgtaacttagccttatctcaagtagacagtgaatggacctttttaggagatgatgataataggtttgactccaaattaattgagtttttatttaaccatattggccaatatggtgtccaagtaggtataacagtttatttgcaaagccaatga

SEQ ID NO: 21724 - protein, 196 aa, Unknown
  Obtained from environmental sample
  misc_feature (1)..(196): Xaa is any amino acid
MDILKQASTFTLXKFVKQHYKWVWVYFLSFGLLIFEKKITLLPLIRSLFVKKLSTTFNLEAIPIQSTKTVITKHEIDVIIPTIGRKQYLYDVLKDLAAQTLMPKNVIIVEQNPLEGSVSELNYLNNQEWPFTIKHTFTHQSGVCNARNLALSQVDSEWTFLGDDDNRFDSKLIEFLFNHIGQYGVQVGITVYLQSQ

SEQ ID NO: 21725 - DNA, 885 bp, Unknown
  Obtained from environmental sample
  misc_feature (1)..(885): n is a, c, g, or t
ttgacgaaaggaagagaaaacactactacttatagatacgttaaactagatattgaaaaacggtatatagatatcaatgaaaaatggctcttaacaacctttaaggattcaaataaaaattcaggatatttcgagtttaatccgaaaaataataagggtaaacaattaatagacggggtataccagtattccagtccaattaaagcaaagttaagtgataaacttatttttacgcgtcagtcatttacggaatttccaaatattcaatattcagatttaaactttaaaaggccaacagttataagtaatgccaatccacagcaaaaggattataattggggtactattgaattggtaaaatggacatccttagatggtaaagaacttacaggaatgttggttaaaccggagggttttgattcggctaaaaaatatcctatgatcgtgaatttctatgaaaaaagttcaaatagattgaattcgcacagagcgccttcaccgggtaggtcaacaataaactatagtttttatgccagccgagggtatctcatttttaaccctgatgtttattataaaattggctatcctggtgaaagtgcttataattgtgtaatccccggggtaacgtcacttattgaaaaaggattcgttgataaaaataatataggtgttcaaggtcatagttggggtggatatcaaatcgcctatttagtaactaaaacagatatatttaaagcagcagagtcaggtgctccagttgtaaatatgataagtgcttatggaggtatacgatggggaactgggttgagcaggcaatttcaatatgaacatacgcaaagtagaattggcggtactccttggggaaatttcgcgcaaggtatatag

SEQ ID NO: 21726 - protein, 294 aa, Unknown
  Obtained from environmental sample
  misc_feature (1)..(294): Xaa is any amino acid
MTKGRENTTTYRYVKLDIEKRYIDINEKWLLTTFKDSNKNSGYFEFNPKNNKGKQLIDGVYQYSSPIKAKLSDKLIFTRQSFTEFPNIQYSDLNFKRPTVISNANPQQKDYNWGTIELVKWTSLDGKELTGMLVKPEGFDSAKKYPMIVNFYEKSSNRLNSHRAPSPGRSTINYSFYASRGYLIFNPDVYYKIGYPGESAYNCVIPGVTSLIEKGFVDKNNIGVQGHSWGGYQIAYLVTKTDIFKAAESGAPVVNMISAYGGIRWGTGLSRQFQYEHTQSRIGGTPWGNFAQGI

SEQ ID NO: 21727 - DNA, 645 bp, Unknown
  Obtained from environmental sample
  misc_feature (1)..(645): n is a, c, g, or t
ttgttttaccagaaaacagttttctcacaagaaaagaagccaaaagtagctttaattttaagtggaggaggtgcaaaaggcattgcacatattcgcacgcttcaagcattagactctctgcatattgttcctgatttgatagtgggtactagtatggggagtattgtgggcggactatatgctatggggtattctggcgacagtattgcgagtcttacaaaaaatgttaaatgggaaaaactcttgggaggagatgtgtcactaaaaaatgttggagcagaagaaaagagcgagtataataaatatctaattgaattagaacttaaaaaaggaaaaatcacaactggagcctatcttattaatgatcaaaatttaagagagtttattgctttagtttctatccctagttatgagattgagttatttgataatctccctataccatttagggcggttacaacagatataattaatggcaaagaagttatcttagatagaggctctcttgctcttgcaatgcgggctagtatgtcaattccaggagtcttttcacctattcgttataagaatacacttttagtagatggtggattgttaaacaactttcctgcagatattgctaagatttgggagcagatattataa

SEQ ID NO: 21728 - protein, 214 aa, Unknown
  Obtained from environmental sample
  DOMAIN (18)...(208): Patatin-like phospholipase
  misc_feature (1)..(214): Xaa is any amino acid
MFYQKTVFSQEKKPKVALILSGGGAKGIAHIRTLQALDSLHIVPDLIVGTSMGSIVGGLYAMGYSGDSIASLTKNVKWEKLLGGDVSLKNVGAEEKSEYNKYLIELELKKGKITTGAYLINDQNLREFIALVSIPSYEIELFDNLPIPFRAVTTDIINGKEVILDRGSLALAMRASMSIPGVFSPIRYKNTLLVDGGLLNNFPADIAKIWEQIL

SEQ ID NO: 21729 - DNA, 816 bp, Unknown
  Obtained from environmental sample
  misc_feature (1)..(816): n is a, c, g, or t
atgactgaaaagcgagtacacaagaaagagcggtataaaaataccaccgccaagaaagaagtcacagaaaaattgacacaaaaagcgattgggcttcagattgagaacctatcaactgcaaaggtcattcccgacccgatgcaacccagaaagacttttaatgaagcacatctgcaacagctttccgaaagcgtcaaaaagcacggtgttctacagcctattacagtccgaaaatctggaaacgaatttatcatcgtgatgggcgaacgtaggtatcgagcaagtaagatggccgacaagaaaactattccgtgtattgtcagggaatataagaacaacgatgttcttgaaattcaaatcatcgaaaatctgcaaaggcaggatgttgaacctaccgaagaagctgaggcgattgcttacttaagcgaaaaatatgcgcctacagaaattgcaaagcgattgggaagaacagataactttatcagacaacgattaaagctggctggtttaattgaaggttttaagcattttgttcgtaatggcgaaatgacgatttcgttaggtgtgggtgttgcactttttgaaccagaagaacagcagatgatgttggaaacgatgggcgaagattttagtgcccatcaggtgaacaggatgattaaagaccagacctatgatttggaaaaagcatcttttgatgtaaatgatacgaaattggtgccaaaagtaggctcttgtattgaatgtccgtttaacgcggcacatcaggtaatcttttcggggatggcaaaatggttgtacaaaatcagattgttatga

SEQ ID NO: 21730 - protein, 271 aa, Unknown
  Obtained from environmental sample
  DOMAIN (35)...(124): ParB-like nuclease domain
  misc_feature (1)..(271): Xaa is any amino acid
MTEKRVHKKERYKNTTAKKEVTEKLTQKAIGLQIENLSTAKVIPDPMQPRKTFNEAHLQQLSESVKKHGVLQPITVRKSGNEFIIVMGERRYRASKMADKKTIPCIVREYKNNDVLEIQIIENLQRQDVEPTEEAEAIAYLSEKYAPTEIAKRLGRTDNFIRQRLKLAGLIEGFKHFVRNGEMTISLGVGVALFEPEEQQMMLETMGEDFSAHQVNRMIKDQTYDLEKASFDVNDTKLVPKVGSCIECPFNAAHQVIFSGMAKWLYKIRLL

SEQ ID NO: 21731 - DNA, 315 bp, Unknown
  Obtained from environmental sample
  misc_feature (1)..(315): n is a, c, g, or t
ttgtttaatctaaattcaaaagctatgtatttacaaaatttgcaacaggatgaaatctttgtttcatcagaaatgaaatccttaaaaactctgacacagatagaatcccgacgagggcttgaaaatgccatcatttcaaatggtaaaatcgtcaatgtggtatctaacagttatggacacattccaaaccaattgttcttcaagaaagctgaagaaatgctgacagatgcacaactgaactttcacaagcgcaccatcaacaaatattatagtcgttcataccgactttatcttcaagtactgaccgattcttga

SEQ ID NO: 21732 - protein, 104 aa, Unknown
  Obtained from environmental sample
  misc_feature (1)..(104): Xaa is any amino acid
MFNLNSKAMYLQNLQQDEIFVSSEMKSLKTLTQIESRRGLENAIISNGKIVNVVSNSYGHIPNQLFFKKAEEMLTDAQLNFHKRTINKYYSRSYRLYLQVLTDS

SEQ ID NO: 21733 - DNA, 624 bp, Unknown
  Obtained from environmental sample
  misc_feature (1)..(624): n is a, c, g, or t
atgttgcaaattataaaagtttgtggggtatccaaaattttaagtgttatgtcaggatgcgagattaaacatatgaacatggagtatcattatttatatataaaaaatttcaaaaaactattgtttacaatcttactgttggtgtttagtctatcaggattttcaaatactcaaaatgaaaaattaacggctaaaaaacacactcaaacagcgaaagcaaacgagatgattacgtatgcatttcaattgggaaacacaaaaaatagttctgaaacctattttttaagtgtacttcatccgcgagaattagcttgccaaaacactttaagtgcttcagaaatcatcttaaaacccaacgcgaattataaaggtaccttgcaagttatcgtgagtgatcgtctgcctttgggcggccacgaatcgagtgtggttgttgtgaaagacgaacatggtaatgagatagagcgtttggagtttattactgttcgctctaaagcacatccttttatgttggtcactaatgatgttattgaagacactaaaaagaagattgaaaactatccatgggctaagaacaatctagatgctatgcttaagggaattgatacctttcaatttccaggn

SEQ ID NO: 21734 - protein, 208 aa, Unknown
  Obtained from environmental sample
  misc_feature (1)..(208): Xaa is any amino acid
MLQIIKVCGVSKILSVMSGCEIKHMNMEYHYLYIKNFKKLLFTILLLVFSLSGFSNTQNEKLTAKKHTQTAKANEMITYAFQLGNTKNSSETYFLSVLHPRELACQNTLSASEIILKPNANYKGTLQVIVSDRLPLGGHESSVVVVKDEHGNEIERLEFITVRSKAHPFMLVTNDVIEDTKKKIENYPWAKNNLDAMLKGIDTFQFPG

SEQ ID NO: 21735 - DNA, 543 bp, Unknown
  Obtained from environmental sample
  misc_feature (1)..(543): n is a, c, g, or t
atgaaatctgatacgntacaccattacgattggttgatgcatcctattgggtttttaggaattgaaggggcaaagaaaacaggtgcagtagtaaacactttaagtacaaaaaacgattctccttataaatattttaagaacgcacagtggtatagctcaaaacaaggcacaaaagttcagtttaacgaggatggtaataaattagatatacacacaatttggccaagaaaagcagaggtactaattagtgattaccccaacggcggaaagccaagagggattagaaataatccggagcgtaaaacctatggtgtacgtgttcataaaaaggaagctacttttcttactgttatagaaccttacgctggtaaatcagcaatatccagcataatttctaaatcatcagatgagcttagcgtaaccttaaaagatggtcgcgtacaaaccattactatagaaaatataaaaggcgatcatccgaaagttaactatcagaaacaatacaaggaaaagctgttaaaacagaacaaactaaataactaa

SEQ ID NO: 21736 - protein, 180 aa, Unknown
  Obtained from environmental sample
  misc_feature (1)..(180): Xaa is any amino acid
MKSDTXHHYDWLMHPIGFLGIEGAKKTGAVVNTLSTKNDSPYKYFKNAQWYSSKQGTKVQFNEDGNKLDIHTIWPRKAEVLISDYPNGGKPRGIRNNPERKTYGVRVHKKEATFLTVIEPYAGKSAISSIISKSSDELSVTLKDGRVQTITIENIKGDHPKVNYQKQYKEKLLKQNKLNN

SEQ ID NO: 21737 - DNA, 573 bp, Unknown
  Obtained from environmental sample
  misc_feature (1)..(573): n is a, c, g, or t
atgtctaaaatcattccgtttaaagcagtacgccctacccgagataaagtgagcttggtagcttcgcgatcgtaccaaagttatacgcaagcagaacgcgaaggccgtttagattacaatccctactcatttttacatatcgtaaatccggggtataaatatgctaaagaaatttcaggagtagcccgttaccaactcgttaaaaacagatatttagaatttaaagaggaaggcgtttttgttcaagatagaaacccttgtttttatatttataaaattatagaccgtaaaaaccaagagtttaacggtattgttgcagcggcaagtgtagaagactataaagtagatgctataaaaaaacacgaagacacaatatctagcagagaggtcgtatttaaagattatttaaaaacggtggggtttaatgcagaacctgttttgctaacgtatcctgataacgctgttatttcttctattataaagaatgaacaagaagacaaagccgagtttgagtttaccactacgtttcgagatacccattatttatggaaaattgaaactggagcggtgtaa

SEQ ID NO: 21738 - protein, 190 aa, Unknown
  Obtained from environmental sample
  misc_feature (1)..(190): Xaa is any amino acid
MSKIIPFKAVRPTRDKVSLVASRSYQSYTQAEREGRLDYNPYSFLHIVNPGYKYAKEISGVARYQLVKNRYLEFKEEGVFVQDRNPCFYIYKIIDRKNQEFNGIVAAASVEDYKVDAIKKHEDTISSREVVFKDYLKTVGFNAEPVLLTYPDNAVISSIIKNEQEDKAEFEFTTTFRDTHYLWKIETGAV

SEQ ID NO: 21739 - DNA, 321 bp, Unknown
  Obtained from environmental sample
  misc_feature (1)..(321): n is a, c, g, or t
atgacagataaagaattagaagaaattggcgataaaattataagagttttaaaaactatttatgatccagaaatccctgttgatatatacgaacttggattgatttatgatgtttttgtttctgatgaaaacaatgcaaaaattttaatgacattaacatcacctaactgtccagttgcagaaagtttacctgttgatattgaagagaaagtaaaatctttaaaagaaattaattcttgcgaagtagaaattactttcgacccaacttggacttctgaaatgatgagtgaagaagcaaaattggagttaggaatgctttaa

SEQ ID NO: 21740 - protein, 106 aa, Unknown
  Obtained from environmental sample
  DOMAIN (9)...(84): Domain of unknown function DUF59
  misc_feature (1)..(106): Xaa is any amino acid
MTDKELEEIGDKIIRVLKTIYDPEIPVDIYELGLIYDVFVSDENNAKILMTLTSPNCPVAESLPVDIEEKVKSLKEINSCEVEITFDPTWTSEMMSEEAKLELGML

SEQ ID NO: 21741 - DNA, 342 bp, Unknown
  Obtained from environmental sample
  misc_feature (1)..(342): n is a, c, g, or t
atgagcgacgcaattaaacacgaatgtggaatagcattggttagattaaaaaagccattacagttttataaagataaatacggttctgctttttacggaattaataaaatgtatttattaatggaaaagcaacacaatcgtgggcaagatggagcaggttttgcaagcgtaaaatttaatgttgcaccaggaactagatatattagtagagttcgttcaaaccaatcgcaaccaattcaagatatttttgcgcaaattaacggacgtttaaatggtgttttagaacaaaatcctgagaaaaaagacgatgtaaatggctcgagccgattcttgatccactag

SEQ ID NO: 21742 - protein, 113 aa, Unknown
  Obtained from environmental sample
  misc_feature (1)..(113): Xaa is any amino acid
MSDAIKHECGIALVRLKKPLQFYKDKYGSAFYGINKMYLLMEKQHNRGQDGAGFASVKFNVAPGTRYISRVRSNQSQPIQDIFAQINGRLNGVLEQNPEKKDDVNGSSRFLIH

SEQ ID NO: 21743 - DNA, 522 bp, Unknown
  Obtained from environmental sample
  misc_feature (1)..(522): n is a, c, g, or t
atgctaaaaaattataagacatcaagtctttttaaaaggttgttctttattgtagttatactaaattcagcaatagcttcagctcaagatcaaaacttggttaatgttatactggatggtaaacctgcagttttaaacaccaaaacgggaattacccaatttgttgatgataattcagacaataatcaagaggtagtaaatggtgatacggatttagtaacaacccatattgtagaacaaggagatacactatacgccatatctaataaatatggcgtaagtatttcacatattaaagcaattaataacttaagtgctaacctgatatcaataaatcaaaggttaaaaataggttatgctaattcagctaaagtaaaagttagtaatgtgtggattgtaaaaaaaggcgatacattgtatagtatttctaaaaaaacaggagtgccaatttcaaaaattcaaagccttaataatataaaggataatataataattgtaggaaaaacactatttttaagatag

SEQ ID NO: 21744 - protein, 173 aa, Unknown
  Obtained from environmental sample
  DOMAIN (131)...(173): LysM domain
  misc_feature (1)..(173): Xaa is any amino acid
MLKNYKTSSLFKRLFFIVVILNSAIASAQDQNLVNVILDGKPAVLNTKTGITQFVDDNSDNNQEVVNGDTDLVTTHIVEQGDTLYAISNKYGVSISHIKAINNLSANLISINQRLKIGYANSAKVKVSNVWIVKKGDTLYSISKKTGVPISKIQSLNNIKDNIIIVGKTLFLR

SEQ ID NO: 21745 - DNA, 636 bp, Unknown
  Obtained from environmental sample
  misc_feature (1)..(636): n is a, c, g, or t
atgactgaatcaaaggtaattccgtttattgacgatcttagtgggatgacccaggagatggtaaacaaaacacttgtttcctcgggtttctcgggcaagatagatcaggtcaattggaaagcaaacgattataagccgtcggtggccttttacctggcacacaacaatcagcatctttttatcctttacaaggtaagtgagcaaaatatccgtgccacgtatgtaaacgataacgatgccgtttgggaagatagttgtgtggaagcgtttttctcgaaagatataaatgatggatatttcaacattgaagttacctgtattggcactgccctcgttggttttggcaaaggccgggacaatagagcccatctgggagaggattgtatgaaaacgatcaaaagagcctcttctcttggaaaagagattattggaaaggagaatgtgaatggagactggtggttgcaacttgcaattcccttggagatactcggcattaagaaaggacaaaccattcgcgctaatttttacaagtgtggggatgaatgcaaagtgccacattttttaagctggcaacccatcacaacacctcagcccgattttcatcaacccactctcgaccgagtcttgatcacgtag

SEQ ID NO: 21746 - protein, 211 aa, Unknown
  Obtained from environmental sample
  misc_feature (1)..(211): Xaa is any amino acid
MTESKVIPFIDDLSGMTQEMVNKTLVSSGFSGKIDQVNWKANDYKPSVAFYLAHNNQHLFILYKVSEQNIRATYVNDNDAVWEDSCVEAFFSKDINDGYFNIEVTCIGTALVGFGKGRDNRAHLGEDCMKTIKRASSLGKEIIGKENVNGDWWLQLAIPLEILGIKKGQTIRANFYKCGDECKVPHFLSWQPITTPQPDFHQPTLDRVLIT

SEQ ID NO: 21747 - DNA, 429 bp, Unknown
  Obtained from environmental sample
  misc_feature (1)..(429): n is a, c, g, or t
gtgatgtcgaatcccaatttgaaacctatggatattaaagtggccttaggattgttaaatattttggatcaaatcaatgcagttgaaggatttgtttttatttccagtacaaatgaacttgtatatcaatattatggtgaagataatttagaggttcactttacaaatatggacaccgccgatattgaactgaccccgcttcatgaactcatatcaaaaaagctcaactcaaaaattagtaacgacagcttaaacaaggttttaattagacttgatagctttcactatataaatgtcacgcccattacttaccaaaattcgaaacttggtatcaacgataaatcattaaaaaaaggaaaagcatatctaaaatttatagagattaacgatatgatgaactctaaatgcttagagagcatttggatttag

SEQ ID NO: 21748 - protein, 142 aa, Unknown
  Obtained from environmental sample
  misc_feature (1)..(142): Xaa is any amino acid
MMSNPNLKPMDIKVALGLLNILDQINAVEGFVFISSTNELVYQYYGEDNLEVHFTNMDTADIELTPLHELISKKLNSKISNDSLNKVLIRLDSFHYINVTPITYQNSKLGINDKSLKKGKAYLKFIEINDMMNSKCLESIWI

SEQ ID NO: 21749 - DNA, 693 bp, Unknown
  Obtained from environmental sample
  misc_feature (1)..(693): n is a, c, g, or t
gtgattctattaaaaaatgggaaagatacttttaaggctataaatgaagctttaaaaaacgccaaaaactttatccatttgcaatattatatgattgaagatggagaaattttgtcggaaatcatgggtattttagaacagaaaataaaagaaaatgtagaggttagaattatttatgatacacttggtagttttgaattgaagaaaagtaccaagcaaaaactaaaagatattggtgtagaattatacccagaaacgccttttaaatatggaagttttatcttttctttaaattttagaaatcacagaaaaattgcaattatagataatgaaattggttttacaggaggtgtaaatatttctgatgaatatattacagatgatgattttttaggcatttggcaagacacgcatttgcaaattaaagggtgtgcagtaaatagcattcacaaatcttttttaaaggatttttattatgccagcaatcaagatttaacgaaagataaaaaatatataacgtcttgtgattttgagggtgaaacaaaacttcaaattgtttctggtgggccagattatgagcaatctgtagtaatgcaacagtatttgagctttataaatttagccgaaaaaagtatttgcgttttaaatccttattttattccgacttttgcaattctggaagccttaagatag

SEQ ID NO: 21750 - protein, 230 aa, Unknown
  Obtained from environmental sample
  DOMAIN (97)...(124): Phospholipase D Active site motif
  misc_feature (1)..(230): Xaa is any amino acid
MILLKNGKDTFKAINEALKNAKNFIHLQYYMIEDGEILSEIMGILEQKIKENVEVRIIYDTLGSFELKKSTKQKLKDIGVELYPETPFKYGSFIFSLNFRNHRKIAIIDNEIGFTGGVNISDEYITDDDFLGIWQDTHLQIKGCAVNSIHKSFLKDFYYASNQDLTKDKKYITSCDFEGETKLQIVSGGPDYEQSVVMQQYLSFINLAEKSICVLNPYFIPTFAILEALR

SEQ ID NO: 21751 - DNA, 339 bp, Unknown
  Obtained from environmental sample
  misc_feature (1)..(339): n is a, c, g, or t
ttgtctccaaaatgggacaatctattgaaacttgttattgccattttaagaaaaatggagcgcgatcaagttgtagaaataatgctgcaaataaccgatgctacactcacctttctcgtaccacgggaagacgacaaaaccataaatgtaatttcgcgtgaagtggaagcgctgaacagaaaaaaaatcgcccaagtaaattctgttctaaactatattgcgaataccaaaacttgtcgaagcgtacaactggtttcctactttggtggaacaactgtctgccaatgggggaaattgtccgcttgttggaaaccacaattcccgtttttccannnnnnn

SEQ ID NO: 21752 - protein, 113 aa, Unknown
  Obtained from environmental sample
  misc_feature (1)..(113): Xaa is any amino acid
MSPKWDNLLKLVIAILRKMERDQVVEIMLQITDATLTFLVPREDDKTINVISREVEALNRKKIAQVNSVLNYIANTKTCRSVQLVSYFGGTTVCQWGKLSACWKPQFPFFXXX

SEQ ID NO: 21753 - DNA, 444 bp, Unknown
  Obtained from environmental sample
  misc_feature (1)..(444): n is a, c, g, or t
ttgacagcaaaacaacaacattcattcttggacaacggcataaaccaggctcccttcggctccgctcagtataaacctctgcctcgctcttttttatacgtcttaccaagcctgaatattgaatcacaaccagcatcaaaaaaaggtaacagcgacggcgctatgggaagtaaatctaaaatgaagcttatgaaatcttacaaaatcaataaaaaggaagcggaacaaaagaaaaaatcaaaaaaggaaaacgctcaagatataataagtaaatcaataaaaaaaatgataaaatcatacaaaatcaataattcggaagtgtctaaaaagttaaaaaatcaaaaaaataaatacacttcggatataatatctaaatcacttttaaaacctgcccgaatacctgcccgacatttttctggtggggttcaggtgggtaattattaa

SEQ ID NO: 21754 - protein, 147 aa, Unknown
  Obtained from environmental sample
  misc_feature (1)..(147): Xaa is any amino acid
MTAKQQHSFLDNGINQAPFGSAQYKPLPRSFLYVLPSLNIESQPASKKGNSDGAMGSKSKMKLMKSYKINKKEAEQKKKSKKENAQDIISKSIKKMIKSYKINNSEVSKKLKNQKNKYTSDIISKSLLKPARIPARHFSGGVQVGNY

SEQ ID NO: 21755 - DNA, 381 bp, Unknown
  Obtained from environmental sample
  misc_feature (1)..(381): n is a, c, g, or t
atgaaaaacatattactcctcacaatagcgctttcatttgttaatcttttcgcacaagaaaattgtgaaaaattcaaaaccggaactttcaggatgagtgattccacaataaactttgagtgcaccattaccagaaatgactctctacaaattgaaacagtgaaaggctccaatgaagtatctgtttacaaagtggcatggccaagtgcgtgtgaatataccctgcagatgatttcgggaaaatctccagatctggaacttttcaaagacaaaattttaagggtgaaaattttggctacagaagaagataattatacctatgaagccaaaatggacggaatagatttagttgtttctgagaccatatatataatcgattaa

SEQ ID NO: 21756 - protein, 126 aa, Unknown
  Obtained from environmental sample
  SIGNAL (1)...(18)
  misc_feature (1)..(126): Xaa is any amino acid
MKNILLLTIALSFVNLFAQENCEKFKTGTFRMSDSTINFECTITRNDSLQIETVKGSNEVSVYKVAWPSACEYTLQMISGKSPDLELFKDKILRVKILATEEDNYTYEAKMDGIDLVVSETIYIID

SEQ ID NO: 21757 - DNA, 786 bp, Unknown
  Obtained from environmental sample
  misc_feature (1)..(786): n is a, c, g, or t
atggatttacgatacgttaaacaaacagcaaagatttcacagtcgcctggagttattggcttgtctattcacaatgtgcgtgcaacaggaagttatatcgcgggaacaaatggtacaagtaacggaattgtgcctatgttaaaagtatttaacgatacagcgcgatacgtagatcaaggtggtggaaaacgtaaaggaagttttgcaatgtatatcgagccttggcatgcagatattatgagtttcttagacttaaagaaaaatcacggtgccgaagaattgcgtgctagagatttattttacgcgatgtggatgcccgatttatttatgaaacgtgtagaagaaaatgcagaatggacgttaatgtgtcctaacgaatgtcctggtttatgcgatgtacacagtgaagaatttgaagcgctttacacaaaatacgaaagtgaaggaaaaggtcgtaaaaaaataaaagcgcgtgaactttgggagaaaatattagaatctcaaatcgaaaccggtacgccatatatgttgtataaagatgcagcaaaccgtaaatcgaatcagaagaatttaggaactattcgttcttcaaatttatgtactgagattatggaatacacctctccagatgaggtggcggtatgtaatttagcctctattgctttgccaatgtttattaaaaacggggagttcgaccacaaagaattattccgtattacaaaacgtgtcactaaaaacttaaaccgcgtcattgatagaaactactatccgggtaaaagaagctga

SEQ ID NO: 21758 - protein, 261 aa, Unknown
  Obtained from environmental sample
  DOMAIN (1)...(261): Ribonucleotide reductase, barrel domain
  misc_feature (1)..(261): Xaa is any amino acid
MDLRYVKQTAKISQSPGVIGLSIHNVRATGSYIAGTNGTSNGIVPMLKVFNDTARYVDQGGGKRKGSFAMYIEPWHADIMSFLDLKKNHGAEELRARDLFYAMWMPDLFMKRVEENAEWTLMCPNECPGLCDVHSEEFEALYTKYESEGKGRKKIKARELWEKILESQIETGTPYMLYKDAANRKSNQKNLGTIRSSNLCTEIMEYTSPDEVAVCNLASIALPMFIKNGEFDHKELFRITKRVTKNLNRVIDRNYYPGKRS

SEQ ID NO: 21759 - DNA, 624 bp, Unknown
  Obtained from environmental sample
  misc_feature (1)..(624): n is a, c, g, or t
ttgttggtctttatacagttgatagaaatgcttgaaactgctgttgccaatcctgtgaattatgacaaaatggatttgctttttgagaaacatcctgaatttaaaacagattttcagaatttaatttttgaattttctcaccagctgcgagctattgctaacaccattaataagtctaaacggtttccttcaaataacgttctttcccaagccattaaaacactagaaaatgacattttaaaatttaaagatgaaaattatatagaagattacgagcactatttaatgcttcaaaatctattagattatcaaataaaacaatttgaaaaattaaagaaaattaaatggctactaggcaaccctaaattatcatcggacgattttattaaaaatgataagttaaggcgttttatcgatgagcaagattataacccaaaactcatactcagaaatttcagttttagatccactatttttaaacattctttacgtttggctgttgtggtaatgctaggttatggtattggaatatttttcgattttcaaaatccatattggataatacttaccataattgtgattatgagcctattacgtctaccaaaacccctcgaccgatcttga

SEQ ID NO: 21760 - protein, 207 aa, Unknown
  Obtained from environmental sample
  misc_feature (1)..(207): Xaa is any amino acid
MLVFIQLIEMLETAVANPVNYDKMDLLFEKHPEFKTDFQNLIFEFSHQLRAIANTINKSKRFPSNNVLSQAIKTLENDILKFKDENYIEDYEHYLMLQNLLDYQIKQFEKLKKIKWLLGNPKLSSDDFIKNDKLRRFIDEQDYNPKLILRNFSFRSTIFKHSLRLAVVVMLGYGIGIFFDFQNPYWIILTIIVIMSLLRLPKPLDRS

SEQ ID NO: 21761 - DNA, 351 bp, Unknown
  Obtained from environmental sample
  misc_feature (1)..(351): n is a, c, g, or t
ttgaccgtaaaggttttcccctcttttacattcttaataaatattctgaagagccatgttaaactgatggcgaataaaattacaaaaagaagcgcaaaccccacttttttagcaataaaattgggagtgttaaaaaaatggattcgagttgaagcttctaccaactcaactttaatatcctgcccatttagatataggtttcctgtttctaaaaaatctactttaacaggtaaatcagtatgcaattgcatatcattcccaaagaaatccgtgtataataaaatgttaaatataatggtggctaaaaaaacgagcgtcaataatccaactacaatattactgaaccagtaa

SEQ ID NO: 21762 - protein, 116 aa, Unknown
  Obtained from environmental sample
  misc_feature (1)..(116): Xaa is any amino acid
MTVKVFPSFTFLINILKSHVKLMANKITKRSANPTFLAIKLGVLKKWIRVEASTNSTLISCPFRYRFPVSKKSTLTGKSVCNCISFPKKSVYNKMLNIMVAKKTSVNNPTTILLNQ

SEQ ID NO: 21763 - DNA, 834 bp, Unknown
  Obtained from environmental sample
  misc_feature (1)..(834): n is a, c, g, or t
gtgtttgttctagtgctaattttttctttaatatattcaagtaattttagtaaaggtattgaagaaattagaaaaatattaccattaatccttctgccatttgttttttttttttgttacaaaaatcaaattaaaaagaaaattcctgtcatattaaatgcatttgtgtttgcaaaccttatttatataatttatttatataattttattgttttaaaactttcgccatataaagagtttggttttagaaatgagatttaccctgttaagtttgtaaaatctttttttattccttttaataaaattttactaaaagcaatacatgtccagtaccaaccgccttctttaatgtttcataaggcctatatgtctatgtttgttttattctcaatatttatattagtttatcaattttctaaaacaaaaaagaaggtgtttaaactggtttctgttttacttatatttctttttttagttgtgttgatacattggttttcaatgcctaatatttttgttttaggactaatgtccgttttatttgtttttaaatttttgaataaaaaaattatcttaatcggagcattggtagtgtctggaatacttttaatatcaagtccttttatcaaaagtagattagattcaaattctatttttaatgtaaattataatcaggttacacaatttataaaaaacacttttagtgattctgacaaagatttaagtggaagagcagcaattaataaatgtagtgtaaaattagtaaaagatagccctttacttgggtatgggatgggtgctgcaaatgacgttttattggattgttatggaagatag

SEQ ID NO: 21764 - protein, 277 aa, Unknown
  Obtained from environmental sample
  misc_feature (1)..(277): Xaa is any amino acid
MFVLVLIFSLIYSSNFSKGIEEIRKILPLILLPFVFFFCYKNQIKKKIPVILNAFVFANLIYIIYLYNFIVLKLSPYKEFGFRNEIYPVKFVKSFFIPFNKILLKAIHVQYQPPSLMFHKAYMSMFVLFSIFILVYQFSKTKKKVFKLVSVLLIFLFLVVLIHWFSMPNIFVLGLMSVLFVFKFLNKKIILIGALVVSGILLISSPFIKSRLDSNSIFNVNYNQVTQFIKNTFSDSDKDLSGRAAINKCSVKLVKDSPLLGYGMGAANDVLLDCYGR

SEQ ID NO: 21765 - DNA, 573 bp, Unknown
  Obtained from environmental sample
  misc_feature (1)..(573): n is a, c, g, or t
atgagtgattttaaagtttcaatacaagaaacctctaaccctaccataattaaattcgaattaaaccaatttataaccaagcaccaaagctttgaatttaacaacattgacgaggctaaagactcacctttagcacaacaattattttatcttccttttgtaaaaaaagtttacatatctagcaattttatagctattgaaagatataatattgtagaatggaacgatgttaagactgaagtagcagaacagattgaatcctacctaaacgatggtggaatagctgtgtcagaaactgctgtaacaaaaaaggttgctgtaaccgtttacacggaaagcacgccaaacccatcagtactaaaatttgtttcaaacaaaaaattagttacctcttcttacgagtttacctcaatcgaaacagctaagccatcacctatggctacagcattatttcattttccatttgttaaaagcgtcttttttgacgaaaactatgtgtcaatcacaaaatatgatatcgcagaatggaatgacatttcttttgaattaagagagtttataaaaaatacatag

SEQ ID NO: 21766 - protein, 190 aa, Unknown
  Obtained from environmental sample
  misc_feature (1)..(190): Xaa is any amino acid
MSDFKVSIQETSNPTIIKFELNQFITKHQSFEFNNIDEAKDSPLAQQLFYLPFVKKVYISSNFIAIERYNIVEWNDVKTEVAEQIESYLNDGGIAVSETAVTKKVAVTVYTESTPNPSVLKFVSNKKLVTSSYEFTSIETAKPSPMATALFHFPFVKSVFFDENYVSITKYDIAEWNDISFELREFIKNT

SEQ ID NO: 21767 - DNA, 486 bp, Unknown
  Obtained from environmental sample
  misc_feature (1)..(486): n is a, c, g, or t
ttggtaaaagtggattattatattgaaaacattgctgatgtgtataagaatctacaaactaaacttttaaatttaattaccgaaaaaaaagaatattacaatctactaggttttaaattagaaaactataatgctgtcatggctgatcaaaaatattgttacttcccaaaagatttttatcaaaattatcaggcatttaacagcatatctttccaagctttaaaacaggataaaggtgttactgaagtaaaaaaacaaacctcatattactaccaacctttgtcttacgagaactatgatattgtaattaatccttcaatattagagcctgttgtacaaattggtatggaaataaaactacattttacaccaaaaccagctgagcaaaaacaagaccctattgttaaaacagaaatcaaacataaatactttgttatatcacctgacggaaccattgacgttaaagagttaaatactaaccattaa

SEQ ID NO: 21768 - protein, 161 aa, Unknown
  Obtained from environmental sample
  misc_feature (1)..(161): Xaa is any amino acid
MVKVDYYIENIADVYKNLQTKLLNLITEKKEYYNLLGFKLENYNAVMADQKYCYFPKDFYQNYQAFNSISFQALKQDKGVTEVKKQTSYYYQPLSYENYDIVINPSILEPVVQIGMEIKLHFTPKPAEQKQDPIVKTEIKHKYFVISPDGTIDVKELNTNH

SEQ ID NO: 21769 - DNA, 696 bp, Unknown
  Obtained from environmental sample
  misc_feature (1)..(696): n is a, c, g, or t
atgagtaaacattatttacagctaaagaccggctaccccgacttaatggttatccataacggcaaagtacattttgaagaagtaaaagccccaggcgacaagctaaggcgaaatcaattaacgactatagataacttaaagagcagtgnttttgaggtacatatagccgttgttaaatggtttatagatcccaaccgcatttacagcgtagttgatttagaaacgacaggcgcattaaaaggcggtaacaaaataaccgaaattggcttagttaaagtacagcatggcaaagtaatcgatacctggactactttagttaacccacagcgacatatacctgggtttatcacgtcgttaaccggtattagcgatagcatggtaagtaatgcgccagtatttgcagatatagtaaaacctttaatggctaaattagcgggaagcatttttgttgcgcacaatgttaactttgactacgggtttattaaaaaagaatgcgaaatggcaaaggtgccttttaaaatgcccaagttgtgcactgtggtggaatcgcgtaaagcctttgcgggcttaaagtcgtactcgttgggtaatttgtcaaagcactttaatttaaacttaactagccatcaccgagcgcttgccgatgcaaccgccacagcgcagttgttactgttaattcaaaaatcacaaagctag

SEQ ID NO: 21770 - protein, 231 aa, Unknown
  Obtained from environmental sample
  DOMAIN (68)...(223): Exonuclease
  misc_feature (1)..(231): Xaa is any amino acid
MSKHYLQLKTGYPDLMVIHNGKVHFEEVKAPGDKLRRNQLTTIDNLKSSXFEVHIAVVKWFIDPNRIYSVVDLETTGALKGGNKITEIGLVKVQHGKVIDTWTTLVNPQRHIPGFITSLTGISDSMVSNAPVFADIVKPLMAKLAGSIFVAHNVNFDYGFIKKECEMAKVPFKMPKLCTVVESRKAFAGLKSYSLGNLSKHFNLNLTSHHRALADATATAQLLLLIQKSQS

SEQ ID NO: 21771 - DNA, 534 bp, Unknown
  Obtained from environmental sample
  misc_feature (1)..(534): n is a, c, g, or t
atggttacgcagaaaagtttcaaatcatatccatatgcaaaattggcgtcagaaaggttagattccttaaatgcaagattggatagaatagattctaaaagcaaaaagagaaaatacactaggcaaattcagaaatatatagaaggtgaattcacagagcaaattaaaaagatgaccaaaacagaaggtcgtattttaataaaactaattcatcgtcaaacaggcaaaacagctttcaataatataaaaggactcagaagtggttggaaagccttttggtataacacaactgcgaatcttttcagcttatctctaaaagatgaataccatccagaaactataaacgaagattttttaatcgaagatattttacaacgtgcttttagagatcgggttttaaagagtcaacccacaaagctaaatttcgattttgtagaaattatttcagagaaaaaagcagaaataaatgttgaggaatataaaatcttatttgctaaaatgaaaaagaagaaaaaaattaggaatagtaattaa

SEQ ID NO: 21772 - protein, 177 aa, Unknown
  Obtained from environmental sample
  misc_feature (1)..(177): Xaa is any amino acid
MVTQKSFKSYPYAKLASERLDSLNARLDRIDSKSKKRKYTRQIQKYIEGEFTEQIKKMTKTEGRILIKLIHRQTGKTAFNNIKGLRSGWKAFWYNTTANLFSLSLKDEYHPETINEDFLIEDILQRAFRDRVLKSQPTKLNFDFVEIISEKKAEINVEEYKILFAKMKKKKKIRNSN

SEQ ID NO: 21773 - DNA, 816 bp, Unknown
  Obtained from environmental sample
  misc_feature (1)..(816): n is a, c, g, or t
atgaagaaaaaaaaaaagaaaaatanatcaggtgtttctttgagctttgactcggctcaggcacgggccgttgattttaaacgttgggaagctaatgaaaagttagtgtttagaaaaaatgaactctattttgaaaaagataaaaatggaaagcaactcccttacctagaagctgtcgctatcacatttttacccgacaaacagagtgaatttcttcaatttgcacaagaaaagatagattttcttagcggattagatccgtcgtataaagatgaattgcttaacgccaaaggagaattgcaaacgaattacgaagagcgtattcaaatgctaagagcaccttatttaaatactgaatatctaggtatatacttagaccattcttcctcggaaatcaaatcaaaaaaaattagacaagccataaattatgggtttgatagaaataccatgatcacctacctaagaaacggtattggcacaccggcttctgggggctttatccctaaaggtttacctgggttttcagatgctagctattacgaatacaatccgcgtaaagcgaaaaaacttattgaaaattacaaaattgaaacaggtaatcaaaatcccaaaataagcattagcactaatgcttcttatttagatttgtgtgagtatatacaacgcgaattacaaaaagtaggattgcaagttgaaatagatgttatgccaccttctacacttagacaacaacgatcggccgggaaattagcttcttttcgcgccagttggatagcagattatcctgatgccgaaaattatctatctctgttttan

SEQ ID NO: 21774 - protein, 272 aa, Unknown
  Obtained from environmental sample
  SIGNAL (1)...(19)
  misc_feature (1)..(272): Xaa is any amino acid
MKKKKKKNXSGVSLSFDSAQARAVDFKRWEANEKLVFRKNELYFEKDKNGKQLPYLEAVAITFLPDKQSEFLQFAQEKIDFLSGLDPSYKDELLNAKGELQTNYEERIQMLRAPYLNTEYLGIYLDHSSSEIKSKKIRQAINYGFDRNTMITYLRNGIGTPASGGFIPKGLPGFSDASYYEYNPRKAKKLIENYKIETGNQNPKISISTNASYLDLCEYIQRELQKVGLQVEIDVMPPSTLRQQRSAGKLASFRASWIADYPDAENYLSLFX

SEQ ID NO: 21775 - DNA, 672 bp, Unknown
  Obtained from environmental sample
  misc_feature (1)..(672): n is a, c, g, or t
atgagtgcgctcgccttgtgcttaatgagcgtggagaaattactaaatccagagattgatatagcttattttaatcagaaagcctcatttttagcacgcttaggctctggtagtgcttgtcgaagtatagaaggtgatttggtggtttggggacaacataatcagattaaaggaagttcggatttatatggtgtaaaatatacagacgaagtgcaccctgtttttaagaattatcacgataccattctgttagttgataaaggcgaaaaacaagtcagtagtactgtagggcataatttaatgcacaatcatccctatgcccaaaaaaggtttaagcaggcggttgaaaatatttcagaaatgaaaaatatattaaaattgggtgatttaaaagggtttattgctttattggaaagtgaagctttaacattacatgctatgatgatgactagtatgccttattttattttaatgaagccaaatactttagagattataaataaaatttgggaatttagagcaaaaacaggccttcatataggctttactttagatgctggtgccaatgtacatatactatttccagaaaatgaacgccaaaaacttatgaattcattaccaagagttagttgcctattgtccaaacggtcacttatatttgtgacaacatag

SEQ ID NO: 21776 - protein, 223 aa, Unknown
  Obtained from environmental sample
  misc_feature (1)..(223): Xaa is any amino acid
MSALALCLMSVEKLLNPEIDIAYFNQKASFLARLGSGSACRSIEGDLVVWGQHNQIKGSSDLYGVKYTDEVHPVFKNYHDTILLVDKGEKQVSSTVGHNLMHNHPYAQKRFKQAVENISEMKNILKLGDLKGFIALLESEALTLHAMMMTSMPYFILMKPNTLEIINKIWEFRAKTGLHIGFTLDAGANVHILFPENERQKLMNSLPRVSCLLSKRSLIFVTT

SEQ ID NO: 21777 - DNA, 360 bp, Unknown
  Obtained from environmental sample
  misc_feature (1)..(360): n is a, c, g, or t
atgaaatatttcgtattctttttttctattattttatgttcttgttcatcctcagaaaaaaaattaacagcacaacaaattatcgacaaaacaattgttgcttctggaactgataaagttgataattcaaaaattactttcaattttagagatttgaattatgtagccattagaaaaaacggaaaatttgaattatcaagagaggtagactcgattaaggatgttttaactaatgatggttttaaacgttttatagaaggaagtgaagctgaaattgataaagaattgagccagaaaatttacaattctattaattctgtgcactattttccggtgttgccttttggtttgaatgaanga

SEQ ID NO: 21778 - protein, 120 aa, Unknown
  Obtained from environmental sample
  SIGNAL (1)...(19)
  misc_feature (1)..(120): Xaa is any amino acid
MKYFVFFFSIILCSCSSSEKKLTAQQIIDKTIVASGTDKVDNSKITFNFRDLNYVAIRKNGKFELSREVDSIKDVLTNDGFKRFIEGSEAEIDKELSQKIYNSINSVHYFPVLPFGLNEX

SEQ ID NO: 21779 - DNA, 378 bp, Unknown
  Obtained from environmental sample
  misc_feature (1)..(378): n is a, c, g, or t
gtgatgggcttattaaagcaatctgtaagaactgaatttttaaacagaattgatgatgtaattatgtttacacctttaaatgaaaaggatatttttcaaattgttaagttacaaattgaacatttaaagaaaatgattggtaaacaagaaattactttagatgctacagatgaagcaataacttatttggctaaaaaaggttatcagccagaatttggagcaagacctgtaaaaagagtcattcagaaagaagtattgaatcagctttctaaagagattttatcaggaaaaataaccacagacagcattattttattagatgctttcgatgatcagttggtttttagaaatcaatctgatttggctgaagagttataa

SEQ ID NO: 21780 - protein, 125 aa, Unknown
  Obtained from environmental sample
  misc_feature (1)..(125): Xaa is any amino acid
MMGLLKQSVRTEFLNRIDDVIMFTPLNEKDIFQIVKLQIEHLKKMIGKQEITLDATDEAITYLAKKGYQPEFGARPVKRVIQKEVLNQLSKEILSGKITTDSIILLDAFDDQLVFRNQSDLAEEL

SEQ ID NO: 21781 - DNA, 600 bp, Unknown
  Obtained from environmental sample
  misc_feature (1)..(600): n is a, c, g, or t
atgaatgaagaaaatttaatattcatcatttcccagccccgtagtggttccacctatctacagaacttgctgtctaacaatgctgaagttaatacttgtagtgagtcctggatgctgcttaattttgcgaatcaaataaagccttcctcggttcaggcaaaatttgataatacattggcggttggagcctttaaagaatatttaggcaagtatccaaatttaaaatttagggaagcgtttcatgattttctattgaaattgtatagtcccatgtttgagggataccagtttgtagtagataaaacgccccgatattgggaaatttcatctgaaataacgagcctattccccggcagtaaagttattgtattacatagaaaccctattgatgttgcaaaatctatgataaaaacatgggggtttacttcctttaaagaattaaacatctttagaagagatttgctacagggtccacaaaagttgcgctcgttttcaatagcaaataaggaaaataagaacgtatataatctttcttacgaagaccttattaccgatacccccantgaagtacaaaaaatatacaattggactgggataccn

SEQ ID NO: 21782 - protein, 200 aa, Unknown
  Obtained from environmental sample
  misc_feature (1)..(200): Xaa is any amino acid
MNEENLIFIISQPRSGSTYLQNLLSNNAEVNTCSESWMLLNFANQIKPSSVQAKFDNTLAVGAFKEYLGKYPNLKFREAFHDFLLKLYSPMFEGYQFVVDKTPRYWEISSEITSLFPGSKVIVLHRNPIDVAKSMIKTWGFTSFKELNIFRRDLLQGPQKLRSFSIANKENKNVYNLSYEDLITDTPXEVQKIYNWTGIP

SEQ ID NO: 21783 - DNA, 744 bp, Unknown
  Obtained from environmental sample
  misc_feature (1)..(744): n is a, c, g, or t
atggatgatcaaatgcatttggcagctcagtatttagctgcagctggaattagttttcttgaaaagaaagacgacgacagtcacacaaattttggatttagtataacagataagtgtttatatacgcattcactttctataaacgacgatgtcttaggtttagattacgaaaacttcgcattagtatggaagtctaaaaaaggtaaaacaagttttagtttggatggtgtctcgcatagcactatcctgaagtggctttcggatatgtctaaaagcaatcttaataagttgtatacctataagtttcattatacgttgccatatagtatagacgcaagttacacttttaaattgtctaatttagatcgtcttaaaacattgacagctcaacgtgtaatggtagaaaaagttattgaaagtataaaagcagattataaattggaagcaccttgcagagtatggcctcatcattttgatactggtatttatgcaaagataccagatactaatttaaccattggtttaggactagcaattccggataatgtatctaaaactcactatttttatatctctggatataaaaatgataaaataattaaaccttataatttttttgaattaacaataggagagtggagaactgaagattttactggtgcaattttagaattgttggacgtaaataaaaatgatactatatcattttttaaagaagctattaaacaatttaaatcaaaatag

SEQ ID NO: 21784 - protein, 247 aa, Unknown
  Obtained from environmental sample
  misc_feature (1)..(247): Xaa is any amino acid
MDDQMHLAAQYLAAAGISFLEKKDDDSHTNFGFSITDKCLYTHSLSINDDVLGLDYENFALVWKSKKGKTSFSLDGVSHSTILKWLSDMSKSNLNKLYTYKFHYTLPYSIDASYTFKLSNLDRLKTLTAQRVMVEKVIESIKADYKLEAPCRVWPHHFDTGIYAKIPDTNLTIGLGLAIPDNVSKTHYFYISGYKNDKIIKPYNFFELTIGEWRTEDFTGAILELLDVNKNDTISFFKEAIKQFKSK

SEQ ID NO: 21785 - DNA, 390 bp, Unknown
  Obtained from environmental sample
  misc_feature (1)..(390): n is a, c, g, or t
ttgaaacactattatttatcggttttgttgtttttcagtagcattactgctgaattatgttctcaaaatgaggcactatcaagtaatgatgcgtacaatcaatataaagccataagtgactctatggcgatatcatttcctgaagatgatattgggacctttaggcgtacttcttttaatgaaacccagctacaaaattatctctccatgcactttaagcgtatggatctattgtctcaaattaaggggcatcacgtctttattttgaatagttacttacattctggcaattggtttaaggcaattggttttcctaaggaatccattaagtcctataaaaatttctttcgacactataaacgttataaacagagtactctcacaagctga

SEQ ID NO: 21786 - protein, 129 aa, Unknown
  Obtained from environmental sample
  misc_feature (1)..(129): Xaa is any amino acid
MKHYYLSVLLFFSSITAELCSQNEALSSNDAYNQYKAISDSMAISFPEDDIGTFRRTSFNETQLQNYLSMHFKRMDLLSQIKGHHVFILNSYLHSGNWFKAIGFPKESIKSYKNFFRHYKRYKQSTLTS

SEQ ID NO: 21787 - DNA, 354 bp, Unknown
  Obtained from environmental sample
  misc_feature (1)..(354): n is a, c, g, or t
gtgctaagaatcggtcagaaggttgaaactaagctgattaataagttattaaaatatacaggctttacagcataccaaagcaagttagataaagagccgctattaaaaaggcttaacgatgttgtaaaaatcaaccttgaaccaaggtatgtttttgatgaatgtattgcttattttggtcaaaacagaatagcgctagctggttatacaacgnctgcaagacactatttctacnggtatttatcnnaaatgagcgtaaccgaattgaaatggtgctgcttgatagtttgtcttcaggtaccagaaaaacattacttaaattacttgagtcaaataatacctttactgacttag

SEQ ID NO: 21788 - protein, 117 aa, Unknown
  Obtained from environmental sample
  misc_feature (1)..(117): Xaa is any amino acid
MLRIGQKVETKLINKLLKYTGFTAYQSKLDKEPLLKRLNDVVKINLEPRYVFDECIAYFGQNRIALAGYTTXARHYFYXYLSXMSVTELKWCCLIVCLQVPEKHYLNYLSQIIPLLT

SEQ ID NO: 21789 - DNA, 438 bp, Unknown
  Obtained from environmental sample
  misc_feature (1)..(438): n is a, c, g, or t
ttgaccgctaaagacaccatagacgaaactgtttttggactacaggctggcgcaaatgattacattaaaaaacctttccattttgaagagcttctggaacgcataaaagtgcaattacgaccaaaatctggagaacattctatttttaaaattggagatatcacgctgaacacaacaacctatcaagtgtttaaaggaacagaagaagtcaacttaacacaaaaagaatttgctttgttagagtacttattacgtaataaaggtatagtatgtagaagatcccgaattattgaaagtgtctgggatatacattttgattataatacaggtgttattgatgtttttattaatgcgcttcgtaaaaaattgaaattgagtaaggacgaaaactatatccagaccgttagaggtgttggttacattgcgaaggagctatga

SEQ ID NO: 21790 - protein, 145 aa, Unknown
  Obtained from environmental sample
  DOMAIN (66)...(142): Transcriptional regulatory protein, C terminal
  misc_feature (1)..(145): Xaa is any amino acid
MTAKDTIDETVFGLQAGANDYIKKPFHFEELLERIKVQLRPKSGEHSIFKIGDITLNTTTYQVFKGTEEVNLTQKEFALLEYLLRNKGIVCRRSRIIESVWDIHFDYNTGVIDVFINALRKKLKLSKDENYIQTVRGVGYIAKEL

SEQ ID NO: 21791 - DNA, 369 bp, Unknown
  Obtained from environmental sample
  misc_feature (1)..(369): n is a, c, g, or t
ttgcataaattaaataaaaaggtcgggactgtgttcgaccagacaattgtaatgaagaatctaaaaaaaatattgctcctttttaccgttacctttctaatagtaagtttttcgaattgtggtggggctcaggatgcgaacaataaaaaattatttattgaaaacccaccgtttaagattgctgaagcatattaccaaaactgggtttgcaggtataaaagatggtggctcgggaaccaaatgtccatattgcttttaagcgaaatggattccgatgctgtgattcagaatatctacttcagaaaccatattcttgaagcaaaggcgaatctaaacgaaccaaataatatgtgggtaatcttaaaatga

SEQ ID NO: 21792 - protein, 122 aa, Unknown
  Obtained from environmental sample
  misc_feature (1)..(122): Xaa is any amino acid
MHKLNKKVGTVFDQTIVMKNLKKILLLFTVTFLIVSFSNCGGAQDANNKKLFIENPPFKIAEAYYQNWVCRYKRWWLGNQMSILLLSEMDSDAVIQNIYFRNHILEAKANLNEPNNMWVILK

SEQ ID NO: 21793 - DNA, 360 bp, Unknown
  Obtained from environmental sample
  misc_feature (1)..(360): n is a, c, g, or t
ttgttacgatggttaggtgaatctgtttggtttccaaccaaccttttgccaaataaaagattaaagtggtttcctattgatgatacatctgctaaattaatgtttgattataaagggttgtccttgttatacattgtcaggtttaatgaaaaaaatgaaattattcagttggaaaccgagagattatacgatgaaaaaaacctaaagaaatggattggtaattgttctaattacaaagaaataaataatgtaaaagttccaacagtaattaaagctacctggagactaaaacaaaaagaccacaattatgtcatttttaatctcaaagaaattgagtatgacttgccaaaaaaatattaa

SEQ ID NO: 21794 - protein, 119 aa, Unknown
  Obtained from environmental sample
  misc_feature (1)..(119): Xaa is any amino acid
MLRWLGESVWFPTNLLPNKRLKWFPIDDTSAKLMFDYKGLSLLYIVRFNEKNEIIQLETERLYDEKNLKKWIGNCSNYKEINNVKVPTVIKATWRLKQKDHNYVIFNLKEIEYDLPKKY

SEQ ID NO: 21795 - DNA, 600 bp, Unknown
  Obtained from environmental sample
  misc_feature (1)..(600): n is a, c, g, or t
atggtcctttttgaagctgtttcagaaggtattattgtagtagatgaagctcaaaaaatagtcactgtaaattcatcggcagaaaaaatgtttggttacccaaaagatgaactgatcaaccgttctttacaaattttaatcccatcaaaatatcactcaaatcatggagcacatgttagtggttttatgaaaaaaagtagccgtagaaaaatggggcaaggactagatctctatggtgttactaaaaacaaaaaagagtttccattagaagtcggattaaatccttttacctttgatgaaaaaaaatatatcatggcgttagttattgatattaccgcccgtaaagaaactgaaaaacaaaaggaaattttaaacgctcaacttgaaaaaaagataaaagagagaacatctcaattaaataaaaccattatacaattaaaagaagtaaacctaaactttgaaaaggaaattaaaaagagaggtcgggtagaacataaactcaaaattgccttaaaaaaagaaatagaactaaatgatctaaaaaccaaatttttatctcttgtttcacatgaatttaaaacacctttaagtggaatttaa

SEQ ID NO: 21796 - protein, 199 aa, Unknown
  Obtained from environmental sample
  DOMAIN (2)...(60): PAS domain
  misc_feature (1)..(199): Xaa is any amino acid
MVLFEAVSEGIIVVDEAQKIVTVNSSAEKMFGYPKDELINRSLQILIPSKYHSNHGAHVSGFMKKSSRRKMGQGLDLYGVTKNKKEFPLEVGLNPFTFDEKKYIMALVIDITARKETEKQKEILNAQLEKKIKERTSQLNKTIIQLKEVNLNFEKEIKKRGRVEHKLKIALKKEIELNDLKTKFLSLVSHEFKTPLSGI

SEQ ID NO: 21797 - DNA, 480 bp, Unknown
  Obtained from environmental sample
  misc_feature (1)..(480): n is a, c, g, or t
atgccaacaaagatctattcaacagccaaaatacttatagtggaggagcaaccgctcgcccaaagctatatgaaacaatcgctagaaaagcttggctttggacagttacgatttgcagatcatgctaactcggcaaaagagcagtgtataaacgagcaatttgatttaattgtatgctcattcaatctaaataagcatcaagatggttatcagctttatgaggaattgcgaataaagcagttaattaaaagctccactgggtttatttttatttctgcagaaacaagtggctcgcttgtacatagtgttcttgaattacaacccgatgattttttggttaaaccatttacagcacaagagcttaaaatacgtatagagcgtattttaaaacgtaaacgtgatttacaaacagtttacaactttattgatgacggtaatgattccaagagcacttttaagtacataagctgccagcattaa

SEQ ID NO: 21798 - protein, 159 aa, Unknown
  Obtained from environmental sample
  DOMAIN (9)...(133): Response regulator receiver domain
  misc_feature (1)..(159): Xaa is any amino acid
MPTKIYSTAKILIVEEQPLAQSYMKQSLEKLGFGQLRFADHANSAKEQCINEQFDLIVCSFNLNKHQDGYQLYEELRIKQLIKSSTGFIFISAETSGSLVHSVLELQPDDFLVKPFTAQELKIRIERILKRKRDLQTVYNFIDDGNDSKSTFKYISCQH

SEQ ID NO: 21799 - DNA, 441 bp, Unknown
  Obtained from environmental sample
  misc_feature (1)..(441): n is a, c, g, or t
gtggacgctataaataaaaaaatagcggtggtggtgctgtttataggtgtggcgcttagtgtgctaatgctaactacaaagcttacagagcagccttggtttatatttttatttgtcttatgggtatttgtttattgctcttgttgttaccgattaaccccactgtttaaaacacgaaaccaagttaatgattttattaagcgcgatgcaaaacatttagtattgtttagcttagcgggattttttgataaaaaatctggcccgcagtggttagcaatcaaaaatattaagcacctttcaacccgcaataatgaactgctagtacacagctaccagcaaacgcaatttagtattagtttacctgcgtcaaaagtagagctagatgcttttttacagcagatactgactaattcagaaagacgaagtattacatttgattaa

SEQ ID NO: 21800 - protein, 146 aa, Unknown
  Obtained from environmental sample
  misc_feature (1)..(146): Xaa is any amino acid
MDAINKKIAVVVLFIGVALSVLMLTTKLTEQPWFIFLFVLWVFVYCSCCYRLTPLFKTRNQVNDFIKRDAKHLVLFSLAGFFDKKSGPQWLAIKNIKHLSTRNNELLVHSYQQTQFSISLPASKVELDAFLQQILTNSERRSITFD

SEQ ID NO: 21801 - DNA, 750 bp, Unknown
  Obtained from environmental sample
  misc_feature (1)..(750): n is a, c, g, or t
gtgattgcaaattctgatttcttaaatggtttgccatacaaaaaagccatgaaacgaattatttatgaaattgaacaaggtggttttggttatggtaaaataaactaccgtttacgggatgcagtttttagtcgccagcggtattggggagaaccatttccggtttattatgtgaatggattgcctcaaatgatcgatgtgaaacatttaccactgatcttgccgaaagttgaaaaatatttacctactgaagatggaaaaccaccgttgggaaatgctgaggtttgggcatgggatactaaaaataataaggttgtttctaacgatcttgtcaccctgagcgtagtcgaagggtctcaagaagacaacggtatttaccccttagaactcaataccatgccgggttgggcaggcagttcacaatactttaaccgctatatggatcctgataatgaagatgagatcttctcaaaagaagccatcaattactggcaagatgtagatctgtatattggtggtagtgaacacgctaccgggcatttattatacagccgtttttggcagaaattcatgtttgataaaggcctggttcctaaagatgaatatgctaaaaagcatattaatcaggggatgatcttaggaacgagtgcatttgtctatagagttgaaggagaaaataaatttttatctaaaggattgataaatggtataaaaacacaagcaatccatgttgatgttgtcgctcgttaa

SEQ ID NO: 21802 - protein, 249 aa, Unknown
  Obtained from environmental sample
  misc_feature (1)..(249): Xaa is any amino acid
MIANSDFLNGLPYKKAMKRIIYEIEQGGFGYGKINYRLRDAVFSRQRYWGEPFPVYYVNGLPQMIDVKHLPLILPKVEKYLPTEDGKPPLGNAEVWAWDTKNNKVVSNDLVTLSVVEGSQEDNGIYPLELNTMPGWAGSSQYFNRYMDPDNEDEIFSKEAINYWQDVDLYIGGSEHATGHLLYSRFWQKFMFDKGLVPKDEYAKKHINQGMILGTSAFVYRVEGENKFLSKGLINGIKTQAIHVDVVAR

SEQ ID NO: 21803 - DNA, 399 bp, Unknown
  Obtained from environmental sample
  misc_feature (1)..(399): n is a, c, g, or t
ttgaaagaaattattctcttgctattgcaaacgaaaaactcaccagaaatcatcaatatggttcgaagtttgttttcagaaagaacctttagcttcaaggaagtaatagatgctcatatttgtttgccaatgacggttgagaatttagctcaattaaccaatacaagtatttctgccttcaaaaaagaattcaaaagaatatacaatagcactccaagtgcctatataattgataaaaggatagagaatgtagcaaatcgtctaaaaatgtctgatgattctatatctaacattggatatcaatgtggatttagtagttcatcacatttatctagggtttttaaaactaagtacggaatctcaccatctaaatatcgattaaacttctcagataagtaa

SEQ ID NO: 21804 - protein, 132 aa, Unknown
  Obtained from environmental sample
  DOMAIN (33)...(77): Bacterial regulatory helix-turn-helix proteins, AraC family
  misc_feature (1)..(132): Xaa is any amino acid
MKEIILLLLQTKNSPEIINMVRSLFSERTFSFKEVIDAHICLPMTVENLAQLTNTSISAFKKEFKRIYNSTPSAYIIDKRIENVANRLKMSDDSISNIGYQCGFSSSSHLSRVFKTKYGISPSKYRLNFSDK

SEQ ID NO: 21805 - DNA, 651 bp, Unknown
  Obtained from environmental sample
  misc_feature (1)..(651): n is a, c, g, or t
atgaatcaaagtaaatatttagtaattttaatagttttttgcataattccaaaaataggttgcgctcaaaatttagaaaccaaaattgataaattatataaagtagaagcaaatgaacctggattttcgattgcagtctttaaaaaggaccaaattttgtttcaaaaacaatatggaacaacaaatttagattacaatattcctatttccagcaaaacggtttttgatatagcttctatttctaagcaatttacagcagcagctattttattacttgaggaagaaggtaaattaaatataaaagagccagcgtataagtatatagataaacttccgcgttataaaaagggaaatcctaccatagaacaattactaaaccaaactagtggaattaaagaagttgatccttattttggagttattgatttgtggtttaacgactatattgatcagcagcaaatgattaacattattactaaagttagtgaccttcgttttaaacctggagagtatttttattattccaatgccaattatatactactagcatctattatagaaaaagcttctggcgaaacgtatagtaattatctaccaaaaaacatttcaatccacttaatatggataatacatctattaaggccaatttna

SEQ ID NO: 21806 - protein, 217 aa, Unknown
  Obtained from environmental sample
  DOMAIN (25)...(217): Beta-lactamase
  misc_feature (1)..(217): Xaa is any amino acid
MNQSKYLVILIVFCIIPKIGCAQNLETKIDKLYKVEANEPGFSIAVFKKDQILFQKQYGTTNLDYNIPISSKTVFDIASISKQFTAAAILLLEEEGKLNIKEPAYKYIDKLPRYKKGNPTIEQLLNQTSGIKEVDPYFGVIDLWFNDYIDQQQMINIITKVSDLRFKPGEYFYYSNANYILLASIIEKASGETYSNYLPKNISIHLIWIIHLLRPIX

SEQ ID NO: 21807 - DNA, 318 bp, Unknown
  Obtained from environmental sample
  misc_feature (1)..(318): n is a, c, g, or t
ttgtcctaccctgtcagtcgtgtgtgtgtacatcattgccatattgttctttgtttttccnctccttantctcttgtggaggggttcttctcatgtatatancttgcgttctttacttcttgcaaccttttctacttactanctggcgttgtgtttccgcaatattataacatctgttctgggcctccctcacataatagtaatacatgttttctggtgtcctccacatcacccctagggaccttgttcagcgcactgattatcgtgtgtcatgtttatgctgtggggcnttccataatttcanttttatataggtag

SEQ ID NO: 21808 - protein, 105 aa, Unknown
  Obtained from environmental sample
  misc_feature (1)..(105): Xaa is any amino acid
MSYPVSRVCVHHCHIVLCFSXPXSLVEGFFSCIXLAFFTSCNLFYLLXGVVFPQYYNICSGPPSHNSNTCFLVSSTSPLGTLFSALIIVCHVYAVGXSIISXLYR

SEQ ID NO: 21809 - DNA, 645 bp, Unknown
  Obtained from environmental sample
  misc_feature (1)..(645): n is a, c, g, or t
gtgttctggtttaatccgtttatttggtggtataaaaaagaaattcaacaaaatctagaatacattgcagaccaccaaacacaacaaaaaataaagtgtccaaaaagctatcaaacagttttgttaaaagccaacttaaatcaaaatcaattagcttttactactaatttttatcaatcattaatcaaaaaacgaattattatgctacaaaaatcaaaatcaaaaaacagtaatttattaaaactcactatcgtgttaccttttttagcgctatttctaatgagttttaatacaaaaaaagtatatatcgctaatgcggaaatacaacaaaatccaactattaacgaaacattaataatcacctacaagtctactgaccaacagcttgaaaatattaaaaataagttagaagaccagttagacggaataaaaattaaattttcagacattaaaagaaaccaaaataatgagatcatagctttaacaatagccacaaaaaatataaatcaaatagattttaccaaacatatcacttttaataaattagacagtacacccataaataacactactttacaaattgtaaataaccagctattagtaagtgatgacaaaaatggatctgtagttgctatatcaaannat

SEQ ID NO: 21810 - protein, 215 aa, Unknown
  Obtained from environmental sample
  misc_feature (1)..(215): Xaa is any amino acid
MFWFNPFIWWYKKEIQQNLEYIADHQTQQKIKCPKSYQTVLLKANLNQNQLAFTTNFYQSLIKKRIIMLQKSKSKNSNLLKLTIVLPFLALFLMSFNTKKVYIANAEIQQNPTINETLIITYKSTDQQLENIKNKLEDQLDGIKIKFSDIKRNQNNEIIALTIATKNINQIDFTKHITFNKLDSTPINNTTLQIVNNQLLVSDDKNGSVVAISXX

SEQ ID NO: 21811 - DNA, 672 bp, Unknown
  Obtained from environmental sample
  misc_feature (1)..(672): n is a, c, g, or t
ttgcatgcaacgctcaccgagcaaggccatgacattagcctatacatggttagaagcattaaagaggaacatggcatcaaatgccgtcgccacaagcgctttaaagtcactaccgactccaatcacaacaagctgatctatccaaacgtactggatcagaagtttgatgccagtcgccctaaccaagcgtgggtcagtgacatcacctatatttggacacttgagggttggctgtatttagcaggcgttaaagacttatacactaaagagcttgtcggttacgctattaacaagcgtatgaccgcagatttagtatgccgtgcactcaacatagcgattaagaacaaacgacccagtaaagggctagtcgttcactctgatagaggcagtcagtactgtagtcatgcctaccataagatcatcaagcagcatcagcttacaggctcaatgagcgctaaaggtaactgctttgataacgcacctatagagagtctctggggcgtattaaagaatgagttaatatatcatcaggactataagaccagatttgccgccattaccgatatcattagatatatcgagttgtactacaancaaacgagaattcaaaagggtttaggctataaatcgncaagacaggtgtggtttgactattatcgtcaggctgcgtaa

SEQ ID NO: 21812 - protein, 223 aa, Unknown
  Obtained from environmental sample
  DOMAIN (56)...(216): Integrase core domain
  misc_feature (1)..(223): Xaa is any amino acid
MHATLTEQGHDISLYMVRSIKEEHGIKCRRHKRFKVTTDSNHNKLIYPNVLDQKFDASRPNQAWVSDITYIWTLEGWLYLAGVKDLYTKELVGYAINKRMTADLVCRALNIAIKNKRPSKGLVVHSDRGSQYCSHAYHKIIKQHQLTGSMSAKGNCFDNAPIESLWGVLKNELIYHQDYKTRFAAITDIIRYIELYYXQTRIQKGLGYKSXRQVWFDYYRQAA

SEQ ID NO: 21813 - DNA, 675 bp, Unknown
  Obtained from environmental sample
  misc_feature (1)..(675): n is a, c, g, or t
atgtacttattaagcaataaaaatctatgcttcttttcgatattcctctttactataccattcatcagtgtagctcaaaccacaaacgaagaagattatcaaaattatttagatagcataccacgcgttcagcttaagatgattcctaatccaaaagaagaagtaaacgaatctttcaaccaaaccaatgaaccagattcagtgagctatatcgataaactaaataaagaactggcaatcgatgaagttccttttcggtatgtagattatgagtatagcgatgggaaattcactacttatccatttgaactggtgaatgagaaattgccaacgatagaaggtagtaatcctaattatgataaaagatacgacaaagcctttcaaaaaatgatttccaaactcgtcaaccctatagatcttgctaaaaaagaactttatgcactgggttctcaaaatgcaggagtatatatacaagatataagcactaataaaaagtatgtattcaacgagatttgcttcgataataagtgtgctatagggcaagtattctatatctttaatccaaccaattataatatgacaggtatgctatacgatggttgttcatttatcaaagataatataacgggtaatgagcagcgtactaaagagctattacgaaaatattttgattaa

SEQ ID NO: 21814 - protein, 224 aa, Unknown
  Obtained from environmental sample
  misc_feature (1)..(224): Xaa is any amino acid
MYLLSNKNLCFFSIFLFTIPFISVAQTTNEEDYQNYLDSIPRVQLKMIPNPKEEVNESFNQTNEPDSVSYIDKLNKELAIDEVPFRYVDYEYSDGKFTTYPFELVNEKLPTIEGSNPNYDKRYDKAFQKMISKLVNPIDLAKKELYALGSQNAGVYIQDISTNKKYVFNEICFDNKCAIGQVFYIFNPTNYNMTGMLYDGCSFIKDNITGNEQRTKELLRKYFD

SEQ ID NO: 21815 - DNA, 492 bp, Unknown
  Obtained from environmental sample
  misc_feature (1)..(492): n is a, c, g, or t
atggcacctaagaaaaaccaaggctttattgtttcttttcgaaaagggtatgttattagatttacaagaaaaaggttaattaaaaatacagatgggactatttggatgatgaaaagggctaaaatagaaaaagagaaaatcttttacgattctgtaatggcatttccctataaagagattatagccctttttgaatacacacaaaatcaaaatgttttttccaccaaacacggtactaaaggagaggaataccgtaatgttctagttgttattgatgatactagttggaaatcccaatataaatttgaaggttattttgacgatagtgatacatctgatggtcgtaaagaaaggacaaaaaatcttttttatgtatcatgttcacgagcaaaagaaaatcttgtagttctcgcgctatctaaaatggaagctcctgcaatgacaaccataaaaaaatggtttggagcaaataatgtaagcatttttaaataa

SEQ ID NO: 21816 - protein, 163 aa, Unknown
  Obtained from environmental sample
  misc_feature (1)..(163): Xaa is any amino acid
MAPKKNQGFIVSFRKGYVIRFTRKRLIKNTDGTIWMMKRAKIEKEKIFYDSVMAFPYKEIIALFEYTQNQNVFSTKHGTKGEEYRNVLVVIDDTSWKSQYKFEGYFDDSDTSDGRKERTKNLFYVSCSRAKENLVVLALSKMEAPAMTTIKKWFGANNVSIFK

SEQ ID NO: 21817 - DNA, 792 bp, Unknown
  Obtained from environmental sample
  misc_feature (1)..(792): n is a, c, g, or t
atgcatccgcagatgcaacaagtgtttattagccagatcaaaggtattcttgaagaagctaagaaagacaatatacacgtccaattgttaattacatcgcactcttcacatattctatctgaagcgggaattgattctgacaaaggttttaaaagaattcgatactttaatagaattgatagcggtattgaggtacaagactttaatactcttgaaatttcaaatgaaaaacaaaccgcaagatttttaaaacagtatttgaccctacacaaatctgacttgtttttttcagacaaagtaattatcgttgaaggcactacagaacgtatgctaatgccccaactcatcttcaaatcggctcctggactttccactcagtatgtgtcaattcttgaagtaggcggtgcatatacgcataaatttaaggaaatattagagtttttaaagctaaaaacactggttgtgacagatatagattctgtagattctgtaaatggagaacgatgtgaagtcaatggtggtatagatggagaattaacatctaatcacacactgaaggattggattcccaaaaagtctaaaatcacagaacttatcgcttgtgaggaaaagaataaaattgaaaataatattgttagagtagcatatcaaacaactgaaaacggtattgtaggtagaagctttgaggaagcttttattaacacgaatctggatcttttaaaatcaaattacaccgacgataaaggcgaggagaaaaatgtgaaaaacctttttagtttcgcaaaggtttaa

SEQ ID NO: 21818 - protein, 263 aa, Unknown
  Obtained from environmental sample
  misc_feature (1)..(263): Xaa is any amino acid
MHPQMQQVFISQIKGILEEAKKDNIHVQLLITSHSSHILSEAGIDSDKGFKRIRYFNRIDSGIEVQDFNTLEISNEKQTARFLKQYLTLHKSDLFFSDKVIIVEGTTERMLMPQLIFKSAPGLSTQYVSILEVGGAYTHKFKEILEFLKLKTLVVTDIDSVDSVNGERCEVNGGIDGELTSNHTLKDWIPKKSKITELIACEEKNKIENNIVRVAYQTTENGIVGRSFEEAFINTNLDLLKSNYTDDKGEEKNVKNLFSFAKV

SEQ ID NO: 21819 - DNA, 798 bp, Unknown
  Obtained from environmental sample
  misc_feature (1)..(798): n is a, c, g, or t
gtgacgcaaaaaacttttagaaagttggggttacacgtagtaattgggaaacacgtgtttagtcaagactatcattttgctgggacagataatgagcgttgtgaggatttccaaaaagcattagacaatcctaatattaaagccatttgggcggctcgtggaggttatggttcggtgcgtattttagataagttagattattccacatttctaaaacatccaaaatgggttattggctatagtgatattaccgctttacataatcagctcaacactttaggggtagaaagtttacacgcattattggcggtaagtttagcggaagaggccaatgagattaaagcgtctgtctccacttttaaatctacactttttggggagtctttagaatacacattaaaaggatcgaaatataataaagtaggagagactcaaggacaacttgtaggagggaacctaacgattttgcatacgatgttaggctctaatacgagtttagatatggacggtaaaattctttttattgaagaaattggcgaatacgcttaccatatagatcgtatgctgcaaagtttaaagcgagcgggttacttcgaaaactgtaaaggaattatcgtgggtgatatgagtaaagtaagaaaaaacacaaaaccttgggggaaaccaatacagcaactttattcagatgtggtgggcgattatgatttccccgttgcttttaatatgcctgcacgacacgaaatgatacccgcgctttactctcaggaagaacattcattccaggtttccccactgcaa

SEQ ID NO: 21820 - protein, 266 aa, Unknown
  Obtained from environmental sample
  DOMAIN (51)...(113): LD-carboxypeptidase
  misc_feature (1)..(266): Xaa is any amino acid
MTQKTFRKLGLHVVIGKHVFSQDYHFAGTDNERCEDFQKALDNPNIKAIWAARGGYGSVRILDKLDYSTFLKHPKWVIGYSDITALHNQLNTLGVESLHALLAVSLAEEANEIKASVSTFKSTLFGESLEYTLKGSKYNKVGETQGQLVGGNLTILHTMLGSNTSLDMDGKILFIEEIGEYAYHIDRMLQSLKRAGYFENCKGIIVGDMSKVRKNTKPWGKPIQQLYSDVVGDYDFPVAFNMPARHEMIPALYSQEEHSFQVSPLQ

SEQ ID NO: 21821 - DNA, 900 bp, Unknown
  Obtained from environmental sample
  misc_feature (1)..(900): n is a, c, g, or t
gtgatcaagaatcggctccanagaatcaataagtgcgtgtggggaaacctatttcggttaaacgcacaagatgaatataaagatttatctagttttactgattttattagacgtaaaacctatatgttatcgaatactttcgagccgaaagataaaattataaacactatttcttctactttaaaaggacataaaatcccgaagaaaattgtaacgcctgtcgcagcagatattatgattaaagaggttgaagccttgttagaaaacgacaaacgccttttagtgagtaaaaattatgaagtgtatttggcaccagctaaggacattccaaatattattagagagattgggcgtttgcgagagattacctttagagaagtaggggaaggaaccaatgaagcaatcgatttagatagttttgatacgtattatcaccatatgtttttatgggatagtgaagccaaaataatagcaggggcgtatagaatgggtttaggttctaaaattttcgcgaaatacggtatagatgggttctatttacaagatttatttcgatttgagccagaattacataaaatgatgggcgaatctatagaacttggacgtgcatttattattaagagttatcaacaaaaaccaatgcctttatttttattatggaagggaattgtacacactaccttacgtttcccagagcataaatatttaattggaggggttagtattagtaatcagttttctaatttctcgaaatcgctaatgatcgagtttatgaaatcgcattattacgacccgtatgtggcacaatatgtccatccaaaaaaagaatttacagtgaagctgaaagacgctgataaagattntggtcttgatgctactgaagccgatttaataagttga

SEQ ID NO: 21822 - protein, 299 aa, Unknown
  Obtained from environmental sample
  misc_feature (1)..(299): Xaa is any amino acid
MIKNRLXRINKCVWGNLFRLNAQDEYKDLSSFTDFIRRKTYMLSNTFEPKDKIINTISSTLKGHKIPKKIVTPVAADIMIKEVEALLENDKRLLVSKNYEVYLAPAKDIPNIIREIGRLREITFREVGEGTNEAIDLDSFDTYYHHMFLWDSEAKIIAGAYRMGLGSKIFAKYGIDGFYLQDLFRFEPELHKMMGESIELGRAFIIKSYQQKPMPLFLLWKGIVHTTLRFPEHKYLIGGVSISNQFSNFSKSLMIEFMKSHYYDPYVAQYVHPKKEFTVKLKDADKDXGLDATEADLIS

SEQ ID NO: 21823 - DNA, 375 bp, Unknown
  Obtained from environmental sample
  misc_feature (1)..(375): n is a, c, g, or t
ttgatgtccgaactgggattggaaaatatcagtaataatttggtaggctctctgccattgggctggaagcaaaagttatcgttttcagtatcacttttacacgagccaaagattgttttcttggacgaacccacaggtggcgttgaccccataactagaagacagttttgggaaatgatctataaagccgcagaccaaggcaccacaattttcgtgaccacgcattatatggacgaagctgaatattgcgaccgggtttccataatggtggaaggaaaaatagaagccttggacacgccgaaaaaactgaaggaacagtttaaagttgactcaatgaatgatgtgtttttgaagctcgcgaggaatattgaataa

SEQ ID NO: 21824 - protein, 124 aa, Unknown
  Obtained from environmental sample
  DOMAIN (1)...(92): ABC transporter
  misc_feature (1)..(124): Xaa is any amino acid
MMSELGLENISNNLVGSLPLGWKQKLSFSVSLLHEPKIVFLDEPTGGVDPITRRQFWEMIYKAADQGTTIFVTTHYMDEAEYCDRVSIMVEGKIEALDTPKKLKEQFKVDSMNDVFLKLARNIE

SEQ ID NO: 21825 - DNA, 540 bp, Unknown
  Obtained from environmental sample
  misc_feature (1)..(540): n is a, c, g, or t
atgaaaacaatacaaggacaaatagtagacatacataacaaacgtatttttagtggagaaatcactgtggattcaggtaaaatacaatctatcacagaaaaagaacacgatgtaaaacattatattttaccaggttttgtagacgcgcatatacatattgaaagctcgatgttagtaccatcagagtttgctaaaatagcagttaaacatggtacagtgtctaccgttagtgatccgcatgaaattgccaatgtattaggtgtcgcaggagtggagtttatgattgaaaatggtaaaaaaacaccgtttaaattcaattttggagcaccaagttgtgtgccagcaactacttttgagtcggcaggagcagttatagattcggacgacattaaaaccctaatggctaatccagatattaaatatctagccgaaatgatgaactatcctggcgtactgtttaatgacgaggaagtactaaaaaaaatagcttgggcaaaacattataataaacccgtctcgagccgattcttgatccactag

SEQ ID NO: 21826 - protein, 179 aa, Unknown
  Obtained from environmental sample
  misc_feature (1)..(179): Xaa is any amino acid
MKTIQGQIVDIHNKRIFSGEITVDSGKIQSITEKEHDVKHYILPGFVDAHIHIESSMLVPSEFAKIAVKHGTVSTVSDPHEIANVLGVAGVEFMIENGKKTPFKFNFGAPSCVPATTFESAGAVIDSDDIKTLMANPDIKYLAEMMNYPGVLFNDEEVLKKIAWAKHYNKPVSSRFLIH

SEQ ID NO: 21827 - DNA, 312 bp, Unknown
  Obtained from environmental sample
  misc_feature (1)..(312): n is a, c, g, or t
atggttgagttagaggattatgcagatagtattacagctactcgtattaaaaaagtaattcaaggctatgagtttagtggtaagcaaaaagagacattaaaagaatattcaataaatataacaaatctgaaaaaagctgataaaattataaaacagtatgaagatttcaaaaatgatactcaatattcaaaagttgcattgacagatgataatggtgcaatttctatagttggcgaaaaaatgatttctggtaaaacagaaggtattggcggttcattcgattattacgaattaggaaaaccaatatttaaa

SEQ ID NO: 21828 - protein, 104 aa, Unknown
  Obtained from environmental sample
  misc_feature (1)..(104): Xaa is any amino acid
MVELEDYADSITATRIKKVIQGYEFSGKQKETLKEYSINITNLKKADKIIKQYEDFKNDTQYSKVALTDDNGAISIVGEKMISGKTEGIGGSFDYYELGKPIFK

SEQ ID NO: 21829 - DNA, 960 bp, Unknown
  Obtained from environmental sample
  misc_feature (1)..(960): n is a, c, g, or t
ttgaaaatatctgatttaaattggaaaacccttgccttatcaactttgctaaaaaaacataaatatcgagcaggtagacagattgaattttccgctccttctcacttaaaacgttatctcatacagtatttgaaacttagagagtgggtgnataaccttcatcttcctggagactgtcaagaatacttgtttatgcgtattggagaacatcgtcaattaaagcgttttgcacgtagctctgtcagttctattgacgacaatactccactttttaaaggggttaaaagggttactgctagagacattagaaacctatgtgcggaatactacataaaacattctaaaggaaatttgtcattagtagctaggaagttgaataactctttaactacagtagctaaatcttacacttcgatcgatattgagtctcaagcaatagagatgaatcattatcacgaaaaaatgattaccgcagttcttaggtctaatcgaactaatgaacaaactatatctatcaagacttcaactaactatgatacggagaaaataccagcaggatcttgttctaacctatcagataatgatcctgttaaggcattgggctttaataatgaagcccccaacccttcctgtgctacatttgaaagttgtttgttctgtgaattttttgcaattcatatagattttgaagatatacataaactattaagtttgaaggaggctctactaaagtcttctatgattcgtgatgatcctgaatatcatcttctctctatagaaccatcactatttagaattgacgagattatcaatattcttaaaggaaaagataatagagtaattgaactcgttgatgatgctgaacaaaaaataaaaatgcaaatttataatgagtattgggatgagcatataaattttctcactgtagcctcagaatctaacagaaaaagcttaagttag

SEQ ID NO: 21830 - protein, 319 aa, Unknown
  Obtained from environmental sample
  misc_feature (1)..(319): Xaa is any amino acid
MKISDLNWKTLALSTLLKKHKYRAGRQIEFSAPSHLKRYLIQYLKLREWVXNLHLPGDCQEYLFMRIGEHRQLKRFARSSVSSIDDNTPLFKGVKRVTARDIRNLCAEYYIKHSKGNLSLVARKLNNSLTTVAKSYTSIDIESQAIEMNHYHEKMITAVLRSNRTNEQTISIKTSTNYDTEKIPAGSCSNLSDNDPVKALGFNNEAPNPSCATFESCLFCEFFAIHIDFEDIHKLLSLKEALLKSSMIRDDPEYHLLSIEPSLFRIDEIINILKGKDNRVIELVDDAEQKIKMQIYNEYWDEHINFLTVASESNRKSLS

SEQ ID NO: 21831 - DNA, 717 bp, Unknown
  Obtained from environmental sample
  misc_feature (1)..(717): n is a, c, g, or t
atggggcataacagtaaagaaagagactcctcattagaagacttcaaaaacttcttacaaacctgcattacatactttaatgaattctcatacgccatattaaataaaatctaccctatacctattactttagcaaaatcatcaagtaatgattattattgggattcaactagaaaatatggcataaagaaactacctaattgcttctacaatagtggtgaacccttaccctttaatgaggtaaaaaatgctttatcaaattattataattgtgagcatactaagaaagatttctataaaaacacattaataaacaacagaaatacatggatcaatgagaatttagactctagaaaaatttatgcttataacctatgtacatattgcttttattacatttacctttctttcactgctgctaatatacaacccacacttgatttgaaaatatctgatttaaatttggaaaaccttggcttatcaacttttgctaaaaaacataaatatcgagcaggtagacagattgaattttccgctccttctcacttaaaacgttatctcatacagtatttgaaacttagagagtgggttgataaccttcatcttcctggagactgtcaagaatacttgtttatgcgtattggagaacatcgtcaattaaagcgttttgcacgtagctctgtcagttctattgacgaccatactcccactttttaa

SEQ ID NO: 21832 - protein, 238 aa, Unknown
  Obtained from environmental sample
  misc_feature (1)..(238): Xaa is any amino acid
MGHNSKERDSSLEDFKNFLQTCITYFNEFSYAILNKIYPIPITLAKSSSNDYYWDSTRKYGIKKLPNCFYNSGEPLPFNEVKNALSNYYNCEHTKKDFYKNTLINNRNTWINENLDSRKIYAYNLCTYCFYYIYLSFTAANIQPTLDLKISDLNLENLGLSTFAKKHKYRAGRQIEFSAPSHLKRYLIQYLKLREWVDNLHLPGDCQEYLFMRIGEHRQLKRFARSSVSSIDDHTPTF

SEQ ID NO: 21833 - DNA, 393 bp, Unknown
  Obtained from environmental sample
  misc_feature (1)..(393): n is a, c, g, or t
atgctttctgttatgctaagtgtggtggatcactataaaaatcatcaatttgtaattgctggtgctccaagccaagattatgagttctattcacaatttattaaaaaatctaacgttcactttctatccaataaaacgtatgatttattaagtgtatctaccgcggctttagtaacctctggaacagctactttagaaactgccttatttaaagtgccacaagtggtgtgttataaaggaagttggatatcctaccaaattggtaaacgcgtaattaatttaaaatatatttcgttagtgaatttaatattagacaaagaagctgttaccgaattaattcagggagattttaataataaacgattaaaaaaagaactggatattattttannn

SEQ ID NO: 21834 - protein, 131 aa, Unknown
  Obtained from environmental sample
  misc_feature (1)..(131): Xaa is any amino acid
MLSVMLSVVDHYKNHQFVIAGAPSQDYEFYSQFIKKSNVHFLSNKTYDLLSVSTAALVTSGTATLETALFKVPQVVCYKGSWISYQIGKRVINLKYISLVNLILDKEAVTELIQGDFNNKRLKKELDIILX

SEQ ID NO: 21835 - DNA, 348 bp, Unknown
  Obtained from environmental sample
  misc_feature (1)..(348): n is a, c, g, or t
gtgctggccaagctggaaatgaccgatgatgtctatcacctggtcaagaaccagcccaaggtcaccggctttctcggcagcagcggcaagccgcaggcgatcagcgaatccgaagccgcccgcattctcaacaccaaggaagaagcggccaacgctccgaaagaacggatcacggtcagctacgaaattggcgacgaggtcaaggtcaagagcggcccgttcaacagcttcaacggcattgtcgaggaactcgatttcgacaagaacaaggtcaaggtttcggtgtcgatctttggtcgcgcaaccccggtcgaactggactttggcgaagtcgacctgattagctag

SEQ ID NO: 21836 - protein, 115 aa, Unknown; identical to SEQ ID NO: 18636
  Obtained from environmental sample
  DOMAIN (61)...(98): KOW motif
  misc_feature (1)..(115): Xaa is any amino acid

SEQ ID NO: 21837 - DNA, 408 bp, Unknown
  Obtained from environmental sample
  misc_feature (1)..(408): n is a, c, g, or t
atgaattttatcccctgcaatatttccgaaggtatgacgcgcaatatgattagacaagctctcttcaataccgcattgggtagcaattctattcaaatacttattaaagagtttagtagcatttctcgtaaaagtgaaaaaatcttcatcatcatttggccgaacgtctttcaaaaaaggaaagatatatccacaattttcttaaaaggtactaagataaaattctacaatagctttccctttctcaggtatcttgagactcaaaggctatacattcttgtccataacgtaatacaatctatcctctttacaaatctgaccatcgtaactttcacaacatccgaaataccgaataccagcaaacataaccggaaatcaagcaaacattggagcgtatgccaaatttga

SEQ ID NO: 21838 - protein, 135 aa, Unknown
  Obtained from environmental sample
  misc_feature (1)..(135): Xaa is any amino acid
MNFIPCNISEGMTRNMIRQALFNTALGSNSIQILIKEFSSISRKSEKIFIIIWPNVFQKRKDISTIFLKGTKIKFYNSFPFLRYLETQRLYILVHNVIQSILFTNLTIVTFTTSEIPNTSKHNRKSSKHWSVCQI

SEQ ID NO: 21839 - DNA, 687 bp, Unknown
  Obtained from environmental sample
  misc_feature (1)..(687): n is a, c, g, or t
atgaaaaaaaatttaatcatttttggcacccgtccggaggcaataaaaatggcgcctttagtaaaagaatttttaaaacattccaagacttttgaaacgaaagtatgtataactggccagcatagagaaatgttagatcaagtattgtcttttttcgaaattacaccagattatgacttaaatttgatgaaaccaaatcagaatttatattcattaacagctgatattattacaaaccttaagcccgttcttgaaacatttaaacccgattatgtttttgtgcacggggatacgacgacgacaatggcggcaagtatagcagggttttattctggcgctaaagtttgtcatattgaagcaggtttaagaacttttaataagcgttccccttttccagaagaagttaatagaggtattgcaggagtagtgtctgactatcacttttctccaacagtcacttctcggcaaaacttattacatgacaatatcaataaagaaacaattttggtaacaggtaatacggttatagatgcccttcaatttagtgtagagaaagtaactgaagagaggtattcagattctgaaatagatccacttaaaagtatggttgatagttccaagaaatcattatcagtcactgtacaccgtaaagaaaatccacgtccacgtctacttactatctcgtga

SEQ ID NO: 21840 - protein, 228 aa, Unknown
  Obtained from environmental sample
  DOMAIN (23)...(226): UDP-N-acetylglucosamine 2-epimerase
  misc_feature (1)..(228): Xaa is any amino acid
MKKNLIIFGTRPEAIKMAPLVKEFLKHSKTFETKVCITGQHREMLDQVLSFFEITPDYDLNLMKPNQNLYSLTADIITNLKPVLETFKPDYVFVHGDTTTTMAASIAGFYSGAKVCHIEAGLRTFNKRSPFPEEVNRGIAGVVSDYHFSPTVTSRQNLLHDNINKETILVTGNTVIDALQFSVEKVTEERYSDSEIDPLKSMVDSSKKSLSVTVHRKENPRPRLLTIS

SEQ ID NO: 21841 - DNA, 807 bp, Unknown
  Obtained from environmental sample
  misc_feature (1)..(807): n is a, c, g, or t
atggaccgtttgcctgatggcattgaagagtgtaggttcatcaacttaactagcgatgaaggctataaaaattcgcatttcgaacccataatccctttgaaacgccgcagaaactgttaccggattgactcggaacagatgaatattgaaatcactcggggccgttcagaaatctatgatattcttacgcacttaaccttcctcttcatcgagtcgcataagattatgaaacaggtgcttatcaacgaaaatggcgaagtgatccgcgattggaaaaagctggaacaggctgtgcagaaaaaaggcaagcttacgcaggaagaaaaagaagtagcacttacgcacaccgcgaattttcttggaagaacctttgaggaggtaaatgacgtttatccctatttcgcaactcagaagaacgaaaacaggtttttaaacattatctattatcttggaaaactggctattgacgaaattcttgaaaacaacaaacgcatcattaccttcagccctgttcttagggagcgtttgggacaccacattcacggtgagcaatgggcataccgcataaaacagactttacaagaaaggggatttctggagcgtcctttacacattattagcgctaatatgcatagtgtaatgaacagtctatatgcgcctaaggcattgcctgctgaattttcaaagaaacaacccatggctgtttttgaagctttgagtagtccgataaatataaaatgcgtgaaagtatccaaaccgcacttgcggaaggatgatttttatatgaactctgggccgaattcttga

SEQ ID NO: 21842 - protein, 268 aa, Unknown
  Obtained from environmental sample
  misc_feature (1)..(268): Xaa is any amino acid
MDRLPDGIEECRFINLTSDEGYKNSHFEPIIPLKRRRNCYRIDSEQMNIEITRGRSEIYDILTHLTFLFIESHKIMKQVLINENGEVIRDWKKLEQAVQKKGKLTQEEKEVALTHTANFLGRTFEEVNDVYPYFATQKNENRFLNIIYYLGKLAIDEILENNKRIITFSPVLRERLGHHIHGEQWAYRIKQTLQERGFLERPLHIISANMHSVMNSLYAPKALPAEFSKKQPMAVFEALSSPINIKCVKVSKPHLRKDDFYMNSGPNS

SEQ ID NO: 21843 - DNA, 429 bp, Unknown
  Obtained from environmental sample
  misc_feature (1)..(429): n is a, c, g, or t
atgtcagccttgttactgaaagtacatacgtcaggtataaaaattttaaataacgtagctgttgaagaactaagtgatttagggaacaaagtaaaattacaaactaattgtttcgatttttcatctcataaagtgtgtatagcaaccaacggatttacttcacaccttataaaaacggatgagataaaacccgcacgagcccaagtattaataaccaaacctatcgcaaatttgccttttaaaggcacgtttcatatggataaaggatattattattttagatctatagataacagggtgttgttaggtggcggaagacatcttgattttaaaaccggaagaaaccacaaaatttgcccaaacaccactgatacaaaacacattagacgactttttaaaaaccgttattttaccaacaataccttttga

SEQ ID NO: 21844 - protein, 142 aa, Unknown
  Obtained from environmental sample
  misc_feature (1)..(142): Xaa is any amino acid
MSALLLKVHTSGIKILNNVAVEELSDLGNKVKLQTNCFDFSSHKVCIATNGFTSHLIKTDEIKPARAQVLITKPIANLPFKGTFHMDKGYYYFRSIDNRVLLGGGRHLDFKTGRNHKICPNTTDTKHIRRLFKNRYFTNNTF

SEQ ID NO: 21845 - DNA, 741 bp, Unknown
  Obtained from environmental sample
  misc_feature (1)..(741): n is a, c, g, or t
atgaaaatgatactacatacactatttattttactaatttctataccattatacgcccaaaaagaatacgaggtttcaggaataattaccgatgaaagcgggcttcctttacccggcgttaatattattgcaaaaggaacctctacaggaacacaaactaattttgatggagaatactacattcctgtaaaaaagggagcgacattagtgtattcttttgtgggatatgttactgaagaacgaaaaataagaaaaagcgctatgttaagttttgcgatgcaagttgataaagagtcgttagacgaagttgtcattaccgcgctgggtacgacacggaaaaaagatagaattaagtacagtactcaagtagtgcgtacggagcaattaactcgagttaacaatcctaatgttgttcaatctttatcgggtaaagtgtcaggattgtcaattcaaaatcaaaatacctcaaaaattatgcttcgtggaaatagatccattaaagggggtggtgttaaagctttggttgttatagatggtgtaatttcttcagatgaaaagctcaattctataaatccaaacgaaatcaataatgttaacgttattaaaggtgctaaagggagtgcgctttatggaaatcagggaaagaatggagttatagtcgttactactaaaaatggcggatttaaagagcctaataacacttttcatccagaagaattaagtaatgaggaattacactaa

SEQ ID NO: 21846 - protein, 246 aa, Unknown
  Obtained from environmental sample
  SIGNAL (1)...(19)
  misc_feature (1)..(246): Xaa is any amino acid
MKMILHTLFILLISIPLYAQKEYEVSGIITDESGLPLPGVNIIAKGTSTGTQTNFDGEYYIPVKKGATLVYSFVGYVTEERKIRKSAMLSFAMQVDKESLDEVVITALGTTRKKDRIKYSTQVVRTEQLTRVNNPNVVQSLSGKVSGLSIQNQNTSKIMLRGNRSIKGGGVKALVVIDGVISSDEKLNSINPNEINNVNVIKGAKGSALYGNQGKNGVIVVTTKNGGFKEPNNTFHPEELSNEELH

SEQ ID NO: 21847 - DNA, 636 bp, Unknown
  Obtained from environmental sample
  misc_feature (1)..(636): n is a, c, g, or t
atgagctacttgaagtggctaggtgtatttgaatcagtcaattctcaaaaaatagatatcagtgccagtatacaaaatttaaaaaatgctcatattcaggctggatcaaaattaccaagtttcgaatttagagcaaaagagtacaatgctggatttttcttaacgatagctatttttgcactaatgatatggctgagcactaaactgattatgtcatggctactaccattattcacaagccaaacatttgatccctctgatatcatttgggcagtgataccgattggtgcagcgatactctgttatttggtagccaggaatgaagataaaaataaaataccgttagtatcgatatctagtcttaagttattaccagagaaactacaaatcattcaatccaatcaagtcttagatataccatggcgatcgattaaggatattcatgaaaaacgaacacgttcacgtgctttactaaagatagtagtaagcgaagagggtagtgaggtgaagccaaactatggcgagtattcatttgatatatatcacgtaccttataaagcaacagatattgaacagcttgccattgtttactgggtaaaggcagaggtacagaggttaaagatatacaatagatga

SEQ ID NO: 21848 - protein, 211 aa, Unknown
  Obtained from environmental sample
  misc_feature (1)..(211): Xaa is any amino acid
MSYLKWLGVFESVNSQKIDISASIQNLKNAHIQAGSKLPSFEFRAKEYNAGFFLTIAIFALMIWLSTKLIMSWLLPLFTSQTFDPSDIIWAVIPIGAAILCYLVARNEDKNKIPLVSISSLKLLPEKLQIIQSNQVLDIPWRSIKDIHEKRTRSRALLKIVVSEEGSEVKPNYGEYSFDIYHVPYKATDIEQLAIVYWVKAEVQRLKIYNR

SEQ ID NO: 21849 - DNA, 354 bp, Unknown
  Obtained from environmental sample
  misc_feature (1)..(354): n is a, c, g, or t
ttgaattttgatattttaaatgaggattttcagcaatttattactgataatttaaactcagaaattacaaaactgattttaaaaggaagcccttttgcaactatttccattcaagaattagcgaatcaaatacttgccaaacaaaaatcaacaaaaaaaataccaacttggttttcttcggaaaatatttattatccagcaaaaattagtattgagcaaacctcatcagaaactacagcagaatataaatcaaaattaatttctggtgatgcaattattgatcttacaggaggttttggtgtagattgtttttatttttcaaaagagtttaaaaaggtaattcatttgaaataa

SEQ ID NO: 21850 - protein, 117 aa, Unknown
  Obtained from environmental sample
  misc_feature (1)..(117): Xaa is any amino acid
MNFDILNEDFQQFITDNLNSEITKLILKGSPFATISIQELANQILAKQKSTKKIPTWFSSENIYYPAKISIEQTSSETTAEYKSKLISGDAIIDLTGGFGVDCFYFSKEFKKVIHLK

SEQ ID NO: 21851 - DNA, 822 bp, Unknown
  Obtained from environmental sample
  misc_feature (1)..(822): n is a, c, g, or t
atgaagaaattttttaagtttttaggaattctcctagtagtattaattgttgcaggaactgttttttatttcgttaaaaatgaagatttacctcaaggaaaacaaggtgtagaagcagatgctttagcgattaaaatgttgaacgctataaatcataaagcttttgaaactacagaaattattgagtgggattttagaaaggctcatttttataaatggtacaaacacaaaagtattgtagaagtttcttgggatgaaaacaaggtgattttaaatacaaaagaacctaaaaaatctgaggtttttgtcaatgataaaaaagttaacaatcctgaacttatacaaacagcagaaagctattttaacaacgattctttttggctaattgcaccttacaaaatatttgatgctggcacacaaagaagcatcgttaattacgaaaacaaagaagctttaatgattacctatacttctggtggttcaactcctggagactcttacctttggtttttagatgataattatatgccaacatctttcaaaatgtggacgaaggttattccaattggtggagtttctgcaacttggagcaattttaaaaacacaaaatctggcataaaactacctaaaaaccatcagctttctttatttggactggaaattccaattaataatgcaaaagcttataatgaaaatgccgatgctttagcaaacaaaattttacaagcgattaaccatgaaaatcttcaaaacactaaatttttagaatggagtttcggtggaacaagagcttttaactgggatacagaaaccacattgtaa

SEQ ID NO: 21852 - protein, 273 aa, Unknown
  Obtained from environmental sample
  SIGNAL (1)...(18)
  misc_feature (1)..(273): Xaa is any amino acid
MKKFFKFLGILLVVLIVAGTVFYFVKNEDLPQGKQGVEADALAIKMLNAINHKAFETTEIIEWDFRKAHFYKWYKHKSIVEVSWDENKVILNTKEPKKSEVFVNDKKVNNPELIQTAESYFNNDSFWLIAPYKIFDAGTQRSIVNYENKEALMITYTSGGSTPGDSYLWFLDDNYMPTSFKMWTKVIPIGGVSATWSNFKNTKSGIKLPKNHQLSLFGLEIPINNAKAYNENADALANKILQAINHENLQNTKFLEWSFGGTRAFNWDTETTL

SEQ ID NO: 21853 - DNA, 411 bp, Unknown
  Obtained from environmental sample
  misc_feature (1)..(411): n is a, c, g, or t
atggatttagaaactgctaaaaacattgcgacaatagccacacctttgaccaaaattgtgcttgatacatttctaatacccaaattccaagaacttaaagaaaagtggaaaaaacaagacttaattatagaccacgctttcgaaaataagtttcaagaatatctaaacgagtcgtatgaaaaaaatgccatattaaatacagtagcctttaagaaaagaaaggtattattgaataatgtctacataccattaaaattacgttgtgaagaagttgaaaaaaatataaaaattgatgattatgacgataacttatttgagcattcaaataaaatattgataactgatacagcgggaatgggtaagtctaccttgtccaaaaaacttcttattcctgtctcgagccgatcttga

SEQ ID NO: 21854 - protein, 136 aa, Unknown
  Obtained from environmental sample
  misc_feature (1)..(136): Xaa is any amino acid
MDLETAKNIATIATPLTKIVLDTFLIPKFQELKEKWKKQDLIIDHAFENKFQEYLNESYEKNAILNTVAFKKRKVLLNNVYIPLKLRCEEVEKNIKIDDYDDNLFEHSNKILITDTAGMGKSTLSKKLLIPVSSRS

SEQ ID NO: 21855 - DNA, 324 bp, Unknown
  Obtained from environmental sample
  misc_feature (1)..(324): n is a, c, g, or t
ttgaaaataaattataagaatttagggccgggtaaaatttctgataaaaaaatgtctataaattcagaaattagaaaagccataaacaaggatggcggagacaatgtgattgtgactttatatcttgaaaatcaatcggaaataaaagatagttctgaaattttggattgttttaaagacgcacaggttttgcagatttttgaacgtttggacaaagttgaacagactgaaattctaaaagaaattaagactgttgcgacggacaagcaaaaagcagaaaaaattatcaaagcaatagaaaatcttgaaagcaaacgagcataa

SEQ ID NO: 21856 - protein, 107 aa, Unknown
  Obtained from environmental sample
  misc_feature (1)..(107): Xaa is any amino acid
MKINYKNLGPGKISDKKMSINSEIRKAINKDGGDNVIVTLYLENQSEIKDSSEILDCFKDAQVLQIFERLDKVEQTEILKEIKTVATDKQKAEKIIKAIENLESKRA

SEQ ID NO: 21857 - DNA, 486 bp, Unknown
  Obtained from environmental sample
  misc_feature (1)..(486): n is a, c, g, or t
atgcaaactgataataacgagatattatctgatgaaatccttgataaaggttttttaaatactattgaagatgctctagctattggatcctgggaattaaatatgttatcaaatactttaaaatggagtagcgtaacaaaaaaaatccatgatgttgttgccaattacgtcccaaatgttgatactgccattaacttttataaaaaaggacaacatcgtgagaaaattttagacttatttcaaaaagccttacaaaaaggagaaaattttgatgatgagtttatcattataacttcaaaaggagaagaaaaatgggtaagatccattggacatcctaaatttaaaaatggggtttgcgttgcacttagaggtgtttttcaggatattacacaaaaaacactgcaatcaaaaaacacgttaataaaagagaaagaatttagatcgctatttgactactctttaacaggaatggctaaagttagctag

SEQ ID NO: 21858 - protein, 161 aa, Unknown
  Obtained from environmental sample
  DOMAIN (91)...(132): PAC motif
  misc_feature (1)..(161): Xaa is any amino acid
MQTDNNEILSDEILDKGFLNTIEDALAIGSWELNMLSNTLKWSSVTKKIHDVVANYVPNVDTAINFYKKGQHREKILDLFQKALQKGENFDDEFIIITSKGEEKWVRSIGHPKFKNGVCVALRGVFQDITQKTLQSKNTLIKEKEFRSLFDYSLTGMAKVS

SEQ ID NO: 21859 - DNA, 795 bp, Unknown
  Obtained from environmental sample
  misc_feature (1)..(795): n is a, c, g, or t
ttgttaaaccctcatagtcgtttcctagaaggaaaaatttatacggttgttacttgtaagagcggacaggaagctctggaggaaattcagaaaatcgctgtggatattatttttttagatgaaaatatgccaggactttcggggctggaaactttgaatgaaatcaaagtaattaattcttccattcctgttgttatgattaccaaaagtgaagaggaacttattatggaagaggccattggttccaagattgcagattacttaataaagcctgttaatccaaatcaaatattgctatccttaaagaaaaacttggatcactcacgtttggtttcagaacgtacaactactaattatcagcaggagtttcggaaaattgccatggatatgtccatggtgaattcttatgaggagtggataaaattgtataaaaaattgatttattgggaattgcgtcttgaagatattgaggacaatagcatgttcgaaattctggaatcacaaaaaattgaagcgaacaatcaattcggtaaatttgtcgagaagaactatgaagattggtttagtggtcatgatgcgcccgtaatgtcgcacaatcttttcaaagaatggatcaaaccagaaatcattgatacgcccaccctattggtggtaattgataatttaaggtatgaccagtggtttgcctttgaggaaacggttaattcattttacaaaaagaccaaagaagaatcatatataagtatacttcctacagctacgcaatacgcccgttacgctattgtctcaggataa

SEQ ID NO: 21860 - protein, 264 aa, Unknown
  Obtained from environmental sample
  DOMAIN (1)...(109): Response regulator receiver domain
  misc_feature (1)..(264): Xaa is any amino acid
MLNPHSRFLEGKIYTVVTCKSGQEALEEIQKIAVDIIFLDENMPGLSGLETLNEIKVINSSIPVVMITKSEEELIMEEAIGSKIADYLIKPVNPNQILLSLKKNLDHSRLVSERTTTNYQQEFRKIAMDMSMVNSYEEWIKLYKKLIYWELRLEDIEDNSMFEILESQKIEANNQFGKFVEKNYEDWFSGHDAPVMSHNLFKEWIKPEIIDTPTLLVVIDNLRYDQWFAFEETVNSFYKKTKEESYISILPTATQYARYAIVSG

SEQ ID NO: 21861 - DNA, 540 bp, Unknown
  Obtained from environmental sample
  misc_feature (1)..(540): n is a, c, g, or t
gtggccgaacaagtattgattcgtattttaaaacgtgctaaacaactcattgctataggtgtgcctttagaatgtagtgaagctcttcttttttttatggaanacaagattgaaaaaaccaattttgatacaggaaccttagaaagattctcacaacttgatgatatagatattctcgcagctctaaagaaatggcagtatcacgatgattttgtgctttcaaaattgtgcggaatgataattcaccgaaaattgttgaccatcaaaatgaaaagtaagccaattgccattgataagcttgatgaggaatttaacgctttcaaaaaactccacggtctctctgatgaggaaaccgggtatttcgtttttaaagggaaaatagagaacagagcttataatcttgaaaaacagaatattaatattttaaaaaaagatggtaaattgaaggatgtggccaaggcttcagaccacttgaatttaaagaccctttctaaaaaggttaccaaatattatatctgttaccccaaagaatctgtttaa

SEQ ID NO: 21862 - protein, 179 aa, Unknown
  Obtained from environmental sample
  misc_feature (1)..(179): Xaa is any amino acid
MAEQVLIRILKRAKQLIAIGVPLECSEALLFFMEXKIEKTNFDTGTLERFSQLDDIDILAALKKWQYHDDFVLSKLCGMIIHRKLLTIKMKSKPIAIDKLDEEFNAFKKLHGLSDEETGYFVFKGKIENRAYNLEKQNINILKKDGKLKDVAKASDHLNLKTLSKKVTKYYICYPKESV

SEQ ID NO: 21863 - DNA, 555 bp, Unknown
  Obtained from environmental sample
  misc_feature (1)..(555): n is a, c, g, or t
atgaaagcattattttttattataatttttgtagccatagcagttgcttgttggcaatttgttaaattgttaggcttaactaaagttgagaaccaaacagctactgaaaaagaaaataatattaacggatggttaatgttgggtttaatgggtttcatttattgcctgatgatctttagtttgtatggcacaaaggatctattattacctcaattatctgcctcggctgaaggaaaacacattgatatactgttcaaattaacaatgacactaattttaatagtacaatttgttttacaatttattattttttacttcacatttaagtatagagggattaaaggtagaaaggcattgttctttgctgatagtcataaattagaattggnctggactataacgcccgcaattgtgttggcaggtttacttatttatggtctttggacctggaacgaagtgatggatgtttctgatggtgaaaaaccgttaaaatttgaattatttgcaaagcagttcaatgggaaggtccgtatgcagggtttgattacgatttag

SEQ ID NO: 21864 - protein, 184 aa, Unknown
  Obtained from environmental sample
  SIGNAL (1)...(16)
  DOMAIN (62)...(149): Cytochrome C oxidase subunit II, transmembrane domain
  misc_feature (1)..(184): Xaa is any amino acid
MKALFFIIIFVAIAVACWQFVKLLGLTKVENQTATEKENNINGWLMLGLMGFIYCLMIFSLYGTKDLLLPQLSASAEGKHIDILFKLTMTLILIVQFVLQFIIFYFTFKYRGIKGRKALFFADSHKLELXWTITPAIVLAGLLIYGLWTWNEVMDVSDGEKPLKFELFAKQFNGKVRMQGLITI

SEQ ID NO: 21865 - DNA, 441 bp, Unknown
  Obtained from environmental sample
  misc_feature (1)..(441): n is a, c, g, or t
ttgtggtatgagttagggaaattaaaatctccaatggaagtcacgggtacgattttaggtgataaaatttataccataggcggtttaaatcagaagatatcgtcaattgaatcctgggatatcaatagcggagaatgggttgtggaaggtgaattgttctatggatttaaagagcctgcactggcaagctttggaactaacatttatatatatcactatgggaaattacttatatacaatgtggttcaaaaatctctaaaagaatatacaatagcgttatatctaaataacccaaatatgcatgtgtataaggatgccctttatatcataggcggttataaagaaactgaatatactaaagatcctagctctgggatttacagtatagagctttcagaatttagtaaaactacagtcacaaatttcaaaaatcttcaataa

SEQ ID NO: 21866 - protein, 146 aa, Unknown
  Obtained from environmental sample
  misc_feature (1)..(146): Xaa is any amino acid
MWYELGKLKSPMEVTGTILGDKIYTIGGLNQKISSIESWDINSGEWVVEGELFYGFKEPALASFGTNIYIYHYGKLLIYNVVQKSLKEYTIALYLNNPNMHVYKDALYIIGGYKETEYTKDPSSGIYSIELSEFSKTTVTNFKNLQ

SEQ ID NO: 21867 - DNA, 456 bp, Unknown
  Obtained from environmental sample
  misc_feature (1)..(456): n is a, c, g, or t
ttgagtataagacatttaactgattggtatgaatttaacaaagaggaaaagctctttggcaggagaataacatttaagatgattgaaccgatattaaataagatatccaatcaatttatcattgatcagttagggagttcattcaaccaaatacctatttataaaattactattggaaaaggtaagaccaaaatattgttgtggtcacaaatgcacggtaatgaaagtacagggaccaaagcaatattcgatgtatttcaattttttactaatccgggaaaaaacctatcaataactacacgtatattaaaagaatgtacgttggtttttatccctttactgaatccggatggggctgaattatatacaaggaaaaatgcccaaggtgttgatcttaatagggatgtgttagatttgaaagcacctgaaagtaaaatcttaacggactgttattga

SEQ ID NO: 21868 - protein, 151 aa, Unknown
  Obtained from environmental sample
  DOMAIN (28)...(149): Zinc carboxypeptidase
  misc_feature (1)..(151): Xaa is any amino acid
MSIRHLTDWYEFNKEEKLFGRRITFKMIEPILNKISNQFIIDQLGSSFNQIPIYKITIGKGKTKILLWSQMHGNESTGTKAIFDVFQFFTNPGKNLSITTRILKECTLVFIPLLNPDGAELYTRKNAQGVDLNRDVLDLKAPESKILTDCY

SEQ ID NO: 21869 - DNA, 633 bp, Unknown
  Obtained from environmental sample
  misc_feature (1)..(633): n is a, c, g, or t
atgaaaacattttataaaatagcagcatcattaatttttgcgaccatgatcttaattgcatgtacagttccggtacagcatgaagaagagatcggttatatgattaaaggtattgccacttcagaatcggttagcttaaaatctaagcttgctcaatttccaagtattgatccttcacagcttagtataagcgaaataatccatgaagaaataggagcaggagaggaaacgactgaaaggttagaagaaattgtaatgatcttgccagaagccaattataaggccgccaaagataaaaaagcaactttagctggaatgtttaattttaaatcgctggaaatccttccgattgaagagacggtagaacgaactgtgttcgaatctgctcttcataccttgaatcttaagcaaagtaaagaaatccctgactcaaccgtagcgagaaggctcaatacattcttacatgaaaatagcgagacaatgcatggagatgccaaaatggtggtaaatgaagaaggagaaaggtacgtagaaattattattgaaaatctttctaatggagatggatcaatagattctttaagtatgtcaggagtcaaattgatcgagatcaaggaaacaaatagaaaatag

SEQ ID NO: 21870 - protein, 210 aa, Unknown
  Obtained from environmental sample
  misc_feature (1)..(210): Xaa is any amino acid
MKTFYKIAASLIFATMILIACTVPVQHEEEIGYMIKGIATSESVSLKSKLAQFPSIDPSQLSISEIIHEEIGAGEETTERLEEIVMILPEANYKAAKDKKATLAGMFNFKSLEILPIEETVERTVFESALHTLNLKQSKEIPDSTVARRLNTFLHENSETMHGDAKMVVNEEGERYVEIIIENLSNGDGSIDSLSMSGVKLIEIKETNRK

SEQ ID NO: 21871 - DNA, 432 bp, Unknown
  Obtained from environmental sample
  misc_feature (1)..(432): n is a, c, g, or t
ttgcttagtatgagccaaagaataccgactgtaatgtaccattccattgggattattaacagaaaatggcattggaattttttaacttgtccttatgaggtttttgaaaatcaattaaaatggttaaaaaaaggaggatacacaactttaaattttcaagaaatttatgattttattataaacgataaacccgttcctaaaaattctgtttttttaacctttgatgatggttatttagataattatgtatttgcatatccattacttaaaaaatatggtatgaaaggtactatattcgtaaatccagattttgtcgatacttctgtaaatattagacaaacaatagatgatgttcaaacgaacaaggaagtatttgaacttcaaaaagtgggtttttgcaattggaatgaagttgaagaaaatggattctga

SEQ ID NO: 21872 - protein, 143 aa, Unknown
  Obtained from environmental sample
  misc_feature (1)..(143): Xaa is any amino acid
MLSMSQRIPTVMYHSIGIINRKWHWNFLTCPYEVFENQLKWLKKGGYTTLNFQEIYDFIINDKPVPKNSVFLTFDDGYLDNYVFAYPLLKKYGMKGTIFVNPDFVDTSVNIRQTIDDVQTNKEVFELQKVGFCNWNEVEENGF

SEQ ID NO: 21873 - DNA, 339 bp, Unknown
  Obtained from environmental sample
  misc_feature (1)..(339): n is a, c, g, or t
atgatgttcaaacgaacaaggaagtatttgaacttcaaaaagtgggtttttgcaattggaatgaagttgaagaaaatggattctgaaggagtgttagatgttcagagtcatgctaaaacgcatacgtggtacccaatttcggatcaaataattgattttagacatcctggagataactatgtttggatggattggaatgaaaacctagaagaaaagtcgaacctacaatatattgattatgacaatgtaaagtttgggacagctattttcgaacacgaaaaagcattgagctccaaaaggatttatatttatccagatttccaaaaaagtttgctnngn

SEQ ID NO: 21874 - protein, 113 aa, Unknown
  Obtained from environmental sample
  misc_feature (1)..(113): Xaa is any amino acid
MMFKRTRKYLNFKKWVFAIGMKLKKMDSEGVLDVQSHAKTHTWYPISDQIIDFRHPGDNYVWMDWNENLEEKSNLQYIDYDNVKFGTAIFEHEKALSSKRIYIYPDFQKSLLX

SEQ ID NO: 21875 - DNA, 537 bp, Unknown
  Obtained from environmental sample
  misc_feature (1)..(537): n is a, c, g, or t
gtgctacatgaactctttacacattcacgtgatgcagttttgagtaaaagagctattactcaagtcattgagtcacaagatattcatgccaaaactggaatcatctattcatattggtgttctggaattacttttggtgctacattaaatgatccaaatattccagtagtttctcgaattcatagaggagatttgtatgaagaactctatccaaaaaactatattccttttcgagaatttatattttctagaataaatactcttttttcgatttcagaaaacggagttaactatctgttagaaaaatatccctcttataagaataaattcaagctttcacgacttggtattccaatttcaaagtgtccagacactttgaatgaaaataaagaaacctcttttgttatagtatcatgttcaaacatttacaatattaaaagagtagatagtatagccagatcactgaaaatttttgcaaaatcaacatccaacattaaacttaatttggcaccacttcggttcaggaaaaatgcttga

SEQ ID NO: 21876 - protein, 178 aa, Unknown
  Obtained from environmental sample
  misc_feature (1)..(178): Xaa is any amino acid
MLHELFTHSRDAVLSKRAITQVIESQDIHAKTGIIYSYWCSGITFGATLNDPNIPVVSRIHRGDLYEELYPKNYIPFREFIFSRINTLFSISENGVNYLLEKYPSYKNKFKLSRLGIPISKCPDTLNENKETSFVIVSCSNIYNIKRVDSIARSLKIFAKSTSNIKLNLAPLRFRKNA

SEQ ID NO: 21877 - DNA, 387 bp, Unknown
  Obtained from environmental sample
  misc_feature (1)..(387): n is a, c, g, or t
atgaagatagataaaatacagttggacgaaagtatgtggaagggggcaacccctcaaattttttcaaatgcaaaacaattgagagaaaatatgactaatgctgaatctattttatgggaaaagttaaaaaataatagatttcacgggctcaagtttcgttgtcaacatccaattcacaaatatatagccgatttttattgtcataaattaaaactaataatcgagattgatggcggataccatttaaccaaaaaccaagatgaatatgataatgaaagaacagaaaatttagagttcaatgagataaaagttattcgatttacaaatgaagaagttgaaaataatttggaaaatgttttgtttaaacgggaagaattattggattaa

SEQ ID NO: 21878 - protein, 128 aa, Unknown
  Obtained from environmental sample
  DOMAIN (18)...(128): Protein of unknown function (DUF559)
  misc_feature (1)..(128): Xaa is any amino acid
MKIDKIQLDESMWKGATPQIFSNAKQLRENMTNAESILWEKLKNNRFHGLKFRCQHPIHKYIADFYCHKLKLIIEIDGGYHLTKNQDEYDNERTENLEFNEIKVIRFTNEEVENNLENVLFKREELLD

SEQ ID NO: 21879 - DNA, 540 bp, Unknown
  Obtained from environmental sample
  misc_feature (1)..(540): n is a, c, g, or t
atggttgatcacttaaaaatagcaattcgagcctctattgacgcagggaaagagatcatgaaagtttacgccggcgattttgatgtggaattgaaaagtgatgcttcgcctttgactttggcagataaaaatgcaaatgaggttatcaatagctatttagttaaaacgggtatcccgatcattagtgaagaaaatgcccggatagattacgaaataaggaaaaaatggaatacctgttggatcgtagatcccttagatggaacaaaagaatttatcaaacggaatggcgaatttaccgtaaatatagcgctgattgaaaatagtaaacctgtattaggagtcatttatgtgcctgttgagaaaaaattatattatgcagatgttttaaaaaaggaagcctatttattaagtttgccttctaaagagatatcatttgatgagatgatgaagacttctacaaaaattaatgatcatgtattacaaaatgacatcattagaatagttggcagccgttctcatattgatccagaaactatttga

SEQ ID NO: 21880 - protein, 179 aa, Unknown
  Obtained from environmental sample
  DOMAIN (1)...(175): Inositol monophosphatase family
  misc_feature (1)..(179): Xaa is any amino acid
MVDHLKIAIRASIDAGKEIMKVYAGDFDVELKSDASPLTLADKNANEVINSYLVKTGIPIISEENARIDYEIRKKWNTCWIVDPLDGTKEFIKRNGEFTVNIALIENSKPVLGVIYVPVEKKLYYADVLKKEAYLLSLPSKEISFDEMMKTSTKINDHVLQNDIIRIVGSRSHIDPETI

SEQ ID NO: 21881 - DNA, 753 bp, Unknown
  Obtained from environmental sample
  misc_feature (1)..(753): n is a, c, g, or t
atgagatcgataattatagacggcgataatagagctagacggtattttaaaaccttgatagaagaagagtgtccaaagattctaaccatttttgatgcagaaaatttattggaaggtgtagccataatgaaatcagaacaaccagactttgtgtttctagatatagaaatgcctaaccattctggacttcaaattttagaattctttaaaaatgatacgattaattttcaaattattttcacgaccgcttatggacattatgcgattgatgcatttaaattatcagctgtagattatttactaaaaccaattgatattgacgaattaaaaacagctataaataaagcgtctgatagtttagaagaaaactttataaaagaaaaattacttaatttagaacgtaattttcaacaactagcattaaacaaaatagctttagaagttcctaaaggaatacgatttgtttcgcatgaagatatcttgttttttgaagcagatggtgtatataccaaggtttttttgcaaaatggtaaaacagaattaatttgtaaaacgctaaaacattttacagagcaattaagtaataaaccgttgttttataaaccgcatagatcgtatttaattaatcttaaatacatgacggaaattactaaaaaagatggtcttcaagttataatgagtaataataaaagcattccaattgcacgagaccgtaaagatcaatttatggatattattaatcgtgtattttaa

SEQ ID NO: 21882 - protein, 250 aa, Unknown
  Obtained from environmental sample
  DOMAIN (1)...(121): Response regulator receiver domain
  misc_feature (1)..(250): Xaa is any amino acid
MRSIIIDGDNRARRYFKTLIEEECPKILTIFDAENLLEGVAIMKSEQPDFVFLDIEMPNHSGLQILEFFKNDTINFQIIFTTAYGHYAIDAFKLSAVDYLLKPIDIDELKTAINKASDSLEENFIKEKLLNLERNFQQLALNKIALEVPKGIRFVSHEDILFFEADGVYTKVFLQNGKTELICKTLKHFTEQLSNKPLFYKPHRSYLINLKYMTEITKKDGLQVIMSNNKSIPIARDRKDQFMDIINRVF

SEQ ID NO: 21883 - DNA, 825 bp, Unknown
  Obtained from environmental sample
  misc_feature (1)..(825): n is a, c, g, or t
gtggatcacagaatcggctcgagagaagtatataacatttgctataaccctttagcaaaggacgtattaatggttgcgactacggattcaaaaatttataatctagacaccaagcaaagtcaaagtagtaacctgatagtaacaaaatcaattgatgtgttggatcataatcaatatttaattagtcttccacattcactttctatttataataaaaataaagactctatttataatcttagaacattaagaagctatgggtctgtattaaataaagcaaaaaacaaagcgtattgtagttttgtagatggcttaggttgggtagatttaaagactaaaaagtataaaaaaataacccataataacagtcctgtttatgccttaaaaatcgcgataagccatgacgatacggtatgggttgctgcagatggaaaaggattattaggttttaaaaatgatagtttaattacgacaataaatataaaaaacggactagcatcaaacttaattaatgtactagtagcagataaaaatgtaatttggatagctacagataaaggtttacaaagctataattataaaacaaaaacattaaatactattaataaacaagatggtatagactcgtacaatattaacgctattgaagtcgtaggagatcaagtcttttttagttcaaatacaggtttgtataaatttaatagtaataaaataaatactgttagaagtacttctcaaccttattttactaatgtatccatacaagacaaagataccataattaagacgtcatataccttaaagcaaacagaaaagcgaaattag

SEQ ID NO: 21884 - protein, 274 aa, Unknown
  Obtained from environmental sample
  misc_feature (1)..(274): Xaa is any amino acid
MDHRIGSREVYNICYNPLAKDVLMVATTDSKIYNLDTKQSQSSNLIVTKSIDVLDHNQYLISLPHSLSIYNKNKDSIYNLRTLRSYGSVLNKAKNKAYCSFVDGLGWVDLKTKKYKKITHNNSPVYALKIAISHDDTVWVAADGKGLLGFKNDSLITTINIKNGLASNLINVLVADKNVIWIATDKGLQSYNYKTKTLNTINKQDGIDSYNINAIEVVGDQVFFSSNTGLYKFNSNKINTVRSTSQPYFTNVSIQDKDTIIKTSYTLKQTEKRN

SEQ ID NO: 21885 - DNA, 474 bp, Unknown
  Obtained from environmental sample
  misc_feature (1)..(474): n is a, c, g, or t
atgatatttaaaccgattaaaattggcgattttattgaagctcaaggagaaagtggaactgtaaaagaaattgaaatttttactacaaaattaaatacaccagataataaagaagtgattatacctaatggagcactttctaacggaaatattgtaaattatagtacagaagcaactcgtagagtggattttacttttggtgttggttacgattctgatattaaaaaaacaaaggaaattatttttggtatcttaaacaaccatcctttaattttaaaagagcctgcaacagccgtaaatttatctgaattgggtgatagttctatcaacttttttacacgtgcttgggtaaaaaaagaagattattgggctgtaaagtttgatgttatggaacaaacaaaagatgcttttgatgctgctggtattgatataccttatccacataatgtaaacattataaaaaaggaaagttaa

SEQ ID NO: 21886 - protein, 157 aa, Unknown
  Obtained from environmental sample
  DOMAIN (1)...(145): Mechanosensitive ion channel
  misc_feature (1)..(157): Xaa is any amino acid
MIFKPIKIGDFIEAQGESGTVKEIEIFTTKLNTPDNKEVIIPNGALSNGNIVNYSTEATRRVDFTFGVGYDSDIKKTKEIIFGILNNHPLILKEPATAVNLSELGDSSINFFTRAWVKKEDYWAVKFDVMEQTKDAFDAAGIDIPYPHNVNIIKKES

SEQ ID NO: 21887 - DNA, 450 bp, Unknown
  Obtained from environmental sample
  misc_feature (1)..(450): n is a, c, g, or t
atggaaacttattgtggtagagatcatgatatcttgagaccttatattgttgaaaaatctaattttaaatatttaagtaattgtttaagagcgcacttagaacggtttccttgtcagaaaagcggtcttagtgtcatcgaagccaatattttaacaatagtaaaagataatttcattaagtctaaaaaccaccttttgggttatagtcttaattatcaaggttattatgggtttggtgacctacaagttgcacgaattatagataaattagatctcttttttacagaagatgacagcggaattacactcaatagaaaaggtcatgaagccttattaaaacagcataattttgttaaagacataaataacgacatggtttatggtggagttaaacgtttagagtttcaattcaacataagacagaataaacttataaaaaccataatttaa

SEQ ID NO: 21888 - protein, 149 aa, Unknown
  Obtained from environmental sample
  misc_feature (1)..(149): Xaa is any amino acid
METYCGRDHDILRPYIVEKSNFKYLSNCLRAHLERFPCQKSGLSVIEANILTIVKDNFIKSKNHLLGYSLNYQGYYGFGDLQVARIIDKLDLFFTEDDSGITLNRKGHEALLKQHNFVKDINNDMVYGGVKRLEFQFNIRQNKLIKTII

SEQ ID NO: 21889 - DNA, 657 bp, Unknown
  Obtained from environmental sample
  misc_feature (1)..(657): n is a, c, g, or t
atggaagaaaagtattataactctagagacatgcatttaaaggctagtggtaagatttctgtattcaaaagatttcggaatgttattaagaatggaatgtttctttttggcttgaaaaatcgtttggctcgaattggaattgaaattatgccttattattgggttcaagaagaagtcgaagattgtgtggaacctcaaattaaaggagctgattcagaattcacattaagagaacttaatttcgacgaagtgaaatttatcagcaaagaaattgataatttgcaaatagaccttttagaaaaagaatatcaagaatgtccattgtgtctgggtttggaacatgaaaatgaaatagccgcatatatgttcattggatttaatgatgtgacctttaaggataaattgtttccgataaaaaataatgaagcctatcttacaagcatgtggacattccatgcctttagagggagaaatcttgccccatatttgagatataagagttatcaatttttaaaagaaaatggaagggataccaaatatagtataagtgagtattttaataaatccactataaaatttaaaagtaaactgaattcaaagcatttgcgactttatattatttcgattgtttctcgagccgattctgtgatccactag

SEQ ID NO: 21890 - protein, 218 aa, Unknown
  Obtained from environmental sample
  misc_feature (1)..(218): Xaa is any amino acid
MEEKYYNSRDMHLKASGKISVFKRFRNVIKNGMFLFGLKNRLARIGIEIMPYYWVQEEVEDCVEPQIKGADSEFTLRELNFDEVKFISKEIDNLQIDLLEKEYQECPLCLGLEHENEIAAYMFIGFNDVTFKDKLFPIKNNEAYLTSMWTFHAFRGRNLAPYLRYKSYQFLKENGRDTKYSISEYFNKSTIKFKSKLNSKHLRLYIISIVSRADSVIH

SEQ ID NO: 21891 - DNA, 585 bp, Unknown
  Obtained from environmental sample
  misc_feature (1)..(585): n is a, c, g, or t
ttgtgtgccatattattgcatgatattggacacggccctttttcgcatgctatggagcacagcattgtggaaggagttaatcatgaacatatatccttattgttcatggaggccctcaacaaaaaatataaaggaaaattaagtaccgccattgacatttttaaggggcaatatccaaggaaatttttaaaccaattggtctctagtcaactcgatatggacaggatggattatttaaaaagggatagtttctacactggcgttgccgaaggtaatataaattccgaaaggctccttaccatgttgaatgttctaaatggagagttggtgatagaggagaaggggatatattcggtcgaaaaattcctgatggcgagacgctttatgtattggcaggtttatttgcacaaaaccggattggtagctgaacagcttttgataaaaatattgcaaagggccaaagaattgttggccaagggtgaaaatgttcaatttaacggtgccctcaagttctttatggaaaataaaattcctaaagaagatttttcccaagataagctggaattgtttgcccaatttggatga

SEQ ID NO: 21892 - protein, 194 aa, Unknown
  Obtained from environmental sample
  misc_feature (1)..(194): Xaa is any amino acid
MCAILLHDIGHGPFSHAMEHSIVEGVNHEHISLLFMEALNKKYKGKLSTAIDIFKGQYPRKFLNQLVSSQLDMDRMDYLKRDSFYTGVAEGNINSERLLTMLNVLNGELVIEEKGIYSVEKFLMARRFMYWQVYLHKTGLVAEQLLIKILQRAKELLAKGENVQFNGALKFFMENKIPKEDFSQDKLELFAQFG

SEQ ID NO: 21893 - DNA, 462 bp, Unknown
  Obtained from environmental sample
  misc_feature (1)..(462): n is a, c, g, or t
atgattaaaaagattctattacttaaccttttattattctcgacaattggaatttcgcaagaaatcacaaaaaaaactgaaatttacaaacacgtttcaggagaatacattaacgctataaggactattgaaaacggagaggaaaaagatttaaaaattcattttttgggtagaaatcataaatatcagcatatagatgatttattaagtttttcatattcaagtccttcagaattctatgaatttttaaacaaattgattgaatgtttcaagtacgataaagacacatcattaaaagtgaatggactaaatgtaacagtcgataaaatgatgggaaaaaaaataattactttatgggacaaagatatgctaggttataggttgtttaatgaaaaaaaactgattaaaatactcaaaaagtatgaaaagtggtgtacagaaaataatgtgacttatcaataa

SEQ ID NO: 21894 - protein, 153 aa, Unknown
  Obtained from environmental sample
  misc_feature (1)..(153): Xaa is any amino acid
MIKKILLLNLLLFSTIGISQEITKKTEIYKHVSGEYINAIRTIENGEEKDLKIHFLGRNHKYQHIDDLLSFSYSSPSEFYEFLNKLIECFKYDKDTSLKVNGLNVTVDKMMGKKIITLWDKDMLGYRLFNEKKLIKILKKYEKWCTENNVTYQ

SEQ ID NO: 21895 - DNA, 537 bp, Unknown
  Obtained from environmental sample
  misc_feature (1)..(537): n is a, c, g, or t
ttgagtttaaaaaatcgcactatgaataaaaaccttttaattttagttttctttttcttccaggtatctttttcacaagaaaatacaatcataattgattatacgcaccatattcatatgaaagaattgccctcagccacaattgttgatgctagattaactattaacgatactgtatcaaattacgaaatggactttgtaggaaatttaaactttgaggaagaaaaagcaggtaaagaaggtggctctgtttatgcgataaaggcaaaaaaaaatcctcatatttttaaaaattttatagaaaaaaaaataagcagcattgaaagagtgtcaatgaaaccattttatgtaaaagacactatgaacatttttgattggaaaattgatacttcaaaaagagaaatattaggctacaagtgtcagaaagctaaaacccattttagaggaagagaatatattgcatatttcactttagaaataccatatccaacaggaccatggaaattttatggattacctggagtattttatctgtag

SEQ ID NO: 21896 - protein, 178 aa, Unknown
  Obtained from environmental sample
  misc_feature (1)..(178): Xaa is any amino acid
MSLKNRTMNKNLLILVFFFFQVSFSQENTIIIDYTHHIHMKELPSATIVDARLTINDTVSNYEMDFVGNLNFEEEKAGKEGGSVYAIKAKKNPHIFKNFIEKKISSIERVSMKPFYVKDTMNIFDWKIDTSKREILGYKCQKAKTHFRGREYIAYFTLEIPYPTGPWKFYGLPGVFYL

SEQ ID NO: 21897 - DNA, 459 bp, Unknown
  Obtained from environmental sample
  misc_feature (1)..(459): n is a, c, g, or t
ttgaaaaacggtgatatgatgctcattgaagatcatattaatttacaaggtggatcgcccttggcatttaaaggtgttagcgaatttggcgagcgttttgcagacatgtccgaaccttacgatttagatatgcgaaacaagctaatggctatagctaaagagcataatatttcattaaaaagtggcgtatacgcctctgtagttggacctcagttagaaactaaggcagaatatagaatgattaaattaattggtgcagatgctgttggcatgagtactgtgccagaggttattgttgccaatcatttatcgttacctattatagctgtttctgttttaaccgatgaatgtgacccagacaatcttaaacctgttgatataagtgagattatctcaattgcagaaaaaaccgaacctaaaatggtgaagttatttcaagaattaatcaaacaattgtaa

SEQ ID NO: 21898 - protein, 152 aa, Unknown
  Obtained from environmental sample
  DOMAIN (1)...(151): Phosphorylase family 2
  misc_feature (1)..(152): Xaa is any amino acid
MKNGDMMLIEDHINLQGGSPLAFKGVSEFGERFADMSEPYDLDMRNKLMAIAKEHNISLKSGVYASVVGPQLETKAEYRMIKLIGADAVGMSTVPEVIVANHLSLPIIAVSVLTDECDPDNLKPVDISEIISIAEKTEPKMVKLFQELIKQL

SEQ ID NO: 21899 - DNA, 870 bp, Unknown
  Obtained from environmental sample
  misc_feature (1)..(870): n is a, c, g, or t
gtggatcaagaatcggtcgagacgtatagtgtacatttaattgcaggcaaaatatatgtaattccgaatgtgaaattagataccgttgccattgtagattctttacagcaacaagcaaaggaaattaaaaaaatagagagtgcttcttatgatatttttggaaagaagcataaaacggttatatctaaaagtgaacgtttaaaagataatatttactatttggttagcggtcatggtggtcctgatcctggtgcaatgggtgtttacgcaggtaagacaattgctgaagatgaatatgcgtatgatattacgctgcgattggccaaagaattaatagctcacggggcaaaggtttatattattatccaagatgaaaatgacggaattagagatgattttgttctagaaatagaccatgatgaggtcgcttatccagataaaataattcctttaaaccaagtagcacgcctaaaacagcgtgtagaaattgtaaataacctgtataaatctaataagggaaagtatcaacgactaattgttacccatgtagatagtagaagtgaaggtcaaaacattgatgtcttcttttaccatcatgagcatagtaagaacggtaaaaagctagcggagagtattcataaaaccttcgaagcaaagtataagaaatatcagccaaatagaagttatgcaggtacttttgaagatagaacatctctttatttagtaaagaaaacgcaccccgcaatgggttttattggaatcggaaatattagaaatgccaacgatccagtaagaattgtagacccagataaccgtcaagcgcttgctaagtggatccatgaaggtgtttactggattttgcagacagtg

SEQ ID NO: 21900 - protein, 290 aa, Unknown
  Obtained from environmental sample
  misc_feature (1)..(290): Xaa is any amino acid
MDQESVETYSVHLIAGKIYVIPNVKLDTVAIVDSLQQQAKEIKKIESASYDIFGKKHKTVISKSERLKDNIYYLVSGHGGPDPGAMGVYAGKTIAEDEYAYDITLRLAKELIAHGAKVYIIIQDENDGIRDDFVLEIDHDEVAYPDKIIPLNQVARLKQRVEIVNNLYKSNKGKYQRLIVTHVDSRSEGQNIDVFFYHHEHSKNGKKLAESIHKTFEAKYKKYQPNRSYAGTFEDRTSLYLVKKTHPAMGFIGIGNIRNANDPVRIVDPDNRQALAKWIHEGVYWILQTV

SEQ ID NO: 21901 - DNA, 738 bp, Unknown
  Obtained from environmental sample
  misc_feature (1)..(738): n is a, c, g, or t
atgtccttaaagtataccaagtgtaaaaattgcgatagcgattttaaatcaggattccaattttgtccacattgtggaatgaaagataaagaggaattaacacttggaattttattttacaataccttaaataattatctgctgtgggattttaaatttttaaagagttttattcctttaatgagtaaaccaggatttttgcctaaaagatttattgaaggtaaacgtctatcttatttgcatcctgcacaattatatttatttgttacgtttgtgtttttctttttgttttcctttcaaatgaataaagtagaagaaaatttaaatgaagattttaaagcgaaatcaactaaagttttaaatgaaattgaaagaaaagaaatggactctattgaaagaagtgaaattagagccacattaaatagtaataagttgctatccggaatgacagataaacagatagactctattgtaaatcaaaaagaaattaaatcaagtaataacgttttatttgggtacaagggtcaaaaaatagactcattattgactgttggagcatcaaaggaatctatttacatggctatgggaatggatgataatccaggatggtttgataggatgttatatcctagacttttaacgtttcatcaggatagaaaagctggtacgatttggatgtccatgataaattacacaccaatagcattatttattctattaccaattttggcttcnnca

SEQ ID NO: 21902 - protein, 246 aa, Unknown
  Obtained from environmental sample
  misc_feature (1)..(246): Xaa is any amino acid
MSLKYTKCKNCDSDFKSGFQFCPHCGMKDKEELTLGILFYNTLNNYLLWDFKFLKSFIPLMSKPGFLPKRFIEGKRLSYLHPAQLYLFVTFVFFFLFSFQMNKVEENLNEDFKAKSTKVLNEIERKEMDSIERSEIRATLNSNKLLSGMTDKQIDSIVNQKEIKSSNNVLFGYKGQKIDSLLTVGASKESIYMAMGMDDNPGWFDRMLYPRLLTFHQDRKAGTIWMSMINYTPIALFILLPILASX

SEQ ID NO: 21903 - DNA, 777 bp, Unknown
  Obtained from environmental sample
  misc_feature (1)..(777): n is a, c, g, or t
atgaacaaatacattgttgtcaatcaaccagaaaaatggcatttttcgattgagaatattacggtaatttcatcgcaagattatcttaccaatcctaaattttcgcttttaaaaaaagcaagaatatttaatctttgcaaagattatagttaccaatccaaaggttactacgtctcgcttttagccgaagctagaggtcatttagccattccaacagtaagaaacattgtagatttaaaaacacttaaactagtcaaaatagtttccgacgagtttgacgatgttatacaacaaagcctaaaaagcattaagtctagagagtttactttaagtatatactttggtcaaaatgtggcacaaaaatataaagagctaagcagtttgttttacaaacattttcaagttccttttttacgcgtaaattttcatcataataataagtggaatatacaaagtattaaagctatttcagaatcagaaatccctagtgatcatcttgaaagtgtcaacctttttgctaatcagtattttgctaaaaaacgttacgacacacctaaactaacaacatcagattttgacttagctattttggtcaatccaaacgatcctgctcctcctagcaatacaaaagctttaaaaaagtttatagacattgctgaaaagatgaatatttatgctgaaattatagagcntaaagatttaagtcgtttgtcctcttttgacgctttatttataagacaaagtacagagctactcgagccgattcttgatcactag

SEQ ID NO: 21904 - protein, 258 aa, Unknown
  Obtained from environmental sample
  misc_feature (1)..(258): Xaa is any amino acid
MNKYIVVNQPEKWHFSIENITVISSQDYLTNPKFSLLKKARIFNLCKDYSYQSKGYYVSLLAEARGHLAIPTVRNIVDLKTLKLVKIVSDEFDDVIQQSLKSIKSREFTLSIYFGQNVAQKYKELSSLFYKHFQVPFLRVNFHHNNKWNIQSIKAISESEIPSDHLESVNLFANQYFAKKRYDTPKLTTSDFDLAILVNPNDPAPPSNTKALKKFIDIAEKMNIYAEIIEXKDLSRLSSFDALFIRQSTELLEPILDH

SEQ ID NO: 21905 - DNA, 351 bp, Unknown
  Obtained from environmental sample
  misc_feature (1)..(351): n is a, c, g, or t
gtgaaaccaaaaaatattcacttctttaaaaatatggaacccactgattttttaaagttgttagctaatagtaaatgtttaattggaaattcaagtgtaggtattagagaatgttcttatttagctgtgccagtagttaacattggcacacgtcaaaacagaagagaaagaggtaataatgtaatagacgttcctcacgataaacacaaaataaaagcagcaatacaagagcgtatttctaacacagctattacttcagaatctatttatggggcgggagattcagggataaaaatagcggaaatattagctaatgttactttacagtttcataaaacaataacctattaa

SEQ ID NO: 21906 - protein, 116 aa, Unknown
  Obtained from environmental sample
  misc_feature (1)..(116): Xaa is any amino acid
MKPKNIHFFKNMEPTDFLKLLANSKCLIGNSSVGIRECSYLAVPVVNIGTRQNRRERGNNVIDVPHDKHKIKAAIQERISNTAITSESIYGAGDSGIKIAEILANVTLQFHKTITY

SEQ ID NO: 21907 - DNA, 546 bp, Unknown
  Obtained from environmental sample
  misc_feature (1)..(546): n is a, c, g, or t
atgccatttataacaaataaaacgactcaagaacacgtagatattcactataaagattatggaaaagggcaacctgttattttaattcacgggtggcccttaagtcatcaagcttgggaaggacaaattagtgctattgtcgaggctggttaccgttgcattgcttacgatcgccggggtttcggaatctcatctgcgccttgggacaaatataattattccactttagcatcagatttaaacacacttataaccgacctcaaacttgaaaaagcggtattggtaggtttctctatgggtggcggtgaagtgattcgctatttaacagatttcggaacagataagattgataaaattgccctaatagcttccattatacctttagtaaagaaaacaaatgataatcctgatggtgttccagaagacggattaaacggtattatgaaggccttgttaacggaccgcggtggtttcttaaaagatttccacaagaatttttatactttcgatgatcataaaggcgaacgtaataatgaagcgccatag

SEQ ID NO: 21908 - protein, 181 aa, Unknown
  Obtained from environmental sample
  misc_feature (1)..(181): Xaa is any amino acid
MPFITNKTTQEHVDIHYKDYGKGQPVILIHGWPLSHQAWEGQISAIVEAGYRCIAYDRRGFGISSAPWDKYNYSTLASDLNTLITDLKLEKAVLVGFSMGGGEVIRYLTDFGTDKIDKIALIASIIPLVKKTNDNPDGVPEDGLNGIMKALLTDRGGFLKDFHKNFYTFDDHKGERNNEAP

SEQ ID NO: 21909 - DNA, 753 bp, Unknown
  Obtained from environmental sample
  misc_feature (1)..(753): n is a, c, g, or t
ttggtttgtccgctaatgctaattaatataggactgtatgtttttctacataaaaccgaaggcccgaaaaatgncgacagcagataccaagtaaactttgcaactactaaaggaaatttcagattggataatatcaaacgtggtgcatccatcattggttctgccggaagtggtaaaaccgaaagcgtggtttatggatttctaaagcattttgaaaaagaaggtttctgcggaattattcacgattataaagattttgaattgaccgaaatggcatatccgcttttcaaggatagcgacatcccttttaaggtcatttccttcgataaaatcattcataaggtaaatcctattgcgccacggtatttagagaatgaggaaagcgtaaacgaggtgtcaagggtgttgattgagaatctattagagcaaagagaaagcggaacaactggcacgacaaaattcttcaacgatgctgcagaagggttgattggtggtttgatttggaaactgaaaacggactatcccaagttttgtacgttgccacatttaattgcggtttatcaatttctcgatactaaaagtttgattcagtttctggaaaccaacaccacatcacgagcaatggcagatgcctttataagtggcaaggattctgaaaggcagaccgctggtgtaaaaagcacattggcaaatgcgctgaaaagaattagtacacaacggatttttatggattgtcctcgaccgattctgtga

SEQ ID NO: 21910 - protein, 250 aa, Unknown
  Obtained from environmental sample
  misc_feature (1)..(250): Xaa is any amino acid
MVCPLMLINIGLYVFLHKTEGPKNXDSRYQVNFATTKGNFRLDNIKRGASIIGSAGSGKTESVVYGFLKHFEKEGFCGIIHDYKDFELTEMAYPLFKDSDIPFKVISFDKIIHKVNPIAPRYLENEESVNEVSRVLIENLLEQRESGTTGTTKFFNDAAEGLIGGLIWKLKTDYPKFCTLPHLIAVYQFLDTKSLIQFLETNTTSRAMADAFISGKDSERQTAGVKSTLANALKRISTQRIFMDCPRPIL

SEQ ID NO: 21911 - DNA, 834 bp, Unknown
  Obtained from environmental sample
  misc_feature (1)..(834): n is a, c, g, or t
ttgtctcataaaatattaattgaattggccgctttacgtcgtgaagacaaagacattacatatttgagacccgattctaagagtcaagtgactattgaatatagcgatgacaacgtcccacagcgtattgaagctattgtgatttctacacagcatgacgactttgtaaaaccagcgtcaaaagctagagaagatgtttctaaagcagatgaagagatgctttctaaaattagaaaagatcttgttgagatattaattcctagagtaattgcgaaattacctaaagatttaaagactttatttaacgactctattaaataccatattaaccctacaggaaaatttgttattggtggacctcacggtgataccggattaacaggccgtaaaattattgtagatacttacggtggaaaaggcgcacacggtggaggtgctttttcgggaaaagatcctagtaaagtagatagaagtgccgcttatgcgacacgacatattgcaaaaaacttggtggctgctggtgtttgcgacgaagtattagtacaagtatcttacgctattggtgtngtagaacctatggggatctttatagatacttatggcacgtgcccgtttaatatgacggatggcgagattgccaaaaatgtcagtgaaattttcgatatgcgcccgtcggcaatagaaaaacgtttaacatttagaatcctatttacagtgaaactgcgggttacggacttttgggacgaaaacatgaagtggtttccacaaccgttggaggacattcctggtacaggacattcatttcgaagtgaattatttcttgggaacaactaa

SEQ ID NO: 21912 - protein, 277 aa, Unknown
  Obtained from environmental sample
  DOMAIN (1)...(115): S-adenosylmethionine synthetase, central domain
  misc_feature (1)..(277): Xaa is any amino acid
MSHKILIELAALRREDKDITYLRPDSKSQVTIEYSDDNVPQRIEAIVISTQHDDFVKPASKAREDVSKADEEMLSKIRKDLVEILIPRVIAKLPKDLKTLFNDSIKYHINPTGKFVIGGPHGDTGLTGRKIIVDTYGGKGAHGGGAFSGKDPSKVDRSAAYATRHIAKNLVAAGVCDEVLVQVSYAIGVVEPMGIFIDTYGTCPFNMTDGEIAKNVSEIFDMRPSAIEKRLTFRILFTVKLRVTDFWDENMKWFPQPLEDIPGTGHSFRSELFLGNN

SEQ ID NO: 21913 - DNA, 438 bp, Unknown
  Obtained from environmental sample
  misc_feature (1)..(438): n is a, c, g, or t
gtggattatgcccacacccctgatgcattaaaagatgtattagaaaccataaacagtatccgtacaaaaaacgaagaacttattaccgttgttgnttntgntggtgatcgcgatgttacaaaaagacctaaaatggggcatatcgcttcggtattaagtacgaaagtagtgtttactagtgacaatccaagaagtgaggtgccagaggctattataaaagatatagagaaaggcgttgctccacaaaattttaagaaaacactgtctattaccgatagagcacaagctattaaaacagcttgccaattggcaaattcaggagatattatccttatcgcaggaaaaggacacgaaacgtatcaagacattaatggcgtgcgtttcgattttgacgattataaaacagtagaaaaaatattaaagcaattacagaaataa

SEQ ID NO: 21914 - protein, 145 aa, Unknown
  Obtained from environmental sample
  DOMAIN (1)...(74): Mur ligase family, glutamate ligase domain
  misc_feature (1)..(145): Xaa is any amino acid
MDYAHTPDALKDVLETINSIRTKNEELITVVXXXGDRDVTKRPKMGHIASVLSTKVVFTSDNPRSEVPEAIIKDIEKGVAPQNFKKTLSITDRAQAIKTACQLANSGDIILIAGKGHETYQDINGVRFDFDDYKTVEKILKQLQK

SEQ ID NO: 21915 - DNA, 816 bp, Unknown
  Obtained from environmental sample
  misc_feature (1)..(816): n is a, c, g, or t
ttgtttggacgcgatttgaccaatggagatttggtaaaaaaacttaaaggcttaatagatacaaaagttaaccttgaagttatacgtcgcggtagcgataaacctttagcgtttacggttattcgtggaaatattcctataaaaagtgttgatgcggcttatatgcttagcgataatttagggtatattaaaattaataggtttgctgagtctacatacaaagaatttaaaaaagaattaaataagttacaggcgcttggagctacagaattggctttagatttacgtgaaaatccaggaggatttttaggaattgctgaaaaaattatagatgaatttttagaagatgaaaagctaattttatttactaaaaataaaagtggccagattgaaagaaattacgccacagcacgaggttcgtttgaaaaagggaaggtttatgtgctaatcgatgaaaattcggcttcggcaagtgagattgtagcgggtgctttacaagataacgataagggggttattgtggggcgtcgctcgtacggaaaaggattggtgcaacgcgaaatgcaattgggtgatggtagtgcggtacgtttaacagtgtcgcgttattatacgccaacggggcgtactaattcaagcgttcttacgacgaaggggaatagtgattatcttgatgattattacccgcgaatagaacgtggagacttgtttgatgcttctaaaattgaggttgccgattcgttaaaattacaaccgcccaaaggaaaggtgcttaccgcggtggtggcattatccagaattttttgtggctattaa

SEQ ID NO: 21916 - protein, 271 aa, Unknown
  Obtained from environmental sample
  DOMAIN (59)...(214): Peptidase family S41
  misc_feature (1)..(271): Xaa is any amino acid
MFGRDLTNGDLVKKLKGLIDTKVNLEVIRRGSDKPLAFTVIRGNIPIKSVDAAYMLSDNLGYIKINRFAESTYKEFKKELNKLQALGATELALDLRENPGGFLGIAEKIIDEFLEDEKLILFTKNKSGQIERNYATARGSFEKGKVYVLIDENSASASEIVAGALQDNDKGVIVGRRSYGKGLVQREMQLGDGSAVRLTVSRYYTPTGRTNSSVLTTKGNSDYLDDYYPRIERGDLFDASKIEVADSLKLQPPKGKVLTAVVALSRIFCGY

SEQ ID NO: 21917 - DNA, 549 bp, Unknown
  Obtained from environmental sample
  misc_feature (1)..(549): n is a, c, g, or t
atgggaacagtgttgagggtggaacggatatgctgtggaatttatttgagtcagaataagaacatttctaagacttatgtttcatcaaaaaaaatacacaaaaaaaattttataagaattattaatgttcatacgagtaaaagtggttttcaagaatttaatcatgatattaatatagaaataactatttattgcgctgatagaattgagtctcctgcaatttcctatcaaattgttagtactgataatattccaataattcatgaactaattttaaactcagaaaaagcttttgggcaggaaaagggattttataaattaacttctactataaataatctgaaattatatgaaggaatttatagtttaaatgtttttttcgcagataattttagtaaaacgacatttaataggttatttgaagtttgccaatttgaagttattaatagtgataaaaggccctattattggcagaagggttcggcaatatacaaagagaataatactaaatgggttatttccaaagtagatgaagaaagtgttgcgtag

SEQ ID NO: 21918 - protein, 182 aa, Unknown
  Obtained from environmental sample
  misc_feature (1)..(182): Xaa is any amino acid
MGTVLRVERICCGIYLSQNKNISKTYVSSKKIHKKNFIRIINVHTSKSGFQEFNHDINIEITIYCADRIESPAISYQIVSTDNIPIIHELILNSEKAFGQEKGFYKLTSTINNLKLYEGIYSLNVFFADNFSKTTFNRLFEVCQFEVINSDKRPYYWQKGSAIYKENNTKWVISKVDEESVA

SEQ ID NO: 21919 - DNA, 384 bp, Unknown
  Obtained from environmental sample
  misc_feature (1)..(384): n is a, c, g, or t
gtgcatgattttataaaaaattcgctgttagctttaaaaccaaatggaaagttgataataggtgttcccaacaacaatccctatttatttgttaatgataaataccatactttgaatttacctccacatcatgcaggactttggaataaaaagtctctaaaatcattagaacagctatttaatattaagttagtttctttacaatatgagcctttagaaaaaacctacagtcaatttttaaaaacttatataaacaattctaaccctgtttattctaaatttttaaaagtaacaaataaattatctcctaaaattttaagaaaggtattatgcaaatgtattgatggcaggaatattttagtggtctttagaaaaatagcttaa

SEQ ID NO: 21920 - protein, 127 aa, Unknown
  Obtained from environmental sample
  misc_feature (1)..(127): Xaa is any amino acid
MHDFIKNSLLALKPNGKLIIGVPNNNPYLFVNDKYHTLNLPPHHAGLWNKKSLKSLEQLFNIKLVSLQYEPLEKTYSQFLKTYINNSNPVYSKFLKVTNKLSPKILRKVLCKCIDGRNILVVFRKIA

SEQ ID NO: 21921 - DNA, 645 bp, Unknown
  Obtained from environmental sample
  misc_feature (1)..(645): n is a, c, g, or t
ttgagtgatttagaactgattagtttaagtcttacagctgaatttatgggaatagatagtgagaatgatttattcagaaaacttcccaagcctatttctgctaaaattgaacgaagtgtttacaacagaagaagacgaaaattagtaaattatatcgatggtattcgattaaaactagcttctcattttaatgaatttgaagattattttattgtagatagcatgcctttggaggtttgtaaattatctcgaagttctcgttcaaaaatatgtaaagaagatacttacgcatttcctgacaaaggctattgtgcttctcaaagttctaattattatggttataaattacatgctgttagttctgtaaatggtgtttttcagagtattgatttgagtccagcatctgtacatgatgtgaattatcttaaagatattacccaacaaataagtgattgtactttaattggcgatagaggtcatttgtcagcagaaatacaactcaatttatttgaaacctgcaatattaaactaaacacacctatgagaaacaatcaaaaaaattacaaaaaaacaagcttatatgttcagaaaaaacagaaaacgaatagaaaccattgttctctcaactatgtgacccaattatga

SEQ ID NO: 21922 - protein, 214 aa, Unknown
  Obtained from environmental sample
  DOMAIN (69)...(212): Transposase DDE domain
  misc_feature (1)..(214): Xaa is any amino acid
MSDLELISLSLTAEFMGIDSENDLFRKLPKPISAKIERSVYNRRRRKLVNYIDGIRLKLASHFNEFEDYFIVDSMPLEVCKLSRSSRSKICKEDTYAFPDKGYCASQSSNYYGYKLHAVSSVNGVFQSIDLSPASVHDVNYLKDITQQISDCTLIGDRGHLSAEIQLNLFETCNIKLNTPMRNNQKNYKKTSLYVQKKQKTNRNHCSLNYVTQL

SEQ ID NO: 21923 - DNA, 750 bp, Unknown
  Obtained from environmental sample
  misc_feature (1)..(750): n is a, c, g, or t
atgaacttgcaaaatatatgtgattgttcaaccacttgtgttgtgagcgaaggttattcagaaaccttgacaaataccattaaacttacgaagtatgaatcgcatttggcaaatccgtttgtggtaaaaagtctactcgatatggatatcatttcccatgaaatctatactccccggggacaagaacatattcaattaagaaatatccgaattgaaacagctaaacgaaattcaaaaaaactttacgattctggagtacttattgctgctaatacagatgcaggaaatataggaacgtttccgggatcatctatttacagagaatttgaattattaaaagaagcaggtttatcaccaagtaatattttaacatcggtaacaataaatgcggcaaaattaatgagaagtgaaaaatatctgggctcaatatctaaagaaaaacttgctgatctggttattttgaattctgacccacgtatagatattttgaatacgactgatattagtatggttattaaagatggtgagatattcaagcctgatgaaattattacaaaaagccctgagcaattaattcagcaagaagttaacgcctataatgctggagatatagacaattttatggagactttccatcccgaaattacagtattcaattatccggatgaattacgttatgataataaaacagataaaagagaagcctataaaaaatatttgagaaatacacaaacaatcatgcagaaatag

SEQ ID NO: 21924 - protein, 249 aa, Unknown
  Obtained from environmental sample
  misc_feature (1)..(249): Xaa is any amino acid
MNLQNICDCSTTCVVSEGYSETLTNTIKLTKYESHLANPFVVKSLLDMDIISHEIYTPRGQEHIQLRNIRIETAKRNSKKLYDSGVLIAANTDAGNIGTFPGSSIYREFELLKEAGLSPSNILTSVTINAAKLMRSEKYLGSISKEKLADLVILNSDPRIDILNTTDISMVIKDGEIFKPDEIITKSPEQLIQQEVNAYNAGDIDNFMETFHPEITVFNYPDELRYDNKTDKREAYKKYLRNTQTIMQK

SEQ ID NO: 21925 - DNA, 486 bp, Unknown
  Obtained from environmental sample
  misc_feature (1)..(486): n is a, c, g, or t
atgagctataacaacattattcttattgtactaatcgccttgttgaacgttaaaccgaatattgaaaaaacaataaacttttcggaatacacctttaacactacaaaaggtaatcaaacctcaataacattagaagacaacaaaatttatatcctagacttttggtatttagaatgtccgccatgtgtaaaagaccacgaagtaattgcagaatatcttaagacaaaaaagcatcaaaatgttgaagttataggaatgtctattgacagaagtataagtaaatgggtatcttatttagaaacacatcaatataattggacgaattataaccaaaatagttctgaaaaaacactctataaagatttagaaatacaatttttccctagttatttagtagtaaatagtaaaggagaaatacttcagaaatcaaatcgatttaaaaaagctttggattatattgaatcggctaatcttaagatggaatag

SEQ ID NO: 21926 - protein, 161 aa, Unknown
  Obtained from environmental sample
  misc_feature (1)..(161): Xaa is any amino acid
MSYNNIILIVLIALLNVKPNIEKTINFSEYTFNTTKGNQTSITLEDNKIYILDFWYLECPPCVKDHEVIAEYLKTKKHQNVEVIGMSIDRSISKWVSYLETHQYNWTNYNQNSSEKTLYKDLEIQFFPSYLVVNSKGEILQKSNRFKKALDYIESANLKME

SEQ ID NO: 21927 - DNA, 393 bp, Unknown
  Obtained from environmental sample
  misc_feature (1)..(393): n is a, c, g, or t
ttggtaaactatcaacctaattaccagccaaaggccgggcgttacaatatgggcgaatgcagtaattttaatttagtacccatgctcacgaagagcatagaacaactcgctgaatggaagccccaaaatattcaagattattgtgaaaatatttctaaaaaggcaattgatgaattacgaaatttaggctgctttatagaagacgaagcttatcgagctaatcatttatttggtgtctatttaccaaaaaatatcaatctggataaactaaaagcaaaatttcaagaaaaaaatatttatgtctcgtatcgaggtgatgctattcgtgtttcagccaatgtatataatactgaaagtgaatttgagaaattcgtaagtagtatttacgaataa

SEQ ID NO: 21928 - protein, 130 aa, Unknown
  Obtained from environmental sample
  misc_feature (1)..(130): Xaa is any amino acid
MVNYQPNYQPKAGRYNMGECSNFNLVPMLTKSIEQLAEWKPQNIQDYCENISKKAIDELRNLGCFIEDEAYRANHLFGVYLPKNINLDKLKAKFQEKNIYVSYRGDAIRVSANVYNTESEFEKFVSSIYE

SEQ ID NO: 21929 - DNA, 513 bp, Unknown
  Obtained from environmental sample
  misc_feature (1)..(513): n is a, c, g, or t
ttgctgatcaaaaatctcaacgaaaatactgaaaatgatattaaaaattatctgttctgtgccaatgaaaaacaagcagaacgatttcatgatatttttgaagatgttgatgaagacgtagtttatgaaactatcgtttttccgttataccaaggttttatagatcatgatcaaaaagtagcttactataccgatcaccaaatttttgaacggtatcataaattcagattaaaaagcggctttgctaaaaagcaggctattacccttaaagaactgaccaatttagaaataggcgattatgttacgcatatggaccatggcattggtaagtttggcggtttgcagaaaattgatgtagaaggtaaacagcaagaggccattaaactaatttatggagacagagacatcttgtatatcagtatacattcactgcataaaatttctaaattcaacggtaaagatgggaggcctccaaaaatatataataggctccgtgcgtggaagtcacgctga

SEQ ID NO: 21930 - protein, 170 aa, Unknown
  Obtained from environmental sample
  DOMAIN (94)...(167): CarD-like/TRCF domain
  misc_feature (1)..(170): Xaa is any amino acid
MLIKNLNENTENDIKNYLFCANEKQAERFHDIFEDVDEDVVYETIVFPLYQGFIDHDQKVAYYTDHQIFERYHKFRLKSGFAKKQAITLKELTNLEIGDYVTHMDHGIGKFGGLQKIDVEGKQQEAIKLIYGDRDILYISIHSLHKISKFNGKDGRPPKIYNRLRAWKSR

SEQ ID NO: 21931 - DNA, 639 bp, Unknown
  Obtained from environmental sample
  misc_feature (1)..(639): n is a, c, g, or t
atggtcccctttaaagaatactttttaggtcaaaaaaagggggatgttaaacgcattgcagacacacaaaaatgtttaagagtatctggtaagcataatgatcttgaagaagttggtattgacacttatcatcataccatgttcgaaatgttaggcaattggagttttggtgattactttaaaaaagaagctattgcatgggcttgggaattgcttgttgatgtttataaaataaataaagataatttatatgtaaccgtttttgaaggtgccaaagatgaaaacttagcttttgaccaagaggcatttgattattggaaaacccatattccggtagatagaatcttaaaaggcaacaaaaaagataatttttgggaaatgggagctcaaggaccctgtggaccttgttcagaaattcacgtagatattcgttctgatgatgaaaaatcgaaaatttctggtaaaaatttagttaacaaagaccaccctcaggttattgagatttggaacttggtttttattcaattcaatcgtaaggctgatggatctttagaggatttgcctgcaaaacatattgataccggaatgggctttgaacgtctatgcatggtactgcaaagatgttacttcaaattatga

SEQ ID NO: 21932 - protein, 212 aa, Unknown
  Obtained from environmental sample
  DOMAIN (1)...(212): tRNA synthetases class II (A)
  misc_feature (1)..(212): Xaa is any amino acid
MVPFKEYFLGQKKGDVKRIADTQKCLRVSGKHNDLEEVGIDTYHHTMFEMLGNWSFGDYFKKEAIAWAWELLVDVYKINKDNLYVTVFEGAKDENLAFDQEAFDYWKTHIPVDRILKGNKKDNFWEMGAQGPCGPCSEIHVDIRSDDEKSKISGKNLVNKDHPQVIEIWNLVFIQFNRKADGSLEDLPAKHIDTGMGFERLCMVLQRCYFKL

SEQ ID NO: 21933 - DNA, 579 bp, Unknown
  Obtained from environmental sample
  misc_feature (1)..(579): n is a, c, g, or t
atgaatcacaactcaacttttccgataaaacaaaatgaacttgatatgcttcgagatgaagcaacaggttatttaaaatctattcaatgggagcaaagtcagcgtgcaaaaaataaagataaagatgcaaaagacgaatctattttactgtatttatcaagagcaaataacggaagtaatgttgaaattacatcagtttctaaaactattttagcgctcaaaaaacgtttattgccagattcaattgcaattcctgtttatttaaatcagacgttgtttgcagttcaagaaggaatcactttaggaatttggatcaaagattcttattatgatgcctcaggtttatctagtttaaatgaaagaaaatcagccttaaattcatctcaaaaaagagaatttgaaagtaaattacaaacagcaacagcttttcaattatttgcaacttcgtataagatattacacgatttaaaatcttttgcaagtgatgatttatctgtgatgaaacaaaagtttgcagggattccagaagtgtcatttttatcaccattaaaaggaatgcatgtgctttgttttatttga

SEQ ID NO: 21934 - protein, 192 aa, Unknown
  Obtained from environmental sample
  misc_feature (1)..(192): Xaa is any amino acid
MNHNSTFPIKQNELDMLRDEATGYLKSIQWEQSQRAKNKDKDAKDESILLYLSRANNGSNVEITSVSKTILALKKRLLPDSIAIPVYLNQTLFAVQEGITLGIWIKDSYYDASGLSSLNERKSALNSSQKREFESKLQTATAFQLFATSYKILHDLKSFASDDLSVMKQKFAGIPEVSFLSPLKGMHVLCFI

SEQ ID NO: 21935 - DNA, 369 bp, Unknown
  Obtained from environmental sample
  misc_feature (1)..(369): n is a, c, g, or t
ttggttaccggagttcgtgctaatagaaaagacagttttgtgaaaaatatgtcgtccaccatagccaatggtataagacgtagtttcacgcacgacggaatggacgatacgggttgcccgctaaaagttattaaaaccgattacgctaaacgtattcctatgtttaaaggcttacatcgtttcttacccgcaatgattttattacaaaatggaacgataaaacaaattcctgtacagcattttcctcgtcttgctggagaagctaaatttggagtttggaaccgtttacttggtccattaatggattgttttgcttatttatggatgaaaaaaaagtacattaattatacggtagcaaaacaaggataa

SEQ ID NO: 21936 - protein, 122 aa, Unknown
  Obtained from environmental sample
  misc_feature (1)..(122): Xaa is any amino acid
MVTGVRANRKDSFVKNMSSTIANGIRRSFTHDGMDDTGCPLKVIKTDYAKRIPMFKGLHRFLPAMILLQNGTIKQIPVQHFPRLAGEAKFGVWNRLLGPLMDCFAYLWMKKKYINYTVAKQG

SEQ ID NO: 21937 - DNA, 582 bp, Unknown
  Obtained from environmental sample
  misc_feature (1)..(582): n is a, c, g, or t
atgaaacactataaaaatggtctcgtagtcttagacgatattgaccattatatgacaggtgcaaaaggacagtctatgattggtgcgctttgtacagtgcgtcataaaggaattgacattgtactcacacaccagtctgtagcaaaaatcacaacctcagaatggcaaaattgtacgtggttgcgattgcaccaccaagttgacgatgtgacgcgctatcgagaacgtattcctaaatatcaaatggttcgtataggtcagcttattgtagatgaacaatacgagctgtgttccaatgcttttgcaatgggtaagattacagagcttgaatataaaatccagaagagcttttttgtgtacgtcaatatgcgagagcaacgtattaaaggttgtagtcgtgcagcatttataagagcctgtaaaaagtttatcgaccaggaagaaagtcgcaaagtcaagatgctacttaatgagcaagattttgatgggaataacatctacaaaaccaagaacgaggctattgtaaagatgatttctgaaaagttacgttatcacgaagatgggttgaatagtcctttatag

SEQ ID NO: 21938 - protein, 193 aa, Unknown
  Obtained from environmental sample
  misc_feature (1)..(193): Xaa is any amino acid
MKHYKNGLVVLDDIDHYMTGAKGQSMIGALCTVRHKGIDIVLTHQSVAKITTSEWQNCTWLRLHHQVDDVTRYRERIPKYQMVRIGQLIVDEQYELCSNAFAMGKITELEYKIQKSFFVYVNMREQRIKGCSRAAFIRACKKFIDQEESRKVKMLLNEQDFDGNNIYKTKNEAIVKMISEKLRYHEDGLNSPL

SEQ ID NO: 21939 - DNA, 576 bp, Unknown
  Obtained from environmental sample
  misc_feature (1)..(576): n is a, c, g, or t
atgaaaggaatatttttttatctcttactatttgtttctgctttaagcttttcgcagccctctactaaagcgttacaattgtcaaattccgctctagcgctgacaaagcaatatgttacttacgatcctagttatttctctatcaattatcctaacggagatgtaccttcagataaaggagtctgcaccgatgtagtgataagaacctaccgaaaattagacattgatctacaagagttggttcataacgatatgaaagctcattttaataagtatccaaacttttggggactcaaatctaccgataccaacatagatcacagaagagtacccaatttaatggtgttttttaaacgaaagggaacagaaaaacctattacacaaaaccctaatgactatttacctggagatattgtctgttggagtttgggagggggtaagacacatattgggatggtcacacataagaaatctatagatggtaaaagatataaaattgtgcataacattggcgcgggccaagtattagaggattgccttttcaactttaaaataattggtcattatagctattaa

SEQ ID NO: 21940 - protein, 191 aa, Unknown
  Obtained from environmental sample
  SIGNAL (1)...(18)
  DOMAIN (20)...(191): Protein of unknown function (DUF1287)
  misc_feature (1)..(191): Xaa is any amino acid
MKGIFFYLLLFVSALSFSQPSTKALQLSNSALALTKQYVTYDPSYFSINYPNGDVPSDKGVCTDVVIRTYRKLDIDLQELVHNDMKAHFNKYPNFWGLKSTDTNIDHRRVPNLMVFFKRKGTEKPITQNPNDYLPGDIVCWSLGGGKTHIGMVTHKKSIDGKRYKIVHNIGAGQVLEDCLFNFKIIGHYSY

SEQ ID NO: 21941 - DNA, 639 bp, Unknown
  Obtained from environmental sample
  misc_feature (1)..(639): n is a, c, g, or t
ttggatttaagtctaaaaaaagtatacagtagactgcattctgatggtaacgaaaccagtaatgcctttttaaatattgacgctattgattattgtacttttggaaactctaaaccttttagaataaaaatccgaaatgttttaaatgacaactacacctatttttatgtcaaaaaagcagacgcttctcgtatttatggtctagaattagagcatatgttatctccatatcaactaaattttatggtacatggtaatactttaatcgaagagcatattgcaggaatccctggagatgtatttattgaaaccatgttggatgactgttctgaatctgaaaaatcccaaatagcaaaagagtttgttaagtttaacgagcgttgtatgatcaggctacttggtgatatgcgctcttataattacgtagttgtgccaacccatgactttgatcatgtggtgtttaaaattagagccatagattttgaccaacaatgttatgaaggtaagtttaaggtatacagacctcagttttttaaagaaaatctgcgcttggtagagttggtcgttagtaagtttaaaaaggagtctatcgatcaatataaaattgtgcacgcctcgagccgaatcttgatccactag

SEQ ID NO: 21942 - protein, 212 aa, Unknown
  Obtained from environmental sample
  misc_feature (1)..(212): Xaa is any amino acid
MDLSLKKVYSRLHSDGNETSNAFLNIDAIDYCTFGNSKPFRIKIRNVLNDNYTYFYVKKADASRIYGLELEHMLSPYQLNFMVHGNTLIEEHIAGIPGDVFIETMLDDCSESEKSQIAKEFVKFNERCMIRLLGDMRSYNYVVVPTHDFDHVVFKIRAIDFDQQCYEGKFKVYRPQFFKENLRLVELVVSKFKKESIDQYKIVHASSRILIH

SEQ ID NO: 21943 - DNA, 690 bp, Unknown
  Obtained from environmental sample
  misc_feature (1)..(690): n is a, c, g, or t
gtggatctaacaacaatgacttgggattgtactgagttgttatatcaaattttaggaatagatgaatccttcgttagaacaatagatagttgggttgatcttattcatactgaagacaaaataaacgttttaaattattttgatagctgtgtaaaaaacaatacacgatttaataaagagtatcgtgttattcaatataattctaaaaaagaaatttgggtacatggtattggtgaattgttatttgatgacaagtctaaccctatcaaaatgatagggactatgcaaaatattacaaatcgaaaaaaagtagaattaaaacttcagaaaaatgaaaaatcattactagaagctcaaaaaatagctaaaataggaagttactttctagatttagaaaccagtttagctcatgcctcaataacctttaaagagattgctggtttagagaaaaaagatactatttctcgaaaattatggaaagatatcacacacccagaagatgccgaaataaatagtgctgagatcgaaagatgtatacgaaccggacaagagtttgatttggaatatagaatttattctaaaaccgataatcaattacactggattacccggcttaggagaagtaatcttattccaaacggtaaagcaaaaagcttctttggaaccatccaagatataacagagcgttaa

SEQ ID NO: 21944 - protein, 229 aa, Unknown
  Obtained from environmental sample
  DOMAIN (58)...(101): PAC motif
  misc_feature (1)..(229): Xaa is any amino acid
MDLTTMTWDCTELLYQILGIDESFVRTIDSWVDLIHTEDKINVLNYFDSCVKNNTRFNKEYRVIQYNSKKEIWVHGIGELLFDDKSNPIKMIGTMQNITNRKKVELKLQKNEKSLLEAQKIAKIGSYFLDLETSLAHASITFKEIAGLEKKDTISRKLWKDITHPEDAEINSAEIERCIRTGQEFDLEYRIYSKTDNQLHWITRLRRSNLIPNGKAKSFFGTIQDITER

SEQ ID NO: 21945 - DNA, 660 bp, Unknown
  Obtained from environmental sample
  misc_feature (1)..(660): n is a, c, g, or t
ttgttggctagaactggacacaatataagtagcagaaacagcaagccattaattaaagttaattgttctgcaataccacgagagttaattgaaagcgaattatttggtcacaaaaaaggatcgtttacaggagcctttagtgacaaaattggtaagtttgaacttgcggatggtggtacattatttttagatgaaattggagaactaccattagacatgcaacctaaaattctaagatttttacaagaaggagaaattgaagtcgttggtggattaggatctaaaaaattagatgtacgcgttattgcagcaaccaatagaaacttattggcagagatagagaaaaagcaatttagagaagatttatactttagattaaatgtatttccaattgcggttccagccttaagagatcgtaaggatgatattccattgttagtagagcattttgtagataaatttggtaaaacttatgaaaaacagatcaaatatatatctgatgatgcgatgtcccaacttaaagcttacaattggcctggaaatattagagagcttgaaaacttaattgagcgcgcattaatactatctaatagcgatactttaattattcctggttttgaaccactaatcaaaaatctaagcaacgcattaacagtgtag

SEQ ID NO: 21946 - protein, 219 aa, Unknown
  Obtained from environmental sample
  DOMAIN (1)...(186): Sigma-54 interaction domain
  misc_feature (1)..(219): Xaa is any amino acid
MLARTGHNISSRNSKPLIKVNCSAIPRELIESELFGHKKGSFTGAFSDKIGKFELADGGTLFLDEIGELPLDMQPKILRFLQEGEIEVVGGLGSKKLDVRVIAATNRNLLAEIEKKQFREDLYFRLNVFPIAVPALRDRKDDIPLLVEHFVDKFGKTYEKQIKYISDDAMSQLKAYNWPGNIRELENLIERALILSNSDTLIIPGFEPLIKNLSNALTV

SEQ ID NO: 21947 - DNA, 516 bp, Unknown
  Obtained from environmental sample
  misc_feature (1)..(516): n is a, c, g, or t
atgtcggtaatcgtcgatatgatacaaaaagaaaagaatccagagatactcaatcagcttctccctaaacttgatcaaatagcaaaaagtattactcaccttactgaagatattaatgactatgtgtctattttggataaccaagaagttaaaattgaagatatagaccttaagaaactaatacttgaagttaaaaatgaatttaccgaaactctgttagacgataccggatttgaagtattgataaacttagatacctggggtcatatctcatattcaaaattttatatgcaaagcatcgttcacaactttatttcaaattctataaaatacaaaagagacaatgttgcatcatacatagaatttaaatctgcaatagaaaacaagcacaaagtcttatatgtaagggataatggtattgggttgaatatggaacgtcatggagacaacgtatttaaactctacaaaagatttcatagaaatatttctggcaaaggtatgggactatttctgtaa

SEQ ID NO: 21948 - protein, 171 aa, Unknown
  Obtained from environmental sample
  misc_feature (1)..(171): Xaa is any amino acid
MSVIVDMIQKEKNPEILNQLLPKLDQIAKSITHLTEDINDYVSILDNQEVKIEDIDLKKLILEVKNEFTETLLDDTGFEVLINLDTWGHISYSKFYMQSIVHNFISNSIKYKRDNVASYIEFKSAIENKHKVLYVRDNGIGLNMERHGDNVFKLYKRFHRNISGKGMGLFL

SEQ ID NO: 21949 - DNA, 549 bp, Unknown
  Obtained from environmental sample
  misc_feature (1)..(549): n is a, c, g, or t
ttgttgattattaatcaggtccatggtcgtatcaaaataagactgtgccaaattgagaaccagtattttatgaccaactacgatattgttatcgataatgaaaaattcattttaaatccaacggatatagcatccttggatattgttccaataggcaatcatcaatttcatgccctcaggaacaaccattcctataagatcaaaatcttgaataccgattttgccaataaatctttgaccatagaggtaaatgggaatagttataaaatggtcctggcagatgaatatgatcaaatggtccaaaaaatgggattattgactaccaaaacccataaaataaacaatatcaaggcccccatgcctgggcttataatagatgtcatagcatcaaaagggcagaaaatagaaccagggacacccttgatcgtgttatcggccatgaaaatggagaatatcattacttcccacggggaaggcgttataaaaagtataaatgtcaaggtgaacgatactgttgacaaaggacagttaatcattgaaatggaatag

SEQ ID NO: 21950 - protein, 182 aa, Unknown
  Obtained from environmental sample
  DOMAIN (114)...(181): Biotin-requiring enzyme
  misc_feature (1)..(182): Xaa is any amino acid
MLIINQVHGRIKIRLCQIENQYFMTNYDIVIDNEKFILNPTDIASLDIVPIGNHQFHALRNNHSYKIKILNTDFANKSLTIEVNGNSYKMVLADEYDQMVQKMGLLTTKTHKINNIKAPMPGLIIDVIASKGQKIEPGTPLIVLSAMKMENIITSHGEGVIKSINVKVNDTVDKGQLIIEME

SEQ ID NO: 21951 - DNA, 660 bp, Unknown
  Obtained from environmental sample
  misc_feature (1)..(660): n is a, c, g, or t
gtgatttcgtttgttcctgtttatgaggtagaggtcactaaaaagctatttagcaaaacgtatactgaagtccctaaaggatttgagctgcaacaaaacatacacatccaatttactaagacacaacaatttgaaaaaattcttactgcttgtgctaaaaatgaaatttataacttggtaaaagtggattattatattgaaaacattgctgatgtgtataagaatctacaaactaaacttttaaatttaattaccgaaaaaaaagaatattacaatctactaggttttaaattagaaaactataatgctgtcatggctgatcaaaaatattgttacttcccaaaagatttttatcaaaattatcaggcatttaacagcatatctttccaagctttaaaacaggataaaggtgttactgaagtaaaaaaacaaacctcatattactaccaacctttgtcttacgagaactatgatattgtaattaatccttcaatattagagcctgttgtacaaattggtatggaaataaaactacattttacaccaaaaccagctgagcaaaaacaagaccctattgttaaaacagaaatcaaacataaatactttgttatatcacctgacggaaccattgacgttaaagagttaaatactaaccattaa

SEQ ID NO: 21952 - protein, 219 aa, Unknown
  Obtained from environmental sample
  misc_feature (1)..(219): Xaa is any amino acid
MISFVPVYEVEVTKKLFSKTYTEVPKGFELQQNIHIQFTKTQQFEKILTACAKNEIYNLVKVDYYIENIADVYKNLQTKLLNLITEKKEYYNLLGFKLENYNAVMADQKYCYFPKDFYQNYQAFNSISFQALKQDKGVTEVKKQTSYYYQPLSYENYDIVINPSILEPVVQIGMEIKLHFTPKPAEQKQDPIVKTEIKHKYFVISPDGTIDVKELNTNH

SEQ ID NO: 21953 - DNA, 531 bp, Unknown
  Obtained from environmental sample
  misc_feature (1)..(531): n is a, c, g, or t
atgcgtattctttttataaattctgaccctgatagatctgaactagacatggttctaaaaattaatgcaaaagggatttacatcaaaattcttacttccggaaattctaaataccgtaaagaactggaagaagctggtgtttatatatcttgtaaagattttcattcaaaatggaattggtcactaattaaacagattcgatcgctcatcaataaagaaggatttaatatcttacacgctactcagagttctgggttggcaaatgctatttgggcaagttacggaaagcgtgtaaaaattattggatacagaggcacgctagcaaggataaggcgtcacgaccctacatactggttaggtattttaaacccaagagtcaataaagtaatttgtgttaatcagactatttatgattatctgtgcaacttttatcgcccagaaaatttattgctaaactataaaggatatgatattaagtgggcagaagaattgactaaagaaaatacaactatagatggagttccagaataa

SEQ ID NO: 21954 - protein, 176 aa, Unknown
  Obtained from environmental sample
  misc_feature (1)..(176): Xaa is any amino acid
MRILFINSDPDRSELDMVLKINAKGIYIKILTSGNSKYRKELEEAGVYISCKDFHSKWNWSLIKQIRSLINKEGFNILHATQSSGLANAIWASYGKRVKIIGYRGTLARIRRHDPTYWLGILNPRVNKVICVNQTIYDYLCNFYRPENLLLNYKGYDIKWAEELTKENTTIDGVPE

SEQ ID NO: 21955 - DNA, 429 bp, Unknown
  Obtained from environmental sample
  misc_feature (1)..(429): n is a, c, g, or t
atgaattttaacaactatacaattaaatcgcaagaagcgatacagcaagctcagcagcttgcccaaagtttagggcatcagcaaattgagaatgaacacattataaaatctatttttgatgttgatgaaaatgtgctaccattcattttaaaaaagatgaatgtcaatattccaatggtacagcaaattttagataagcaattagaaagttttccaaaagttacaggtggcgatttagtattgtctcgcgaagcctctaaaacgttaaacaaagcgtctattattgcaaaaaaattgaccgacgattatgtatcgatcgaacatttagtacttgctatttttaaatcgaaccgtacaatttgctcaggttttaaaagatcacggcgttaccgaaaaacattgactgcagtattgacaattagaaagnnn

SEQ ID NO: 21956 - protein, 143 aa, Unknown
  Obtained from environmental sample
  DOMAIN (17)...(69): Clp amino terminal domain
  misc_feature (1)..(143): Xaa is any amino acid
MNFNNYTIKSQEAIQQAQQLAQSLGHQQIENEHIIKSIFDVDENVLPFILKKMNVNIPMVQQILDKQLESFPKVTGGDLVLSREASKTLNKASIIAKKLTDDYVSIEHLVLAIFKSNRTICSGFKRSRRYRKTLTAVLTIRKX

SEQ ID NO: 21957 - DNA, 396 bp, Unknown
  Obtained from environmental sample
  misc_feature (1)..(396): n is a, c, g, or t
gtgtgggtatcggacataacatacatcagaaccataaaaggattttgttatctggcactcattactgatatgcattctcgtaaaatagtaggatacgatattagtgatagcctagagcttaaagggtgtgtaagagctcttaataaagcgatttatcaagcaaaaaacattaaaggacttatacaccattcggacagaggaatacaatattgcagtaatgtatacacacaaatacttaaaagaaaaaagatagacattagtatgaccgaagaaaatcactgctacgaaaatgcgatggctgaacgtgtaaatggtatcttgaaagatgaattttatctcgaccagacctttatcaacctagcacacgcaaagagagacaacaaaaaatgcaattaa

SEQ ID NO: 21958 - protein, 131 aa, Unknown
  Obtained from environmental sample
  DOMAIN (1)...(131): Integrase core domain
  misc_feature (1)..(131): Xaa is any amino acid
MWVSDITYIRTIKGFCYLALITDMHSRKIVGYDISDSLELKGCVRALNKAIYQAKNIKGLIHHSDRGIQYCSNVYTQILKRKKIDISMTEENHCYENAMAERVNGILKDEFYLDQTFINLAHAKRDNKKCN

SEQ ID NO: 21959 - DNA, 570 bp, Unknown
  Obtained from environmental sample
  misc_feature (1)..(570): n is a, c, g, or t
atgacatcagcaagattagggctatattcagtattggtatcctcagttggtaatgacggtttaggagagtatatatttaaaaaattggccgaagttggtgttaatgcatccaatattaacatcattcaaaaaaaaccaactagtgtgatttttgtgtctaggtcatcgggtacacctgattttataccatacagagaagcagattgtgttattacagaagatcaaataacaacaaaaactttaaaagacaccaaaatttttcataccacttgttttgctctaagtaaagatcctgcgcaagcaacaatactaaaaaaagcagaagaagcatttaatttaggatgtcaattacgtatagatatcaattatgcggataaattctggcatagtaaaaatgacgctttaaaaataattaaagcttattgtaagtttaatcctttggttaaactaagtgaagatgatatgcttagattgtttggacacaaattaccagacgaagaaattttttcatttttccatgccgaaggcgttgaccactgtatgtttaactctaggaagtcaaggcgttaa

SEQ ID NO: 21960 - protein, 189 aa, Unknown
  Obtained from environmental sample
  misc_feature (1)..(189): Xaa is any amino acid
MTSARLGLYSVLVSSVGNDGLGEYIFKKLAEVGVNASNINIIQKKPTSVIFVSRSSGTPDFIPYREADCVITEDQITTKTLKDTKIFHTTCFALSKDPAQATILKKAEEAFNLGCQLRIDINYADKFWHSKNDALKIIKAYCKFNPLVKLSEDDMLRLFGHKLPDEEIFSFFHAEGVDHCMFNSRKSRR

SEQ ID NO: 21961 - DNA, 618 bp, Unknown
  Obtained from environmental sample
  misc_feature (1)..(618): n is a, c, g, or t
atgttaggctgtcatgatggaatacctgtcttagatttaaaaggaaaagcggttaatggtaattataatgaaggtttattggaggataaagaaatagaagccataatggacaccataataagtcgtggtggacgtgttaaaaacctttatggtccatcaggtacaaaaatatcttactatcaagtaaatgcgactttttttagcgctttaggagaggatgaaaaaaaattacttttggctcgagctattcaaatgtttgtgccaggaatacctcaagtatggtatttggatatttttgcgggaaaaaacgattatgaggcagcagataatgctggaagtggaggacataaagaaattaatagaacaaccttaagtcatgatgatattgaggcaggactaaaaaaagatattgtacttaaacaattagagataattaaaataagaaatacatgtcatgcctttactggaaatgtagacataaatacgtctaataaaaacatattagacataacatggcaaacccaaaacagtcaagcacaacttttagcagatcttaaaaacttgtcgtttacaatacaagtaacagaaaataatcaaacaaaaacatatcattattaa

SEQ ID NO: 21962 - protein, 205 aa, Unknown
  Obtained from environmental sample
  misc_feature (1)..(205): Xaa is any amino acid
MLGCHDGIPVLDLKGKAVNGNYNEGLLEDKEIEAIMDTIISRGGRVKNLYGPSGTKISYYQVNATFFSALGEDEKKLLLARAIQMFVPGIPQVWYLDIFAGKNDYEAADNAGSGGHKEINRTTLSHDDIEAGLKKDIVLKQLEIIKIRNTCHAFTGNVDINTSNKNILDITWQTQNSQAQLLADLKNLSFTIQVTENNQTKTYHY

SEQ ID NO: 21963 - DNA, 858 bp, Unknown
  Obtained from environmental sample
  misc_feature (1)..(858): n is a, c, g, or t
atgacaattgatgaaaaacgtctgctacttctagctagtccgattgcgaggctaattaacgcaacacaggacgatgctatagagataacagcgtcagattttgcagatgagtgcggtataaaagtcaattcagcatatagtcaaatgcatgatgcaagtcttactttgatgagcaaacagtttagctataagaatgagaaggggaagcgcgtacatgtgcagtgggtcattagatcaatctatgatgaagcatgtgtatcattatgctttacgaaagaagttttactaatgcttaaagagtttgataaaaataatccgttcacaaagtacaagaaggagtacgtccttgcgctgcgtggtgagtattctattgatatgtatcatctagctaagaaacatgaagctatgagtaaattttacatgtcactagaggattatagaaacgaattaggtttaacagatacctatgtgcgtataaacaatttaaaagctcgtactttacatccagctatagacgaaattaacgaaaaaactgatataaagttatcttacgagaatagaaaaaaaggcggtcgagtgattggttttgactttacggttaaggctaagccacagctaaagcaaatacctaaaagtgctacagtagaggtaagggttgctgatttgaaagataagcagatagaagcgatcgtctgtactcaagcatttaaagatgattataaccatctgataagcccaacaagccctataaacacagatctaacacaatggaagcctgaaatgtcaaagctgctaaaggctcatcctgagaaaattattaagcgcccaatcctcttattacttggcaaagataggtag

SEQ ID NO: 21964 - protein, 285 aa, Unknown
  Obtained from environmental sample
  DOMAIN (1)...(200): Initiator Replication protein
  misc_feature (1)..(285): Xaa is any amino acid
MTIDEKRLLLLASPIARLINATQDDAIEITASDFADECGIKVNSAYSQMHDASLTLMSKQFSYKNEKGKRVHVQWVIRSIYDEACVSLCFTKEVLLMLKEFDKNNPFTKYKKEYVLALRGEYSIDMYHLAKKHEAMSKFYMSLEDYRNELGLTDTYVRINNLKARTLHPAIDEINEKTDIKLSYENRKKGGRVIGFDFTVKAKPQLKQIPKSATVEVRVADLKDKQIEAIVCTQAFKDDYNHLISPTSPINTDLTQWKPEMSKLLKAHPEKIIKRPILLLLGKDR

SEQ ID NO: 21965 - DNA, 411 bp, Unknown
  Obtained from environmental sample
  misc_feature (1)..(411): n is a, c, g, or t
atgaatattacaagagaaaacatagatgcattaaacgcagttgtaacggtagatatcgcaaaagacgattacaataacaaagttcaaaaaatcttaacagattataagaaaactgcgaacattccagggtttagaaaaggccaagtgccaatgggaatggtgaaaaagcaatacggtaaagcggtattaatagaagaagtaaacaaacttcttcaagagtctttaaataaatatttatctgaagagaagttagatgttttaggacagccattgccaaaaattcaaaataacattaattgggaaggtgacaatttttcttttgaatctgaattaggattagctccagaatttgatgttgactttaaacaggaaaggaaaggccatttaaccatttattccgattggttggct

SEQ ID NO: 21966 - protein, 137 aa, Unknown
  Obtained from environmental sample
  DOMAIN (1)...(131): Bacterial trigger factor protein (TF)
  misc_feature (1)..(137): Xaa is any amino acid
MNITRENIDALNAVVTVDIAKDDYNNKVQKILTDYKKTANIPGFRKGQVPMGMVKKQYGKAVLIEEVNKLLQESLNKYLSEEKLDVLGQPLPKIQNNINWEGDNFSFESELGLAPEFDVDFKQERKGHLTIYSDWLA

SEQ ID NO: 21967 - DNA, 426 bp, Unknown
  Obtained from environmental sample
  misc_feature (1)..(426): n is a, c, g, or t
atgaaaaacaataaaataaacatccactttttgggatcggcaggcaccgtgactggctcaaaatatttggtggatacaggagatagaaagatacttatagactgtggcctcttccaagggttaaaggaattacgccttaaaaactgggagtacccacctgttaatgtaggtgatattgatgctgttttgcttacccacggtcatatggaccatacaggttatttacccagattggtaaaacaaggcttcaatggtcccatttatggtacgaatcctactttggacattgcaaaaatcattttgaatgatagtgcaaaaatacaggagcaagaagccgaacgtgccaataaggaaggctattccaaacatagtcccgcagaaccattatacgatttaaaggatgtagaagaactatcccacacttga

SEQ ID NO: 21968 - protein, 141 aa, Unknown
  Obtained from environmental sample
  DOMAIN (18)...(140): Metallo-beta-lactamase superfamily
  misc_feature (1)..(141): Xaa is any amino acid
MKNNKINIHFLGSAGTVTGSKYLVDTGDRKILIDCGLFQGLKELRLKNWEYPPVNVGDIDAVLLTHGHMDHTGYLPRLVKQGFNGPIYGTNPTLDIAKIILNDSAKIQEQEAERANKEGYSKHSPAEPLYDLKDVEELSHT

SEQ ID NO: 21969 - DNA, 576 bp, Unknown
  Obtained from environmental sample
  misc_feature (1)..(576): n is a, c, g, or t
gtgcttgaaaaattaaaggaatcgggagttcaatatattgcgcttcgtaccgctgggtataataatgtatctatcgaaaaagctaccgaactgggtataaaagtagctcgtgttccagcctattccccttatgccattgcagagcatacaatggcgctcatacttgcattaaaccgaaaattgattaaagcacacaacagggtacgtgaccagaatttctcattgaacggtcttaccggtttcgacctcaatggaaaaaccgtcggcgttatcgggactggaaaaattgggtctgtattggtaaaaatactacacggttttggttgtaaaatacttgttcaagatgtcattgtggatgaaaatttaatcaattcttataacgtaagctataccaattgtgaaactatttgtaagcagtccgatatcataagcttgcacgtaccactaacgtcttcaacgaaacactttattgatgcaaaacatatttcattaatgaagcaaggccgtaatgcttatcaatacaagtcgtggaggattggtcgataccaaagctgttatcgaaggattgaaaactaa

SEQ ID NO: 21970 - protein, 191 aa, Unknown
  Obtained from environmental sample
  DOMAIN (46)...(184): D-isomer specific 2-hydroxyacid dehydrogenase, NAD binding domain
  misc_feature (1)..(191): Xaa is any amino acid
MLEKLKESGVQYIALRTAGYNNVSIEKATELGIKVARVPAYSPYAIAEHTMALILALNRKLIKAHNRVRDQNFSLNGLTGFDLNGKTVGVIGTGKIGSVLVKILHGFGCKILVQDVIVDENLINSYNVSYTNCETICKQSDIISLHVPLTSSTKHFIDAKHISLMKQGRNAYQYKSWRIGRYQSCYRRIEN

SEQ ID NO: 21971 - DNA, 567 bp, Unknown
  Obtained from environmental sample
  misc_feature (1)..(567): n is a, c, g, or t
atgttgacttggaaaaaaaagccaagtattattcactgtcatgatcatcatacagggttaacaccttttatattacaagaatcctttaagtataaatcgttaaataaaattccgactgttatgaccattcacaatgcacaataccagggttggttttctcatgacaaagtaaatttaattccggaatttaataaagaaaatgttggattgttagattgggggaacacaataaatcctctggcagcaggaataaaatgcgcttggagagtgaccaccgtttctccaagttatatggaagaattaaaaattgatgcaaatggtctggagaatttattgagcgacgaaagcgataaatgcattgggattttaaacggaatagactcagaagtttggaatccagaaacggatgattacatcattcaaaactttaataaagcaaaggtagtttctggcagaaaagcaaataaaaaatggttatgtncagaatttgatttagatatcaatagaccactatttgcctttattgcaagattggttggtgaaaaaggatcagatctattaccgtga

SEQ ID NO: 21972 - protein, 188 aa, Unknown
  Obtained from environmental sample
  misc_feature (1)..(188): Xaa is any amino acid
MLTWKKKPSIIHCHDHHTGLTPFILQESFKYKSLNKIPTVMTIHNAQYQGWFSHDKVNLIPEFNKENVGLLDWGNTINPLAAGIKCAWRVTTVSPSYMEELKIDANGLENLLSDESDKCIGILNGIDSEVWNPETDDYIIQNFNKAKVVSGRKANKKWLCXEFDLDINRPLFAFIARLVGEKGSDLLP

SEQ ID NO: 21973 - DNA, 753 bp, Unknown
  Obtained from environmental sample
  misc_feature (1)..(753): n is a, c, g, or t
atgaaatggaatagtatataccccagtaactatataatcttgagcaaggtaaaacaacttttcctagctataattataatgctggcatttacggctggtaaagaaaataaccaaaagaatgcgattcaggatgcaatgcatgaaacaaatcacgacaaacacgatagttcaaaatccgcaaatgaacacatgcagcgttcatccacaaaagatttaatagagcggtttgagtcgcctgaacgtgatgcttatcaaaacccagagaaagtgcttgaataccttggtgatataaacggtaaaaaaattatggatttaggtgctggttcaggttatttttcggtgaaattggctgaaaaaggtgcgcatgttattgctgctgatgttagtaatgagtttcaagacgcattaaaaaaacgaatagaagaaaacaaccttgaaaatatagaacttcgaaaaattccttatgacagtcctaacttatcagacaacgaagtagatatggtgttaattgttaatacataccatcacatagaaaaccgaatcaattatttttcaaaagttaaaaaaggaattaaattaaatggagaattagtcgttatagattacttcaaaaaagaacttccagtaggtccgtctgttgaccataaaattgatctagagactgtaaagagcgaattagaaaaggcaggctatacacaattggatgtcaatgtagatttgttgccttatcaatttataatacgagctaaataa

SEQ ID NO: 21974 - protein, 250 aa, Unknown
  Obtained from environmental sample
  misc_feature (1)..(250): Xaa is any amino acid
MKWNSIYPSNYIILSKVKQLFLAIIIMLAFTAGKENNQKNAIQDAMHETNHDKHDSSKSANEHMQRSSTKDLIERFESPERDAYQNPEKVLEYLGDINGKKIMDLGAGSGYFSVKLAEKGAHVIAADVSNEFQDALKKRIEENNLENIELRKIPYDSPNLSDNEVDMVLIVNTYHHIENRINYFSKVKKGIKLNGELVVIDYFKKELPVGPSVDHKIDLETVKSELEKAGYTQLDVNVDLLPYQFIIRAK

SEQ ID NO: 21975 - DNA, 543 bp, Unknown
  Obtained from environmental sample
  misc_feature (1)..(543): n is a, c, g, or t
ttggtattgcaaacattaatagaattcacgttaacaaataacccctttaaaaatataaatatgaaagtacttaaaattattacactcgtaactgttctcatttcaacagtcagcattaccaatgcacagaatgataaagattctaaagataaagaagatgttatcgcagtaatgaaagcttacaaagatgcactacaaaacttaacgaccgaggggacatttgaactatttacagaagattcaaaagtatttgaatctggtggtgtagaaggctcgtatgcgcactatatagaacaccatttggggcctgagttggggcatttcaaaaaatttgaattttcagattatgaaattgatgcggaagtagatttgccttatgcatttactactgaaacctacatctacactatcgtgctcaatccagatgaaaaaggcgaaagtagaacgataaagaacaaaggagtagcgacgtctatcttaaaaaagatggatggtaaatggaagattattaaaaaacattcttcgtcaagaaattgtcaataa

SEQ ID NO: 21976 - protein, 180 aa, Unknown
  Obtained from environmental sample
  misc_feature (1)..(180): Xaa is any amino acid
MVLQTLIEFTLTNNPFKNINMKVLKIITLVTVLISTVSITNAQNDKDSKDKEDVIAVMKAYKDALQNLTTEGTFELFTEDSKVFESGGVEGSYAHYIEHHLGPELGHFKKFEFSDYEIDAEVDLPYAFTTETYIYTIVLNPDEKGESRTIKNKGVATSILKKMDGKWKIIKKHSSSRNCQ

SEQ ID NO: 21977 - DNA, 975 bp, Unknown
  Obtained from environmental sample
  misc_feature (1)..(975): n is a, c, g, or t
gtggaaaaagggcggaaaatggctgggacatttttaaatggaagcaggagcatttttccataccctgaagccataaaatatttggctaaaaagtccaatatagaaatcgaggagactgagcgtacagatgaagaaaaagcgcaagccgatacgcgagaaagtttgtatttggttagtgagtatgctaattcgtattttcaaaaaatcctccataaaaccgaccaaggaaaagccataggcttaagttactttaaagaacgtggttttactgaagaaactattaagaaatttgagttgggatactctttagatgagtggcaagcgtttacagatgatgccttgcgtaaggcgtataagttagagtttttagaacaaacaggcttaaccattgtaaaaggagaaaaacgtttcgataggtttaagggtagggttatgtttcctattcatagtatgagtggtcgtattttaggatttggtggtcgtatattagtcaatgataaaaaagctgcaaaatatctaaattcaccagaaagcgaaatctaccataaaagtaaaattttatatggattatatcatgctaagcaaagtattgctaaggaagataattgttatttagttgaagggtatacagatgttattcagtttcatcaaaccggaattaccaatgtggtttcatcttctggtacagctttgtcaccagatcaaatacgtttaattaatcgtttaacaaataatattacggtgctttttgatggtgatgcagccggaattagagcttcgattcgtggtatcgatttaatcttagagcaaggtgttaatgttaaaatctgtacatttccagatgatgaagatccagatagtttttcaagatcaaacaccttagaagaactcacggcatatcttgaagataatgctaaagattttattcagtttaaagcctcgctattggttaaggaagcaaataatgatccataa

SEQ ID NO: 21978 - protein, 324 aa, Unknown
  Obtained from environmental sample
  DOMAIN (201)...(280): Toprim domain
  misc_feature (1)..(324): Xaa is any amino acid
MEKGRKMAGTFLNGSRSIFPYPEAIKYLAKKSNIEIEETERTDEEKAQADTRESLYLVSEYANSYFQKILHKTDQGKAIGLSYFKERGFTEETIKKFELGYSLDEWQAFTDDALRKAYKLEFLEQTGLTIVKGEKRFDRFKGRVMFPIHSMSGRILGFGGRILVNDKKAAKYLNSPESEIYHKSKILYGLYHAKQSIAKEDNCYLVEGYTDVIQFHQTGITNVVSSSGTALSPDQIRLINRLTNNITVLFDGDAAGIRASIRGIDLILEQGVNVKICTFPDDEDPDSFSRSNTLEELTAYLEDNAKDFIQFKASLLVKEANNDP

SEQ ID NO: 21979 - DNA, 639 bp, Unknown
  Obtained from environmental sample
  misc_feature (1)..(639): n is a, c, g, or t
ttggttgaaggtgattatcagtcagttatgccattgcccaaaagaaaaaaatatggcattcattatatttatcaaccaccatggacacagcaattgggagttttttcactcgaaactatcaatgaatttgatgtgctgaagttcgtaaaaaaaatccctaaaaaatttagattaattgatatttttttgaattcggataattttataagttctcaacgaattaagatgagagacaattttatattgtcgttagataagtcgtatgaatcattacaaaaacaatacagtaagggtcgtaaaagtagttgcaagcaagccaaacaatataatttagagctcattgaaggttatgatcataataaaattattttactctttaaacaaaataagggctccgaattgaacaaacattattctgattatctggttttggctaaattattcgaacatgttttacaattgaaacatgctaaaactatggctgtcgttaatagtaataaggaattaattggaggggcattgtttttaaaagataatcatagaatcacctatttgttttccgcaataaataatgaaggaagagaaaaacaagccatgtcatttttattagactacctcattaagaagatgctaacctga

SEQ ID NO: 21980 - protein, 212 aa, Unknown
  Obtained from environmental sample
  misc_feature (1)..(212): Xaa is any amino acid
MVEGDYQSVMPLPKRKKYGIHYIYQPPWTQQLGVFSLETINEFDVLKFVKKIPKKFRLIDIFLNSDNFISSQRIKMRDNFILSLDKSYESLQKQYSKGRKSSCKQAKQYNLELIEGYDHNKIILLFKQNKGSELNKHYSDYLVLAKLFEHVLQLKHAKTMAVVNSNKELIGGALFLKDNHRITYLFSAINNEGREKQAMSFLLDYLIKKMLT

SEQ ID NO: 21981 - DNA, 552 bp, Unknown
  Obtained from environmental sample
  misc_feature (1)..(552): n is a, c, g, or t
atggtaggattagccaagcgtattttaacttttacatctaataatttaaatcaattagggaagttgtctgttaatgatttaactcaatttaaaggaataggagaggccaaagccattgccataataactgccctagaattgggtaggagacgtcgattagaagaagcattggaaagacctaaagttgggagtagtaaggcagtatacgaaataatgcaaccaatactcggtgagctaaaccacgaagaatttggggtgttgtatttaaataattctaataaaattatacataaaaatcagctaagcagtggaggtattacaggtactttggtagatattagaatattgtttaaaaaagcgctcgagctatcatcggttgccgttatattatgccacaatcatccttctggaagtttaaaaccaagtaaatctgaccttgatcttacaaaaaaaatacagcaggctggtaaaagtttagatattaaaattttagaccatttattaattactgaaaaagcgtactttagctttgccgatagtaatttgatataa

SEQ ID NO: 21982 - protein, 183 aa, Unknown
  Obtained from environmental sample
  DOMAIN (59)...(183): RadC, DNA repair protein
  misc_feature (1)..(183): Xaa is any amino acid
MVGLAKRILTFTSNNLNQLGKLSVNDLTQFKGIGEAKAIAIITALELGRRRRLEEALERPKVGSSKAVYEIMQPILGELNHEEFGVLYLNNSNKIIHKNQLSSGGITGTLVDIRILFKKALELSSVAVILCHNHPSGSLKPSKSDLDLTKKIQQAGKSLDIKILDHLLITEKAYFSFADSNLI

SEQ ID NO: 21983 - DNA, 369 bp, Unknown
  Obtained from environmental sample
  misc_feature (1)..(369): n is a, c, g, or t
atgcctatttatgggcaaatacagtcttttgatgtcactaatatactgattgttgttgttagatattttggaggtgttaaacttggtgttggaggcttaattaatgcctacaaaactggagctcaaatggctttggaagcttcaaaaattgtaacacgaaccataaatattaaataccttattagttttgactacaaaaacatgaataaggtcatgcgtgttattaaagagaaaaacttaaaagttatcaaccaaaaattagaactagactgccaaatcacgatctctgttagaaaaaaagaggcgcaaactatttttgaaatttttgatacaatttacgaggttaaaatcaaagatttagctatttaa

SEQ ID NO: 21984 - protein, 122 aa, Unknown
  Obtained from environmental sample
  DOMAIN (1)...(46): Uncharacterized protein family UPF0029
  misc_feature (1)..(122): Xaa is any amino acid
MPIYGQIQSFDVTNILIVVVRYFGGVKLGVGGLINAYKTGAQMALEASKIVTRTINIKYLISFDYKNMNKVMRVIKEKNLKVINQKLELDCQITISVRKKEAQTIFEIFDTIYEVKIKDLAI

SEQ ID NO: 21985 - DNA, 597 bp, Unknown
  Obtained from environmental sample
  misc_feature (1)..(597): n is a, c, g, or t
atgattaaaaccctaatatttgattttggagatgtctttattaatttagataaagaaggtgcaatgaccaacgctttagagctgtttgacgttgatgagttatccgaagaaatcgtcgcttttaatagtttttacgaacaaggtctgatagacactaacgagtttatagatttttacatgggtaattttccaaaattatccaaacaacaaatcgttgaagcttggaactacattatttgtgattttcccgtcaaacgattagagtttatacaacaattagcaaaagacaaaaagtacaatctaatattactaagtaatactaatgagttacatattgattgtattaaaaatcaggtatcgttttatgacgaatttaaaaatgcgtttgataaattttacctttcacacgaaatacaattgtgtaaaccaaacaaagatatttttcagtttgtactaaatgaaaacaacctaaaaccagaggaatgcctgtttatagatgatacttctgaaaacacagaaactgctagtaatttaggtattaacgtatggaataacaatccaaaaacagaagatattatagatttatttaccatctaa

SEQ ID NO: 21986 - protein, 198 aa, Unknown
  Obtained from environmental sample
  DOMAIN (2)...(188): haloacid dehalogenase-like hydrolase
  misc_feature (1)..(198): Xaa is any amino acid
MIKTLIFDFGDVFINLDKEGAMTNALELFDVDELSEEIVAFNSFYEQGLIDTNEFIDFYMGNFPKLSKQQIVEAWNYIICDFPVKRLEFIQQLAKDKKYNLILLSNTNELHIDCIKNQVSFYDEFKNAFDKFYLSHEIQLCKPNKDIFQFVLNENNLKPEECLFIDDTSENTETASNLGINVWNNNPKTEDIIDLFTI

SEQ ID NO: 21987 - DNA, 639 bp, Unknown
  Obtained from environmental sample
  misc_feature (1)..(639): n is a, c, g, or t
atgaagaaaataatgctagttctaggtattcttattgttgtttttatggcgttattgtattggtcagtaatgagtacaaacaataaaaataagcagggaatattaataaatagcgatactttagaaactacagatttcaaaacctacgattcggtggttattgccgctagtacattatataaaggcagccctataaaaaacgtaatgcaaggggagcaatacagaaaagcgtgggaaactcctataaaagtgcctgtagtttatttagatacattatttggagggctaaccataactaaagaaggtggcggtaagcaaacacattccctaaaattacagagtaaaaataacattcaatacacattacgaagtataaacaaagatcctgaagctttaattccagatttactaaaaattcttagtttagaaaatatcgtagtcgatggaatttctgcgcaaaacccctatggcgccatattaggtgcggaattagcaacgtcgggcaaaatatttttctacgcaaccaaaaatcgttttattcctaaacaagaacgtttaagagagcactacattgaaagttttgtaacagggtcttctcctagaatacgaactgaaatgctacccatggtccgatcctaa

SEQ ID NO: 21988 - protein, 212 aa, Unknown
  Obtained from environmental sample
  SIGNAL (1)...(16)
  misc_feature (1)..(212): Xaa is any amino acid
MKKIMLVLGILIVVFMALLYWSVMSTNNKNKQGILINSDTLETTDFKTYDSVVIAASTLYKGSPIKNVMQGEQYRKAWETPIKVPVVYLDTLFGGLTITKEGGGKQTHSLKLQSKNNIQYTLRSINKDPEALIPDLLKILSLENIVVDGISAQNPYGAILGAELATSGKIFFYATKNRFIPKQERLREHYIESFVTGSSPRIRTEMLPMVRS

SEQ ID NO: 21989 - DNA, 573 bp, Unknown
  Obtained from environmental sample
  misc_feature (1)..(573): n is a, c, g, or t
ttgacaccaatgaagtcttggaagctgcggtacaaaatggaatttttacctttcaaaccaggattagttggagggcattgtattggtgttgacccctattatttagctcaaaaagctatggagttagggtacaatcctgaaattattttggcggggagacgtttaaatgacagtatggggccttttgtttcacaagaaacagtaaaaatgatgatcaagaaagggatccctattaaagatgcgaatgtattagtattgggtattacttttaaagaggattgccctgacattagaaattcaagagctattgatatcgttagagaactagagacctataatgttaatgttgacgtttatgatccatgggcaacagtttctgctgtgaatcatgaatatggcatcgaccttttatcatctaaaaaggatattacaaaaaaatatgatggtattatcattgctgtttcccacaaggagttcatagagttagatctcaatgattatgttgtagataagcatattatttttgatgtgaaatctaccttgtcaaaagaaaaatctcatgggaggttataa

SEQ ID NO: 21990 - protein, 190 aa, Unknown
  Obtained from environmental sample
  DOMAIN (6)...(61): UDP-glucose/GDP-mannose dehydrogenase family, central domain
  misc_feature (1)..(190): Xaa is any amino acid
MTPMKSWKLRYKMEFLPFKPGLVGGHCIGVDPYYLAQKAMELGYNPEIILAGRRLNDSMGPFVSQETVKMMIKKGIPIKDANVLVLGITFKEDCPDIRNSRAIDIVRELETYNVNVDVYDPWATVSAVNHEYGIDLLSSKKDITKKYDGIIIAVSHKEFIELDLNDYVVDKHIIFDVKSTLSKEKSHGRL

SEQ ID NO: 21991 - DNA, 810 bp, Unknown
  Obtained from environmental sample
  misc_feature (1)..(810): n is a, c, g, or t
atgacactattaataaggcttatttttactaaaagagttgaaatgaaatctattttattagttgaagatgatattgctttctcacaaatgttgaagcgttttttagagcgacataaatttaatatcgtgttatcgcattccattgcgcattccaaaaccttaataaaaacagagcagttcgatttaatctttaccgatttaagacttcccgatggcgatggtatttctttactagacgatgttaaacacaacgaaaaactaacgcctgtggttttaatgacgagttacgctgaagtaaccacagcagtaaaagcaatgaaaaatggtgctttcgattatatttcgaaaccatttaatccagacgaattactggagataattaaaaatgctttagaggaaaatcctaaaaaaactgaagaagatgttttagaatctaaattaaaggatactattaaaaagcaaatttcacaaaatagtaaaaacgaatcctctgtttccaattctcaatttattaaaggcattagtaatgcttctaaaaaattatatgaatatatcgatttggtagcaccaacagatatgtctgtgcttattactggcgaaagcggaacaggaaaagaagttgtagcaaaatctattcatttacaaagttcccgaagtgatgctccttttatagccgtagattgtggtgctattcctaaagaaatagcgtctagcgagtttttcggacataaaccaggctcatttacgggcgcctttaatggatacactcagccctttggaagcggccacaaaggacccctttttggatga

SEQ ID NO: 21992 - protein, 269 aa, Unknown
  Obtained from environmental sample
  DOMAIN (171)...(268): Sigma-54 interaction domain
  misc_feature (1)..(269): Xaa is any amino acid
MTLLIRLIFTKRVEMKSILLVEDDIAFSQMLKRFLERHKFNIVLSHSIAHSKTLIKTEQFDLIFTDLRLPDGDGISLLDDVKHNEKLTPVVLMTSYAEVTTAVKAMKNGAFDYISKPFNPDELLEIIKNALEENPKKTEEDVLESKLKDTIKKQISQNSKNESSVSNSQFIKGISNASKKLYEYIDLVAPTDMSVLITGESGTGKEVVAKSIHLQSSRSDAPFIAVDCGAIPKEIASSEFFGHKPGSFTGAFNGYTQPFGSGHKGPLFG

SEQ ID NO: 21993 - DNA, 390 bp, Unknown
  Obtained from environmental sample
  misc_feature (1)..(390): n is a, c, g, or t
atgcataataaaaaaaagcctaatacaataattaatgctatgtgtaaaattgaaaatgacgaagaatttcgctcctttacagtacctaaagtagttgttagtcagtctaataagcttttatatatgagccgatcacctatcccacttagtaaaactaatgggtttcatttttcatttaaacaagtatgtatctatgccttttcaaaagagcatttagagtttttggcatctcatcaatataaaacgcctacagaagaagttgaagatattgaaattattcgttttttagagaacgatctagaagtaagcatgatcgaagttgatgcaacttcaattgctatggattttccttcggatgtgaacaaagtaattgaaaaattaaaattataa

SEQ ID NO: 21994 - protein, 129 aa, Unknown
  Obtained from environmental sample
  misc_feature (1)..(129): Xaa is any amino acid
MHNKKKPNTIINAMCKIENDEEFRSFTVPKVVVSQSNKLLYMSRSPIPLSKTNGFHFSFKQVCIYAFSKEHLEFLASHQYKTPTEEVEDIEIIRFLENDLEVSMIEVDATSIAMDFPSDVNKVIEKLKL

SEQ ID NO: 21995 - DNA, 657 bp, Unknown
  Obtained from environmental sample
  misc_feature (1)..(657): n is a, c, g, or t
atgcttaaacaattaaaacaagctttatttcaagttttagaatctagtcagaaaaagatagattttaaaaatgtaaattacctaccaaggtgggcaatactttgttttgatagtttcattttagtaatttctttattttttactaagattattgtaagtaaaattaaaaatgcagctttttttaatttaggattttcaaaagaggagcttctaatagttgtaattaatgtcttattttttatactatttaggacttatgctggccttataaggcactcaacttttattgatgctgctaagtttttcctagcgtctttagctaccttgctttcatccttagcattatactacggttatttttatttggttggtgacgagttgttttcaattcctcaactgtttatatattccatcgtatctttttgtggtttatttttatttaggattttggttaaacaggtctttgaagtttaccaacgttacaatgatgatgaatcacgactaaatgttttaatttatggtaccagtgaaaatgcaatagcaatagcaagtgcattaaaatcggaaaaaccttcgcgatacaaggttttaggatttattgataaggatggtaaaaataaaagtaaagaaatattaggtctaccaattatttattaa

SEQ ID NO: 21996 - protein, 218 aa, Unknown
  Obtained from environmental sample
  misc_feature (1)..(218): Xaa is any amino acid
MLKQLKQALFQVLESSQKKIDFKNVNYLPRWAILCFDSFILVISLFFTKIIVSKIKNAAFFNLGFSKEELLIVVINVLFFILFRTYAGLIRHSTFIDAAKFFLASLATLLSSLALYYGYFYLVGDELFSIPQLFIYSIVSFCGLFLFRILVKQVFEVYQRYNDDESRLNVLIYGTSENAIAIASALKSEKPSRYKVLGFIDKDGKNKSKEILGLPIIY

SEQ ID NO: 21997 - DNA, 837 bp, Unknown
  Obtained from environmental sample
  misc_feature (1)..(837): n is a, c, g, or t
ttgagtttgactcggctcgagattatgattaaccaacggaaacaagggtctaaaacttggtatttttctgctaatccaaatggagaagctgaggtagtttctattagtttacgtcaggttggtagtattaaaaagttaaaatgggatttagattttgcggatattttaattaaaggtcgtgcgtctaaaggtaacgtggtgactaaacatcctattaaatctgtagagttaaaagaaaaaggaatttcgactttaaagccaagaaaaatatggtttgacgacactgtacagcgtttaaatgttgacggtagaggtgagttggttggcgagtttagaggagaggataaactgttaataataaatcaaaaaggtatagtaaaaacggttactccagaggtaacgcttcattttgataatgatatgattgtcatggaaaaatggttgcctaaaaagcctgtatctgctatttattatgatggagaaaaggagcgatactatgttaagcgttttttaattgaaaatgaaaacaaagaagaatcctttattacagatcatcctaattcgcaattagaaattgtatctacagactggaaacctgttgccgaaattgtttttgctaaagaaagaggtaaagatagaaaggataacgaagaagtgaatttggaagagtttatcgctattaaagggatttctgctttaggaaaccaactaactaaagacaaagtaaatgccattaatttattagagcctattccttatgaagctccagaagaaactccagcagaagacatagaagtgaaggaggaggaaaatatctctaaaaaaaccagaatctaa

SEQ ID NO: 21998 - protein, 278 aa, Unknown
  Obtained from environmental sample
  misc_feature (1)..(278): Xaa is any amino acid
MSLTRLEIMINQRKQGSKTWYFSANPNGEAEVVSISLRQVGSIKKLKWDLDFADILIKGRASKGNVVTKHPIKSVELKEKGISTLKPRKIWFDDTVQRLNVDGRGELVGEFRGEDKLLIINQKGIVKTVTPEVTLHFDNDMIVMEKWLPKKPVSAIYYDGEKERYYVKRFLIENENKEESFITDHPNSQLEIVSTDWKPVAEIVFAKERGKDRKDNEEVNLEEFIAIKGISALGNQLTKDKVNAINLLEPIPYEAPEETPAEDIEVKEEENISKKTRI

SEQ ID NO: 21999 - DNA, 504 bp, Unknown
  Obtained from environmental sample
  misc_feature (1)..(504): n is a, c, g, or t
atgcacaatttaggaattttcacagggagagacttaaaagaaaaatcgttaacgttttggactaaacattttaaaaaatcggggagccattattttaacatagttagaggaatacaacatagcgttgttaaaccagataggatacgaaaatcagtagcaactgagcatacatttaatacaaaccttacttcagagatctatatgctggaaaaacttgaacatatagctacagaattggaaattcgcctgaaaaaatcaaaaatcttaggtaaaaccattaccttaaaaattaagtatagtgatttttcattgcagaccagaagtaaaacgttgcaatttttttttaatgataaagaaatattgctcaaagtgaccgaagagcttttatttcaagaaaaaatgaacgactctgttagattattaggaatatctcttacaaatttaaatacgaatctaaaatatacagaggaggcttttgatatacaattaaaattggagttttaa

SEQ ID NO: 22000 - protein, 167 aa, Unknown
  Obtained from environmental sample
  misc_feature (1)..(167): Xaa is any amino acid
MHNLGIFTGRDLKEKSLTFWTKHFKKSGSHYFNIVRGIQHSVVKPDRIRKSVATEHTFNTNLTSEIYMLEKLEHIATELEIRLKKSKILGKTITLKIKYSDFSLQTRSKTLQFFFNDKEILLKVTEELLFQEKMNDSVRLLGISLTNLNTNLKYTEEAFDIQLKLEF

SEQ ID NO: 22001 - DNA, 603 bp, Unknown
  Obtained from environmental sample
  misc_feature (1)..(603): n is a, c, g, or t
atgttgcaacaatccactgtaaacaaggccatacaaaggcttagaaaggttgtgaagcatgctgtaacagaggattatttagttaaaaacccattcacttcttataggtataaaacagtaaaaaaagatattatttttttatctgctgaagagttaaaaaggttagaagaatctgactttaaaatagaaagactaaatcaagttagagactgttttgtattctgttgttatactgggttagcctttaaagaaatgtccaatttgaagaaggataatattatcttaggcattgatggattggattggataaaaattaaaaggcagaaaactaattctgttgtttcaataccattactaccaaaagcaaaagcaattctagataagtataatcacattttaccagtagtgagcaatcagagatttaatggctatttaaaggagatagcagacctttctgggattgataagaatctaacacatcatattgccagaaagacctttgctacaactatattgctttataatgatgtccctatggaaattgtatctaaattattaggtcattctaggatggggattacaaagcttattatgggaagataa

SEQ ID NO: 22002 - protein, 200 aa, Unknown
  Obtained from environmental sample
  DOMAIN (39)...(199): Phage integrase family
  misc_feature (1)..(200): Xaa is any amino acid
MLQQSTVNKAIQRLRKVVKHAVTEDYLVKNPFTSYRYKTVKKDIIFLSAEELKRLEESDFKIERLNQVRDCFVFCCYTGLAFKEMSNLKKDNIILGIDGLDWIKIKRQKTNSVVSIPLLPKAKAILDKYNHILPVVSNQRFNGYLKEIADLSGIDKNLTHHIARKTFATTILLYNDVPMEIVSKLLGHSRMGITKLIMGR

SEQ ID NO: 22003 - DNA, 471 bp, Unknown
  Obtained from environmental sample
  misc_feature (1)..(471): n is a, c, g, or t
ttggtaatattaaattatataatggttttatatatctgtgttgttccaaaaatgagaaaaatccatttaatattattaatcttaataaccgtaacaagttgtaaaacttttgattacaaaagtagatttgaagaaaaatatataggcaatccaaaaaaaatccaaatcacattttatgatgtaattgaaattgatgacactataaaaaaaggaaaaatgaaatattcagaaatttcattctttgataaaaaaaatagaatattcaaagattatagtatcaattctaaaggagatacaatcggaaaaaaatgtgaacgactatttaataaaaaagaacttactatcaaaagcgtttgttatacagattctactgaaaatatcctttctatttataagttacataagaatttcaaaaaaagcacatttgaattttatcgtaacaataaattatcntggaaaaagaatttttga

SEQ ID NO: 22004 - protein, 156 aa, Unknown
  Obtained from environmental sample
  misc_feature (1)..(156): Xaa is any amino acid
MVILNYIMVLYICVVPKMRKIHLILLILITVTSCKTFDYKSRFEEKYIGNPKKIQITFYDVIEIDDTIKKGKMKYSEISFFDKKNRIFKDYSINSKGDTIGKKCERLFNKKELTIKSVCYTDSTENILSIYKLHKNFKKSTFEFYRNNKLSWKKNF

SEQ ID NO: 22005 - DNA, 729 bp, Unknown
  Obtained from environmental sample
  misc_feature (1)..(729): n is a, c, g, or t
ttgacagttttagattttgttggaaactcaaaacctgaatacaactttgaaagcaagtttagagctttaataggtaaaacaaatacaactattttaaaagaaattgaggacgattttcctcatctacctttaggttgctctatcattttagagaaaaaaacaaaagaaacaatacttaaaaatatttcagctgcaacctcattaaataagaataagttaattcaaagaatacagcaatatcaaaacgacactaatttaccattaacaataggtaacttttgctcgttttataatatacctctacaatcaatatacaaaagagaaagctggaagcgtttatgtcaattagcaggaagaatagaaaacttcaattctgaaaatgagaaagctattgtttcagctatttcaaacaaatggttatctacaaattcactcagttatttttctttcattttaaaaattgcaaaacagaattttaaggtgacaatttcagaattgaatgaaaatgaaaaaaccatgcttctaatgttgcattacgatgtttggcagaaagaagaaggtttcgattctttagaaaaaagtattctccaaattggaaataatcttgttctagtcgaagaaataaaggaaattctagaatttttaattgataatatagacttcaaagaattaccgattaaacttccatatgaacaaccattaaaattacatagtcgttatacaagaann

SEQ ID NO: 22006 - protein, 243 aa, Unknown
  Obtained from environmental sample
  misc_feature (1)..(243): Xaa is any amino acid
MTVLDFVGNSKPEYNFESKFRALIGKTNTTILKEIEDDFPHLPLGCSIILEKKTKETILKNISAATSLNKNKLIQRIQQYQNDTNLPLTIGNFCSFYNIPLQSIYKRESWKRLCQLAGRIENFNSENEKAIVSAISNKWLSTNSLSYFSFILKIAKQNFKVTISELNENEKTMLLMLHYDVWQKEEGFDSLEKSILQIGNNLVLVEEIKEILEFLIDNIDFKELPIKLPYEQPLKLHSRYTRX

SEQ ID NO: 22007 - DNA, 444 bp, Unknown
  Obtained from environmental sample
  misc_feature (1)..(444): n is a, c, g, or t
atgtttgttttctatgacatagagtatttatgcttgctacataaacttcagcaattacaagttattgctgaagataattatgaaatatacataccactacttcaattagagaattatagtggtgatattaagcttgatatacagcaatgtcataataaagggtttttaaaatttatatatgatgatgacaatggatttctaccttttttaaataagcatgaattaaacaacagctttttcggcactggttttttatatcaattgtattgttgtatgaatagggatttaattttaatcattgacaatcataatatagcccaggtgcaattatgtaacaagttaaaaataaaaacaattactgtagaagatttcacaaaaacggtaattaaaaatgaacagtattataattttttaatggcaaataaagataaagtaattatataa

SEQ ID NO: 22008 - protein, 147 aa, Unknown
  Obtained from environmental sample
  misc_feature (1)..(147): Xaa is any amino acid
MFVFYDIEYLCLLHKLQQLQVIAEDNYEIYIPLLQLENYSGDIKLDIQQCHNKGFLKFIYDDDNGFLPFLNKHELNNSFFGTGFLYQLYCCMNRDLILIIDNHNIAQVQLCNKLKIKTITVEDFTKTVIKNEQYYNFLMANKDKVII

SEQ ID NO: 22009 - DNA, 711 bp, Unknown
  Obtained from environmental sample
  misc_feature (1)..(711): n is a, c, g, or t
atgcaacccagnnaaacgtttgatgaaaagttgctagaacagctttcggaaagtattgagaagcacggcgtactacaacctattacggtaaggaaatcccnnaaagattatatcatcgtaatgggcgagcgtaggtatcgtgccagtaagttagctggcaagaaaacgataccctgtattgtaagaacgtataaggacgatgatgttctggaaattcaaatcattgaaaatctacaaagacaggatgttgaacctaccgaagaggccgaagcaattgcctttctgagtgaaaagtatgcacctgctgaaattgcaaagcgattgggcagaacagacaactttataagacaacgcctaaagttagcaggattgatagagggctttaagcactttgtacgaaatggcgaaatgaccatatccttgggcgtaggtgtagcgctctttgaaccagaagaacagcagatgatgttggaaactatgggcgaggattttaatgcacatcagataaacaggatgattaaagaccagacctacgatttggaaaaagcatcctttgatgtagccgataaaaaattggtcccaaaagcagggtcttgtgtagaatgtcctttcaatgctgcaaatcaaggtaatctgttcggcgaaggaaaaatggtctgtacaaaatcagcctgttttgaaactaagaaaagtaaatcgttcttaacctga

SEQ ID NO: 22010 - protein, 236 aa, Unknown
  Obtained from environmental sample
  DOMAIN (1)...(78): ParB-like nuclease domain
  misc_feature (1)..(236): Xaa is any amino acid
MQPXXTFDEKLLEQLSESIEKHGVLQPITVRKSXKDYIIVMGERRYRASKLAGKKTIPCIVRTYKDDDVLEIQIIENLQRQDVEPTEEAEAIAFLSEKYAPAEIAKRLGRTDNFIRQRLKLAGLIEGFKHFVRNGEMTISLGVGVALFEPEEQQMMLETMGEDFNAHQINRMIKDQTYDLEKASFDVADKKLVPKAGSCVECPFNAANQGNLFGEGKMVCTKSACFETKKSKSFLT

SEQ ID NO: 22011 - DNA, 453 bp, Unknown
  Obtained from environmental sample
  misc_feature (1)..(453): n is a, c, g, or t
atgcactctagatatttcattattttacttttagtactatttacaattaatagttttagtcaaactacaattattgatagtattacaaaaaatggcgtctcgtttgcaacagtttcatttggaaacggaaatggaatatttgctgatgacgatggtaaatttttcttcactaaaaagctatattcagatatcgattcgcttttcgtttcagcattaggatacaaagacgttaagctggcttcaaaaacactaaaagacaccctttatttaacaccacaatctgaccttttagacgaggttatcgttactgctaaaccttcaggaaaacacaaagaaattacactaaaaccaacatcacatgacgactattataaatgttggttaccaactattgaaagtgaaattgctgtatttttccctaacacagacaacaaaccaaagcatgtcacctaa

SEQ ID NO: 22012 - protein, 150 aa, Unknown
  Obtained from environmental sample
  misc_feature (1)..(150): Xaa is any amino acid
MHSRYFIILLLVLFTINSFSQTTIIDSITKNGVSFATVSFGNGNGIFADDDGKFFFTKKLYSDIDSLFVSALGYKDVKLASKTLKDTLYLTPQSDLLDEVIVTAKPSGKHKEITLKPTSHDDYYKCWLPTIESEIAVFFPNTDNKPKHVT

SEQ ID NO: 22013 - DNA, 582 bp, Unknown
  Obtained from environmental sample
  misc_feature (1)..(582): n is a, c, g, or t
ttgggctatgtaaattggaataattcttataaaaataaagccataaaaaaactattaaagcaaaataaaaccatgtgtacaggttatgcctatttaattaaagagttgtgctttttggctaatatagaatgtaaaataattaatggttatggacgttccacaaccactaatgtagataccttacagttagttaaccattcttggaatgcagttaagttaaacgacaaatggtatttatgcgatgctacttggtctagtggttattttataaatgatgtctttataaaagactataatttaggttactttttaactgaacccatactatttgccaaaaaccattatccaattaataaaaaatggttactggatagcactttaatagcaagtgattatcaagcatctccaatggtttatggtaaaacgttttcacatcaaatcattccctattaccctgtcaaatctgaataccaccataaaaggaacgatgttataattttacgcttaaaattccagatgcgctctatatcaggatgtccctttatagaatatctggctttaaggactactcgcgatttgtaa

SEQ ID NO: 22014 - protein, 193 aa, Unknown
  Obtained from environmental sample
  misc_feature (1)..(193): Xaa is any amino acid
MGYVNWNNSYKNKAIKKLLKQNKTMCTGYAYLIKELCFLANIECKIINGYGRSTTTNVDTLQLVNHSWNAVKLNDKWYLCDATWSSGYFINDVFIKDYNLGYFLTEPILFAKNHYPINKKWLLDSTLIASDYQASPMVYGKTFSHQIIPYYPVKSEYHHKRNDVIILRLKFQMRSISGCPFIEYLALRTTRDL

SEQ ID NO: 22015 - DNA, 699 bp, Unknown
  Obtained from environmental sample
  misc_feature (1)..(699): n is a, c, g, or t
gtgtttaactttggagtagcncatctggtcaagacaaagacaacaagaaaaaccaaatgttataaaagaagatatcgcagtataaaaatgatacaaagcataataaaaggaataaacggatactctgggccattggcattaatntcaaaacttaaactttggaagtatttttttattcctattgttattagtattctaactgcaactatcattggttttactgcttatggactatccgataatattggacagtttatcgcaaaaatttggttttgggaatggggtaaacaaacctttacaactatatctacagtgcttggagctataattattatagcattaggcataatcctttacaaacacattattatggcattatcggctccatttatgagtcctgtgtcagaaaaaatagaaacgcatttaactggtatagttaaacacaatcacagaaaaacatcgtttcaagagcaactttggcgtgggattagaattaacatcagaaatttaggtcgcgagctactaattaccattccaattttacttcttaaatttattcctgtaattaatatcttttctacagcattattaataatcatacaatcctattatgctggttttggtaatatggattacaccttggagcgtcattttaattacaaagacagtgtaaaatttgttagagctaatcgtgactag

SEQ ID NO: 22016 - protein, 232 aa, Unknown
  Obtained from environmental sample
  misc_feature (1)..(232): Xaa is any amino acid
MFNFGVAHLVKTKTTRKTKCYKRRYRSIKMIQSIIKGINGYSGPLALXSKLKLWKYFFIPIVISILTATIIGFTAYGLSDNIGQFIAKIWFWEWGKQTFTTISTVLGAIIIIALGIILYKHIIMALSAPFMSPVSEKIETHLTGIVKHNHRKTSFQEQLWRGIRINIRNLGRELLITIPILLLKFIPVINIFSTALLIIIQSYYAGFGNMDYTLERHFNYKDSVKFVRANRD

SEQ ID NO: 22017 - DNA, 330 bp, Unknown
  Obtained from environmental sample
  misc_feature (1)..(330): n is a, c, g, or t
ttggtgcgcaaatacaattttattgcactcatatcgggtatagactttattgctttagaaacaaatttcacaaattataagccttactttgatattcctaataatgagaaaaactatttagatataatttataaaaatgtatttctttctaataggaatcaaacagttgacgttggtatagtttttaaggaagaacttatttcaaatgaaataatttttacaccaagtatagagcacatcaaagatttgttgaagtataatgccaataaaattatagaaaatgaaggtaaagcctttgaaaatgaagagaaattaaaagatttaatttaa

SEQ ID NO: 22018 - protein, 109 aa, Unknown
  Obtained from environmental sample
  misc_feature (1)..(109): Xaa is any amino acid
MVRKYNFIALISGIDFIALETNFTNYKPYFDIPNNEKNYLDIIYKNVFLSNRNQTVDVGIVFKEELISNEIIFTPSIEHIKDLLKYNANKIIENEGKAFENEEKLKDLI

SEQ ID NO: 22019 - DNA, 960 bp, Unknown
  Obtained from environmental sample
  misc_feature (1)..(960): n is a, c, g, or t
atgaacaagggacaactgcatttaggaatgattatcgagattacaagggaaattcatttggctcacatacatcaatgggacgatgaagcaaaaggaaaagcaccatggcattgtgttattattggttttgcaagttatgatattaaggatgaatatctttgtgaatatgatgatataaaaggagaaccacatcaaaaaaaggtgaaaaacagaaatccttatttagtggaggcaaatgatttagttatactaaaacgacgtcaacccatttgtaatgtttcaaatatttcttttggtagtatgccaaatgatggtggaaatttcttgtttactgatgttgaaaaagacaattttttagaattagaaccaaatgctgtaaattttataaaaccattaattagtgctcacgagtttttgaatggcaaaaatcgttggtgcttatggctaaaagatataaaaccaaacgaattaagagctttaaaagaagtccaaaaacgtgttgaaaatgttaagaatttacgtcaaagcagttcacgtgctgcaacccaaaaattagccgcattccccactttatttggagaaattaggcatatagaaagtgattatatacttataccccttcattcatctgaaaacagagcatacataccaatggggttaaaatcaaaggatgaaattgcaaataactcaaccagtattgtgcccaatgctagtttatacgaatttggagttttacaatctggtatgcatatgacttgggtaaaatatacttgtggcagaataaaaagtgatttcagatattcaaacgaaatggtttacaataactacccttggccaaaagaagtaattgaaaaaaaccaaaagaaagttgaagaaaaagcacaaaaagtgttagatataagagcagactttcctgatagtagtttggcagatttatgtactcctggagcgaattcttga

SEQ ID NO: 22020 - protein, 319 aa, Unknown
  Obtained from environmental sample
  misc_feature (1)..(319): Xaa is any amino acid
MNKGQLHLGMIIEITREIHLAHIHQWDDEAKGKAPWHCVIIGFASYDIKDEYLCEYDDIKGEPHQKKVKNRNPYLVEANDLVILKRRQPICNVSNISFGSMPNDGGNFLFTDVEKDNFLELEPNAVNFIKPLISAHEFLNGKNRWCLWLKDIKPNELRALKEVQKRVENVKNLRQSSSRAATQKLAAFPTLFGEIRHIESDYILIPLHSSENRAYIPMGLKSKDEIANNSTSIVPNASLYEFGVLQSGMHMTWVKYTCGRIKSDFRYSNEMVYNNYPWPKEVIEKNQKKVEEKAQKVLDIRADFPDSSLADLCTPGANS

SEQ ID NO: 22021 - DNA, 537 bp, Unknown
  Obtained from environmental sample
  misc_feature (1)..(537): n is a, c, g, or t
ttggagtacgacactaagcgcaaactaaataatcaaggcccgtatagcccaagtcatgttaaaggcgcgtcaatgcttggtgaggcgcagtggcaatggcttgaacaagagcttaaaaagcccgcggctataaagctaattgcctcaagcttacagctacttcccgattttacagggtgggagtcgtgggctaatttcccctacgatcgaaagcgtttatttacactgatcaaaaagcataaagtaaacggcgtagttattattagcggcgatacccactggggcgaaatttcacagtataagcacaaccttgactacccactaatagaaatgaccagttctggcctaaccgaaaaatggaaaaatgtaagccctaacacacaccgaataggggactttacccaccaggttaattacggcgatttaagcatagactggcaacaagccgacccgtcaatttcattacagctcaaagatattgatggtaaagcaataatgcaaagtcagtttaaactctcaagcattagcccttattaa

SEQ ID NO: 22022 - protein, 178 aa, Unknown
  Obtained from environmental sample
  misc_feature (1)..(178): Xaa is any amino acid
MEYDTKRKLNNQGPYSPSHVKGASMLGEAQWQWLEQELKKPAAIKLIASSLQLLPDFTGWESWANFPYDRKRLFTLIKKHKVNGVVIISGDTHWGEISQYKHNLDYPLIEMTSSGLTEKWKNVSPNTHRIGDFTHQVNYGDLSIDWQQADPSISLQLKDIDGKAIMQSQFKLSSISPY

SEQ ID NO: 22023 - DNA, 681 bp, Unknown
  Obtained from environmental sample
  misc_feature (1)..(681): n is a, c, g, or t
ttgaattttgaattgactaggagagtatccaaaatcaccagaaatgaacagattgatttgcttataggatttataacttcagcaaatataattgctacaattgctgcaaaattaaataacatcccttgtttaataagtgagcgcaataatccattaagcaattccataccaaaattctggttgattttgagaaaacatgtctatccaatggccaatcatttaattgtgcagacaaaaaatgtgaaacagatttatgtacccttagttaaatcgcgagacatttctattcttcccaatccactatcttcagaactatctctattaagaaatgaaactcatccacgagaaaacatcattctttcagtagggagactaactaacgataagcaacatcataaattaatcaatgcatttcataccttacagccagagggttggaaagttatgattattggagcgggtcctaaaaaggaaagtttaatagaacttataaagtctcatgacctaggagataaaattgaaattttgtcacatataaaggacattcataattattacaacaaagcatcactttttgtatttacttctaaatcagaaggttttcccaacgcgttattagaggcaatgcattttagtataccatgcatatcaacggattgctacttcggacgttcagattaa

SEQ ID NO: 22024 - protein, 226 aa, Unknown
  Obtained from environmental sample
  DOMAIN (103)...(226): Glycosyl transferases group 1
  misc_feature (1)..(226): Xaa is any amino acid
MNFELTRRVSKITRNEQIDLLIGFITSANIIATIAAKLNNIPCLISERNNPLSNSIPKFWLILRKHVYPMANHLIVQTKNVKQIYVPLVKSRDISILPNPLSSELSLLRNETHPRENIILSVGRLTNDKQHHKLINAFHTLQPEGWKVMIIGAGPKKESLIELIKSHDLGDKIEILSHIKDIHNYYNKASLFVFTSKSEGFPNALLEAMHFSIPCISTDCYFGRSD

SEQ ID NO: 22025 - DNA, 495 bp, Unknown
  Obtained from environmental sample
  misc_feature (1)..(495): n is a, c, g, or t
atgacagcaactcaaaatttgaaattgatctgtaaaattaagggagtgtcatatgataaaattgatgaaaaattaaaagtcgttaatttatatgaacgaagagatagcaaattcaaaaccttttcattaggaatgaaacaacgattggctatcgcttcggctttgttaaatgatccagaaattttaattttagacgaaccgacaaatggcctggacccccaaggcattcatgaaataaggcaaataattaaagatattgctatcaatggtactaccattttattggcttcccatttgctggatgaagtagaaaaagtttgttctcatgtagtagtgattagagaaggtattaaattatattcaggaagagttgatgaaatgacagcttctaaaggtttttttgagttacaaactgaaaatagtcaaggtaaattaacagatctattggataatcatgacgcaattagttccgttaagcaagaagaaggtaactaa

SEQ ID NO: 22026 - protein, 164 aa, Unknown
  Obtained from environmental sample
  DOMAIN (1)...(116): ABC transporter
  misc_feature (1)..(164): Xaa is any amino acid
MTATQNLKLICKIKGVSYDKIDEKLKVVNLYERRDSKFKTFSLGMKQRLAIASALLNDPEILILDEPTNGLDPQGIHEIRQIIKDIAINGTTILLASHLLDEVEKVCSHVVVIREGIKLYSGRVDEMTASKGFFELQTENSQGKLTDLLDNHDAISSVKQEEGN

SEQ ID NO: 22027 - DNA, 588 bp, Unknown
  Obtained from environmental sample
  misc_feature (1)..(588): n is a, c, g, or t
atgaaagtattagtaataggagccggaaacatgggtttaacttattctgaaggaatgataaattcttcattattaaataaacacaaattaagaatttttgataccgatcctaaaaaaattgaaactttaagacaacaacctaaatttaatgtttacacgtccttaacagattgcttaccacaggcagacattatttttttagcagtaaaaccctaccactgtgacgatctatttacagaaatgaggcgtatggtaaataaagagcaaatttttgtatctcttatggcaggagttactataaactccattcaaaaaggcttaggtataaaaaaagtgatcagaaccatgcctaatctaccagctaaggttggtaaaggtgtaacctcgtatactggtgacgcatccgtttctaaagtagagcttttaatgataagacatttattagatactacaggaacatcgattgaagttagtagcgaaaactttattgatgcctcaaccggaatttctggaagtggtcctgcttatgtattttattttatgcagtccatgttagaagctgctttaaaaatggcttttcgactatga

SEQ ID NO: 22028 - protein, 195 aa, Unknown
  Obtained from environmental sample
  DOMAIN (1)...(158): NAD-dependent glycerol-3-phosphate dehydrogenase N-terminus
  misc_feature (1)..(195): Xaa is any amino acid
MKVLVIGAGNMGLTYSEGMINSSLLNKHKLRIFDTDPKKIETLRQQPKFNVYTSLTDCLPQADIIFLAVKPYHCDDLFTEMRRMVNKEQIFVSLMAGVTINSIQKGLGIKKVIRTMPNLPAKVGKGVTSYTGDASVSKVELLMIRHLLDTTGTSIEVSSENFIDASTGISGSGPAYVFYFMQSMLEAALKMAFRL

SEQ ID NO: 22029 - DNA, 402 bp, Unknown
  Obtained from environmental sample
  misc_feature (1)..(402): n is a, c, g, or t
atgggtaagtacatcgcaaaccaaaccattaaagtaatgattaataatgataaaaaaataaagggagcaaaagtattaattctaggagtaacatttaaagaagattgcccagatatgagaaatacaaaggttgttgatattattaacgaattgaatacttttggatgtgatgtagatgtttatgatccttgggttaaacctgaagattttaataataactctaattttaaaattataaaaaatcctatagagcaagacgaaaagtatgacgctattgttgtagctgtagctcataaagaatttaaaaatttaaaagtaaacgactataataagttatccaaagaaactcctgtaattatagatataaaaggaatagtacaaaatcctagttggagactgtaa

SEQ ID NO: 22030 - protein, 133 aa, Unknown
  Obtained from environmental sample
  DOMAIN (26)...(128): UDP-glucose/GDP-mannose dehydrogenase family, UDP binding domain
  misc_feature (1)..(133): Xaa is any amino acid
MGKYIANQTIKVMINNDKKIKGAKVLILGVTFKEDCPDMRNTKVVDIINELNTFGCDVDVYDPWVKPEDFNNNSNFKIIKNPIEQDEKYDAIVVAVAHKEFKNLKVNDYNKLSKETPVIIDIKGIVQNPSWRL

SEQ ID NO: 22031 - DNA, 837 bp, Unknown
  Obtained from environmental sample
  misc_feature (1)..(837): n is a, c, g, or t
ttgaaaaaaattgatttacacatacatactgtcagtacaccgagcgataagaaatttacttttagtatggagcggatgaaatggtatgtagaagaggctaaattagacgccatcgcaattactaatcataatatgtttgatttagagcagttccgtataatccaacaacagcttgcagttaaagtctttccaggaattgaggtagatatagagggaactcaccttttagtaatagctgaagataatgagttaaatgactttaaaagtcgctgcgacatgattacagaactcatacctgataaatatacttcgattacatttgaagaattccatgaagtttttacaagcctttcaaattacctgttgatccctcattacaaaaagtccccagaaataaaagaggagacgctcaataagctgagagagcatgtaatgactggtgaggttacaagccctaggaagtttatttacagtattaaagatgcagatgcactcgtgcctgtatgttttagtgacttacgtgtagaagataaattaaatgttgttcctccaaggcatacatatattgatgttggggaaattacactcaaagctttaaagcttgcactatcagataagtataaagtacatctttcaaaagaagaagggcatcaattctttgaggcgttgaataatggcttgaaattatctacaggtttaaacgttgttctaggcgaacgttcgactggtaagtcacatacactcaatttaaatgcggagcagaatacaactgaagatgtaaaaattaagtatgttaggcagtttttctctgtttccgaagagatgaaaaaagattaa

SEQ ID NO: 22032 - protein, 278 aa, Unknown
  Obtained from environmental sample
  DOMAIN (4)...(70): PHP domain N-terminal region
  misc_feature (1)..(278): Xaa is any amino acid
MKKIDLHIHTVSTPSDKKFTFSMERMKWYVEEAKLDAIAITNHNMFDLEQFRIIQQQLAVKVFPGIEVDIEGTHLLVIAEDNELNDFKSRCDMITELIPDKYTSITFEEFHEVFTSLSNYLLIPHYKKSPEIKEETLNKLREHVMTGEVTSPRKFIYSIKDADALVPVCFSDLRVEDKLNVVPPRHTYIDVGEITLKALKLALSDKYKVHLSKEEGHQFFEALNNGLKLSTGLNVVLGERSTGKSHTLNLNAEQNTTEDVKIKYVRQFFSVSEEMKKD

SEQ ID NO: 22033 - DNA, 684 bp, Unknown
  Obtained from environmental sample
  misc_feature (1)..(684): n is a, c, g, or t
ttgagaagcaataaaaaaataattacagttacagctatggtcgcttttgtgtttttcttaccaataacaggtaatgcacaagaagtttatgttacgttgcccgttatttcaatgaatgaagcagtcaatttatcaaaagaaaattatccattattaaaacaaaagcaattagaaatcaacaaacaaaagcagttaaaaagtacagtttatgattttggtacaactcaaattttcacaggtggagaagagatcaataatggtaatggtatttacactactttaggaattggtcaaagtaacatcaatgtttttggtgtttctgcaaaaaagcgattgcaagagcaacatattcaattagctcaaaaagcgtttcaactttcagaattagatttagagttagaagtaaaaaaggcgtgggcaaatgtttttcagagtaaaaggaaatacaatttatacaaagaattagattccatttataccaactttgaaaaagctgtagctttaaattataaagtagaagcaatttcaaggttagaatattcagcagctaaaaatcaagccttacaaattcaaaataaatttatgcagtcaaaaagtgaatatgatattgcattgcaacaattaaatctatggctggtttctgatacattctatacagttactaatgattttgaaaatcactaa

SEQ ID NO: 22034 - protein, 227 aa, Unknown
  Obtained from environmental sample
  misc_feature (1)..(227): Xaa is any amino acid
MRSNKKIITVTAMVAFVFFLPITGNAQEVYVTLPVISMNEAVNLSKENYPLLKQKQLEINKQKQLKSTVYDFGTTQIFTGGEEINNGNGIYTTLGIGQSNINVFGVSAKKRLQEQHIQLAQKAFQLSELDLELEVKKAWANVFQSKRKYNLYKELDSIYTNFEKAVALNYKVEAISRLEYSAAKNQALQIQNKFMQSKSEYDIALQQLNLWLVSDTFYTVTNDFENH

SEQ ID NO: 22035 - DNA, 537 bp, Unknown
  Obtained from environmental sample
  misc_feature (1)..(537): n is a, c, g, or t
atggctcttaaatccaccattatgaaagtgcagttgtcgcttagcgatatggaccgtcacgtttaccaagattttaatttaaccttggcccagcatccttcagaaaccgaacaacgtttgatgatccgcttactcgcttttgcactcaatagctgtgatggtttagaatttaccaaaggattaagttctgacgatgagcccgagctgtggcataaaaactacagtgaagaaatagagctgtggatagagctgggtttacctgacgaaaagcgccttaaaaaagcctgtaataaagctaaaaaagtggtgctttacacttatggcgaaaacaaccaggctatttggtggcaaaaacagcagcctaaattacgtgattttaaaaatcttagtatatttagtttagattatagtgttacccaagctttggccaatttggttgatcgtaatataaagcttgctattactattcaagatggcgagatgtgggttaataccgacacgaccaatattgaaataaaaccacagcagttaatgtga

SEQ ID NO: 22036 - protein, 178 aa, Unknown
  Obtained from environmental sample
  DOMAIN (1)...(177): YaeQ protein
  misc_feature (1)..(178): Xaa is any amino acid
MALKSTIMKVQLSLSDMDRHVYQDFNLTLAQHPSETEQRLMIRLLAFALNSCDGLEFTKGLSSDDEPELWHKNYSEEIELWIELGLPDEKRLKKACNKAKKVVLYTYGENNQAIWWQKQQPKLRDFKNLSIFSLDYSVTQALANLVDRNIKLAITIQDGEMWVNTDTTNIEIKPQQLM

SEQ ID NO: 22037 - DNA, 774 bp, Unknown
  Obtained from environmental sample
  misc_feature (1)..(774): n is a, c, g, or t
gtgcaaggcacagtgaatccggatgaattcgagattgtcagacccactgtaaagcaaggtttctatcctgttattcaaaaaaaattagggaataaagctaaaacaatggtttatgcaaagtctaatataaaggaatctataattaatatagaaactcccaaagaaaaacaagaagaatatgttttgcacgatgatgagattataaaactggccgattgggcactaattattgaagatcattaccagaagccaatggatattgaatgggcaaaagacggcatcaccaatgaactattcattgtacaggcacgtccggaaactgtacatcattcaaaaaataaaaatgttttagttgagtataaattgttagagaagagtaaagtattatcaactggcaacgcggttggaaccaaaatagcagttggtaaagccaaaattttaacatcatcaaaagaagcagaacaactaaatgatggagatatcattgttacagataccatcagtcctgattgggatcccattcttaaaagatcaggggcaattattactaataaaggaggtagaactagccatgccgcaattgttgcaagagaattaggtgtgcctgccatcgtaggttgtacaaatgctacagaaaatattgaaaacggtgaactgattaccataaattgtgcagaaggtaacataggatatatttataaaggcaaacttaattttgaagaaaaagttattgattttagcaatataataatgccaaaaaccgaagcaaattga

SEQ ID NO: 22038 - protein, 257 aa, Unknown
  Obtained from environmental sample
  DOMAIN (139)...(230): PEP-utilising enzyme, mobile domain
  misc_feature (1)..(257): Xaa is any amino acid
MQGTVNPDEFEIVRPTVKQGFYPVIQKKLGNKAKTMVYAKSNIKESIINIETPKEKQEEYVLHDDEIIKLADWALIIEDHYQKPMDIEWAKDGITNELFIVQARPETVHHSKNKNVLVEYKLLEKSKVLSTGNAVGTKIAVGKAKILTSSKEAEQLNDGDIIVTDTISPDWDPILKRSGAIITNKGGRTSHAAIVARELGVPAIVGCTNATENIENGELITINCAEGNIGYIYKGKLNFEEKVIDFSNIIMPKTEAN

SEQ ID NO: 22039 - DNA, 369 bp, Unknown
  Obtained from environmental sample
  misc_feature (1)..(369): n is a, c, g, or t
atgtatacatctaaaaattacctgctatcagaaaaaacttttgaagcattaatagccaaacgcgacttatattgtgtttccatatatctcccaatgcacaaaacaggcaaagagcaaaatgaacgtctggcgcaggccaacttaaaaagttgtatcaaggaagtgcatcgaaccttagctaaatatcaactacaggaagacgaaattaacagttatctaaaacccatagaagaactcattgctaatatggatttatggaggaacccttcagatggtttggccatttttctggataagaagagtctgaattattatccatttcctatttcatttgacactcaaacatatgtagccgatcattttatctaa

SEQ ID NO: 22040 - protein, 122 aa, Unknown
  Obtained from environmental sample
  misc_feature (1)..(122): Xaa is any amino acid
MYTSKNYLLSEKTFEALIAKRDLYCVSIYLPMHKTGKEQNERLAQANLKSCIKEVHRTLAKYQLQEDEINSYLKPIEELIANMDLWRNPSDGLAIFLDKKSLNYYPFPISFDTQTYVADHFI

SEQ ID NO: 22041 - DNA, 495 bp, Unknown
  Obtained from environmental sample
  misc_feature (1)..(495): n is a, c, g, or t
atggagtttgttttcgaccaagtagatacttctaaagttactggtaaaacgtatttgccaatgtttattaacgagtcgtatagcgaagtgtacggagataatgtaattaatgaaaaacgcgacatattaaaaggaaataagaattcaggttttagtaataatcaaatcattatcgattttatagacgatttatattccgattttgatgtgtacgataattatttaaagttttttgacaagagttttacaagtccgttatcgcgaacaggaattaacacgtataactacgttttggccgatagtgcttatatagataataaatggtgttataatattatttattatccaagacgtaaaaacgaattaacttttaaaggggatttctgggtagcagataccacatttgctattaaagatattaatttacaagcctcgaaaagtgcaaatataaactgggtaaaagaaatttatatagagcaagaatatgaactgtga

SEQ ID NO: 22042 - protein, 164 aa, Unknown
  Obtained from environmental sample
  misc_feature (1)..(164): Xaa is any amino acid
MEFVFDQVDTSKVTGKTYLPMFINESYSEVYGDNVINEKRDILKGNKNSGFSNNQIIIDFIDDLYSDFDVYDNYLKFFDKSFTSPLSRTGINTYNYVLADSAYIDNKWCYNIIYYPRRKNELTFKGDFWVADTTFAIKDINLQASKSANINWVKEIYIEQEYEL

SEQ ID NO: 22043 - DNA, 549 bp, Unknown
  Obtained from environmental sample
  misc_feature (1)..(549): n is a, c, g, or t
atgagttcaaatcatcaaaagaaatacagtttttctgccattagtattaaacctaaagtggcaactcgctttcggaaattttccaaggaaattacccattcacatactgatacgttggaagcaatgatgaactttttcgatttgaacgagctatccccaaatgaatctttgggtgcaaatatgaagactttagagaatagcttaaaaaaacgaatcaatgcacttgtagccattattagggatattgaaaaaaaccagaccaaacccaccaatgcaatgttggaactgctctttcaggagaatccaaaagaggaagaagcacaagaagaattatttgaatttgaacaacaggaattgattacagaaaatgaggaactgaatcattatcgaaatcggtacgaagaagttcaacaacaattccattccgtaaaatatgatttagaaaaaatcattgataagaccacttatgttaaaagcagttttggaggtggctatttaaaactggatttaagcaaagatgaatttgaaaacattaaacaaaaattataa

SEQ ID NO: 22044 - protein, 182 aa, Unknown
  Obtained from environmental sample
  misc_feature (1)..(182): Xaa is any amino acid
MSSNHQKKYSFSAISIKPKVATRFRKFSKEITHSHTDTLEAMMNFFDLNELSPNESLGANMKTLENSLKKRINALVAIIRDIEKNQTKPTNAMLELLFQENPKEEEAQEELFEFEQQELITENEELNHYRNRYEEVQQQFHSVKYDLEKIIDKTTYVKSSFGGGYLKLDLSKDEFENIKQKL

SEQ ID NO: 22045 - DNA, 534 bp, Unknown
  Obtained from environmental sample
  misc_feature (1)..(534): n is a, c, g, or t
ttgcttcttctaacgcttcaattaatgaattatccaccgaataatattagaatgaaaactaatcagaaaaaaaagttaataatgaataattttagaaatagacctaaagataattacatacacgaagcagattggcaaaacctttatttacttactgaaacgtggaaatctgatttgttgttttatacagacgatttgaagtttttacatcaacttattaatgaatatttcaaacttattttaaaaaatgcagatagtgatgttgtaagagaaatggaaatgaatttattggaaatagatggtaaatgttcattgttattaaaacgagtaaacactcatttattccatttgtctgaattaatagatgatccgtttaaatatgattcacataaatttagaatagaacacgagcaattagaagacgatattaatacttttattaagatctttagagataacagaaaagatgtttttaacattacagattatgttatagacagtgagacgatttctttaaaattaagcggtaaataa

SEQ ID NO: 22046 - protein, 177 aa, Unknown
  Obtained from environmental sample
  misc_feature (1)..(177): Xaa is any amino acid
MLLLTLQLMNYPPNNIRMKTNQKKKLIMNNFRNRPKDNYIHEADWQNLYLLTETWKSDLLFYTDDLKFLHQLINEYFKLILKNADSDVVREMEMNLLEIDGKCSLLLKRVNTHLFHLSELIDDPFKYDSHKFRIEHEQLEDDINTFIKIFRDNRKDVFNITDYVIDSETISLKLSGK

SEQ ID NO: 22047 - DNA, 753 bp, Unknown
  Obtained from environmental sample
  misc_feature (1)..(753): n is a, c, g, or t
atgcaacaattattagatttattaaaagatcctcttattcttaagattattaggctttctatatgggttattatcataattattatcattattttttcaagaaaacagttgaaaaaacgagtcaaaaatatagcccatctttacaaagctcaaaaaatgattgaaatcataggtttatttgttattgccttgattgttttaatgtcttttacactagacagcttaaaggattatactataattattggtctttttaccgcggggatagcatttaccttacaagaacttattttaagcattgctggttcattttatatttttgctttaagtgtttacaaacctggagaccgtatagaagttaatggaataaaaggcgatgtcatagacataaatagtatgtacaccaccataatggaaatgggcgaatgggtaagtagtgataattattctggtcgtattgttaaattaagtaacgcctttgtttttaaaggccctataaaaaactattcgatggattttccatttatttgggatgaactcaatattcccataacctatcaatcggatgttgaattggcaaaaaaactgattttggataatgcatcaagaatcctatcggattatacagaaaaatctaactttaatgcgaagaatggtagagcatattatttgacgatgcccttggtccaccatagcataaacttacgatattggttgaataatcctcgtttaacaattaaattgacactataa

SEQ ID NO: 22048 - protein, 250 aa, Unknown
  Obtained from environmental sample
  DOMAIN (52)...(249): Mechanosensitive ion channel
  misc_feature (1)..(250): Xaa is any amino acid
MQQLLDLLKDPLILKIIRLSIWVIIIIIIIIFSRKQLKKRVKNIAHLYKAQKMIEIIGLFVIALIVLMSFTLDSLKDYTIIIGLFTAGIAFTLQELILSIAGSFYIFALSVYKPGDRIEVNGIKGDVIDINSMYTTIMEMGEWVSSDNYSGRIVKLSNAFVFKGPIKNYSMDFPFIWDELNIPITYQSDVELAKKLILDNASRILSDYTEKSNFNAKNGRAYYLTMPLVHHSINLRYWLNNPRLTIKLTL

SEQ ID NO: 22049 - DNA, 837 bp, Unknown
  Obtained from environmental sample
  misc_feature (1)..(837): n is a, c, g, or t
atggatgttggtacgtatgacccaatgctaggtatgtctaacaaggaaattgcttctttggcaagcagtcaacagttatgtcaaggatttggcagactaacttctagaggaacagaagatgaatatgtggagcttttaaagggtgatttaccaaatgataaatctaatttatttgacggcatagatacatcttggtcaagaattgatggcggtaaagctataggtgaaattttgtatgatgttcaagagaattttaatttcaaaaaccctacaactcatattccggcattattagaagcttaccaattattacaaaagtcaactgatgaacattggaaagagcttaaaaccgatgagataacatcaattattgcttctatatcaggtctatatttagaagcctctaccatgtcaccttatacaaacgcaggagaaattgtagatgttcaaattcaggcattgaacagaagtgatatcgatattaaattgaaatctttattcttaaacgaacaaagtataaatatagataacgttgttttaaacaataataaatcattagagaagaaagtaaaacttaccattccaacaaccacaaaattcactagtccttattggttaatggaaaagggcacattaggtacttatacggtaaccaatacagaattaataggtaaaccagaaacacctaaagctttcaatgcaatttttaatattgaaattaatggtatagccattcccattgttaagcctgtaatgtacaaatatgcaaaacctgaaaaaggagaaatacatcaaccttttgaaattgttcctgagctaccgcaattttgcagataa

SEQ ID NO: 22050 - protein, 278 aa, Unknown
  Obtained from environmental sample
  misc_feature (1)..(278): Xaa is any amino acid
MDVGTYDPMLGMSNKEIASLASSQQLCQGFGRLTSRGTEDEYVELLKGDLPNDKSNLFDGIDTSWSRIDGGKAIGEILYDVQENFNFKNPTTHIPALLEAYQLLQKSTDEHWKELKTDEITSIIASISGLYLEASTMSPYTNAGEIVDVQIQALNRSDIDIKLKSLFLNEQSINIDNVVLNNNKSLEKKVKLTIPTTTKFTSPYWLMEKGTLGTYTVTNTELIGKPETPKAFNAIFNIEINGIAIPIVKPVMYKYAKPEKGEIHQPFEIVPELPQFCR

SEQ ID NO: 22051 - DNA, 522 bp, Unknown
  Obtained from environmental sample
  misc_feature (1)..(522): n is a, c, g, or t
atgaaaatagtcttgattggttatatgggaagcggaaaatcttcagttggcaaaaagcttgctgctgttttgggaattccatttaaagatatggatgatgaaattgaaaaacaagagggtatttctattccaaagattttttcagaaaaaggagaaatctatttcagaaaagttgaaattgaagttttaaaaaaaattctttcaaaacccgaaggttttgttctggctaccggtggaggtacgccttgctatgctgactcaatgaattttttagtgaaacaaaaagatgtagtatcagtttatttaaaaacaccacttgatgttttaacgactaggttattttcagaaaaagaaaatagaccattactggcacatcttaaaaccgaagagaatcttaatgacttcatcagaaaacatctttttgaaagagcctatttttacaatcaagcagctttgattgttgaacatggaggagaaagtgttaatgaaacggtagaaaaaataattttgaaattattctaa

SEQ ID NO: 22052 - protein, 173 aa, Unknown
  Obtained from environmental sample
  DOMAIN (1)...(169): Shikimate kinase
  misc_feature (1)..(173): Xaa is any amino acid
MKIVLIGYMGSGKSSVGKKLAAVLGIPFKDMDDEIEKQEGISIPKIFSEKGEIYFRKVEIEVLKKILSKPEGFVLATGGGTPCYADSMNFLVKQKDVVSVYLKTPLDVLTTRLFSEKENRPLLAHLKTEENLNDFIRKHLFERAYFYNQAALIVEHGGESVNETVEKIILKLF

SEQ ID NO: 22053 - DNA, 897 bp, Unknown
  Obtained from environmental sample
  misc_feature (1)..(897): n is a, c, g, or t
ttgaagagaaaatctgcagctgttacagaaaatatgcaaggtaattttgtaggaattggtgttcagtttagaatgataaaagattcaattacagttgtgcaacctataaaaggtggcccaagtataaaagtaggcattaaagctggagatagaattttaatggctgataatgacactttatataacaaaaatatgtttaacaaatttggtgtaaacatgtttaccaacgaagttcctgcatatttaaaaggagagccaggcactaaagttacactacaaatttatcgaaaaagtgcagattctctttttaaagttgatgttactcgtggcaaagtaaatattaaaagtgtcgatttagcgtatatgattaacgattctattggttatataaaactagatcgttttgcaagaaatacatacagcgaatttaaaactgctcttagtggtttgattgataatggaatgacggatttagttttagatctgcgtggaaatggaggtggatttatagatattgccaacagaattatcgacgaatttttagagaataaaaagttgatggttttcacaaaaaataacaaaaattttgttgaagaatattttgcaacctctattggttcttttgaaaaaggtggtttatatgttttaattgacgaaaattcggcttcagcatctgaaattgtggctggtgctttgcaagataatgataaaggaaccattattggaagacgctcttttggtaaaggtttagtgcaagtagaaatggatttaggtgatggttctgctgtacgtttaacaactgcaagatattacactccaacaggacgttccattcaaaaaccttatgataaaaatggagataaagactacagaaaagattatcaagagagaattngc

SEQ ID NO: 22054 - protein, 299 aa, Unknown
  Obtained from environmental sample
  DOMAIN (126)...(292): Peptidase family S41
  misc_feature (1)..(299): Xaa is any amino acid
MKRKSAAVTENMQGNFVGIGVQFRMIKDSITVVQPIKGGPSIKVGIKAGDRILMADNDTLYNKNMFNKFGVNMFTNEVPAYLKGEPGTKVTLQIYRKSADSLFKVDVTRGKVNIKSVDLAYMINDSIGYIKLDRFARNTYSEFKTALSGLIDNGMTDLVLDLRGNGGGFIDIANRIIDEFLENKKLMVFTKNNKNFVEEYFATSIGSFEKGGLYVLIDENSASASEIVAGALQDNDKGTIIGRRSFGKGLVQVEMDLGDGSAVRLTTARYYTPTGRSIQKPYDKNGDKDYRKDYQERIX

SEQ ID NO: 22055 - DNA, 492 bp, Unknown
  Obtained from environmental sample
  misc_feature (1)..(492): n is a, c, g, or t
atggcaaaatcttattcggatactttagaatcgataatggatttttttgaatggcacgacttctcccctgccgataggtttaccaaaagcctcatgcaggaactattaaaaaacagagctcgcacggaaacgtccatcaaacgtaccgaagctacaattgctattattcgaaatattgaagtccaacaaaccaaacccaataatgctatgttgctatctctttttggcgaaagtattaaagatgaaaaaccgatacgggtcgagaaaaaatttgctaagggtctccctgaaacaaaagaggaattggatcgcaacgcttctgaaatccgatacgaaaaactaactgataaaatgaggttggtcaaacaagactttagatatgttttggataaagtcaaaatcgttaataacaatttcggaaagggttatttgaaactggaaatttcaaatactgaactcgaaacatttataaaaaatcttaaaaatttataa

SEQ ID NO: 22056 - protein, 163 aa, Unknown
  Obtained from environmental sample
  misc_feature (1)..(163): Xaa is any amino acid
MAKSYSDTLESIMDFFEWHDFSPADRFTKSLMQELLKNRARTETSIKRTEATIAIIRNIEVQQTKPNNAMLLSLFGESIKDEKPIRVEKKFAKGLPETKEELDRNASEIRYEKLTDKMRLVKQDFRYVLDKVKIVNNNFGKGYLKLEISNTELETFIKNLKNL

SEQ ID NO: 22057 - DNA, 363 bp, Unknown
  Obtained from environmental sample
  misc_feature (1)..(363): n is a, c, g, or t
atgaaaaagtcaacatatataaaaattataattacaatttacactattgttttatttagtattaaacacaatgcgcagagttttaaaacgttagataatgtaccacatgatatttcttacttcagagaaagtaaagttatgtctcccgttataaaagtaatttatggaagacctagtttaaagaaagcgaaagctttcggcgatcaggtaccttttaataagccatggagaacgggcgctaatgaagctactgaagtgaaattttatcaggacgtaatgtttggagaatattatgttaaagctggcacatatgtgttagtaactattccccggagaaaaagaatgggaaattatattaaataa

SEQ ID NO: 22058 - protein, 120 aa, Unknown
  Obtained from environmental sample
  misc_feature (1)..(120): Xaa is any amino acid
MKKSTYIKIIITIYTIVLFSIKHNAQSFKTLDNVPHDISYFRESKVMSPVIKVIYGRPSLKKAKAFGDQVPFNKPWRTGANEATEVKFYQDVMFGEYYVKAGTYVLVTIPRRKRMGNYIK

SEQ ID NO: 22059 - DNA, 414 bp, Unknown
  Obtained from environmental sample
  misc_feature (1)..(414): n is a, c, g, or t
atggnntngncaccgnagggtacgcactatatgcttaatatttcagctgggttggatcaaaatatcataatttcaaaaagtcattttgaagattacagcatgtctcattatctcttaaccgacaatacaaagctaaaaaaaagtaagtataatgttccagagcctgttgatggtatagctatacaaccctcacaattagaagtggtatttattccccttctagcttatgacaaaacaggaaatagaataggttacggcaaaggtttctacgataggtttttaatacagtgtaaacccgaaacggtaaaaattggattgtccttttttgcagctgaaaatgccatatttaaagcttcaaaagatgatgttaggctagattactgtgtgactccaagtgaggtgtttcaattttag

SEQ ID NO: 22060 - protein, 137 aa, Unknown
  Obtained from environmental sample
  DOMAIN (10)...(131): 5-formyltetrahydrofolate cyclo-ligase family
  misc_feature (1)..(137): Xaa is any amino acid
MXXXPXGTHYMLNISAGLDQNIIISKSHFEDYSMSHYLLTDNTKLKKSKYNVPEPVDGIAIQPSQLEVVFIPLLAYDKTGNRIGYGKGFYDRFLIQCKPETVKIGLSFFAAENAIFKASKDDVRLDYCVTPSEVFQF

SEQ ID NO: 22061 - DNA, 417 bp, Unknown
  Obtained from environmental sample
  misc_feature (1)..(417): n is a, c, g, or t
gtggttggtttagatgctgcttcttggcgttattttaatcgaagttcatcagaattatcttggtctgaagctgcaactttagctgttttaccaaatgcaccaaatttgatttatccagggaaaaatcaacagaaattattggtgaaaagaaaccgattgttgaaaaaattactcactaaaaatgtgattgattcgttaacttatgaattatcaatcttagaagaattaccacaaaaagcatatagaattccgcaaataacaacgcatttattacagaaggttaatcaacagaaaaaaggacaatttgtaaaaactacgattgataaaaagctacaaattcaaacaaatgacattgtcaaaaaccattataatcaattcagtaaaaagggaattcacaaagttgcagttaaggtttaa

SEQ ID NO: 22062 - protein, 138 aa, Unknown
  Obtained from environmental sample
  misc_feature (1)..(138): Xaa is any amino acid
MVGLDAASWRYFNRSSSELSWSEAATLAVLPNAPNLIYPGKNQQKLLVKRNRLLKKLLTKNVIDSLTYELSILEELPQKAYRIPQITTHLLQKVNQQKKGQFVKTTIDKKLQIQTNDIVKNHYNQFSKKGIHKVAVKV

SEQ ID NO: 22063 - DNA, 357 bp, Unknown
  Obtained from environmental sample
  misc_feature (1)..(357): n is a, c, g, or t
atgaaaatatatcctatagaaactggtaattttaagttagatggtggtgcaatgtttggtgttgtaccaaaaactatttggcaaaaaaccaatcctgcagatgctaataacttgattgatatgagtatgcgttgtttgcttattgaagatggtaatcgattaattttggttgatacaggtttaggtgcaaaacaatcagacaaattttacggttactactatttatttggggatttttctttggatgcatcccttaaaaaattaggttttcataaggatgatattacagatgttttcttaacacatttacattttactcattntggaggtgttattgaaagaattcaagccgcttga

SEQ ID NO: 22064 - protein, 118 aa, Unknown
  Obtained from environmental sample
  misc_feature (1)..(118): Xaa is any amino acid
MKIYPIETGNFKLDGGAMFGVVPKTIWQKTNPADANNLIDMSMRCLLIEDGNRLILVDTGLGAKQSDKFYGYYYLFGDFSLDASLKKLGFHKDDITDVFLTHLHFTHXGGVIERIQAA

SEQ ID NO: 22065 - DNA, 693 bp, Unknown
  Obtained from environmental sample
  misc_feature (1)..(693): n is a, c, g, or t
gtggctgtattgtatattatggaagaatttaaagcacgctgggatatcgataagaattggcaatttatttttccgattctaggagtcttgattctattttattgcagctataaattaactgggttatttagggaagaataccatattggtattaaattagggtttgctcttttaattttcttttttcttttaaaatttgttcttcttctttttaaaaaactagaaaaaaaatggctcgtagtacatcgctgggaactcattcgtgtttttatggtttttgctataacggggtcgtcgtctttatttgtgggacgaccaattataaaactaatgggaattactaaagaaaacctaaatatctatgtttactggtttttatatattataattggaattgttttttatcaaattcttttagtttgttttggctggcttttcggtcaatttaaattcttttgggagtttgaaaagaaaatgattcgtcgttttggattacgaaaatttgtagattactgcatcaatttaaacaaccatattagtattaaattactcgcactagctttagttattgcagtaagtatacctactattgttaaatttgcccatattcttgaaaaccataaacacgaagtctgtactgctgaaacagctcccatatcccgaaatcgatctggctgtgcatttctcacttaa

SEQ ID NO: 22066 - protein, 230 aa, Unknown
  Obtained from environmental sample
  misc_feature (1)..(230): Xaa is any amino acid
MAVLYIMEEFKARWDIDKNWQFIFPILGVLILFYCSYKLTGLFREEYHIGIKLGFALLIFFFLLKFVLLLFKKLEKKWLVVHRWELIRVFMVFAITGSSSLFVGRPIIKLMGITKENLNIYVYWFLYIIIGIVFYQILLVCFGWLFGQFKFFWEFEKKMIRRFGLRKFVDYCINLNNHISIKLLALALVIAVSIPTIVKFAHILENHKHEVCTAETAPISRNRSGCAFLT

SEQ ID NO: 22067 - DNA, 303 bp, Unknown
  Obtained from environmental sample
  misc_feature (1)..(303): n is a, c, g, or t
atggaaaagttagcaaatgtacatcctggcgagattntgttttacgagtttcttgaacctcttgaaattacagcttatcgcctttcaaaggacttgaaaataccacagacacggatttcggaaatcgtaaaaggaaatcgaagaataacagcggacacagctttgcggttgagcaaatatttcgggaattccgccaagttctggctcggacttcaagatgattatgatatagaagaagagaaggaaacaaaagagtcggaactgaacgaaatcaagcacttcgagaataaaaacgttgcctaa

SEQ ID NO: 22068 - protein, 100 aa, Unknown
  Obtained from environmental sample
  DOMAIN (14)...(68): Helix-turn-helix
  misc_feature (1)..(100): Xaa is any amino acid
MEKLANVHPGEIXFYEFLEPLEITAYRLSKDLKIPQTRISEIVKGNRRITADTALRLSKYFGNSAKFWLGLQDDYDIEEEKETKESELNEIKHFENKNVA

SEQ ID NO: 22069 - DNA, 483 bp, Unknown
  Obtained from environmental sample
  misc_feature (1)..(483): n is a, c, g, or t
atgtttaagcgaatagttagctatctttttatatttctattattggcttcttgcgaatatttttcgccaactaccacgacctcaaatagtaacctgcaagagttagatactattgttgattatacaaaaatagatgtctatcctatattttatgattgtgaagatttttcagaggataataatcaaaagggatgttttgaggcttcattatctaaaagactgtcagaaataattcatcagaataatttgaaagttaaagaagttgtcaacgatactactcatataaacttatttatagataagaccggaaaagctaaggttgttgatataagatcacctgaaagtatttctaaatatttaccaacattagacagtgttataagacaaagcgttgccaaattacccaccatgaaacctgctgtaaaaaggggaattcttgtcaaatctcaatatagtctgtctatcattgtaaggactatttaa

SEQ ID NO: 22070 - protein, 160 aa, Unknown
  Obtained from environmental sample
  misc_feature (1)..(160): Xaa is any amino acid
MFKRIVSYLFIFLLLASCEYFSPTTTTSNSNLQELDTIVDYTKIDVYPIFYDCEDFSEDNNQKGCFEASLSKRLSEIIHQNNLKVKEVVNDTTHINLFIDKTGKAKVVDIRSPESISKYLPTLDSVIRQSVAKLPTMKPAVKRGILVKSQYSLSIIVRTI

SEQ ID NO: 22071 - DNA, 591 bp, Unknown
  Obtained from environmental sample
  misc_feature (1)..(591): n is a, c, g, or t
atgcttccgttaatggaagaattttatacaatacaaggtgaaggttctcatacaggaactgctgcttattttattagagttggtggttgtgatgtgggttgtcattggtgtgatgttaaagaaagttggaatgcagatttgcacccaccaacgttagcagatactattgtagaaaatgtaaaaaagttcgcgaaaacagttgttattactggtggtgaacccttaatgtggtctatggactatattactgaattgctacaaaaaaactatattaaaacgcatattgaaacttctggagcgtattctttttctggaaaatgggattggttttgtctttcgccaaagaaaacaaaattacctttagacgaaaattatagagaagcagatgagttaaaaatgattattcataatcaatctgattttatttttgcagaagaacaagctgcaaaagtgggtaaaaaatgtcaattatttttacagccagaatggagtaaaaaagaaacaatgacagagcaaattgttgaatatgtgatgaaaaatccgaaatggaaaatttctttacagacacacaaatatttgaatattccttaa

SEQ ID NO: 22072 - protein, 196 aa, Unknown
  Obtained from environmental sample
  misc_feature (1)..(196): Xaa is any amino acid
MLPLMEEFYTIQGEGSHTGTAAYFIRVGGCDVGCHWCDVKESWNADLHPPTLADTIVENVKKFAKTVVITGGEPLMWSMDYITELLQKNYIKTHIETSGAYSFSGKWDWFCLSPKKTKLPLDENYREADELKMIIHNQSDFIFAEEQAAKVGKKCQLFLQPEWSKKETMTEQIVEYVMKNPKWKISLQTHKYLNIP

SEQ ID NO: 22073 - DNA, 333 bp, Unknown
  Obtained from environmental sample
  misc_feature (1)..(333): n is a, c, g, or t
atgcaggaagttgaagccatgtgcgatcgtgttattattattaataaaggtgaaattgttgccaacaaaaaactaaaagaattgcgcgatggacagcaacaaattgttattgtggaatttgattatagaattgaagaagcttttttattaaaattacctaatgcaaaacatgttaaaaacatccacgattttacttacgaaatcacgtttggaacgtcagaagatatgcgtagccatgtctttgattttgctcatgataacgaattaaagattttacaacttaatcaaaaaaacgcaagtctagaaagtctatttagagaactaacaagttag

SEQ ID NO: 22074 - protein, 110 aa, Unknown
  Obtained from environmental sample
  misc_feature (1)..(110): Xaa is any amino acid
MQEVEAMCDRVIIINKGEIVANKKLKELRDGQQQIVIVEFDYRIEEAFLLKLPNAKHVKNIHDFTYEITFGTSEDMRSHVFDFAHDNELKILQLNQKNASLESLFRELTS

SEQ ID NO: 22075 - DNA, 795 bp, Unknown
  Obtained from environmental sample
  misc_feature (1)..(795): n is a, c, g, or t
ttgcactttgattcggctcgagagcatacaanggaacgtattgtagattatatgtttaaggaatacgaaaaaggaagaacgccaaatccagatgtgttatgtaaccgtgagattaaatttgatgtgtttatgaaaatcgcattggaattgggtgcggattacgtagcaacgggtcactattgccgaaaaggaacgcttaccgaaaacggaaaagaaacataccagttactagcaggaaaagataataataaggaccagtcttattttttatgtcagttatctcaagagcaattagcaaaagctttgtttcctattggcgaattccaaaagcctgaagtaagagcaattgctgcagaagccgatttaattacggccgataaaaaagactctcaagggttatgttttattggtaaagtaaggttaccagactttcttcaacaacaactaaaacctaaaacaggaaatattattgaaattccgaaaacgttttcagaatatactattgagaaaaataacttcacctctaaaattgaagaattagaatttctatcacgtaaaataaactattcagaaaccgatggtgaagttgtgggaacacatcaaggggcacattattttacaaaaggacaacgtaaagggttatccgttggcggaaaagtcgagcctttatttgtaatagataccgatgtagataccaatactatttatactggacaaggtaaaaaccacccaggattatacaaaagcgctttatttgtaaccaatgaagaattcattgggtacgcgaagatttga

SEQ ID NO: 22076 - protein, 264 aa, Unknown
  Obtained from environmental sample
  DOMAIN (4)...(264): tRNA methyl transferase
  misc_feature (1)..(264): Xaa is any amino acid
MHFDSAREHTXERIVDYMFKEYEKGRTPNPDVLCNREIKFDVFMKIALELGADYVATGHYCRKGTLTENGKETYQLLAGKDNNKDQSYFLCQLSQEQLAKALFPIGEFQKPEVRAIAAEADLITADKKDSQGLCFIGKVRLPDFLQQQLKPKTGNIIEIPKTFSEYTIEKNNFTSKIEELEFLSRKINYSETDGEVVGTHQGAHYFTKGQRKGLSVGGKVEPLFVIDTDVDTNTIYTGQGKNHPGLYKSALFVTNEEFIGYAKI

SEQ ID NO: 22077 - DNA, 702 bp, Unknown
  Obtained from environmental sample
  misc_feature (1)..(702): n is a, c, g, or t
gtgatcaaagcacttgcgcagcatggcattgagccagatattgtctgtggtacttctatcggtgccttagtcggcgcatcttatgtaaatggcaagttagatcaattagaggcatggacaacgtcactgacaaaatttgaagcggcaaaactgtatgagattaattcgtcgctgaatggctttgtaaatacacgcagattgcataagttaatgatagatctggtagcagatgaatcaactctggtcgaaaacctccccaaaaagtttgcttcagtcgcaaccgatttagatagcggtcgtgaaatctggttaactcaaggatctgtgctagaagctatttggtcatcgatctcattaccgggtttatttcccgccgttcgcaaaaatgacaaatggttagttgatggcggtttagttaaccctgtgccagtttcggtttgtcgtgccttaggtgctgacgttgtaatcgccgttaatttaaatggagacattgttggtaaacaccgaaaaaatgctaaatcttcaaataagaaaaaaaataaaaagaagcaaaactcgcaaataacaaacggttttgttaataaattctcaagcctaatggaagggtatacaccttcgttttttctaccaaaaaagacaaagaaactcgccatccttatcgaaacgttgccgatcagtcaatatcacccagatgaatcntaa

SEQ ID NO: 22078 - protein, 233 aa, Unknown
  Obtained from environmental sample
  DOMAIN (1)...(148): Patatin-like phospholipase
  misc_feature (1)..(233): Xaa is any amino acid
MIKALAQHGIEPDIVCGTSIGALVGASYVNGKLDQLEAWTTSLTKFEAAKLYEINSSLNGFVNTRRLHKLMIDLVADESTLVENLPKKFASVATDLDSGREIWLTQGSVLEAIWSSISLPGLFPAVRKNDKWLVDGGLVNPVPVSVCRALGADVVIAVNLNGDIVGKHRKNAKSSNKKKNKKKQNSQITNGFVNKFSSLMEGYTPSFFLPKKTKKLAILIETLPISQYHPDES

SEQ ID NO: 22079 - DNA, 666 bp, Unknown
  Obtained from environmental sample
  misc_feature (1)..(666): n is a, c, g, or t
gtggtggacaacaagcgtgtgttagctgtaaaagcaatgtacagacgtaaggttaaaggtgccataatgggtggaagtaaaacaggaagcatcgtttatatcgagcctgaaaccacgttacaacacaccagagaacttaataatttagaatacgaagaaagcgaagaagtcgtgcgtatcctaaaagaagtgaccaattacattcgtcattacttaccgttattagagttatatcaaacctttttaaccgaaatggatgtgatttccgcgaaagcgaaatatgctaaatccatgaacgctattttaccagaaatcagcgaagacagagcgttatacttgcgtgatgcctaccatccactactctatttaaacaatttagagaaaaaagaaaaaacgtttccgcaaaccattggacttaaagaagacagtcgcattattgtgatttcgggtccaaatgctggtggtaaatccattacattaaaaaccgttggtttactgcaagtcatgttgcaatccggttttttaattcctgtgcatgagcgtagcaaagcctttttatttgatcgtattgttagcgatattggagataatcaatccatagagaatcatttaagtacctatagctaccgtttaaaacagatgaattatttctttgaagaaaattaa

SEQ ID NO: 22080 - protein, 221 aa, Unknown
  Obtained from environmental sample
  misc_feature (1)..(221): Xaa is any amino acid
MVDNKRVLAVKAMYRRKVKGAIMGGSKTGSIVYIEPETTLQHTRELNNLEYEESEEVVRILKEVTNYIRHYLPLLELYQTFLTEMDVISAKAKYAKSMNAILPEISEDRALYLRDAYHPLLYLNNLEKKEKTFPQTIGLKEDSRIIVISGPNAGGKSITLKTVGLLQVMLQSGFLIPVHERSKAFLFDRIVSDIGDNQSIENHLSTYSYRLKQMNYFFEEN

SEQ ID NO: 22081 - DNA, 372 bp, Unknown
  Obtained from environmental sample
  misc_feature (1)..(372): n is a, c, g, or t
atgatcataggtaagaaatactattgcataccttttattgtaattattctattattaactatatatttagtgagtaaagttatgtctattaacgcagaaaaaaacctttatatagatatagatgtcgacaaacatttacaggataatattgtggtaaatattgagttattaaggaatagtcatgaatatagtgagtatgttgaaactaagctaattagtattcataatcaagaaaaatacagtaactcgacgagaaaaattgatcttgataactccttcgtttatgaactattcgtcaactataaaaacagaaaattttttagtataagtaaagatcanatatatgatcattacatagcagaacacagatga

SEQ ID NO: 22082 - protein, 123 aa, Unknown
  Obtained from environmental sample
  misc_feature (1)..(123): Xaa is any amino acid
MIIGKKYYCIPFIVIILLLTIYLVSKVMSINAEKNLYIDIDVDKHLQDNIVVNIELLRNSHEYSEYVETKLISIHNQEKYSNSTRKIDLDNSFVYELFVNYKNRKFFSISKDXIYDHYIAEHR

SEQ ID NO: 22083 - DNA, 423 bp, Unknown
  Obtained from environmental sample
  misc_feature (1)..(423): n is a, c, g, or t
atgaaaaacaataaatataaaatattgttgctttcagatttaaataagtcggcaacatcagaactgataagtacggtaagtttagcaagaatgttagatggagacattactttatttcatgttaaaaaaccgactgacattgtagaaagagaaagccaattatctgctatgcgttccattaatgaggagcatatttcaactaataaaataattgaaaacctgattaaacctgtttgtcaggaatatcaattaaatattggatatgatgttgctattggtaatataaaattcgaaattgaagcatatatcaaaaactatcaacctgatattattgttttaggtaaaagaaaatctaaaaccattaactttatgggagataatattacagattatgttttaaaacacacaaaggatcaattatga

SEQ ID NO: 22084 - protein, 140 aa, Unknown
  Obtained from environmental sample
  misc_feature (1)..(140): Xaa is any amino acid
MKNNKYKILLLSDLNKSATSELISTVSLARMLDGDITLFHVKKPTDIVERESQLSAMRSINEEHISTNKIIENLIKPVCQEYQLNIGYDVAIGNIKFEIEAYIKNYQPDIIVLGKRKSKTINFMGDNITDYVLKHTKDQL

SEQ ID NO: 22085 - DNA, 471 bp, Unknown
  Obtained from environmental sample
  misc_feature (1)..(471): n is a, c, g, or t
atgaggattaccaagacttcaaaaaacaagttatgtgatttatttatggtttctttagaaaaagaatttccgggtattacaaatcacatgggtcatattgatntagggaccccatggaccaatgaatattatatcaattctacacgagggaatatttacggtacagaaaaaaccttaaagcaaataggtccgtttgcttttaaacctcaatctccatttgaaaatctttatttaactggtgcgagcatattgtctcatggagttgcaggagcagcacatagtggagtagctacggctgctaaaatattgggagagcgtcaagaagaattgcttcaggttaaagcagatcaaaaactcagaattttagaagcagaagatgatactcaatggccacaggatgtaaaaagaaaaatagtacaaaaacagaaaaaattccgcggaagcgaagtgaaaaacaagcatttaaattaa

SEQ ID NO: 22086 - protein, 156 aa, Unknown
  Obtained from environmental sample
  misc_feature (1)..(156): Xaa is any amino acid
MRITKTSKNKLCDLFMVSLEKEFPGITNHMGHIDXGTPWTNEYYINSTRGNIYGTEKTLKQIGPFAFKPQSPFENLYLTGASILSHGVAGAAHSGVATAAKILGERQEELLQVKADQKLRILEAEDDTQWPQDVKRKIVQKQKKFRGSEVKNKHLN

SEQ ID NO: 22087 - DNA, 738 bp, Unknown
  Obtained from environmental sample
  misc_feature (1)..(738): n is a, c, g, or t
atgtctcttgaggatttatcaccaacaacaaaaactaagctgattaataagttattaaaatatacagggtttacagcataccaaagcaagttagataaagagccgctattaaaaaggcttaacgatgttgtaaaaatcaaccttgaaccaaggtatgtttttgatgaatgtattgcttattttggtcaaaacagaatagcgctagctggttatacaacgctgcaagacactatttctacggtattatcaaatgagcgtaaccgaattgaaatggtgctgcttgatagtttgtcttcaggtaccagaaaaacattacttaaattacttgagtcaaataatacctttactgacttagccaagttaaagaaaatggctaaggacttttcaacgagccaaatcacccaagagctgaagacgcataaaattatacgctcgctttatccagaaattaagtcactgattgctgaactggagctatcacctaaaaatcttgaatactatgcttcactggtaaagcacaagtccgtttataagcttagaaaacacgcagatagccaaactattttatatctcgtttgttacttgttcttcacgtaccgagagactaacgacaatcttgttgctgcatttatttacttggtaaggaagttaaccgaatcagctaaaggctatgcaaagcagcgtattgtcgaagatgtcaccattgtaagaaccaaattaaaatcggatggtagttaa

SEQ ID NO: 22088 - protein, 245 aa, Unknown
  Obtained from environmental sample
  misc_feature (1)..(245): Xaa is any amino acid
MSLEDLSPTTKTKLINKLLKYTGFTAYQSKLDKEPLLKRLNDVVKINLEPRYVFDECIAYFGQNRIALAGYTTLQDTISTVLSNERNRIEMVLLDSLSSGTRKTLLKLLESNNTFTDLAKLKKMAKDFSTSQITQELKTHKIIRSLYPEIKSLIAELELSPKNLEYYASLVKHKSVYKLRKHADSQTILYLVCYLFFTYRETNDNLVAAFIYLVRKLTESAKGYAKQRIVEDVTIVRTKLKSDGS

SEQ ID NO: 22089 - DNA, 543 bp, Unknown
  Obtained from environmental sample
  misc_feature (1)..(543): n is a, c, g, or t
atggttacactcaaacaaatagcagaagaattaggtatttctataactacagtttctaaagctttaaaagaatacccagatgtaagtaagaaaactagaaagttagtaagagaaactgctagtatgctaaattataaaccaaattcttttgcagtaaaccttagaaccaaagaatctaaaacaataggactgataattccagaaattgtacaccactttttttcgagtgtcgttaaaggtataattgcgcaagctgaaaaaaaaggatatttagtaattacactacaatctaatgaatcttatgaattagaaaaaaagcagatagaccttttaataaataaaagagtagatggtattttaatttctttagcaaatggtactgcagattataaacatttaactgaagttataagccaagatacaccagtggtaatgtctgataacattgcccacattgtaaaatgctctaaagttctcatcgatgatagaaaagctgcttataatgctaccgaacatctaataatttttgctgtaaaagaatag

SEQ ID NO: 22090 - protein, 180 aa, Unknown
  Obtained from environmental sample
  DOMAIN (2)...(27): Bacterial regulatory proteins, lacI family
  misc_feature (1)..(180): Xaa is any amino acid
MVTLKQIAEELGISITTVSKALKEYPDVSKKTRKLVRETASMLNYKPNSFAVNLRTKESKTIGLIIPEIVHHFFSSVVKGIIAQAEKKGYLVITLQSNESYELEKKQIDLLINKRVDGILISLANGTADYKHLTEVISQDTPVVMSDNIAHIVKCSKVLIDDRKAAYNATEHLIIFAVKE

SEQ ID NO: 22091 - DNA, 423 bp, Unknown
  Obtained from environmental sample
  misc_feature (1)..(423): n is a, c, g, or t
atggaattagtgcttcaaagagcgtattttaaagagggtactaatggtactctctttcgctctggtttatttctttgtcatacaattgagttaccctggaaaaataataagagaaatatttcttgtattccagaaggagaatatcaaattgagcctcgtttttctaaacgatttaaacatcatttaattttaaaagcagtaaaagacagaagttatattttatttcatcctgcaaatgatgctttaaaagatttagaaggctgtattgctccggttacttatttaagtggcataggaaagggtatttattcaaaaaatgctatgcaaaagctactgtctctggtttatcaagctaaagacagaaaggaaattattttattaactattaaatcacaaaattatgaacatagtagaacgttataa

SEQ ID NO: 22092 - protein, 140 aa, Unknown
  Obtained from environmental sample
  misc_feature (1)..(140): Xaa is any amino acid
MELVLQRAYFKEGTNGTLFRSGLFLCHTIELPWKNNKRNISCIPEGEYQIEPRFSKRFKHHLILKAVKDRSYILFHPANDALKDLEGCIAPVTYLSGIGKGIYSKNAMQKLLSLVYQAKDRKEIILLTIKSQNYEHSRTL

SEQ ID NO: 22093 - DNA, 609 bp, Unknown
  Obtained from environmental sample
  misc_feature (1)..(609): n is a, c, g, or t
gtgcaagctgtcggcctgggcatattcgcgttggacggcagcaaataccgaaatattggggtagttggcgatctgcacggatgctacacgaacctgatgaacaaactggatacgattggattcgacaacaaaaaagacctgcttatctcggtgggcgatttggttgatcgtggtgcagagaacgttgaatgcctggaattaatcacattcccctggttcagagctgtacgtggaaaccatgagcaaatgatgattgatggcttatcagagcgtggaaacgttaatcactggctgcttaatggcggtggctggttctttaatctcgattacgacaaagaaattctggctaaagctcttgcccataaagcagatgaacttccgttaatcatcgaactggtgagcaaagataaaaaatatgttatctgccacgccgattatccctttgacgaatacgagtttggaaagccagttgatcatcagcaggtaatctggaaccgcgaacgaatcagcaactcacaaaacgggatcgtgaaagaaatcaaaggcgcggacacgttcatctttggtcatacgccagcagtgaaaccactcaagttgccaaccaaatga

SEQ ID NO: 22094 - protein, 202 aa, Unknown
  Obtained from environmental sample
  DOMAIN (17)...(194): Calcineurin-like phosphoesterase
  misc_feature (1)..(202): Xaa is any amino acid
MQAVGLGIFALDGSKYRNIGVVGDLHGCYTNLMNKLDTIGFDNKKDLLISVGDLVDRGAENVECLELITFPWFRAVRGNHEQMMIDGLSERGNVNHWLLNGGGWFFNLDYDKEILAKALAHKADELPLIIELVSKDKKYVICHADYPFDEYEFGKPVDHQQVIWNRERISNSQNGIVKEIKGADTFIFGHTPAVKPLKLPTK

SEQ ID NO: 22095 - DNA, 477 bp, Unknown
  Obtained from environmental sample
  misc_feature (1)..(477): n is a, c, g, or t
atgagtgttgaactagtacatgattggtatgtagtgcgttgtttctccagtcatgaaaacaaagtgaaagagtttcttgaacgcgaaatcgaagagcaagatcttggcgacaaggtaaaagaagttcttgtaccaactgaaactatagttgagattcgcggagggaaaaagaagaccagagaaaagaattttttcccagggtatatattgctcaacactcactatgatgaagaagtaaataatttagtacaaagtgctccttcttgtttaggatttttgaaagtaggaaagacacaaacaatacctcacccattgaaaaaacacgaagtggatagaattatcggtcgtgttacagaaggcggggaagaaaacgccaatattgagattccgtttagtgaaaggagatctcgtaaaagttatatctggtccattcaaagatttgacgggaccctacacgaagttaacccgattaattaa

SEQ ID NO: 22096 - protein, 158 aa, Unknown
  Obtained from environmental sample
  DOMAIN (6)...(49): Transcription termination factor nusG
  misc_feature (1)..(158): Xaa is any amino acid
MSVELVHDWYVVRCFSSHENKVKEFLEREIEEQDLGDKVKEVLVPTETIVEIRGGKKKTREKNFFPGYILLNTHYDEEVNNLVQSAPSCLGFLKVGKTQTIPHPLKKHEVDRIIGRVTEGGEENANIEIPFSERRSRKSYIWSIQRFDGTLHEVNPIN

SEQ ID NO: 22097 - DNA, 738 bp, Unknown
  Obtained from environmental sample
  misc_feature (1)..(738): n is a, c, g, or t
ttgcgtacagtttatattcaaaataaccgattagaaactatntcaggcactgtaggttatattacaaatagaaactttataaattgcttgagtcaatatccaaattcgtttacagaggaggttaatgacttaaattcagtgattatagacacctacaattctaaacgaaaaaatgtaaatgattctgactttaattttgctgctaaaacgatggttgcttttggagcattggaggtatcaagttatatgctaaaggatatattaacttctaatgcagaaattgcaaaaccatatgcttataagactactggtaaatccaaatctggaacaactgtcggaatttggagcattgtagtctttatacttattattattagacttgcctcattaggaattaatagctctaatcgaaatgattcacgcattaatattgataatcaagaattatttgaagctgttagaaaaattaaacagcgtcaagactatcaaaaaaagatagacttaccactacaagaaaccttaacaactgaggatgtagttgaaacaacattaaacaataaacctataattagtagtgagaagataacattacctgatgttaatagtaaacaaaaagcaaaagatcatactagatttatttattctttaaaattaaaaactaatagaaaagaaccagaaatagacaatagtgcgcctactaaattaaatgatgtanttatccctgggcccattccttga

SEQ ID NO: 22098 - protein, 245 aa, Unknown
  Obtained from environmental sample
  misc_feature (1)..(245): Xaa is any amino acid
MRTVYIQNNRLETXSGTVGYITNRNFINCLSQYPNSFTEEVNDLNSVIIDTYNSKRKNVNDSDFNFAAKTMVAFGALEVSSYMLKDILTSNAEIAKPYAYKTTGKSKSGTTVGIWSIVVFILIIIRLASLGINSSNRNDSRINIDNQELFEAVRKIKQRQDYQKKIDLPLQETLTTEDVVETTLNNKPIISSEKITLPDVNSKQKAKDHTRFIYSLKLKTNRKEPEIDNSAPTKLNDVXIPGPIP

SEQ ID NO: 22099 - DNA, 693 bp, Unknown
  Obtained from environmental sample
  misc_feature (1)..(693): n is a, c, g, or t
ttgataaagagattagaggaaagttctgatattttatcgcaattgcaagaaagagacaataatatttatagaagttactttgaagcaaaccccatccctgaagaacaaagaaaagctggttttggtggagttaacaggtataaaaatttagaaggttttgataattctgggttgataaaaaatttaacgaaagaagttgatattttatcaaaacaaatggtggtacaatctaaatctttagatgaaattgtagctttagcaaaagaaaaagaagatatgttagcttcgattcctgcaattttaccaatcaaaaaaggagaattttatgtggcttctggttacaaaatgagaatgcatcccattttaaaaattaataaatttcataaaggaatggattttacagccccaaaaggaacacctgtttatgcctctggaaatggaaaagttaccatagctcaaagaagtagtacttttggaaatgttgtttatattgaacatggttatggctacaaaacaatttatgcacatttaagtaaaattgaagttaaaaaatataacgaagtaaaaagaggagatttaatagggtttgttggtaatactggtttgtctgtagcttcacatttgcattatgaagtgcataaaaatggtatcgctttaaatccaatcaatttttattatgtgattactctttag

SEQ ID NO: 22100 - protein, 230 aa, Unknown
  Obtained from environmental sample
  DOMAIN (126)...(221): Peptidase family M23
  misc_feature (1)..(230): Xaa is any amino acid
MIKRLEESSDILSQLQERDNNIYRSYFEANPIPEEQRKAGFGGVNRYKNLEGFDNSGLIKNLTKEVDILSKQMVVQSKSLDEIVALAKEKEDMLASIPAILPIKKGEFYVASGYKMRMHPILKINKFHKGMDFTAPKGTPVYASGNGKVTIAQRSSTFGNVVYIEHGYGYKTIYAHLSKIEVKKYNEVKRGDLIGFVGNTGLSVASHLHYEVHKNGIALNPINFYYVITL

SEQ ID NO: 22101 - DNA, 801 bp, Unknown
  Obtained from environmental sample
  misc_feature (1)..(801): n is a, c, g, or t
atgatacgtgcgatgaatcgaatgggtctccatgtcttcatgctggaatactttgccatcaggtatttaaaagagcagcatctgataccggaggattcggtatttattcccggacattccgcagacttttttgccgggagccagttcctcaagcatggaataaactccgaagatgaatcaacgaaggagatcagtaaaaggatctggcacattaaatataacctgtgcaaacctcctaatgatgccaggaaggtcatgatgacgaggatatgcaaaaccctgatgggaaaaaggtaccttgaggctgcccggtcatggtctgtctatgaagactgggaccttaaggaaaagctttccaaattcattgtcaattcctgcaatatttatgcatggtttggatacgaatacaggctgcctttctatgatgtcgccttccaggattttttccgtgatgtaccctacgagttcaagctcaacaaaaagctctatgataccttcctggtaaatgggctttttaagaaatataacttgaaccaggaaaacgagatccagcctgaagccaggatccagcgtacggcaagtctgaaaaggaaactgaagaagatcatgccggaagcccttctaccttccttaccatccagacaggaccccatcttttattatgagataaccaggatgctgcaagaagatctggctaataaaggtacaagtattaatatccatggcaagagctacaattcccttatcgtccagtggtatattgaatacctccagggaggtcactattacaatattctttaa

SEQ ID NO: 22102 - protein, 266 aa, Unknown
  Obtained from environmental sample
  misc_feature (1)..(266): Xaa is any amino acid
MIRAMNRMGLHVFMLEYFAIRYLKEQHLIPEDSVFIPGHSADFFAGSQFLKHGINSEDESTKEISKRIWHIKYNLCKPPNDARKVMMTRICKTLMGKRYLEAARSWSVYEDWDLKEKLSKFIVNSCNIYAWFGYEYRLPFYDVAFQDFFRDVPYEFKLNKKLYDTFLVNGLFKKYNLNQENEIQPEARIQRTASLKRKLKKIMPEALLPSLPSRQDPIFYYEITRMLQEDLANKGTSINIHGKSYNSLIVQWYIEYLQGGHYYNIL

SEQ ID NO: 22103 - DNA, 705 bp, Unknown
  Obtained from environmental sample
  misc_feature (1)..(705): n is a, c, g, or t
atggaacaccacgtatatattaagaagagcaatggagaaactgagcttttttcatttaaaaaactaagaagatcacttcaatctgcaggcgctaccactgatatggtggataccattgtagacaacatacaaggccagatctatgacggcatgtcctctaacgcgatatatagaaaggcgtttagcttattaaaaggcaaaaataaaatctctgcatctcgctacagtttaaaacgcgccattcttgaattgggtcccaccggctacccttttgaaagattgattggagccttactaaaggaaaaaggctatgacactaaagtgagtgtgaccttacatggtgaatgtgtgacgcacgaaattgatgtactggcagaaaaagatggcaatgtatatgccatagaatgtaaattccacgcagatgccagagcaaccagcaatgtcagagtgcccttatacattaattcgcggtttttagacattcaaaaacagtggaataccaatccaaacaacaaatcacatttaaaacaagggtggttggtgaccaatacccgatttaccgaagatgccgtaaattatggaaaatgtgttgggttaactttgttgagttgggattacccaaaaaacaatggcctaaaagcaaatatagattccttagcattatatccagtnttaccttctcgagccgaatctgtgatccactag

SEQ ID NO: 22104 - protein, 234 aa, Unknown
  Obtained from environmental sample
  DOMAIN (95)...(206): Restriction endonuclease
  misc_feature (1)..(234): Xaa is any amino acid
MEHHVYIKKSNGETELFSFKKLRRSLQSAGATTDMVDTIVDNIQGQIYDGMSSNAIYRKAFSLLKGKNKISASRYSLKRAILELGPTGYPFERLIGALLKEKGYDTKVSVTLHGECVTHEIDVLAEKDGNVYAIECKFHADARATSNVRVPLYINSRFLDIQKQWNTNPNNKSHLKQGWLVTNTRFTEDAVNYGKCVGLTLLSWDYPKNNGLKANIDSLALYPVLPSRAESVIH

SEQ ID NO: 22105 - DNA, 555 bp, Unknown
  Obtained from environmental sample
  misc_feature (1)..(555): n is a, c, g, or t
atgagttttgcaaaattaaaccatactttgaaaaaactgctattattcatattgtcattattctttgccaacgcaaatgcacaatcggaatttgatttagaaaaagttttgaaaatcgaaagacgagaaatgattgttatggaaattgactcatatctgaatgaaaaatcagaatatggagaaaagattgagaaactgaattcttcacaacaaacttttctttttgtggaaaatttggaacgtgagataaataatggtggatttaatcaattctattttaattcaagtggaaattttagtcaagaaacagtagatactcttttagaaattggagcaaaaaaaacggcggaaattataaaaaaagcaaattctgaatttaaaaccggaattgttccaaaagacagaactgaaagacaaaccgaattggaactgattgaaaaaaatgcggaagaaaactggaataaatgcgattcggaattttatgaatataaagatgacttgaccgaattattaattgtttttgcgattaagaacaaaactgaatttaaaaaataa

SEQ ID NO: 22106 - protein, 184 aa, Unknown
  Obtained from environmental sample
  misc_feature (1)..(184): Xaa is any amino acid
MSFAKLNHTLKKLLLFILSLFFANANAQSEFDLEKVLKIERREMIVMEIDSYLNEKSEYGEKIEKLNSSQQTFLFVENLEREINNGGFNQFYFNSSGNFSQETVDTLLEIGAKKTAEIIKKANSEFKTGIVPKDRTERQTELELIEKNAEENWNKCDSEFYEYKDDLTELLIVFAIKNKTEFKK

SEQ ID NO: 22107 - DNA, 327 bp, Unknown
  Obtained from environmental sample
  misc_feature (1)..(327): n is a, c, g, or t
ttgatgatgtctaaatgtaataataaaagcttagaattaattaaagaaaaatttgaagcttttaaagaaaacgataccattttagtttcagaaaaagaattggcttttaatagccttaaaagaagaaagtacttatataccacaaactttgctttaaataataaaaacagtgaggtagcgccttatttagcccttaccgaattgcataatgctaacattaagttattagacactataaataactcattaaccaaagaaataaaaacttcgctttacggtaaaagtttacaacagtttatagataggattaaaactgaagaacaatag

SEQ ID NO: 22108 - protein, 108 aa, Unknown
  Obtained from environmental sample
  misc_feature (1)..(108): Xaa is any amino acid
MMMSKCNNKSLELIKEKFEAFKENDTILVSEKELAFNSLKRRKYLYTTNFALNNKNSEVAPYLALTELHNANIKLLDTINNSLTKEIKTSLYGKSLQQFIDRIKTEEQ

SEQ ID NO: 22109 - DNA, 516 bp, Unknown
  Obtained from environmental sample
  misc_feature (1)..(516): n is a, c, g, or t
ttggatcttgatgaaaatacaatagttgtactttggggtgatcacggctggcatctcggagatcaacgtatttggggtaaacatacattattcgaaaatgcactcaaaagtgtgctgattattaaagaacccaaagggaaattgaaaaaagatatcataaattctattgttgaaacagtggacatttatccaagtttattggaactttgtgatattgagatttctcactcaatagatggtgaaagctttatggatttagaaaagtattcaaatatcataactgaagatgtggcttatagttattttaaaaacggaatatcagtacgaaccaatcagtatcgcctaacccagtattttagaaaagaagagcctatcattgaactatatgattatgagaatgacccacatgaaaccaagaacattgctaaaataaaacctgatatggtccaagagttattacctatattagccaaaggaaatacggggctttatgccgattttgaaaccacgaaatag

SEQ ID NO: 22110 - protein, 171 aa, Unknown
  Obtained from environmental sample
  misc_feature (1)..(171): Xaa is any amino acid
MDLDENTIVVLWGDHGWHLGDQRIWGKHTLFENALKSVLIIKEPKGKLKKDIINSIVETVDIYPSLLELCDIEISHSIDGESFMDLEKYSNIITEDVAYSYFKNGISVRTNQYRLTQYFRKEEPIIELYDYENDPHETKNIAKIKPDMVQELLPILAKGNTGLYADFETTK

SEQ ID NO: 22111 - DNA, 795 bp, Unknown
  Obtained from environmental sample
  misc_feature (1)..(795): n is a, c, g, or t
gtggctttagttgaagtcaatgacagagaattaaaggtgattgataatgaaggtgataattttttaggtggagcagattttgataatcttattgtcgaaaaaattattattcctaaaatagaagctaaaacaaatattacaaatctgtttaaatcaattaaatccaagtcaagtcaatacaaagggctatattttgaattacttaaaaaagcagaagaagctaaaaaagaactatcggtttatcctgaaacagaaatcgaattagatatagatataaataatgataatttatttgaacaaataattattacaagagcagaatttgaagctgttatcttgccaaaagttgagcaaaccatagcgtttattaaaaaagtgatttctcaaaatcaacttttaaattctcaaatagatcgcctaattttaattggtggtagtacttatgtgccattaataaaacagcgtataaaagaagaaacagggatacttgtagactcaagtattgacccaacatccgcagtggttgatggtgcagcttattttgctggatcaaaaccaacgactataaaagaggatgacgcagttgttcaagaagttgaagttgatacagtagagactcaacttttttatgagcaaaatactagagatttagaagagttaattacttgtaaagtggctagtgataattttaattatagaattaccagggttgatggtggttatgattctagtatcaagactattgtaaataatgggctttctgaagtttgtcccattactaaaaggacaatttaa

SEQ ID NO: 22112 - protein, 264 aa, Unknown
  Obtained from environmental sample
  misc_feature (1)..(264): Xaa is any amino acid
MALVEVNDRELKVIDNEGDNFLGGADFDNLIVEKIIIPKIEAKTNITNLFKSIKSKSSQYKGLYFELLKKAEEAKKELSVYPETEIELDIDINNDNLFEQIIITRAEFEAVILPKVEQTIAFIKKVISQNQLLNSQIDRLILIGGSTYVPLIKQRIKEETGILVDSSIDPTSAVVDGAAYFAGSKPTTIKEDDAVVQEVEVDTVETQLFYEQNTRDLEELITCKVASDNFNYRITRVDGGYDSSIKTIVNNGLSEVCPITKRTI

SEQ ID NO: 22113 - DNA, 642 bp, Unknown
  Obtained from environmental sample
  misc_feature (1)..(642): n is a, c, g, or t
atggttgcttttggagcattagaggtatcaagttatatgctaaaggatatattaacttctaatgcagaaattgcaaaaccatatgcttataagactactggtaaatccaaatctggaacaacagtcggaatttggagcattgtagtctttatacttattattattagacttgcctcattaggaattaatagctctaatcgaaatgattcacgcattaatattgataatcaagaattatttgaagctgttagaaaaattaaacagcgtcaagactatcaaaaaaagatagacttaccactacaagaaaccttaacaactgaggatgtagttgaaacaacattaaacaataaacctataattagtagtgagaagataacattacctgatgttaatagtaaacaaaaagcaaaagatcatactagatttatttattctttaaaattaaaaactaatagaaaagaaccagaaatagacaatagtgcacctactaaattaaatgaatttacgaatccatatcctaaaacttttaataagattgaagcttatgcttatggtgtggcaaataattcagaatacagcttggttaaaaacagcagtagtaaagatttaatagtatttaaacttcaaaaagggattgannnn

SEQ ID NO: 22114 - protein, 214 aa, Unknown
  Obtained from environmental sample
  misc_feature (1)..(214): Xaa is any amino acid
MVAFGALEVSSYMLKDILTSNAEIAKPYAYKTTGKSKSGTTVGIWSIVVFILIIIRLASLGINSSNRNDSRINIDNQELFEAVRKIKQRQDYQKKIDLPLQETLTTEDVVETTLNNKPIISSEKITLPDVNSKQKAKDHTRFIYSLKLKTNRKEPEIDNSAPTKLNEFTNPYPKTFNKIEAYAYGVANNSEYSLVKNSSSKDLIVFKLQKGIXX

SEQ ID NO: 22115 - DNA, 558 bp, Unknown
  Obtained from environmental sample
  misc_feature (1)..(558): n is a, c, g, or t
atgatgggttggccaaaagggttagaaaattcaaccgaatatgctaaaatgactgaggcgctcttacacttagactacaacctactctatttagattttgaccataaaacaaaatttggcaactataatacggtagatttatggtggagagaaaccgatagcaaaaatgctgaaatgatgttgaatattgcacgttttatcattgcttctcaaaagtggaacaaaacaaacatcagagtactctttgtaaacaataacaatgttgacaaaacaattatctactccaaaataagtaagctggtagaagatttaagagtgaatgttgccatcaaaataatcaataatgcagtagagcaaaaacctttttacgacctcattgaagagcaatctatacatacggatttaactttggtaggtatccctaactatcaaattgaaaagcaagctgaatttgtactaaaaacaagtcacttattcgaatctattgggtcaacgctcatggttaaagcagccaataattttaatgtgttggacttagattttataaaaaatgaataa

SEQ ID NO: 22116 - protein, 185 aa, Unknown
  Obtained from environmental sample
  misc_feature (1)..(185): Xaa is any amino acid
MMGWPKGLENSTEYAKMTEALLHLDYNLLYLDFDHKTKFGNYNTVDLWWRETDSKNAEMMLNIARFIIASQKWNKTNIRVLFVNNNNVDKTIIYSKISKLVEDLRVNVAIKIINNAVEQKPFYDLIEEQSIHTDLTLVGIPNYQIEKQAEFVLKTSHLFESIGSTLMVKAANNFNVLDLDFIKNE

SEQ ID NO: 22117 - DNA, 591 bp, Unknown
  Obtained from environmental sample
  misc_feature (1)..(591): n is a, c, g, or t
atgtttcgtcattattgtgaaagataccaaacagatggtgtagaatacaatatgtacattggtgcatctatcgacgagacaaaagtatttaacgaaatttatttgtttaacttacgtttgtggcagttacaaactacctgcgaaatggaaaatattgcttattcgcttcgtaaaaaaatgaagaacgatttaagagtagcttccttaattttagtccacagcaattccatggccattaagtttagaatggatgaaaaacagtttgatgttgatggagcttacaatattcgttacgaaattattaaaaaacgaattgacaaagcctttataaagaatacagaagaacgtttaactgtacctggtaaaatagccattgtatactcacaagacaaagatgctttagagtatataaaatatataaacttcttacaatctaaaaaacaattgggcaaattagagtttttagaattagaagttttacaaggtgctgctggtttaaaagctttacgtgtagaagttatttaccaagaagattttgatgagaaaaaagtaattacttttaacgatttaattaaggaaatatctaactaa

SEQ ID NO: 22118 - protein, 196 aa, Unknown
  Obtained from environmental sample
  misc_feature (1)..(196): Xaa is any amino acid
MFRHYCERYQTDGVEYNMYIGASIDETKVFNEIYLFNLRLWQLQTTCEMENIAYSLRKKMKNDLRVASLILVHSNSMAIKFRMDEKQFDVDGAYNIRYEIIKKRIDKAFIKNTEERLTVPGKIAIVYSQDKDALEYIKYINFLQSKKQLGKLEFLELEVLQGAAGLKALRVEVIYQEDFDEKKVITFNDLIKEISN

SEQ ID NO: 22119 - DNA, 345 bp, Unknown
  Obtained from environmental sample
  misc_feature (1)..(345): n is a, c, g, or t
atgtatattattgcatgtacgtttattttacaatatgtttatgattataaagtagatacaaaaagacctttttattttgatattcctgataaaaaattaggaacaatgaaatattatagagcagcttttaatggcgatttttctgaaatttatgctactgagaatgcaccaattttaacagaaaaagattttaaagaactcctgaataattttgaggacattaatgtttggagagaaaaattccctaaagatagttatgtctttacaggatttggtatcataaacttgttggatgttactgatgaggaaatgattcctctattcaagcaatttattagctggtga

SEQ ID NO: 22120 - protein, 114 aa, Unknown
  Obtained from environmental sample
  misc_feature (1)..(114): Xaa is any amino acid
MYIIACTFILQYVYDYKVDTKRPFYFDIPDKKLGTMKYYRAAFNGDFSEIYATENAPILTEKDFKELLNNFEDINVWREKFPKDSYVFTGFGIINLLDVTDEEMIPLFKQFISW

SEQ ID NO: 22121 - DNA, 666 bp, Unknown
  Obtained from environmental sample
  misc_feature (1)..(666): n is a, c, g, or t
atgctaaaagtacatcaagagcttaaaaataatatttcttgtgattttaataataataggttggcatcaaaaggtagtaacatttttgccatttatatagataaaggattaaatggaaaagaattatttattggtttacataagttatttgaagatttttggaaattcgaatataataacgatttcaaacctaaatatgatgatcaaatagatataaaacaccaaaagtatggctacaaatatgagactcatccattatttaaagaaataaaatcaaatgaagcaccaattgataattcaatcgagcaacatttaaaagatatagaatttaaatatgaaattttttgggattattttggaaattacataggtgattatttcagaaatatttatcatactttagattatatcagtacggaaaaaacgagagaacttaggacagatatttttgaatcagaaagaaaccaaataaacgaaaaatataaaaaatacgcagatatattacaatcgcaattgagtttttcagagatatttttgattttctataattcacataggtttccgaaaatgaaagagcttattcatgaaattgattttgtagaaaatttcctatttcaaatcttttggctccaanactggcaaattcgaagggatgggcaaacttaa

SEQ ID NO: 22122 - protein, 221 aa, Unknown
  Obtained from environmental sample
  misc_feature (1)..(221): Xaa is any amino acid
MLKVHQELKNNISCDFNNNRLASKGSNIFAIYIDKGLNGKELFIGLHKLFEDFWKFEYNNDFKPKYDDQIDIKHQKYGYKYETHPLFKEIKSNEAPIDNSIEQHLKDIEFKYEIFWDYFGNYIGDYFRNIYHTLDYISTEKTRELRTDIFESERNQINEKYKKYADILQSQLSFSEIFLIFYNSHRFPKMKELIHEIDFVENFLFQIFWLQXWQIRRDGQT

SEQ ID NO: 22123 - DNA, 681 bp, Unknown
  Obtained from environmental sample
  misc_feature (1)..(681): n is a, c, g, or t
atgtcttataagaaaaaggaatccaaaatgcatctttataacgaagctgaagtgctttatgaagatatggaagtgactgctggtcatattattttagattttgataaagatttaatttatgccaaaggtattattgacgattctactaaactttacaaacagcgacctgtatttaaacaaggcgaaaatgtaatagaaccagattctattgtatttaatacggttactaaacaagggttaatatataattcggttaccgaacaaaatggtggtacattaataacagaaactaccaaaaaagtaaatgactcggtttattatttaaaaaacgcaaagtttacaactgctgaagatttagaagatccagaatactactttttaattagaacaggtaaattagtgccaggtagtaaagttattactggactaacaaacttatttatttatgatgtaccaacacctataggattaccttttgccttttttcctttaaccaaaaagcaaacgtcaggtgttatttttcctagttttggagaggatggtaatcgtgggtactttttacaaaatggtgggtattattttgctattagtgattatttcgatttagccttattaggtgattattataccaatggtagttatggtttaagagtagaaaaacaatacgcaagaagttattaa

SEQ ID NO: 22124 - protein, 226 aa, Unknown
  Obtained from environmental sample
  misc_feature (1)..(226): Xaa is any amino acid
MSYKKKESKMHLYNEAEVLYEDMEVTAGHIILDFDKDLIYAKGIIDDSTKLYKQRPVFKQGENVIEPDSIVFNTVTKQGLIYNSVTEQNGGTLITETTKKVNDSVYYLKNAKFTTAEDLEDPEYYFLIRTGKLVPGSKVITGLTNLFIYDVPTPIGLPFAFFPLTKKQTSGVIFPSFGEDGNRGYFLQNGGYYFAISDYFDLALLGDYYTNGSYGLRVEKQYARSY

SEQ ID NO: 22125 - DNA, 495 bp, Unknown
  Obtained from environmental sample
  misc_feature (1)..(495): n is a, c, g, or t
gtgcagaaagatttagagactagatttttatcggactttgaaacaaaccaaaatattgcgcataaaatttgtagaatttatactacaaataaagatgctcataatgatttatttcaagagattactattcagctttggaaaaattaccccaaatttagaggggattccaagtttagtacctggatgtatagagtagctttaaacacagcaatttctttatatagaaaatcgacaagaagaattaaaacacaagatataagtgattttgcttataaaattaaagggcatgaatatgatgatacagaagaaaaacaattagcttctttatacaaagcaatacatcatttaagtgatattgacaaggctttaattttcttgtatttagaagataaaccttataaagaaatagcagaaacattaggaataacctctgtaaatgcgagagtaaagatgaacagagcaaaagaaaaattaaaaaacattttaaacccataa

SEQ ID NO: 22126 - protein, 164 aa, Unknown
  Obtained from environmental sample
  DOMAIN (112)...(160): Sigma-70, region 4
  misc_feature (1)..(164): Xaa is any amino acid
MQKDLETRFLSDFETNQNIAHKICRIYTTNKDAHNDLFQEITIQLWKNYPKFRGDSKFSTWMYRVALNTAISLYRKSTRRIKTQDISDFAYKIKGHEYDDTEEKQLASLYKAIHHLSDIDKALIFLYLEDKPYKEIAETLGITSVNARVKMNRAKEKLKNILNP

SEQ ID NO: 22127 - DNA, 648 bp, Unknown
  Obtained from environmental sample
  misc_feature (1)..(648): n is a, c, g, or t
ttgggcaaaaagaaatcatcagagacaatccagaaggtgatgccatttattggtttagatgcactcatcgaccctgattatcgcggctaccgtctcggtcgtcgtctttatgatgcacgcaaggagttatgccgacagctgaacttccgcgctatcttagctggcggacgcatacctaactatcataaccataaagatctgactccaggtgaatatattgatgccgttgaaagccgtgaaattcacgattcagctttgtcgttccagctatctaatggctttatcgttaaacgtattttgaccgcttatctgccagatgataagcaatcaaagggctttgctaccttgcttgagtgggcaaatatctactacgagcctaaagactataagcctaatactcgcaagtctgaagtgcgtattggtggtattcagtggcagatgcgtgaagtcgaatcacctgaagagctactgcaacaggttgagttttttgtcgatatcatggccgactacaactcagactttgcttgtttacctgagtttttcaaatgcgccattgatgggtctattgtgaagaaaccgatcaaaatattgctattcgaattttggcaggttataccgagtggttcacaaatgacatctcgcatttag

SEQ ID NO: 22128 - protein, 215 aa, Unknown
  Obtained from environmental sample
  misc_feature (1)..(215): Xaa is any amino acid
MGKKKSSETIQKVMPFIGLDALIDPDYRGYRLGRRLYDARKELCRQLNFRAILAGGRIPNYHNHKDLTPGEYIDAVESREIHDSALSFQLSNGFIVKRILTAYLPDDKQSKGFATLLEWANIYYEPKDYKPNTRKSEVRIGGIQWQMREVESPEELLQQVEFFVDIMADYNSDFACLPEFFKCAIDGSIVKKPIKILLFEFWQVIPSGSQMTSRI

SEQ ID NO: 22129 - DNA, 357 bp, Unknown
  Obtained from environmental sample
  misc_feature (1)..(357): n is a, c, g, or t
atgttagaaatagaacgtaaatttttggttaattcttcaagttataagtccgaagcttttaaacaaacccaaattatacaaggatttttaaatacccacaaagcgcgaactgttcgggttagagtaaaaggggataagggctatttaacggttaaaggtgagtcgtctagtaatgggctaacccgttttgaatgggagaaggaaataactaaaaaagaagccgaatcacttttgaatttatgtgagcctggtgtgattagcaaaataagatatgaggttaaagtagaggatcacatctttgaaatcgatgaattttcagtgataattgggaacggctcgaccgatgctgatccatag

SEQ ID NO: 22130 - protein, 118 aa, Unknown
  Obtained from environmental sample
  misc_feature (1)..(118): Xaa is any amino acid
MLEIERKFLVNSSSYKSEAFKQTQIIQGFLNTHKARTVRVRVKGDKGYLTVKGESSSNGLTRFEWEKEITKKEAESLLNLCEPGVISKIRYEVKVEDHIFEIDEFSVIIGNGSTDADP

SEQ ID NO: 22131 - DNA, 456 bp, Unknown
  Obtained from environmental sample
  misc_feature (1)..(456): n is a, c, g, or t
atgatcaaagacataaaattggcagtactcattgatggtgacaatattccttcaaagtatatcaaagaaatgatggaagaaattaccaaatacggcacacctacaataaaacgtatttacggagattggacgaaacctcatttgacaaaatggaaaaatatattgcttgaaaatgcaataaccccaattcaacagtatgcctatactattggtaaaaatgcaactgactcggccatgatcatagatgccatggatattttatattcaaaaaatgttgatgggttcggtatagtttcatccgatagtgattttacaaaattagcgacaagattacgagaagaaggactggtgcgtcatggtattggagaaaagaagacaccagatccgtttattgttgcctgcgataagttatatatctggaaatcattaaaacctttgatgattaacggacggtaa

SEQ ID NO: 22132 - protein, 151 aa, Unknown
  Obtained from environmental sample
  misc_feature (1)..(151): Xaa is any amino acid
MIKDIKLAVLIDGDNIPSKYIKEMMEEITKYGTPTIKRIYGDWTKPHLTKWKNILLENAITPIQQYAYTIGKNATDSAMIIDAMDILYSKNVDGFGIVSSDSDFTKLATRLREEGLVRHGIGEKKTPDPFIVACDKLYIWKSLKPLMINGR

SEQ ID NO: 22133 - DNA, 483 bp, Unknown
  Obtained from environmental sample
  misc_feature (1)..(483): n is a, c, g, or t
ttgaaaagaaaagaaggtttaaataaattaggaaaaaaaaacaagaattatgaaagtggaatttattttatcatagaggaaaaagaaggagagttattttttagagatgaaaatgaatcaaatataataatgactagcaatagagagcaatataaaattaaaatacctaacacaattaaacttaattggcaatctagtgattgtaataataaaggagaagatattaatttcttttattttaattctgaaaaatcgagtttatctaattttgatggtgaagttgctatttcgtcttcaatacacgatgtaagtttagtagatgttaaaggaccagtttctattaatactattggtgggaatgtaactattaaatttgataaaaaaacaccacaaaagctatattcgatttactccaataatggttttatagatattacattacctaaacattcagatttacaattagatatttctggcaagtaa

SEQ ID NO: 22134 - protein, 160 aa, Unknown
  Obtained from environmental sample
  misc_feature (1)..(160): Xaa is any amino acid
MKRKEGLNKLGKKNKNYESGIYFIIEEKEGELFFRDENESNIIMTSNREQYKIKIPNTIKLNWQSSDCNNKGEDINFFYFNSEKSSLSNFDGEVAISSSIHDVSLVDVKGPVSINTIGGNVTIKFDKKTPQKLYSIYSNNGFIDITLPKHSDLQLDISGK

SEQ ID NO: 22135 - DNA, 396 bp, Unknown
  Obtained from environmental sample
  misc_feature (1)..(396): n is a, c, g, or t
atgggatttgtaagacaattaaatgagggcgtttctcgtatttacaaatcaatggaagaatcaatgctttcaaaaccagagtacattgaaaaaaatggtaatgtctatttaatactgcgtaataaaataagcaatcacagtaaaaccataccagatgccattataaagcatattcaaagtaattggtcaaattataatgatacacaaagaaaggttttacagtttttattgtacaacaatcaagctactgtagccgaattatcagaacatacagatattaacgaaaaaactataaaactgtacttaaaacaatttatagaaaatgaaaatattctagatagattgagcgataaggttagagataagaacgcaaaatatgcctttaagaaggattaa

SEQ ID NO: 22136 - protein, 131 aa, Unknown
  Obtained from environmental sample
  misc_feature (1)..(131): Xaa is any amino acid
MGFVRQLNEGVSRIYKSMEESMLSKPEYIEKNGNVYLILRNKISNHSKTIPDAIIKHIQSNWSNYNDTQRKVLQFLLYNNQATVAELSEHTDINEKTIKLYLKQFIENENILDRLSDKVRDKNAKYAFKKD

SEQ ID NO: 22137 - DNA, 780 bp, Unknown
  Obtained from environmental sample
  misc_feature (1)..(780): n is a, c, g, or t
gtgggcgatttagacgaaaaagcgtttagacgtattcaaattagagaaaccattttatcgcacttacaaaaggaaaaagaattatataataaagacataaaagtactatccttattttttattgatactgtagataagtaccgtaagtatgatgaaaatggagaacaagttttaggggaatatgcgcagatatttgaagaggaatacaacaaattaaaaaacgattttctagacttatttcaacaagaatataatgactatttaaaagatacagatcctggtactgcacgtaaagcgtattttcctagtgcttatgcagagtttttagatagagataaagcggatgaaattcacaatgggtatttctcaatagacaaaaagaaaaagtttattgaccctagtgtaaagcgtggtaaagaagattcagatgatatttctgcgtatgatttgataatgaaagacaaagaacgcttgttaagtatggatgaaccaacacgttttatcttttcgcactctgctttaaaagagggatgggataaccctaatgtatttcaaatttgtgctttaaaacattcagaagctactattagaagaagacaagaagttggtcgtggtatgcgtttatgtgttgaaggtaaaaatggtgtacgtcaagattatgatacggttggtgatgctgtgcataccattaataaattaaccattatagcttcagaaagttatgaggattttgcaaaaggactacaatctgaatcgctcggccgattctttgtccngtag

SEQ ID NO: 22138 - protein, 259 aa, Unknown
  Obtained from environmental sample
  misc_feature (1)..(259): Xaa is any amino acid
MGDLDEKAFRRIQIRETILSHLQKEKELYNKDIKVLSLFFIDTVDKYRKYDENGEQVLGEYAQIFEEEYNKLKNDFLDLFQQEYNDYLKDTDPGTARKAYFPSAYAEFLDRDKADEIHNGYFSIDKKKKFIDPSVKRGKEDSDDISAYDLIMKDKERLLSMDEPTRFIFSHSALKEGWDNPNVFQICALKHSEATIRRRQEVGRGMRLCVEGKNGVRQDYDTVGDAVHTINKLTIIASESYEDFAKGLQSESLGRFFVX

SEQ ID NO: 22139 - DNA, 609 bp, Unknown
  Obtained from environmental sample
  misc_feature (1)..(609): n is a, c, g, or t
ttgcgtcacaatatcattccgcagttaaaagctatcaacccacagtttttaagtaattttgaaagcacgcttagtcatttaaaagcgagccaatctattataaacgaaagtgtagatgctgttttaaaagaagcggtaatctcttcagatgcgaaaacgaccgcatttaatattagtattttacaaaaactgaagtccgttgaagcatttttatatgaaatttttaaagccttcggatttaatagtggggctgcaattcaagagttaatgactgcgcaatctggcaaacaattgtttagtgacacgcatacgcttttaaaaaatagagaagaattaatattgtctttaaaaactaaacctatatacaatgacactatttccattcccttaggaattaaacatattaaaataaacagcggaaccttaacttttacatcggttgatagcattttggatcatcacgcaaatactgtttttgtagataaagataaattggagtttccgttaacagtacgacattgggaaactggggattacttttatcctttaggaatgcagggaaaaaagaaattgagtaaattttttaaagatgaaaactatctgttttag

SEQ ID NO: 22140 - protein, 202 aa, Unknown
  Obtained from environmental sample
  misc_feature (1)..(202): Xaa is any amino acid
MRHNIIPQLKAINPQFLSNFESTLSHLKASQSIINESVDAVLKEAVISSDAKTTAFNISILQKLKSVEAFLYEIFKAFGFNSGAAIQELMTAQSGKQLFSDTHTLLKNREELILSLKTKPIYNDTISIPLGIKHIKINSGTLTFTSVDSILDHHANTVFVDKDKLEFPLTVRHWETGDYFYPLGMQGKKKLSKFFKDENYLF

SEQ ID NO: 22141 - DNA, 456 bp, Unknown
  Obtained from environmental sample
  misc_feature (1)..(456): n is a, c, g, or t
atgattgtagacttagtgcgtaacgatttgtcgcataccgcaacaaaaggcagcgtaaaggttgaagaattgtgtaaaatatatactttcgatcaagtgcatcaaatgatttctactgtagtttcaaaagttgatgaaagcacaagtcctataaaaatactgcaaacaacatttccaatggggagtatgacgggtgttccaaaaatttcagctttaaaaattatcgaaaactttgaggaaaccaaacgtggattgtattctggagccgtgggttatattaccccaaatggtgatttcgattttaatgtggtcatacgaagtattctttataacgcaaccaaaaattacgtttcatattctgttggtggcgctattactgctaaaagcaacccagaaaaagagtacgaagagtgtttaattaaagctaaagcaatgcgcgacgtgcttgaaaactag

SEQ ID NO: 22142 - protein, 151 aa, Unknown
  Obtained from environmental sample
  DOMAIN (1)...(149): chorismate binding enzyme
  misc_feature (1)..(151): Xaa is any amino acid
MIVDLVRNDLSHTATKGSVKVEELCKIYTFDQVHQMISTVVSKVDESTSPIKILQTTFPMGSMTGVPKISALKIIENFEETKRGLYSGAVGYITPNGDFDFNVVIRSILYNATKNYVSYSVGGAITAKSNPEKEYEECLIKAKAMRDVLEN

SEQ ID NO: 22143 - DNA, 393 bp, Unknown
  Obtained from environmental sample
  misc_feature (1)..(393): n is a, c, g, or t
ttgctgtccacctcagggcgtgttgttaccagccggtcagaaaagtatcgagaacagactgagatatggttaaaaaagtataaagtagaatacgagtatttaattatgcaagatttacctggtaaagaaggaggacaaaagcaaattagtcatgcaaagcataaagctttattttatcaaaaaagtagtgcagagctttttattgaaagcgactataagcaaagtattgaaattaatcatatcactaaaaaaccagttttttgtgcagctagtaaccaaataattaacaacggcttttataatctaaagcatgaagcagttacaagcttaaaagaacggttggcttcgtttatacctcgtggcatacaaaatcagattaaaaaattatattaa

SEQ ID NO: 22144 - protein, 130 aa, Unknown
  Obtained from environmental sample
  misc_feature (1)..(130): Xaa is any amino acid
MLSTSGRVVTSRSEKYREQTEIWLKKYKVEYEYLIMQDLPGKEGGQKQISHAKHKALFYQKSSAELFIESDYKQSIEINHITKKPVFCAASNQIINNGFYNLKHEAVTSLKERLASFIPRGIQNQIKKLY

SEQ ID NO: 22145 - DNA, 528 bp, Unknown
  Obtained from environmental sample
  misc_feature (1)..(528): n is a, c, g, or t
ttgaatttaacagataataaaggtcgtattggttattttaaaaacactattattatcatgacctccaacatgggaagtcaaataatacaagagcgttttgatgctgtaaaagatgtagaaactgctattgaaggtgctaaagtggatgttttagccttattaaaacaaacggtaagacctgagtttataaataggattgatgacataattatgtttacacctttaacacaagataatattacagaaattgtaggattacagctaaaaggtatttctaaaatgattgcaaaacaagggataacttttgatgcaacacctgaagctattaaatatctagcagataaaggttataatccagaatatggtgcaagacctgtaaaacgtgtcattcagaaagatgtacttaaccaattaagtaaagagattttatcaggaaaagtaacaacagatagtattattttattagatgcttttgatggcgaattagtctttagaaatcaaagcgatttagtaacggaagaactgtaa

SEQ ID NO: 22146 - protein, 175 aa, Unknown
  Obtained from environmental sample
  misc_feature (1)..(175): Xaa is any amino acid
MNLTDNKGRIGYFKNTIIIMTSNMGSQIIQERFDAVKDVETAIEGAKVDVLALLKQTVRPEFINRIDDIIMFTPLTQDNITEIVGLQLKGISKMIAKQGITFDATPEAIKYLADKGYNPEYGARPVKRVIQKDVLNQLSKEILSGKVTTDSIILLDAFDGELVFRNQSDLVTEEL

SEQ ID NO: 22147 - DNA, 621 bp, Unknown
  Obtained from environmental sample
  misc_feature (1)..(621): n is a, c, g, or t
ttggcaggagaggtaaaatcgaatacctacctagatgtccaaaaaatagcaagagataccattaataaaataggctacactaaaggcgcctatatgttcgacggtagttcttgtggtgtattctctgcaatacatgaacaaagtgaagacattaatcgtggcgtagacaaagaaaataaagaagaacaaggtgctggcgaccaaggaatgatgtttggctatgcaactaaagagactgaaaactatatgccactggctttagacttgtctcataaaatattaattgaattggccgctttacgtcgtgaagacaaagacattacatatttgagacccgattctaagagtcaagtgactattgaatatagcgatgacaacgtcccacagcgtattgaagctattgtgatttctacacagcatgacgactttgtaaaaccagcgtcaaaagctagagaagatgtttctaaagcagatgaagagatgctttctaaaattagaaaagatcttgttgagatattaattcctagagtaattgcgaaattacttaaagatttaaagactttatttaacgactctattaaataccatattaacccgacaggaaattgtacttgtcattaa

SEQ ID NO: 22148 - protein, 206 aa, Unknown
  Obtained from environmental sample
  DOMAIN (61)...(203): S-adenosylmethionine synthetase, central domain
  misc_feature (1)..(206): Xaa is any amino acid
MAGEVKSNTYLDVQKIARDTINKIGYTKGAYMFDGSSCGVFSAIHEQSEDINRGVDKENKEEQGAGDQGMMFGYATKETENYMPLALDLSHKILIELAALRREDKDITYLRPDSKSQVTIEYSDDNVPQRIEAIVISTQHDDFVKPASKAREDVSKADEEMLSKIRKDLVEILIPRVIAKLLKDLKTLFNDSIKYHINPTGNCTCH

SEQ ID NO: 22149 - DNA, 591 bp, Unknown
  Obtained from environmental sample
  misc_feature (1)..(591): n is a, c, g, or t
atgcaaaataatattttacatctagatttagacactttttttgtctcatgcgagcgactaatagatagtcgtttacaaaaaaaacctttactagttgggggtacaggagatagaggtgtagtggcagcttgtagttatgagactagagtgtttggtatacattctggtatgtccatgaaagttgctagacgcttatgtccagaagctacagtaattagagggaatgcttcgatttatacaaaattttctcatcaagttacagagattataaaagaaaaagtacctgtatttgaaaaagcaagtgtggacgagttttacgcagatttatcaggaatggataagttttatggctgttataaatacgcgtcagagcttagacaaaaaataattaaagactctggattacccatttcgtttggattgtctgccaataaaattgtatctaaagtagcaactggtgaagctaaaccaaataaccaattacagatagattctggttttgaaaaagattttttggcaccattatccattcgtaaaataccatctgtggagaaaaacctatcagtgtcacaggtccggatgattaaatag

SEQ ID NO: 22150 - protein, 196 aa, Unknown
  Obtained from environmental sample
  DOMAIN (8)...(196): impB/mucB/samB family
  misc_feature (1)..(196): Xaa is any amino acid
MQNNILHLDLDTFFVSCERLIDSRLQKKPLLVGGTGDRGVVAACSYETRVFGIHSGMSMKVARRLCPEATVIRGNASIYTKFSHQVTEIIKEKVPVFEKASVDEFYADLSGMDKFYGCYKYASELRQKIIKDSGLPISFGLSANKIVSKVATGEAKPNNQLQIDSGFEKDFLAPLSIRKIPSVEKNLSVSQVRMIK

SEQ ID NO: 22151 - DNA, 531 bp, Unknown
  Obtained from environmental sample
  misc_feature (1)..(531): n is a, c, g, or t
ttgaatcctattgaatgtaaattaatgaaatatttatttatactttttttaacaattacttctgttgctttttctcaagttaaagtaagcggtactgttatagatgaatttaaggaacctgtgtctttcgctagtgttacttttaaaggctctacggttggggccgtttctgatgaaaacggtaaattctatttagaatctgatataacatatactgaactagaagtttcttttttgggctttgaaaagaaaattataccgcttaaagctagaaattttgatcttataattgtgttggaagaagacagtgcaggtttagacgaagttctagtttatgcaggtaaacagaagaaaaaagggaatcctgcaatcgccattcttagaaaaatttgggcaaaaaaacgccaaaatggtattcatttatatcaacaattccaatatgataaatacgaaaagatagaatttgatttaaatagtattgatgaaaaatctaaaaagaaaaagcttttaaaggaatggaatttgtattga

SEQ ID NO: 22152 - protein, 176 aa, Unknown
  Obtained from environmental sample
  misc_feature (1)..(176): Xaa is any amino acid
MNPIECKLMKYLFILFLTITSVAFSQVKVSGTVIDEFKEPVSFASVTFKGSTVGAVSDENGKFYLESDITYTELEVSFLGFEKKIIPLKARNFDLIIVLEEDSAGLDEVLVYAGKQKKKGNPAIAILRKIWAKKRQNGIHLYQQFQYDKYEKIEFDLNSIDEKSKKKKLLKEWNLY

SEQ ID NO: 22153 - DNA, 750 bp, Unknown
  Obtained from environmental sample
  misc_feature (1)..(750): n is a, c, g, or t
atgatcgataacgtattaccgcgcaaagattggcgcattaatctgcgtgatgatgggcataccaacggtaagtatctactggtgagcaatcatcaatcatgggttgataccagtatcgtgcaatatatcagcgaaaacggtttaccattgacgcgcttttttaccaagtttgagctcatatatatccctgtcattggtcaagctttctactttctcgactttcctatgatgcgtcgacattccaaagaagccatcgccaaaaaccctgccctaaagggtaaggatatcgaagaagcgaaacgagcgtgtgcattgctcaaggacaaaccctttacgctattgaattatctagaagggactcgcttcactcctagcaaacatgataaacaaaaatccccatatacgcatttacttaagccacgcgctggcgggttatcactggctatgagtgcattaggggaagagattgatgggattttggacatgacgattgtctaccctgacggtgttcccacttatagtgatctatggaaaggcaatatcaagcgtttaggtgtcgatgtacgacatattgagatacccaaagacctgtttacggcgatcaaaaacggcggctatgaaacagatgaagcgataaaagcacagatgtttgattgggtagaacagatatggcatcaaaaagatcaactaatcacagaaatgttggctgactttgagagcaaagatgctatcaaaacaagtgatctttga

SEQ ID NO: 22154 - protein, 249 aa, Unknown
  Obtained from environmental sample
  DOMAIN (12)...(168): Acyltransferase
  misc_feature (1)..(249): Xaa is any amino acid
MIDNVLPRKDWRINLRDDGHTNGKYLLVSNHQSWVDTSIVQYISENGLPLTRFFTKFELIYIPVIGQAFYFLDFPMMRRHSKEAIAKNPALKGKDIEEAKRACALLKDKPFTLLNYLEGTRFTPSKHDKQKSPYTHLLKPRAGGLSLAMSALGEEIDGILDMTIVYPDGVPTYSDLWKGNIKRLGVDVRHIEIPKDLFTAIKNGGYETDEAIKAQMFDWVEQIWHQKDQLITEMLADFESKDAIKTSDL

SEQ ID NO: 22155 - DNA, 390 bp, Unknown
  Obtained from environmental sample
  misc_feature (1)..(390): n is a, c, g, or t
atgaaatacggaaatattattctagaaaaaaaagaatatgtgtatttaaaacggcttttaaacctgaactcttatactaataatactaatactcaaagttctattcaaagattaattgaagagctaaaaacagctcaaattgtagatgaagcagaaatgccagaagatgtaattcgttttaatagtaatgttacagttactgcagaacatggctgggaaaacacgttaaaagttgttgttccgtcagaaaaaaatgtaaaagaacataaaatatcagttttatcgccaatgggaattgccctttttggatatccagaaaacgatgaattagtttgggattttcctggaggaccaaaaaaaataaaaatcgttgcttgtaaaacaagatga

SEQ ID NO: 22156 - protein, 129 aa, Unknown
  Obtained from environmental sample
  DOMAIN (53)...(128): Prokaryotic transcription elongation factor, GreA/GreB, C-terminal domain
  misc_feature (1)..(129): Xaa is any amino acid
MKYGNIILEKKEYVYLKRLLNLNSYTNNTNTQSSIQRLIEELKTAQIVDEAEMPEDVIRFNSNVTVTAEHGWENTLKVVVPSEKNVKEHKISVLSPMGIALFGYPENDELVWDFPGGPKKIKIVACKTR

SEQ ID NO: 22157 - DNA, 726 bp, Unknown
  Obtained from environmental sample
  misc_feature (1)..(726): n is a, c, g, or t
atgattcaaaataataaaaagaacagatctattaatttattacatatccaattaaaccaattgaagtttttttataaaaattactataatagtcttgaaaataaacaaataagaagaatattaaataccgatgatgttgcgtataagatcaaaagaaatgatttaaaaaaactagctctcaaactattaagacgaaaaaaatacaaatcaatccaaaaaagtatccataacaattctttaaatcaaaaaagtgatctactaattgattcaattctctataatactataaaaaatacattttataataaaagctctataagaaatgacaaacgaaagatacgtcacctgtttaataatgacaatgcccacaataccggcagaacaattacccattaccttagcggtttaatggggaattttatgggagtattcaagtttagaaaagggtatttatataaaaacgattccattcttaatgagataagtaatcgtcttaagccgatggatattattggtgaaaaaaccaattttacattaactgataaattaattataggtcattttagccatattgccatttggttgggcacaaaaaagcaattacatgaatcaaatctttggaatcatccttcaattgtcccctttcataaataccttaatgacggtttttgtatacttgaaaatgatagacaaggaacacatttaaaaacacttaaagacttttaa

SEQ ID NO: 22158 - protein, 241 aa, Unknown
  Obtained from environmental sample
  misc_feature (1)..(241): Xaa is any amino acid
MIQNNKKNRSINLLHIQLNQLKFFYKNYYNSLENKQIRRILNTDDVAYKIKRNDLKKLALKLLRRKKYKSIQKSIHNNSLNQKSDLLIDSILYNTIKNTFYNKSSIRNDKRKIRHLFNNDNAHNTGRTITHYLSGLMGNFMGVFKFRKGYLYKNDSILNEISNRLKPMDIIGEKTNFTLTDKLIIGHFSHIAIWLGTKKQLHESNLWNHPSIVPFHKYLNDGFCILENDRQGTHLKTLKDF

SEQ ID NO: 22159 - DNA, 369 bp, Unknown
  Obtained from environmental sample
  misc_feature (1)..(369): n is a, c, g, or t
ttgaaacgtaaaataattgaccattaccgcaagataaattccactaagggaaaagcagaaattagaattaatttttatgaagatggagataaaaaaggtacttggatagaagaacgagtgcctaagatgtggggtaatgaagctgaaaaaaatattgaaaataccgaactcaaaaacgcgttggatagttgtattgaaaatttaccggaaaaatatagaatggtgtttttgatgaaaaatgttcaagattatgaaacagaagagatctgtaatgaactaggtataacagcgtctaacctctgggtaataatccacagagcaaggcatcaactaagaaaatgtttagaagataattggtttgcaaaataa

SEQ ID NO: 22160 - protein, 122 aa, Unknown
  Obtained from environmental sample
  DOMAIN (64)...(113): Sigma-70, region 4
  misc_feature (1)..(122): Xaa is any amino acid
MKRKIIDHYRKINSTKGKAEIRINFYEDGDKKGTWIEERVPKMWGNEAEKNIENTELKNALDSCIENLPEKYRMVFLMKNVQDYETEEICNELGITASNLWVIIHRARHQLRKCLEDNWFAK

SEQ ID NO: 22161 - DNA, 534 bp, Unknown
  Obtained from environmental sample
  misc_feature (1)..(534): n is a, c, g, or t
ttgatgttggtggttgatattagcggttccgaatattttggtacgcaggaacaattcaaacatgaaattattactgaagttgcggcgactcttgcattttcagcaatgcaaaacaatgataaaacaggattgattcttttttcagatgaaattgaactttacattccgccgaaaaaaggaaaatcacacgtgcttcgaatcattcgtgaattgcttgaattcgaaccaaaaagcaacaaaaccgaccttgccaacgcattaaaatttttaagtagtgtaatgaaaaagaaagccatcgttttcgtgctttcagattttattgctgacaattatcgagatacgttgaagattgcagccaaaaaacacgatttaactggaatccgtatttatgacaaggctgaagaaaacattccaaatttaggaatggtacaaatgcaggatcaagaaaccggtgaacttctattggtcaacacaggttccaaaagtgtgcgcaatcaatattatagttaccatcgcgaacgcgtggattatttc

SEQ ID NO: 22162 - protein, 178 aa, Unknown
  Obtained from environmental sample
  misc_feature (1)..(178): Xaa is any amino acid
MMLVVDISGSEYFGTQEQFKHEIITEVAATLAFSAMQNNDKTGLILFSDEIELYIPPKKGKSHVLRIIRELLEFEPKSNKTDLANALKFLSSVMKKKAIVFVLSDFIADNYRDTLKIAAKKHDLTGIRIYDKAEENIPNLGMVQMQDQETGELLLVNTGSKSVRNQYYSYHRERVDYF

SEQ ID NO: 22163 - DNA, 771 bp, Unknown
  Obtained from environmental sample
  misc_feature (1)..(771): n is a, c, g, or t
ttgaaaaatcaggaataccttgaaaaattacaaaaaaggcgaaaacgcagaaaatggattcttggaatttcgggcgttgttacggcaattattttagctggaattatttacggagcagctactggttttgacaatcttaaagataaagtaataggaaatgacctccgcgaactcaccgaaggacgatggataaagagtgaatacggaaatccagcagtcattttggaaactcctgaagttcttcttagagtggaagctccagtaacaaatccaactaagagtgctgttagcgcaaaagattttttcacttatggtgaaatgaattccccgctttacattatggtttcaacaacgcagtttagtcaaaaacaagacattgcattggaaacagcattagatggaattttagatgaccttgaacaaagtggcgccaaaaatttaattgtaaaacgcgacgattttgaaaccgaaaaaggaataaaaggcttgaaggcttatggcgaattcaacgtacaggtttctgataataaagtattgaaaaagaaaagcacttatgaattgttacttttcgcgcagcaaaacggtctgcaggaagttttgatagtgtatcaagacgatggcaaatacgccgaagaaattaaaaaacgaattgaagcttccatagagcttgaatttcagagaaagatgggcagtaatttcgaatttgtaaatcctcagtttttctggttgttccttaacttccagtgctcgagccgattcttgatccactag

SEQ ID NO: 22164 - protein, 256 aa, Unknown
  Obtained from environmental sample
  misc_feature (1)..(256): Xaa is any amino acid
MKNQEYLEKLQKRRKRRKWILGISGVVTAIILAGIIYGAATGFDNLKDKVIGNDLRELTEGRWIKSEYGNPAVILETPEVLLRVEAPVTNPTKSAVSAKDFFTYGEMNSPLYIMVSTTQFSQKQDIALETALDGILDDLEQSGAKNLIVKRDDFETEKGIKGLKAYGEFNVQVSDNKVLKKKSTYELLLFAQQNGLQEVLIVYQDDGKYAEEIKKRIEASIELEFQRKMGSNFEFVNPQFFWLFLNFQCSSRFLIH

SEQ ID NO: 22165 - DNA, 891 bp, Unknown
  Obtained from environmental sample
  misc_feature (1)..(891): n is a, c, g, or t
atgctatgtctagtatctaagtggaaaaacgagggtataagaatgattaggtgctccgttatttgcctgcttaaaaggtattacctaaggcatatgtatatcttttcaaagagttttcctcatgaagagtcaagtgaatcatttatcaagaggttaacagctaagatgataaggtacatatcggtaaaaaatacagataaaatatatgtagtatctagtctagctagtaaaagaataaaaaaatatgtttctaataaaggaagtaacatatatgtgatacctttatgtactgagtttcctattcgaaaaagttcaatagattttagtggagatattattagatttgtatatataggtactttctcaaggctgagggctttagatacaatgatgaatgctttttatagattgaaagttgaaggctttacaggttggaaactagagttttttggtggtaataaaagcgattttttaattcgataccctcaatgcaaagaagttgtcaatgaacttgttaactctaatcttcttatattcaatggaattgttaaccgtaatgtattaatagatgaattagatagatttcatgtaggtattaatctaataccacctactaaaatgtatctagaaagtagttcgactaaacttggtgaatacctttcaagaggtttagctgtactaagcaactctgaagtcccttatcatcaagacatctatgacaagggtgatattggatggctttgtgaatttaatactgagtcgatttacaatgaattaaataatattttaaaaataagttctaacaggatagagtctaaatcgaaaaatagtttacaagtcgctgagaagtttttaacttataagtcttatttaaatgatattttacagtag

SEQ ID NO: 22166 - protein, 296 aa, Unknown
  Obtained from environmental sample
  DOMAIN (99)...(280): Glycosyl transferases group 1
  misc_feature (1)..(296): Xaa is any amino acid
MLCLVSKWKNEGIRMIRCSVICLLKRYYLRHMYIFSKSFPHEESSESFIKRLTAKMIRYISVKNTDKIYVVSSLASKRIKKYVSNKGSNIYVIPLCTEFPIRKSSIDFSGDIIRFVYIGTFSRLRALDTMMNAFYRLKVEGFTGWKLEFFGGNKSDFLIRYPQCKEVVNELVNSNLLIFNGIVNRNVLIDELDRFHVGINLIPPTKMYLESSSTKLGEYLSRGLAVLSNSEVPYHQDIYDKGDIGWLCEFNTESIYNELNNILKISSNRIESKSKNSLQVAEKFLTYKSYLNDILQ

SEQ ID NO: 22167 - DNA, 360 bp, Unknown
  Obtained from environmental sample
  misc_feature (1)..(360): n is a, c, g, or t
ttggtgaatgacttcagcgcaaaaatgtacaatcgcgctattttgaccaactgccaatttggtttcaccgtatgcgccacatattgcgaggaactttggcagcaattgggctacaaggaatctatatcaacagcatctttccccatatttgatgcaagtcatttggtggagagtagcaagcaataccctatatcattcaacgggaaaatgcgattcactttagaattaccattggattactccaaagatgagatagaagccgctgtaatggcccacgaaaagacccaacatcaattgcagggaagaactccgaagaaaatcattgtggttccaggaaaaatcgtaaacattgtaggataa

SEQ ID NO: 22168 - protein, 119 aa, Unknown
  Obtained from environmental sample
  misc_feature (1)..(119): Xaa is any amino acid
MVNDFSAKMYNRAILTNCQFGFTVCATYCEELWQQLGYKESISTASFPIFDASHLVESSKQYPISFNGKMRFTLELPLDYSKDEIEAAVMAHEKTQHQLQGRTPKKIIVVPGKIVNIVG

SEQ ID NO: 22169 - DNA, 657 bp, Unknown
  Obtained from environmental sample
  misc_feature (1)..(657): n is a, c, g, or t
atgagttattataatagcttagagcctgatgaatttgttcattggtattcgattagagatgaaaataataacgtcattgaaagtagaagaatagatgaagatggagaggattacacaactttatatgaacttaataacgaaggaaaagtaattagaacctatataaaatttatacttaacaagcgaaaatctaagaaggctcaatcaaaatttcaaaataaagaaagggatattaatgaatttagatatgatgaaagaggaaacaagatactgcagctaaactataacacatccactaataacattcgatcaaaacaggtttataaatacgatgatagaaattatttaattgagtataaaaattattcgaatattagtgataccactaattatataaaagtagtctatgactataacaataaaggctttaaaacttacgagaaagagacaacaactaataattctacttttagtataattaagacattttacaataaagaagattatgtaattagaaccattattatagataatgacataacaaagacattagattttaaatataagtttgataaaaaaggtaattggacaaaaattacaaaaattgttaatggagcgcctttttatgcttgggttcgaaaaataaaatattactaa

SEQ ID NO: 22170 - protein, 218 aa, Unknown
  Obtained from environmental sample
  misc_feature (1)..(218): Xaa is any amino acid
MSYYNSLEPDEFVHWYSIRDENNNVIESRRIDEDGEDYTTLYELNNEGKVIRTYIKFILNKRKSKKAQSKFQNKERDINEFRYDERGNKILQLNYNTSTNNIRSKQVYKYDDRNYLIEYKNYSNISDTTNYIKVVYDYNNKGFKTYEKETTTNNSTFSIIKTFYNKEDYVIRTIIIDNDITKTLDFKYKFDKKGNWTKITKIVNGAPFYAWVRKIKYY

SEQ ID NO: 22171 - DNA, 408 bp, Unknown
  Obtained from environmental sample
  misc_feature (1)..(408): n is a, c, g, or t
atgagtaaatgtcaacaatgtattatgcgtgaatttagcacattaaaatcactctctaaagaagaattaaaaaatatttccaatcataaagattctctagattttaagaaaggtgatgtgcttttttctgaaggtaatttattaaatggcgtttattgtattaaagaaggcgtttgtaaattgaccagactgagtacaaatggcaaagaacaaatcgtacgtttcgtcaacggaggtgacctgttaggatatcgctctattttaagtgaagagcctgttacctttaactgttacggttttaaccgatatgaacgcttgttatattccgaaaaaggagatattgattctataaaatcaaatcctagttttccattggatatgatgacattgtttgtcctgattacgtga

SEQ ID NO: 22172 - protein, 135 aa, Unknown
  Obtained from environmental sample
  DOMAIN (29)...(123): Cyclic nucleotide-binding domain
  misc_feature (1)..(135): Xaa is any amino acid
MSKCQQCIMREFSTLKSLSKEELKNISNHKDSLDFKKGDVLFSEGNLLNGVYCIKEGVCKLTRLSTNGKEQIVRFVNGGDLLGYRSILSEEPVTFNCYGFNRYERLLYSEKGDIDSIKSNPSFPLDMMTLFVLIT

SEQ ID NO: 22173 - DNA, 564 bp, Unknown
  Obtained from environmental sample
  misc_feature (1)..(564): n is a, c, g, or t
ttgcgcaagcatattcggaaaaatgtaacttatgaagagtatttaaaaattagaaaggaaaagcatgacgtggtagttacggtatctaatttgtctatgaatcgtgtggaatataaatcgatacaagagtgttcttatgaggaattttgtaactggatatggatttcgtgtaattacattccgtttatgtctttagcaaaagtcgatggttatgagtatgcagatggtggtttaggttctgtaattcctattagagaggctatacaacgcggtgccacagaagtagatgctattgttttagaggcggaaaccttaggcaagcaaaaagtgctgggaaagaatccgttttcgttaatgattagcttgttcggacatttgttagatcaggtagagcgaaatgatattattataggaaaattggcagctcgcaataaaaatgtaaagctcaatttgtattacacaccaaccagtctcacagaaaattctttaatttttagcaaacgcctaatggaaaaatggtggcaagaaggttatgattatgcagaaagacgacatgataaataa

SEQ ID NO: 22174 - protein, 187 aa, Unknown
  Obtained from environmental sample
  misc_feature (1)..(187): Xaa is any amino acid
MRKHIRKNVTYEEYLKIRKEKHDVVVTVSNLSMNRVEYKSIQECSYEEFCNWIWISCNYIPFMSLAKVDGYEYADGGLGSVIPIREAIQRGATEVDAIVLEAETLGKQKVLGKNPFSLMISLFGHLLDQVERNDIIIGKLAARNKNVKLNLYYTPTSLTENSLIFSKRLMEKWWQEGYDYAERRHDK

SEQ ID NO: 22175 - DNA, 807 bp, Unknown
  Obtained from environmental sample
  misc_feature (1)..(807): n is a, c, g, or t
ttgcctgaaatatttcctcagttaaaagattctgttttagaattagacagttttatgaagtggattagaagtgatagcaaacgtactttttacgatttagacgaagatggaaatccagaaaaaatattaccaaccaataaaattagaattcctgtaaataaagaaaatgctttaaaatatggcattgttgctcaaaaagatgcagatttaattgtaccttatattgatattactattgatagggctcttggtaaaaacaccattttaatgctcgacattttaaataatttcgattggaaacaaccaatttattttactggcggttccaatacagacagcgaatatatttggttaaaagattatttacaattagatggtgttgcttttaaatttgtaccaattaaaactccaactaaaatttataacgaaaatggacagttagttcgtgaattgagtttgtttgacattggtagaattgataccgaaaaaatgtacaacaacattcaaaaatggaattggagaaacattaacgatggtaagatttatttagatgaacaaactaaaagaagcgcaatttctttacgaaatagtttaatgcgtttatcgtctgcttttgcaatggaaggtgataccattaaagcacttgaaattttagatttatctatagacaaaatgccaattgaagattttgaccattacagtttatcactggaatacccagaaatgtctcataggtggggagatcacacacacgcagagacctgcagaagattaattccgttattcaacgagaacctagttggttaa

SEQ ID NO: 22176 - protein, 268 aa, Unknown
  Obtained from environmental sample
  misc_feature (1)..(268): Xaa is any amino acid
MPEIFPQLKDSVLELDSFMKWIRSDSKRTFYDLDEDGNPEKILPTNKIRIPVNKENALKYGIVAQKDADLIVPYIDITIDRALGKNTILMLDILNNFDWKQPIYFTGGSNTDSEYIWLKDYLQLDGVAFKFVPIKTPTKIYNENGQLVRELSLFDIGRIDTEKMYNNIQKWNWRNINDGKIYLDEQTKRSAISLRNSLMRLSSAFAMEGDTIKALEILDLSIDKMPIEDFDHYSLSLEYPEMSHRWGDHTHAETCRRLIPLFNENLVG

SEQ ID NO: 22177 - DNA, 912 bp, Unknown
  Obtained from environmental sample
  misc_feature (1)..(912): n is a, c, g, or t
ttgatcggtcagacaactggtggaatcattagaacattaaaaataggagcttcttgtgattgggagcgaactagttttacgatggatgaaaaacgctctgaatctgtaatcgaagtgtttttagatttgtataaaaaaggattgatttaccgcggatacagaatggtgaattgggaccctgaagcccaaacaacgttgtctgatgaagaggtaatttttgaagagaaaccaggaaacttatactatgtaaattataaaattgaagggagtgatgatgtgctaactatagcaactacacgtcctgaaactattttgggagatactgcaatttgtattaatcctaatgatgaacgtttttcgcatcttaaaggaaagaaggcaattgtaccaattgtaaacagagtaatcccaataattgaggatgaatatgttgatgtagagtttggaacaggttgtttaaaagtgactcctgctcatgatcaaaatgataaagtgttgggagagaaacatcaattagaagtagttgatgtttttaatgacgatgcaaccttgaattcttttggactgcattatcaaggaaaagatcgttttgtggttcgtaaagaaataaccaaagaattagaagagttaggttgtttggtgaagattgaacaacacatgcataaagtgggaacatcagaaagaaccaaagcagttattgaaccaaaaatttctgcgcagtggtttttaaaaatggaagatattgttaaacctgctttaaaagctgttttagaagatgaagaaattaaatttttcccaaagcattataacaatacatatcgtcattggttagagaatattagagattggaatatctcacgtcaattgtggtgggggcatcaattccagcttattttatgggtgatggagtag

SEQ ID NO: 22178 - protein, 303 aa, Unknown
  Obtained from environmental sample
  DOMAIN (1)...(303): tRNA synthetases class I (I, L, M and V)
  misc_feature (1)..(303): Xaa is any amino acid
MIGQTTGGIIRTLKIGASCDWERTSFTMDEKRSESVIEVFLDLYKKGLIYRGYRMVNWDPEAQTTLSDEEVIFEEKPGNLYYVNYKIEGSDDVLTIATTRPETILGDTAICINPNDERFSHLKGKKAIVPIVNRVIPIIEDEYVDVEFGTGCLKVTPAHDQNDKVLGEKHQLEVVDVFNDDATLNSFGLHYQGKDRFVVRKEITKELEELGCLVKIEQHMHKVGTSERTKAVIEPKISAQWFLKMEDIVKPALKAVLEDEEIKFFPKHYNNTYRHWLENIRDWNISRQLWWGHQFQLILWVME

SEQ ID NO: 22179 - DNA, 759 bp, Unknown
  Obtained from environmental sample
  misc_feature (1)..(759): n is a, c, g, or t
gtgtttttactaacttctgttggattggtttggtggtactattccgcaaaaacacaacgagtaaacagtgtacaacttcaagccttagaaaaagcaaagatcaatcagcaattggtgttttcgcaattagaaaatttgagatcacaaatgaatcctcattttatatttaatgcattaaactctatccaagattatattattttaaacgaaagtaaattggcgcgtcaatatctagttaagttttctagacttattaggacctatttagagcatagtcaagccaatgaaatttcattaaatgaagaaattaaaacactaaaactttatctagaacttgaaaaagatcgctttgatgacgattttaaatttgaaattaatattcatccagatctagatttagaaaacacttttgtcccaacattatttattcagccatatgttgaaaatgctttaaaacatggtttgcttcataaaaaaaacaataaaaaattggtacttaattttaagcaggatactattaatcaaagtctaatatgcgaaattatagacaatggtattggacgtaaagcatccgcaattataaaaaatcaacgtcaggataattacaagtcttttgcaacctctgcaaatcaaaaaaggatagagctactaaatcgcagtcataataaagcaattacattaactattgaagatgttattaatgaaaaacaagacgtttgcggtaccaaagtggtaattaaaatacaagtaaaagattaa

SEQ ID NO: 22180 - protein, 252 aa, Unknown
  Obtained from environmental sample
  DOMAIN (42)...(126): Histidine kinase
  misc_feature (1)..(252): Xaa is any amino acid
MFLLTSVGLVWWYYSAKTQRVNSVQLQALEKAKINQQLVFSQLENLRSQMNPHFIFNALNSIQDYIILNESKLARQYLVKFSRLIRTYLEHSQANEISLNEEIKTLKLYLELEKDRFDDDFKFEINIHPDLDLENTFVPTLFIQPYVENALKHGLLHKKNNKKLVLNFKQDTINQSLICEIIDNGIGRKASAIIKNQRQDNYKSFATSANQKRIELLNRSHNKAITLTIEDVINEKQDVCGTKVVIKIQVKD

SEQ ID NO: 22181 - DNA, 549 bp, Unknown
  Obtained from environmental sample
  misc_feature (1)..(549): n is a, c, g, or t
atgaaagtagaaaaaaataaaatagtctttgccatcgtgttggtatgcatcctgctttttataggtggctatgcaatgcttatattgggcgaggacgaagaaccgaccattgagaacaaccagattcctgtaccggaactggaagacgaccaaaaggaatacgattccaaattggatgccctaaacgacttaaaggaagttagggaaaccaacgcacccagcatttatgatgaacggctgttggattccacaggcgtatatgaccctgatttattggacaagaaaaaaatgcagatggtagatagcatttaccaacaagggcagattcgatattcagatagaacgtttgaaaatattaatccaagatactatccaccaaaaccacctgttaagaaggaaaaagacacaacggatgctattgaagagcaagaaacgaacgtggaagccaaagaacgtgctttggagcatcaactcttttttgcttcgcatcctattgaaaatgaggatttgaattcaaaaaataccgatgatttcatttatgtacgataa

SEQ ID NO: 22182 - protein, 182 aa, Unknown
  Obtained from environmental sample
  misc_feature (1)..(182): Xaa is any amino acid
MKVEKNKIVFAIVLVCILLFIGGYAMLILGEDEEPTIENNQIPVPELEDDQKEYDSKLDALNDLKEVRETNAPSIYDERLLDSTGVYDPDLLDKKKMQMVDSIYQQGQIRYSDRTFENINPRYYPPKPPVKKEKDTTDAIEEQETNVEAKERALEHQLFFASHPIENEDLNSKNTDDFIYVR

SEQ ID NO: 22183 - DNA, 651 bp, Unknown
  Obtained from environmental sample
  misc_feature (1)..(651): n is a, c, g, or t
atggtgaatcaatttcaggacgaaaaatcgcaacccatctattccattattgacaaaggtcgggtgatgaagatgccctttggcggcttgagcctgttggattatgccataaatgcgactttggtaatcagcaatattgcgttgaaaaaacacgataaagcgggcatgctctctttttccaaaaatgtagaaaacatggtcgtggcgcaacgccgcagctcacaaatgcgcttgatcttagaatcactttataatgtaaagaccgattattttgaaagtgatttcagccgattgtacgccaacatcaaacggcacatcacacaacgaagcctaatcctactctacaccaactttgaaaccttagacagtcttaaccgtcaattgccctatttaaaagcaattgccaaaaatcacctgatggtggttatcttttttaaaaacacggagctgaattcaattgtagaccaaaaggcggctacaattcagcaggtatacgataaggtgattgcagaaaaattcgcttttgaaaaacgacttatcgtacaagaattgaaaaagtatggcatttattcaatacttaccacgccagaaaatttaaccatagataccataaataaatatttagagattaaatcacgaggtttactttag

SEQ ID NO: 22184 - protein, 216 aa, Unknown
  Obtained from environmental sample
  misc_feature (1)..(216): Xaa is any amino acid
MVNQFQDEKSQPIYSIIDKGRVMKMPFGGLSLLDYAINATLVISNIALKKHDKAGMLSFSKNVENMVVAQRRSSQMRLILESLYNVKTDYFESDFSRLYANIKRHITQRSLILLYTNFETLDSLNRQLPYLKAIAKNHLMVVIFFKNTELNSIVDQKAATIQQVYDKVIAEKFAFEKRLIVQELKKYGIYSILTTPENLTIDTINKYLEIKSRGLL

SEQ ID NO: 22185 - DNA, 672 bp, Unknown
  Obtained from environmental sample
  misc_feature (1)..(672): n is a, c, g, or t
gtggcgatttcagaattggtatcattcttacggtcatgcccaccttgtttacccatgtttttaaaatcttttattaagaaataccctaaggtgaagcttaaaattgaagaattgacgacggatgatattattgaacgcattaaagatggtcatttagatgctgccattgccgcaacacctttagaaagtgaaaatattaaagaacgggtgctttattacgaaccttttgtagggtatattccagagcaccatcggctatacaaaaagaaaaccatagatgtttctgatcttgaaattgacgatatgcttctattggaagatggccactgttttagggatggggtcatcaacttatgtaaggcctttaaaggccaaaccaatgagagttttcaattggaaagtgggagtatagaaacgctgatcaaactttccaatgaaggtttaggaatgacgctactaccgtacttacatacccttgaactcagtgataaattgaccaataacctgcaccattttaatgagcccaccccagcacgggaagtgagtattatctatcataaaagtgaattaaaaatgcaaattattgacgcattacacgccgttatctccggaattataagaggggccattgctttccaaaacgtgaaaattatcagtccgttatcaaaataa

SEQ ID NO: 22186 - protein, 223 aa, Unknown
  Obtained from environmental sample
  DOMAIN (7)...(207): LysR substrate binding domain
  misc_feature (1)..(223): Xaa is any amino acid
MAISELVSFLRSCPPCLPMFLKSFIKKYPKVKLKIEELTTDDIIERIKDGHLDAAIAATPLESENIKERVLYYEPFVGYIPEHHRLYKKKTIDVSDLEIDDMLLLEDGHCFRDGVINLCKAFKGQTNESFQLESGSIETLIKLSNEGLGMTLLPYLHTLELSDKLTNNLHHFNEPTPAREVSIIYHKSELKMQIIDALHAVISGIIRGAIAFQNVKIISPLSK

SEQ ID NO: 22187 - DNA, 582 bp, Unknown
  Obtained from environmental sample
  misc_feature (1)..(582): n is a, c, g, or t
ttgtataaaaagcatcaagtaacaactatagatgaattaatagagaaacaaaaaatattaactattaaagtaagttcggtagaaaatgcctcagctattctagaagcaaggaaagctgaaattactgaaatcgaaaatcagcttaacaaattggccgggatcattagaaataatagaagtaaagcaatccctgacctaataaagcagcttgaaacattattaaaaaaactggagatgccaactacgtcctttaaaatcaatttaattgattctgaaattttttcgtataatggcaaagatgaattagcatttttaatagctaccaataaaggacgtaattataagaatttaaaaaaaatagcttctggaggagaaatgtcaagaataatgctagcggtaaaatctattttaagtaactattcaaatttacctactattatttttgacgaaatagatactggagtttccggtgaagtttccaatcgaatagcttcggtgatgtcatctatgagtaacaatatgcaagttatcgctattacgcacttgccacaaattgcggcgaaaggggatccatcattttaa

SEQ ID NO: 22188 - protein, 193 aa, Unknown
  Obtained from environmental sample
  misc_feature (1)..(193): Xaa is any amino acid
MYKKHQVTTIDELIEKQKILTIKVSSVENASAILEARKAEITEIENQLNKLAGIIRNNRSKAIPDLIKQLETLLKKLEMPTTSFKINLIDSEIFSYNGKDELAFLIATNKGRNYKNLKKIASGGEMSRIMLAVKSILSNYSNLPTIIFDEIDTGVSGEVSNRIASVMSSMSNNMQVIAITHLPQIAAKGDPSF

SEQ ID NO: 22189 - DNA, 474 bp, Unknown
  Obtained from environmental sample
  misc_feature (1)..(474): n is a, c, g, or t
atgaaattgaaatcaactatgcgaataggtattctaacgcttatagggttattgaccattgcttgtaacaccaaaataaatacgagtaaaaagactgcacaaaaacccaatatcgtgtttattatggcagatgatcatgccgtacaggcaattagtgcctatggtcatcccatcagtaaattagcacctacaccgaatattgatagacttgctaaaaatggggtactattcaataatagtttcgttaccaactcaatttgtggtcctagtagagcagttatcctaactggaaaacatagccatataaacgggtttagacaaaacggagatcactttaatggcagtcagcctacattacctaaaatgctgcagcaatctggttataacaccgcagtgttcggtaagtggcatttgcatggttacccagaaggattcgatcactggaaaattatcgtgaccaaggaactattataa

SEQ ID NO: 22190 - protein, 157 aa, Unknown
  Obtained from environmental sample
  misc_feature (1)..(157): Xaa is any amino acid
MKLKSTMRIGILTLIGLLTIACNTKINTSKKTAQKPNIVFIMADDHAVQAISAYGHPISKLAPTPNIDRLAKNGVLFNNSFVTNSICGPSRAVILTGKHSHINGFRQNGDHFNGSQPTLPKMLQQSGYNTAVFGKWHLHGYPEGFDHWKIIVTKELL

SEQ ID NO: 22191 - DNA, 558 bp, Unknown
  Obtained from environmental sample
  misc_feature (1)..(558): n is a, c, g, or t
atgggtaaagtatatcaaggaggttatggctggatttttcccttaaagaatgaaagagctattgttggttttggtacttttgatgatgaagttgttaaagatttaaaaaatcgtttgcataaaattatagaattaccaaaaattaaaaaactagttattaaagataatgataaagtagaaggtgcaagtattcctataactccagttttagagaagtttgttatcaataatttagtgtgcgttggcgatagtgtttctcaagtaaaccccattgttggcgaaggttataaatttatttttgaagctgcattaatggcaagtaaagctattgataagtccttagaaaaagaagatataaacttattgaatgaatatgaattggagtggaaaaacaggttttctgcaaattataaaagatctaaaaatacgcaagaacgtttctttaaatattctcaaaataatcttctaatggattatgctttgctaatctcaaaatttgtaactgataaacgagctgtaacatctctctcaggagaatatggtttacaccataagtag

SEQ ID NO: 22192 - protein, 185 aa, Unknown
  Obtained from environmental sample
  misc_feature (1)..(185): Xaa is any amino acid
MGKVYQGGYGWIFPLKNERAIVGFGTFDDEVVKDLKNRLHKIIELPKIKKLVIKDNDKVEGASIPITPVLEKFVINNLVCVGDSVSQVNPIVGEGYKFIFEAALMASKAIDKSLEKEDINLLNEYELEWKNRFSANYKRSKNTQERFFKYSQNNLLMDYALLISKFVTDKRAVTSLSGEYGLHHK

SEQ ID NO: 22193 - DNA, 396 bp, Unknown
  Obtained from environmental sample
  misc_feature (1)..(396): n is a, c, g, or t
ttgattttttcatttttgtttttaactgctatttatacaatcgcatttttaatattttctaatttcgaaatcttttattctactattttaataataccaatggttgtatttttgatcttgaaaaaagtaaagaaacgtttctataaaatttctgatgatatgttattagttggtaaaggattgttagaaacgcatgttacttatttagaaatctttaaagttcaaaacataaaattacaacaaactattttccaaaaaagaagcaatgttgcagatttaattttacaaacagcatcaggaaaaataaagattccttgtatcaattttaaagaagccatcaaaatttataaccatactttatataaagtagaaacgagccaaacttcatggatgtaa

SEQ ID NO: 22194 - protein, 131 aa, Unknown
  Obtained from environmental sample
  DOMAIN (42)...(119): Bacterial membrane flanked domain
  misc_feature (1)..(131): Xaa is any amino acid
MIFSFLFLTAIYTIAFLIFSNFEIFYSTILIIPMVVFLILKKVKKRFYKISDDMLLVGKGLLETHVTYLEIFKVQNIKLQQTIFQKRSNVADLILQTASGKIKIPCINFKEAIKIYNHTLYKVETSQTSWM

SEQ ID NO: 22195 - DNA, 585 bp, Unknown
  Obtained from environmental sample
  misc_feature (1)..(585): n is a, c, g, or t
ttgctgaggcaaataatttatagatttatgaaaactgtaagggttttattatgttttttattagtcggtttttcctgttcaaaaaagcagaaagacagaagaaacatgaatattcctgaaccagattatccagaaatgattcgtaaacctaataataatataaaaggtcaacttaaaatagacgattcaacaaagcaaataacaaaagaaactttagaagaaattcctgaagaaattattcataaaactcctacagaagcttttaaaaacacctcaaaagaagctgtaaaaaaagttgaaaaagaaactgttaaagaagtttctaaagtagaagagaaaaaagtctctattgatacatcaggtcttatttatacagttcaaatagcagctgtagatcgtgaaagtaaaaaatttagcactataaataatgtaattacttacaatgaaaactccttagtaaaatatagtttaggtgcttttaaaactcttaaagaagctaataactataggttacaaataaataagcaatacaaaggagcgtttgtcaaagcgttaagaaacaatgtgccagtttctattaaatnn

SEQ ID NO: 22196 - protein, 195 aa, Unknown
  Obtained from environmental sample
  misc_feature (1)..(195): Xaa is any amino acid
MLRQIIYRFMKTVRVLLCFLLVGFSCSKKQKDRRNMNIPEPDYPEMIRKPNNNIKGQLKIDDSTKQITKETLEEIPEEIIHKTPTEAFKNTSKEAVKKVEKETVKEVSKVEEKKVSIDTSGLIYTVQIAAVDRESKKFSTINNVITYNENSLVKYSLGAFKTLKEANNYRLQINKQYKGAFVKALRNNVPVSIKX

SEQ ID NO: 22197 - DNA, 432 bp, Unknown
  Obtained from environmental sample
  misc_feature (1)..(432): n is a, c, g, or t
atggaaaacatttctgatttgacggtggtacgaaccagctatgcaaaagtggttaaagaagagctttcctttagaaaattagatataaccgcagagcaagtactaaacgatacgcaagaagcttgttttgtgctttcaactcgcgacactaaatctgaagattttaaacatcttcaaacaggtatcagtaattttacaaactttaccattgaaaaatttaatattgaagaagccatcatagcatcttcaaaagtggcatacttgtctgaaatacttaaaactggaaaagaaactgagattgaaagtttcaacaactcacttgaagtcaaagattggataatagaaaaccctgaatttaataagctgaataagctgaaaaagagtaatcctgaggctttcttttattggtgtaaggcaataactttaacttaa

SEQ ID NO: 22198 - protein, 143 aa, Unknown
  Obtained from environmental sample
  misc_feature (1)..(143): Xaa is any amino acid
MENISDLTVVRTSYAKVVKEELSFRKLDITAEQVLNDTQEACFVLSTRDTKSEDFKHLQTGISNFTNFTIEKFNIEEAIIASSKVAYLSEILKTGKETEIESFNNSLEVKDWIIENPEFNKLNKLKKSNPEAFFYWCKAITLT

SEQ ID NO: 22199 - DNA, 642 bp, Unknown
  Obtained from environmental sample
  misc_feature (1)..(642): n is a, c, g, or t
atgtctttaaatcaacttaatgcgatctctccaattgatggtcgttaccgaaataaaattgaaaaactacaagattttttctctgaagaagcactaattaaataccgtgttttagtagaaattgaatactttattgctttatgcgaagtgccactaccacaacttaaaggtgtagattctagtaaatttgaagcattgcgtgacatttacaaatcgtttactactgaaaatgctcaggctataaaagatattgaaaaggttaccaaccatgatgttaaagcggttgagtattttataaaagaacaatttgatgctttaggtttaagcgaatttaaagagtttatacactttggattaacgtctcaggacattaacaacacagcaatcccattaagtattaaggatgctatgaatgaggcttacgtaccagaatatttaaatgttttaaaagaattaaagcgtcttgctaaagattggaaagatataccaatgctagctagaacacatggtcagccagcgtctccaacccgtttaggtaaagaaattgaagtatttgctgtacgtttagaagagcaattaanttatttaatgatatcncaagtgctgccaaattggtggtgcaccggaaatttatgcccataa

SEQ ID NO: 22200 - protein, 213 aa, Unknown
  Obtained from environmental sample
  DOMAIN (14)...(209): Lyase
  misc_feature (1)..(213): Xaa is any amino acid
MSLNQLNAISPIDGRYRNKIEKLQDFFSEEALIKYRVLVEIEYFIALCEVPLPQLKGVDSSKFEALRDIYKSFTTENAQAIKDIEKVTNHDVKAVEYFIKEQFDALGLSEFKEFIHFGLTSQDINNTAIPLSIKDAMNEAYVPEYLNVLKELKRLAKDWKDIPMLARTHGQPASPTRLGKEIEVFAVRLEEQLXYLMISQVLPNWWCTGNLCP

SEQ ID NO: 22201 - DNA, 528 bp, Unknown
  Obtained from environmental sample
  misc_feature (1)..(528): n is a, c, g, or t
atgattgcagtatccatgtcttttataattaaaaaaaacgcgatagattttaccatttacaccaaagagttagctttaaaaggcgagttattaacccacaacaaggaccaaagtgtactaaccctaatgtctttagatagtgtaatagaaactaattttgtaaaactaaacccaaacatgacacttggagacatgctacataaaggcgttgcaaaatctaccagaaatctatttcctgtggtcaataaaaacaaagctttagttggtataatcctactggatgatgtcagagagattatgtttaatcaagcactgtacgacaccactttagtcgaagatttaatgcataatccaccagatattattgattataaaaatgattctatgaaaacggttatggcaaaatttcaagattctaatgcttggaatttacctgtaatcaaagatggcatatacattggttttgtatcaaaatctaaattattaaccgcttacagacgccaattaatcaactacaccaccacttag

SEQ ID NO: 22202 - protein, 175 aa, Unknown
  Obtained from environmental sample
  DOMAIN (47)...(101): CBS domain
  misc_feature (1)..(175): Xaa is any amino acid
MIAVSMSFIIKKNAIDFTIYTKELALKGELLTHNKDQSVLTLMSLDSVIETNFVKLNPNMTLGDMLHKGVAKSTRNLFPVVNKNKALVGIILLDDVREIMFNQALYDTTLVEDLMHNPPDIIDYKNDSMKTVMAKFQDSNAWNLPVIKDGIYIGFVSKSKLLTAYRRQLINYTTT

SEQ ID NO: 22203 - DNA, 768 bp, Unknown
  Obtained from environmental sample
  misc_feature (1)..(768): n is a, c, g, or t
gtgtccgacactagtgatcaagaattcggtcgagatatatcaagaacaggtacagtcttcgaaaaatccagcatagatgaattttatgcagatcttacgggaatggaccgtttttatggttgtcaccaattctccaccgaactgcgccataaaattatcaaggaaaccggacttcccatttcctttggcctgtcggtaaacaaggtagtatccaaagtagctaccaatgaggccaagcccaacaatgaactgaagatagatataggccatgagaaaccttttttagcgcccttatccataaaaaaaatacctatggtaggcgacaagacctaccagaccctccgcaatttgggattgcggcaaataaagaccatccaagaaatgcccatagatatgatgcagcgggtattgggcgccaatgggggcgtaatatggaaacgggccaatggtatagacaacacccctgttatccctttttccgaacgcaaatccatttccaccgaacgtacttttgagagggacaccatagatgtcattaagctaaggggaatccttattgccatgaccgagaatctggcctatcagttgcggaggggaaaaaaacttactgcctgcattgccgtaaaaattcgctattcggattttaacacctattccaaacaactaaagattccgtacaccagtgcggaccatatcctgattccccaagattctggacctgtttcaaataccattggtaccaanaaaaaggggttggtcggatttagc

SEQ ID NO: 22204 - protein, 256 aa, Unknown
  Obtained from environmental sample
  DOMAIN (1)...(254): impB/mucB/samB family
  misc_feature (1)..(256): Xaa is any amino acid
MSDTSDQEFGRDISRTGTVFEKSSIDEFYADLTGMDRFYGCHQFSTELRHKIIKETGLPISFGLSVNKVVSKVATNEAKPNNELKIDIGHEKPFLAPLSIKKIPMVGDKTYQTLRNLGLRQIKTIQEMPIDMMQRVLGANGGVIWKRANGIDNTPVIPFSERKSISTERTFERDTIDVIKLRGILIAMTENLAYQLRRGKKLTACIAVKIRYSDFNTYSKQLKIPYTSADHILIPQDSGPVSNTIGTXKKGLVGFS

SEQ ID NO: 22205 - DNA, 825 bp, Unknown
  Obtained from environmental sample
  misc_feature (1)..(825): n is a, c, g, or t
ttgtataaaaatctaaaccttttgcaactatctcaaacttttaaagacggactcaattctcttggttttaaccaagagaacaatgattgtctttttcatactgatgattacaagcaaacagaagatttatcggtaaaacttcaacttgaaaaagcaatgaagtttgaagcctcggcagtttttttcaggaatgaaattaataagctcaaagcccaaatttatatctacgaccatactcaattagattctgatgagagccatttgagccacatacaaaaaatggtatggagcaacggagctgttcctattgcctgtatcttttacaggacagaaataaaaatactcgattgtacccaacatattcaagatgacaataagcccgtttacctagcaagtttaaaaattgtagccaaagcacatcagctttataataaaaattttgctgttaagataaaaactggtacgttctgggaagaatctagtgtcaaaaataaatttaaattcaatgcctcttcctacgatatccttatacggtggatacgagagatagctaaacaaattgcattctcaaattccaatgccgatgagcgaataataaaaaaaatcattattcagtctataatgattaaatatctggaggaaagaaaagatccagatggcaatagctcttttaatcaaaaatatttccagaaatatggcagttgccaagaatttgtagatgttctgtctaatggaaattttgttgctttgctagacgatttacagaaagatttaatggtaatctttttgagtggaatccgaaaagaaaatctaataccactttaa

SEQ ID NO: 22206 - protein, 274 aa, Unknown
  Obtained from environmental sample
  misc_feature (1)..(274): Xaa is any amino acid
MYKNLNLLQLSQTFKDGLNSLGFNQENNDCLFHTDDYKQTEDLSVKLQLEKAMKFEASAVFFRNEINKLKAQIYIYDHTQLDSDESHLSHIQKMVWSNGAVPIACIFYRTEIKILDCTQHIQDDNKPVYLASLKIVAKAHQLYNKNFAVKIKTGTFWEESSVKNKFKFNASSYDILIRWIREIAKQIAFSNSNADERIIKKIIIQSIMIKYLEERKDPDGNSSFNQKYFQKYGSCQEFVDVLSNGNFVALLDDLQKDLMVIFLSGIRKENLIPL

SEQ ID NO: 22207 - DNA, 714 bp, Unknown
  Obtained from environmental sample
  misc_feature (1)..(714): n is a, c, g, or t
ttgctagacgatttacagcaagatttaaatggtaatctttttgagtggaattccgaagagaagaatctaataccaactgtaaatttaaatggtctggtagaagctttaaaagcttataaaagacccgaagagagccacaaccaaattctggaacttattagatactatgagttcagctacattcctgtagaattgataagtcgtatctacgaagagtttttagcaggtggcgatgatactttatttagtcaaaaagagaaaaaacaaaaagatggcatcttttacacaccatctcatcttgcgcagttattagtcgatgagattatgccattacatcagtatatcagtattgatatcaaatcatttacgattttggatccagcttgtggatcgggtatttttcttgtattggcatttaaaaggttagtacaatggtggcgtttacagaacagtctaaaacaaccaaatattcaaactttaaagactattttagcctgtctttatggtgttgataaagagtatcaagcaaccaaattagcagcatttagtctttgcctcgcactctgtgatgagctttcgcctaaacagattatcaatgaattaaaatttagtgaccttacagaaaatcaaattttacattctgatttttttatagaacacttattagttaaggaagataaagattctgcacagagtctgcttttaaaaaaataa

SEQ ID NO: 22208 - protein, 237 aa, Unknown
  Obtained from environmental sample
  misc_feature (1)..(237): Xaa is any amino acid
MLDDLQQDLNGNLFEWNSEEKNLIPTVNLNGLVEALKAYKRPEESHNQILELIRYYEFSYIPVELISRIYEEFLAGGDDTLFSQKEKKQKDGIFYTPSHLAQLLVDEIMPLHQYISIDIKSFTILDPACGSGIFLVLAFKRLVQWWRLQNSLKQPNIQTLKTILACLYGVDKEYQATKLAAFSLCLALCDELSPKQIINELKFSDLTENQILHSDFFIEHLLVKEDKDSAQSLLLKK

SEQ ID NO: 22209 - DNA, 540 bp, Unknown
  Obtained from environmental sample
  misc_feature (1)..(540): n is a, c, g, or t
atgcttcaaaaaaagaatggtatgaaaatttataaaataggatttctaatagtattaatgattttttcgtcctttaaaaatgaagattctaaaaaacaaatacgtatttataccattggcgattctacaatggctgataaaataaagcctgatgaaaatccagaacgtggttggtgtcaattgttgcctcagtttttaaatgagaatgttgaggtaaaaaaccatgcagtaaatggcagaagtaccagaagttttattgatgaaaaaaaatgggatgctgtttatcatcagcttaaaaaaggcgattatgtttttatccaatttggtcataatgatcaaaagaaaaacgatcctgaaagatatacaaatccaactacagcttacagaaataatcttataaaattcattaaagaaacaagagaaaaaggcgcaattcctgttttgttcacatccattgttagacgtaattttaatgaagaaggcacattagtagacacacattatatgtatccttttgtagttcgtttactggcaaagtaa

SEQ ID NO: 22210 - protein, 179 aa, Unknown
  Obtained from environmental sample
  DOMAIN (36)...(177): GDSL-like Lipase/Acylhydrolase
  misc_feature (1)..(179): Xaa is any amino acid
MLQKKNGMKIYKIGFLIVLMIFSSFKNEDSKKQIRIYTIGDSTMADKIKPDENPERGWCQLLPQFLNENVEVKNHAVNGRSTRSFIDEKKWDAVYHQLKKGDYVFIQFGHNDQKKNDPERYTNPTTAYRNNLIKFIKETREKGAIPVLFTSIVRRNFNEEGTLVDTHYMYPFVVRLLAK

SEQ ID NO: 22211 - DNA, 741 bp, Unknown
  Obtained from environmental sample
  misc_feature (1)..(741): n is a, c, g, or t
gtgaacgttaggggtgaattggtaggtataaataccgccataacttcccaaaccggttcttatgttggttattcttttgctgtaccatctaatattgccaaaaaggtaattgaagacatcattgagtttggtgatgtacagacggcatacttaggaatcagacctgcagatttgaatagtgaggtggctaaagaacttggtttaaatataactgaaggtgttttaatagcaggtatatctgatgatggtgctgctaaaccggctggattgaaagtgaatgatatcattacaagaattgataatgttgaaatttctcaattttctgacctgcaaggttacttaagttctaaacggccaggcgatgtagtgagtgttactgtgctaagaaatggcgggaaaaagcagtttgaagtaagattagccaatcaattcggaaaagagactattggtaaacttgattttacaaagtatcttataggagatcttaagaaaatatctaacgaggatgcaactaaatacagggttaattatggagttgaaatttataaattaagaaacaggaacctaatggaaaatgaagttaaaaatggagatattattcttagaataggcaaggaaaaagtatatgatgtagatgaaattgaaataattctaagacagaataaagggaagaatgttattttacaaattttgaatcaggaaggggttgttgaatacctcacattagtgattaataattaa

SEQ ID NO: 22212 - protein, 246 aa, Unknown
  Obtained from environmental sample
  DOMAIN (39)...(128): PDZ domain (Also known as DHR or GLGF)
  misc_feature (1)..(246): Xaa is any amino acid
MNVRGELVGINTAITSQTGSYVGYSFAVPSNIAKKVIEDIIEFGDVQTAYLGIRPADLNSEVAKELGLNITEGVLIAGISDDGAAKPAGLKVNDIITRIDNVEISQFSDLQGYLSSKRPGDVVSVTVLRNGGKKQFEVRLANQFGKETIGKLDFTKYLIGDLKKISNEDATKYRVNYGVEIYKLRNRNLMENEVKNGDIILRIGKEKVYDVDEIEIILRQNKGKNVILQILNQEGVVEYLTLVINN

SEQ ID NO: 22213 - DNA, 306 bp, Unknown
  Obtained from environmental sample
  misc_feature (1)..(306): n is a, c, g, or t
ttgttagattttactcaaaacaccaaaaggatccaagaaattatcaagcaatgtcagtctagagatattaacgtgtatttagtaagtttgccagttaattatagatatgtaaatttagtaaattctaaaaaagtagctaaaatttacgatacagcaaatgctttagcattaggtaatagtaatacaacgtatatcaacttgtttgaagataaccgatttgatgattcagatttttttgatgctaatcaccttaatgttaaaggtgctaaaaaatgtacagtaattttaaaccaaattatacagtag

SEQ ID NO: 22214 - protein, 101 aa, Unknown
  Obtained from environmental sample
  misc_feature (1)..(101): Xaa is any amino acid
MLDFTQNTKRIQEIIKQCQSRDINVYLVSLPVNYRYVNLVNSKKVAKIYDTANALALGNSNTTYINLFEDNRFDDSDFFDANHLNVKGAKKCTVILNQIIQ

SEQ ID NO: 22215 - DNA, 561 bp, Unknown
  Obtained from environmental sample
  misc_feature (1)..(561): n is a, c, g, or t
ttgtttgaattattaagagaattaagaaatacaattgcagaaagagaagatttggttcattttcaaatagttacacaaaagtcattatatgaaatgtgcgaaacattaccaaccagtcaaancgaattattaaatgtcaatggatttggtaaaacacgtgttgccaaatatggtaacgaaattatacaaataataagagagtattgcgaggagaatgacattgaggtttccaatggtaaagagatttttgaaatggctaaaccaaaacgtaaaaagggagatacaaaagaaacgtctttacagatttttaaagcaggtaaatcaatagatcaaatagcttttgaacgtgatttaaatgtgaatactatttttgggcaccttgcaagttttataccgtcaggtgaagttaaaataacagatttgatctctgaaaagcattataaagaattgaaagcattaatccctaaacatacttttgaaaatctttcagatttgaaatctcaaatagctgacaagtatagttatggagagattagattagttttagatgatatatcttag

SEQ ID NO: 22216 - protein, 186 aa, Unknown
  Obtained from environmental sample
  DOMAIN (1)...(75): HRDC domain
  misc_feature (1)..(186): Xaa is any amino acid
MFELLRELRNTIAEREDLVHFQIVTQKSLYEMCETLPTSQXELLNVNGFGKTRVAKYGNEIIQIIREYCEENDIEVSNGKEIFEMAKPKRKKGDTKETSLQIFKAGKSIDQIAFERDLNVNTIFGHLASFIPSGEVKITDLISEKHYKELKALIPKHTFENLSDLKSQIADKYSYGEIRLVLDDIS

SEQ ID NO: 22217 - DNA, 792 bp, Unknown
  Obtained from environmental sample
  misc_feature (1)..(792): n is a, c, g, or t
ttgatgataggggatttacagcagctatctcccgttgtaaaagataatgaatggcacttacttaaaccgttttataataacgctttcttttttagtagtcatgcctatcaacaatgtaatccgatttctgttgaattaaaacatatttatagacaggacaaccctttattcattattatattaaacgaaattagaactaattcgctttcccttgagtcatcaaatgagttaaataaaaggtataagcctgattttgaacctaaagaagatgatgggtatatttcattaaccacacataataataaggcagaatacactaataaagctaatcttgagaagctaaaaggtaggtctcagacatataaagcaaaagtagagggtaagttccctgagttttcttatcctaataaagaatcgcttgtacttaaagtcggatctcaagttatgtttgttaaaaatgatagttctgcagacaagcgttattttaatggaaagataggtaaagttatattactcgataaagatgaagttgttgttaagtgtccagatgatgatttcaatataattacgaaaccagaggtttgggaaaatataaattatgcggttgataaggatactaaggctatttctgaaaacaaaattggatccttctctcaaattccattacgtttagcctggtcaataaccatacataaaagtcaaggtcttacttttgaaccggccatcatagattctgaaggtgcatttgctcatgggcagacttatgtagcattaagtagatgtactctttag

SEQ ID NO: 22218 - protein, 263 aa, Unknown
  Obtained from environmental sample
  misc_feature (1)..(263): Xaa is any amino acid
MMIGDLQQLSPVVKDNEWHLLKPFYNNAFFFSSHAYQQCNPISVELKHIYRQDNPLFIIILNEIRTNSLSLESSNELNKRYKPDFEPKEDDGYISLTTHNNKAEYTNKANLEKLKGRSQTYKAKVEGKFPEFSYPNKESLVLKVGSQVMFVKNDSSADKRYFNGKIGKVILLDKDEVVVKCPDDDFNIITKPEVWENINYAVDKDTKAISENKIGSFSQIPLRLAWSITIHKSQGLTFEPAIIDSEGAFAHGQTYVALSRCTL

SEQ ID NO: 22219 - DNA, 648 bp, Unknown
  Obtained from environmental sample
  misc_feature (1)..(648): n is a, c, g, or t
atgcaaattccaaaaggaaaaaaaatatatttcgcctcagacaatcatttaggcgcaccaacaaaagagctctctttacctcgcgaaaaaaagtttgtcgcatggttagacatggtaaaagaagatgcagcagctattttcttattaggagatatgtttgatttttggatggaatataaacgcgtaataccaaaaggatttaccagaacattaggtaaacttgcagaaattagtgactccggaatcccaatctattactttgtaggtaaccatgatttgtggatggatggctattttgaagaagaattaaacatccctgtttaccacaaaccaaaagaatttacctttaacaacaaaaccttttttataggacatggagacggtttaggaccagaagacaaagggtataaacgcatgaaaaaagtgtttaccaatcctgttgctaaatggttattcccaacgtttattacacccagattttgctttacgcttaggacaatacatgtctggttaaaacaaaataatctctgggggacgatgatgctaaattttttaggaaaccataaagaagggcttggggcaatactgcaaacccaaattaaaaaccaaacatccggatattttttatctttggccacagaaccttaa

SEQ ID NO: 22220 - protein, 215 aa, Unknown
  Obtained from environmental sample
  DOMAIN (7)...(155): Calcineurin-like phosphoesterase
  misc_feature (1)..(215): Xaa is any amino acid
MQIPKGKKIYFASDNHLGAPTKELSLPREKKFVAWLDMVKEDAAAIFLLGDMFDFWMEYKRVIPKGFTRTLGKLAEISDSGIPIYYFVGNHDLWMDGYFEEELNIPVYHKPKEFTFNNKTFFIGHGDGLGPEDKGYKRMKKVFTNPVAKWLFPTFITPRFCFTLRTIHVWLKQNNLWGTMMLNFLGNHKEGLGAILQTQIKNQTSGYFLSLATEP

SEQ ID NO: 22221 - DNA, 549 bp, Unknown
  Obtained from environmental sample
  misc_feature (1)..(549): n is a, c, g, or t
ttgatcagccggaaagcaatggatattgaaggcttaggtgcagaaacggttgaattattatttaaagaaaaattgataacaaattatgctgatttatatgaattaagagttgaacagattactcctcttgagaggatggcggaaaaatcagcagaaaatatgataaatggtattgaaatatctaatcaaattccatttgaaaaagtactctttggaatagggataagatatgttggagaaaccgttgctaaaaaattagctaaacattttaagggaattgataatttattagaagctagttttgaggaattgattcaagtagatgaaattggtgataaaattgcacaaagtattattgattttgctcataatccggtaaatatagatctcgtagataggttaaaaacatatggtattcagttagaattgtcagcagaagcattagagaatcaaacggaaaaattacaaggtaaaatatttgtagtgtctggcgtatttactaagatgagcagaaccgaattaaaaaagtctattgaagataatggtgnn

SEQ ID NO: 22222 - protein, 183 aa, Unknown
  Obtained from environmental sample
  DOMAIN (92)...(121): Helix-hairpin-helix motif
  misc_feature (1)..(183): Xaa is any amino acid
MISRKAMDIEGLGAETVELLFKEKLITNYADLYELRVEQITPLERMAEKSAENMINGIEISNQIPFEKVLFGIGIRYVGETVAKKLAKHFKGIDNLLEASFEELIQVDEIGDKIAQSIIDFAHNPVNIDLVDRLKTYGIQLELSAEALENQTEKLQGKIFVVSGVFTKMSRTELKKSIEDNGX

SEQ ID NO: 22223 - DNA, 321 bp, Unknown
  Obtained from environmental sample
  misc_feature (1)..(321): n is a, c, g, or t
gtgcactcaggtggtatgcgtggcgttattatatcggtttctaaagttaaagtaacggcagatttattatcggcaaaagtatatttaagtattttccctaatgaaaaggctaaagaattggtaacgggtatacgctcaaaccaaccctttataaaacacgaacttgcaaaacgcactaaaaaccaattgcgtcgcgtgccacatttagagttttatatagacgattctttagagcatattgataaaattgagcaatctttaaaaagaaccgataacccaatagacaatccagattctttagggtttagaaaaaaatcgtaa

SEQ ID NO: 22224 - protein, 106 aa, Unknown
  Obtained from environmental sample
  DOMAIN (1)...(87): Ribosome-binding factor A
  misc_feature (1)..(106): Xaa is any amino acid
MHSGGMRGVIISVSKVKVTADLLSAKVYLSIFPNEKAKELVTGIRSNQPFIKHELAKRTKNQLRRVPHLEFYIDDSLEHIDKIEQSLKRTDNPIDNPDSLGFRKKS

SEQ ID NO: 22225 - DNA, 558 bp, Unknown
  Obtained from environmental sample
  misc_feature (1)..(558): n is a, c, g, or t
atgaacttttctttatacatagccaaacggtatttacgctctaaaagcagcaataacgccattaattttattactatattagctttaattggtattgttttaggcgcagcatcgttgtttattgtcttgtctggttttgctggtttaagaaattttacactagaatatacaaccattatagatcctgatttaaaggcagaaaccaccattggtaaatcttttattttaaatgacacgcttgaagctaaattacaagccattaatggaattgcttcgtattctaaagtgattgaagaacgtgttttttcgtcgtttgatggcaaaccctatcctgcatatataaaaggtgtagacgagaattttaagcgtgtaaataacgtggattctatagtaattcaaggcagttgggtgacgcaaaaaacgagtcagattgttgttgggcaaggattgctaatagattatcgatgggcgtttagactattgaaaaaggtatcgatatttgtacaaaactggggaaggacaataaagttaaaaaaagctttaacaatgcaacggtaa

SEQ ID NO: 22226 - protein, 185 aa, Unknown
  Obtained from environmental sample
  misc_feature (1)..(185): Xaa is any amino acid
MNFSLYIAKRYLRSKSSNNAINFITILALIGIVLGAASLFIVLSGFAGLRNFTLEYTTIIDPDLKAETTIGKSFILNDTLEAKLQAINGIASYSKVIEERVFSSFDGKPYPAYIKGVDENFKRVNNVDSIVIQGSWVTQKTSQIVVGQGLLIDYRWAFRLLKKVSIFVQNWGRTIKLKKALTMQR

SEQ ID NO: 22227 - DNA, 426 bp, Unknown
  Obtained from environmental sample
  misc_feature (1)..(426): n is a, c, g, or t
ttgtataataatcatgaagaaatagttattgttatagattttgtaaataccaataaaaaggtcgtaaactttataaaggataaaacaaccaatgggtttttcagctacaagcatttaaaaatgaacccgaaaataggagacatttataacgcaagattaaacccagttggtgtcgatggattttataaagtattaacttttaaaagaagtccaaatacaaatgctgaagtaataaaaaatgtttcagggaatttaagaatcgcagtaaatggagactttggatttataaatgatgatttagtgccatcatatttgattaaaaaaaataagttaaaaaatgatgataagtttaatggtaaagcaatactatctttcgataagaaaaaaggaaattggggatggagagtttttgaacttgataattaa

SEQ ID NO: 22228 - protein, 141 aa, Unknown
  Obtained from environmental sample
  misc_feature (1)..(141): Xaa is any amino acid
MYNNHEEIVIVIDFVNTNKKVVNFIKDKTTNGFFSYKHLKMNPKIGDIYNARLNPVGVDGFYKVLTFKRSPNTNAEVIKNVSGNLRIAVNGDFGFINDDLVPSYLIKKNKLKNDDKFNGKAILSFDKKKGNWGWRVFELDN

SEQ ID NO: 22229 - DNA, 822 bp, Unknown
  Obtained from environmental sample
  misc_feature (1)..(822): n is a, c, g, or t
atgtatcatggaaacttcgatgaattaaagaacgatttttgctatgcgcgttatctaattttttcggctagaaacatacctagtgaccatacacatttcttcaacaaaacatatcctcacgttgatgatatgtcacactccattaccaacctaaaagctagtcattataaaagcgcgttcagaacgctttactcgctatttgataaaattgcttactttatcaatcgcttttttgatctgaatgatatcaagtatgatcataaaatcagctttgacagtatttttagtgagctgaaaggaagtaagagctggaaaccacacagtaagcttaaagacagtcagaattgctttatccatgccttattctacatcctgaaagacattcgagatgtgaaagattcgacttctgtcagtcggtggcttgatcctgatgcaaaggcgttttctgaaattagaaatgctatagagcatcgttctttaaagattgttgatgattttggttataccctaactcaatcaggtaaagcttttaagcaatcacagcttgaaaagcttaatggtgatataggtgactttgaagaacaacttcaagagctgtatggtgaaattgcttcggcgaaaaaggctcataatataactcttaaagccgaactagagaccaaaaaaaaattacttgatgaaggtttgcgtcaagcacagtcaaaaatttatgagcaccaaaagctttcaagtcattctgtgctgataaaagagagcgaatttgaatcaaggctcatgacgctgataaagctcgctcgaaattcgattattacctttcactag

SEQ ID NO: 22230 - protein, 273 aa, Unknown
  Obtained from environmental sample
  misc_feature (1)..(273): Xaa is any amino acid
MYHGNFDELKNDFCYARYLIFSARNIPSDHTHFFNKTYPHVDDMSHSITNLKASHYKSAFRTLYSLFDKIAYFINRFFDLNDIKYDHKISFDSIFSELKGSKSWKPHSKLKDSQNCFIHALFYILKDIRDVKDSTSVSRWLDPDAKAFSEIRNAIEHRSLKIVDDFGYTLTQSGKAFKQSQLEKLNGDIGDFEEQLQELYGEIASAKKAHNITLKAELETKKKLLDEGLRQAQSKIYEHQKLSSHSVLIKESEFESRLMTLIKLARNSIITFH

SEQ ID NO: 22231 - DNA, 363 bp, Unknown
  Obtained from environmental sample
  misc_feature (1)..(363): n is a, c, g, or t
atggaattgcattttgaattaaacgaagtaactaaaaaattacctaaacatttacacaaatttattgtaaaacaaccttatgaagaatatacatctcaaaaccaagcagtttggaggtatgttatgcgaatgaacgtagattatttgagtaaagttgctcataaatcttacattcctggtttagaaaagacaggaatttctacagaaaatattcctaaaatggaaggcatgaaccgaattttgaaagaaattggttgggctgcagtttctgtagatggttttattccaccaaatgcttttatggaatttcaagcctataatgtgttggtaattgcgtatgatatgcgaactataatcatatag

SEQ ID NO: 22232 - protein, 120 aa, Unknown
  Obtained from environmental sample
  misc_feature (1)..(120): Xaa is any amino acid
MELHFELNEVTKKLPKHLHKFIVKQPYEEYTSQNQAVWRYVMRMNVDYLSKVAHKSYIPGLEKTGISTENIPKMEGMNRILKEIGWAAVSVDGFIPPNAFMEFQAYNVLVIAYDMRTIII

SEQ ID NO: 22233 - DNA, 909 bp, Unknown
  Obtained from environmental sample
  misc_feature (1)..(909): n is a, c, g, or t
ttgtcttttgagcgcgattacaagtcgtattttccaatagcggttactaaaatttttaataatgaagaagtgccagttcaggtatatgacataaaaaaaggcgatcgattattaattagaaatcacgagttaattcctgtcgatggtatattaattaacggaaacgcaagaatagattacagctttgtaacaggtgagtctgaaacggttaagaaaatttctggtgacaagttatttgctggtggtaaacaaacctctggtgtcatagaaatggaggccataaaatctgtagaacaaagttacctgacacaattatggagtaacgatgtttttagtaaaaataaagaggatggttttacaaccctaaccaatgcgattagtaaacgttttacaattgctgttttaagtattgcctttatagctacagcatattggatgtttgcggatagcagtaaagctttaaatgtctttacagcagtattaattatagcttgtccatgcgcaattgctttagcagctccttttacttttggtaatttgttacgcatttttggaaaaaagaaattttaccttaaaaacgcttctgttttagaacaattagcacatatcgatactgttatttttgataaaacaggaaccattacgtctaataaaaaaagtgatgcaaaatatgaaggtgtgccattaagtttagatgaggaagtattattaaaaaacacattaagaggctcaaatcatcctttaagtagagggttgtatgatactttacaagataatgatattgttaccttagattatttggagaacattagggcacgtatgaggcgtctatgcgacacaaatataaaattggtcggtaaattgtggtttacaagaagtcagtttaatacgcgtcctatagtcaaanna

SEQ ID NO: 22234 - protein, 303 aa, Unknown
  Obtained from environmental sample
  DOMAIN (8)...(199): E1-E2 ATPase
  misc_feature (1)..(303): Xaa is any amino acid
MSFERDYKSYFPIAVTKIFNNEEVPVQVYDIKKGDRLLIRNHELIPVDGILINGNARIDYSFVTGESETVKKISGDKLFAGGKQTSGVIEMEAIKSVEQSYLTQLWSNDVFSKNKEDGFTTLTNAISKRFTIAVLSIAFIATAYWMFADSSKALNVFTAVLIIACPCAIALAAPFTFGNLLRIFGKKKFYLKNASVLEQLAHIDTVIFDKTGTITSNKKSDAKYEGVPLSLDEEVLLKNTLRGSNHPLSRGLYDTLQDNDIVTLDYLENIRARMRRLCDTNIKLVGKLWFTRSQFNTRPIVKX

SEQ ID NO: 22235 - DNA, 912 bp, Unknown
  Obtained from environmental sample
  misc_feature (1)..(912): n is a, c, g, or t
ttgantcggctgagagtactgctgtttagtgtaatggattttgtagtgcaattattaatattatatacttacgcatccattgccaaaatgtatcctgattggttagacctaagcgtacctagacagctgttagaaaacaaaattaactatcctattattggacaactattacaaaatcaatacttacctttttttgtagcttatggaggtattttatatgatggattaataattcctttattgctttataaaccaaccagaaaactagccttttacagctctataatattccatttatttaattctgttgtatttcaagtaggcattttcccttatttagcgttggcatttagcttattcttttttgctccagaattagttaaaaaaatatttcttaaaaacaagcccttatataaggacaaccaagttattatccctaattacaaaccaatcttaataggagctacaaccatatattttataattcaaatcattctacctttacgtcatcattttataaacgataatgttttatggacagaagaaggtcatagattatcttggcgaatgatgcttagatcaaaatctgggtacgcaacctataaagtagtcgataaaaacaccaatcaagaaaccttaataaatttaaacgattatttaaccaaaaaacaacaacgcttggtcactacaagacctgacgtaatatggcaatttgcacagcatttaaaaaaggactataagtcaaaaggtcaagatattgctgtgtacgtaagcgcaaaagtaagcgttaatggaagacctcataaaacgttaattaatactaaaacagatttagctagtgtcaagtggcaaacctttaagcacagtgattggggtttaaccttcgcaattagattaataatttattttann

SEQ ID NO: 22236 - protein, 304 aa, Unknown
  Obtained from environmental sample
  misc_feature (1)..(304): Xaa is any amino acid
MXRLRVLLFSVMDFVVQLLILYTYASIAKMYPDWLDLSVPRQLLENKINYPIIGQLLQNQYLPFFVAYGGILYDGLIIPLLLYKPTRKLAFYSSIIFHLFNSVVFQVGIFPYLALAFSLFFFAPELVKKIFLKNKPLYKDNQVIIPNYKPILIGATTIYFIIQIILPLRHHFINDNVLWTEEGHRLSWRMMLRSKSGYATYKVVDKNTNQETLINLNDYLTKKQQRLVTTRPDVIWQFAQHLKKDYKSKGQDIAVYVSAKVSVNGRPHKTLINTKTDLASVKWQTFKHSDWGLTFAIRLIIYFX

SEQ ID NO: 22237 - DNA, 639 bp, Unknown
  Obtained from environmental sample
  misc_feature (1)..(639): n is a, c, g, or t
gtggtccatcagttggatccggcgggagttggggcacgtaaccttcaagaatgtttaagtattcaattgcaccgcagggaaaaaaatccggatgtggaattggctattgaaattattgacaatgcctttgatcaatttaccaaaaaacattataaaaaattaattcagaagtttgatatcacagagacgcagcttaaagacgccattgatgagattgaacatctaaatcccaaacccggaggttcctattcaggcaataatcgcatcgtggaacatattgttcctgattttgccattagaattgtggatggcgaattggaattgaccttaaatggtagaaatgctccagaattgcacgtgtctcgagaatacagcaatatgatgaagggctataaggaagccaaagacaagtccagatctcaaaaagatgcggtgatgttcatcaaacaaaaactggatgcggccaaatggtttatagaagccattaaacagcgtcagcagaccctatttgtaacgatgagttctattatgcactatcagaagcaatacttcctaacgggcgatgagcgcaagctaaagcccatgattttacaggatattgcagacgagattgacatggatgtctctaccgtatctcgn

SEQ ID NO: 22238 - protein, 213 aa, Unknown
  Obtained from environmental sample
  DOMAIN (145)...(213): Sigma-54, DNA binding domain
  misc_feature (1)..(213): Xaa is any amino acid
MVHQLDPAGVGARNLQECLSIQLHRREKNPDVELAIEIIDNAFDQFTKKHYKKLIQKFDITETQLKDAIDEIEHLNPKPGGSYSGNNRIVEHIVPDFAIRIVDGELELTLNGRNAPELHVSREYSNMMKGYKEAKDKSRSQKDAVMFIKQKLDAAKWFIEAIKQRQQTLFVTMSSIMHYQKQYFLTGDERKLKPMILQDIADEIDMDVSTVSR

SEQ ID NO: 22239 - DNA, 711 bp, Unknown
  Obtained from environmental sample
  misc_feature (1)..(711): n is a, c, g, or t
ttgccagtagtccataaatatagcttccttagccctttaggcctagtcaccacaattatttctgatacttctttaagatataaagtcattgaatgcgaagactgttccgcacaaaaaatgcttgagcttagcgttaatgagcattctgaaagcaggccttctgggtttaaaaagttctcaaaagaggggtttcctagacaactattttttgctaatgcatatcaatttattgttgctgatttagcaggcaaggacttacttaaaggtaaagataaagttacatttgaaatatcaattgacgtgcctgaatgtaggtggatagcaccaattagggcaaaacctgaaaggatatatgtcagccaagcttctgactattcccctgaaggtaatcatataccaaatatgttaaacaaattatttggtaaaacagggagtgttagcagcaacaaaatatctgaatcaatcaaagagtttggtataaatagcggtctttttgactctgtgggagttaaacgttttgggaaagaggcttcatctccatttgaagtaaatgtaaacctaggtggaagtgatttactcgtatcaaatgttggatatggtgtttctcaagtattaccgataattcttgaagctagaagaaaatctaatgccgagtatattgctattcaacaaccagaagtcaccttcaccctagggctcaagctgctttag

SEQ ID NO: 22240 - protein, 236 aa, Unknown
  Obtained from environmental sample
  misc_feature (1)..(236): Xaa is any amino acid
MPVVHKYSFLSPLGLVTTIISDTSLRYKVIECEDCSAQKMLELSVNEHSESRPSGFKKFSKEGFPRQLFFANAYQFIVADLAGKDLLKGKDKVTFEISIDVPECRWIAPIRAKPERIYVSQASDYSPEGNHIPNMLNKLFGKTGSVSSNKISESIKEFGINSGLFDSVGVKRFGKEASSPFEVNVNLGGSDLLVSNVGYGVSQVLPIILEARRKSNAEYIAIQQPEVTFTLGLKLL

SEQ ID NO: 22241 - DNA, 618 bp, Unknown
  Obtained from environmental sample
  misc_feature (1)..(618): n is a, c, g, or t
ttgaaaaacaacagaacatattatatgcaatgggagtcaatgaaaatgatgaaagtaatgttgcattcgtatcaaaaaaataaagttgagagtgaattctcaacatatattaaaaagcaattgataattcaaggggataagataactgaagatgataaagcgtatttaatagatattaaaaaagaaaaagagcttgcaaaagattcatcttatcaaagaagattgcctttgtttattggagaaaaagaaagcaaaacattttatgttgttccaattagagggaaagggttatgggatgctatatgggcatatataggtttagatgacaagatggtagttcaaggagtatattttgatcatgccggtgaaacacctgggttaggggcgaatatcaaacaacgtttttttatggatgattttattggagaaaatgttctaagcgatgggtcatttaaagggataaaaattgctaaaggaaatgctgacccaaaaaatatagataaaaccgataatgaagtagacgcaataacgggatcaaccattacaggagacggtgtaacggcaatgattaaatctgagttaaaattgtatgtaccttattttaaaaatttcaaataa

SEQ ID NO: 22242 - protein, 205 aa, Unknown
  Obtained from environmental sample
  DOMAIN (90)...(197): FMN-binding domain
  misc_feature (1)..(205): Xaa is any amino acid
MKNNRTYYMQWESMKMMKVMLHSYQKNKVESEFSTYIKKQLIIQGDKITEDDKAYLIDIKKEKELAKDSSYQRRLPLFIGEKESKTFYVVPIRGKGLWDAIWAYIGLDDKMVVQGVYFDHAGETPGLGANIKQRFFMDDFIGENVLSDGSFKGIKIAKGNADPKNIDKTDNEVDAITGSTITGDGVTAMIKSELKLYVPYFKNFK

SEQ ID NO: 22243 - DNA, 765 bp, Unknown
  Obtained from environmental sample
  misc_feature (1)..(765): n is a, c, g, or t
ttgatcgaaaaaatgtgctcacccatggctaatttgttctataaattatacaacagtattcaaagacgcaaatcagtctttgtagtaggnctatgtgttgtttttggaatgcttgtttggatggcttctacgctaaaatttgacgaagacatctccaagttgattccatccaattctgaaaatgagcaactccaaaaagttttaaaaacggttcaattcgcagataaaatcattgttaatattgagagggaagacaacggctctaccgaagatttaactgactatgccacacaatttttagattcactttctgagcgttcaagtaattactttaaagacatccgagggaaaatagaagatgaaaccatttttgaaaccttagattttgtttacactaatgcgccgctctttttaagggaagcagactataatctactcgctaacaaattacatccagattctattgccaaaatcaccgagagtaattacaaaacattgatttcaccttctgggattgttgccaaaaaaaccattgttaaagatccgttaggaatttctttaatggggatcaaacatttggaacaactcgggatttctgacgcgtttactcttagggatggatttttggtcagtaaagatgaacagcacctcttactatttatcaccccagaatatccgagcagcaatactaatgaaaacggcattttttcagcgcaactctaccaactacaagaggaattgacagcggctattccagcaaagtaa

SEQ ID NO: 22244 - protein, 254 aa, Unknown
  Obtained from environmental sample
  misc_feature (1)..(254): Xaa is any amino acid
MIEKMCSPMANLFYKLYNSIQRRKSVFVVGLCVVFGMLVWMASTLKFDEDISKLIPSNSENEQLQKVLKTVQFADKIIVNIEREDNGSTEDLTDYATQFLDSLSERSSNYFKDIRGKIEDETIFETLDFVYTNAPLFLREADYNLLANKLHPDSIAKITESNYKTLISPSGIVAKKTIVKDPLGISLMGIKHLEQLGISDAFTLRDGFLVSKDEQHLLLFITPEYPSSNTNENGIFSAQLYQLQEELTAAIPAK

SEQ ID NO: 22245 - DNA, 579 bp, Unknown
  Obtained from environmental sample
  misc_feature (1)..(579): n is a, c, g, or t
atgtatccaataatttttaaaagagtaatagattttataataagctttttcagctttttattactttctcccatttttatagtactaactactttcctatttatctcttttaaagggaatccattttttacccagattaggccgggtttgcataaaaaattatttcgggtgattaaattcaaaactatgaataataaggtggacgatgccggaaatttattgccggatgcagtaaggttaacaacaattggtaagtttatccgttcaacaagtctggatgagattcctcaattattaaatgtaattaaaggggatatgagtttgataggaccaaggcctttacttactaagtatttagatcgttattcgagtgaacaatcaaaacgtcataacgttagaccaggaataacaggctgggcccaggtaaatggcagaaataatatttcatgggataaaaaattggcattagatgtgtattatgttgataatattagcctaaaactcgattttaaaattatattattaactttgataaaagtgctgagaagggaagatataaatagcggaagttctgcaann

SEQ ID NO: 22246 - protein, 193 aa, Unknown
  Obtained from environmental sample
  DOMAIN (7)...(187): Bacterial sugar transferase
  misc_feature (1)..(193): Xaa is any amino acid
MYPIIFKRVIDFIISFFSFLLLSPIFIVLTTFLFISFKGNPFFTQIRPGLHKKLFRVIKFKTMNNKVDDAGNLLPDAVRLTTIGKFIRSTSLDEIPQLLNVIKGDMSLIGPRPLLTKYLDRYSSEQSKRHNVRPGITGWAQVNGRNNISWDKKLALDVYYVDNISLKLDFKIILLTLIKVLRREDINSGSSAX

SEQ ID NO: 22247 - DNA, 813 bp, Unknown
  Obtained from environmental sample
  misc_feature (1)..(813): n is a, c, g, or t
ttgacggaagcagttagagaanacgacttacttcgtataaatgatttgttagcgcaattaggaaaaacaccattttttaaacatgaaaaacctacaccttacgatgaagcggttagcttaatctggtatctagaaaatgtgttttatgaatccttcggaaaaatatatgactatatccaacaaaatatttttgacgggaaacatatagataacgatattattaacattggtttttggccaggaggagacagagatggtaacccatttgttacaccagaaattacagttaaagtcgcagaaaggttacacgaaactattattaaaaattaccataaagacgtccgaaagttaaaacgtaaattaacctttcaaggtgttgaagcgcgtatatcacacatagaaacacagttatataaaaaagtgcttcatgaagaatcaagtttaactttaaacgaatttgtttcagaattaaaagccatcaggcaaattataattgatcagcatcaatcgctttacgttaccgaagtaactagtttacttaacaaaattcatttatttggttttcatttttcaagcttagatatacgtcaagatagtagagtgcatcattcaatttttacaacaatggtggatagtatgattgctaacggaagcaaggatattccgagtaattatcatagtctttcagaagcggaacaagttaaggttttgtctgaagtaaaaggaacagtggatttgtctttaattaaagatgaagaaaccctaaaagcactatatactattaaggctttaaatctattcagtcactnatga

SEQ ID NO: 22248 - protein, 270 aa, Unknown
  Obtained from environmental sample
  misc_feature (1)..(270): Xaa is any amino acid
MTEAVREXDLLRINDLLAQLGKTPFFKHEKPTPYDEAVSLIWYLENVFYESFGKIYDYIQQNIFDGKHIDNDIINIGFWPGGDRDGNPFVTPEITVKVAERLHETIIKNYHKDVRKLKRKLTFQGVEARISHIETQLYKKVLHEESSLTLNEFVSELKAIRQIIIDQHQSLYVTEVTSLLNKIHLFGFHFSSLDIRQDSRVHHSIFTTMVDSMIANGSKDIPSNYHSLSEAEQVKVLSEVKGTVDLSLIKDEETLKALYTIKALNLFSHX

SEQ ID NO: 22249 - DNA, 900 bp, Unknown
  Obtained from environmental sample
  misc_feature (1)..(900): n is a, c, g, or t
ttgattcggtcgagtaggctaatgtgtantcggaaaacattcgatggaaagtttaaccaagttgaaaccaaatcagaattaatagactataaagagggagataaaaagatccctttctttgtggttaaagaattcaaaggaaaagatttagtaggtattacttatgagcaattattagattacgcattaccaaatgataatcctgaaaacgcatttagagtcatttccggggattttgtaacgacagaagatggtactggaattgtacatacagctccaacatttggagcagatgatgctttagtagcaaaacaagcaacaccagaaataccaccgttattagtaaaagatgacaatggtaatttggtgccattggtggatttacaaggaaggtttagaccagaactaggtgaatttgctggtaagtatgtgaaaaacgaatattacaatgatggtgaagctccagagcgttctatagatgttgagcttgcgattaaattgaaaatagaaaataaggcctttaaggttgaaaaatataagcacagctatccaaattgttggagaacagataagccaattttatactacccattagattcttggtttatcaaagtcactgacgtaaaaggtagaatgcatgagttaaataccactattaattggaagccaaaatcaactggtgaaggtcgttttggtaattggctggcaaatgctaatgattggaatttatcacgttcacgcttttggggaattccattaccaatttggagaacagaagatggtaaagaacaattatgtattggttctgttgcagaattaaaaagtgaaatcgcaaaggcggttcaatctggagttatgtctgaagatatttttgctgcttttgaaatcggtaatatgnng

SEQ ID NO: 22250 - protein, 300 aa, Unknown
  Obtained from environmental sample
  DOMAIN (1)...(300): tRNA synthetases class I (I, L, M and V)
  misc_feature (1)..(300): Xaa is any amino acid
MIRSSRLMCXRKTFDGKFNQVETKSELIDYKEGDKKIPFFVVKEFKGKDLVGITYEQLLDYALPNDNPENAFRVISGDFVTTEDGTGIVHTAPTFGADDALVAKQATPEIPPLLVKDDNGNLVPLVDLQGRFRPELGEFAGKYVKNEYYNDGEAPERSIDVELAIKLKIENKAFKVEKYKHSYPNCWRTDKPILYYPLDSWFIKVTDVKGRMHELNTTINWKPKSTGEGRFGNWLANANDWNLSRSRFWGIPLPIWRTEDGKEQLCIGSVAELKSEIAKAVQSGVMSEDIFAAFEIGNMX

SEQ ID NO: 22251 - DNA, 942 bp, Unknown
  Obtained from environmental sample
  misc_feature (1)..(942): n is a, c, g, or t
ttgctggaaaatatggaatcttctcgaaagcttggtcccgattctaaaacattaacctatccagaaattgaagaaaagctggaacaaatcatccgtattaatggagaagacgaattaaatgcggtaagagacaaagcaagaaagattgccaaagaagtgggcttgattaaagagtttaccaagctaaataaaatcataagcgccttactcactacaaaaccatcgagtatattaaaatcgccagtagcatcagcaagagcatttggagtgccttatgatccggctagaattcaactttttgaatcgttgtttacagctttgaaacaacaagagtttcagcatcgagaagaaaaaaataccacaactgctgcttatagaaactttgccttttatgaaagttacttttccaattacatagaaggtactgtctttgaaattgaagaggcaaaacgagtcatcgaaactcaaaaaccactaccatcacgtaatgaagactctcacgacgtattaggaacgtatcaaattgtttctaacccacgccaaatgaaaatcgttccaagcactaaagaagaattagtagaaatacttcagtacagacatcagatattattgagtgctcgagaagataaaaagccaggaaagttcaaagacaaaaacaacagagctggagacacctcttttgtagaaatggaattagttacaggaacactttataaaagttttgactactatcaagcactaacacatccttttgcaaaagcagcttacataatgtttgtgattagtgaagtccatccttttttagatggtaatggacgttttgcacgtggtatgattaatgctgaactatctactgcatccaagaccaaaataatatccaacagtctaacgagaagattatnaggaggattacacgggttaccagaatcaagaccatcgggn

SEQ ID NO: 22252 - protein, 314 aa, Unknown
  Obtained from environmental sample
  DOMAIN (196)...(313): Fic protein family
  misc_feature (1)..(314): Xaa is any amino acid
MLENMESSRKLGPDSKTLTYPEIEEKLEQIIRINGEDELNAVRDKARKIAKEVGLIKEFTKLNKIISALLTTKPSSILKSPVASARAFGVPYDPARIQLFESLFTALKQQEFQHREEKNTTTAAYRNFAFYESYFSNYIEGTVFEIEEAKRVIETQKPLPSRNEDSHDVLGTYQIVSNPRQMKIVPSTKEELVEILQYRHQILLSAREDKKPGKFKDKNNRAGDTSFVEMELVTGTLYKSFDYYQALTHPFAKAAYIMFVISEVHPFLDGNGRFARGMINAELSTASKTKIISNSLTRRLXGGLHGLPESRPSG

SEQ ID NO: 22253 - DNA, 588 bp, Unknown
  Obtained from environmental sample
  misc_feature (1)..(588): n is a, c, g, or t
atgaaaataaaaaaacaaatattaaagaattctttttttagaaaaaactcatttttaattattataattatattattctcttcttgtagctcactatataattcagtttacacaaaaccaaagttggttgatattaaagtgtcaaaaaacacaaaaattttacacaaaaagcttttttacacagcaaaagaaggttttgcagttgggcatcaagatgccacatcttatggaattggttggaaagaagctgatttttctaacatcataaaaagtgatgtaaaagatattgttggagatcttccagcagtttttggctttgatattggaagaattgaacatgaaaaagatgcaaatttagattccgttccttttgaaaccatgagaaaattaataattgatgctcataaaaatggaggaataattacgattagttggcacgcagacaatcccacaantggtggtgattcttgggacaaaacacctgctgttaaagacattatcggaaatggaatttataacgaaaaatatgagaaatggttaataatgttgccaatttataaaaccttaaatataacgcaattaatctaa

SEQ ID NO: 22254 - protein, 195 aa, Unknown
  Obtained from environmental sample
  misc_feature (1)..(195): Xaa is any amino acid
MKIKKQILKNSFFRKNSFLIIIIILFSSCSSLYNSVYTKPKLVDIKVSKNTKILHKKLFYTAKEGFAVGHQDATSYGIGWKEADFSNIIKSDVKDIVGDLPAVFGFDIGRIEHEKDANLDSVPFETMRKLIIDAHKNGGIITISWHADNPTXGGDSWDKTPAVKDIIGNGIYNEKYEKWLIMLPIYKTLNITQLI

SEQ ID NO: 22255 - DNA, 717 bp, Unknown
  Obtained from environmental sample
  misc_feature (1)..(717): n is a, c, g, or t
gtgtcagttaaatttccattagctaaaatgattggtgttacaggtgtctctggtagcggaaaatctactttaattaacgagacactctaccctattttaaatgcacattattttaatggtgtaaaaaaaccaatgccttataaaagcataaaaggtttagagcatatagataaggttattgatattaatcaatcgccaattggtcgtacaccaagaagtaatcctgcaacttacaccaaaacatttgacgaaatccgtagcctttttgctaaaataccagaagccatgatacgtggttataaacctggacgttttagttttaatgttgcaggaggacgttgcgaaacctgtaaaggtggtggtttacgtgttattgaaatgaattttttacctgacgtgtatgtcgaatgtgaaacttgccaaggtaaacgttttaatcgcgaaacattagagattagatataaaggaaaaagcataagtgatgttttagacatgaccattaatgaaggggttgacttttttgaaaacattcctaaaattcataaaaaactaaaaacaattaaagatgttggattaggttacattaccttgggacaacaaagtacaacgctatctggtggagaaactcaacgtataaaattggctacagagttaagtaaacgcgacacaggtaataccctttatatattagacaaaccactacggtcttcattttga

SEQ ID NO: 22256 - protein, 238 aa, Unknown
  Obtained from environmental sample
  misc_feature (1)..(238): Xaa is any amino acid
MSVKFPLAKMIGVTGVSGSGKSTLINETLYPILNAHYFNGVKKPMPYKSIKGLEHIDKVIDINQSPIGRTPRSNPATYTKTFDEIRSLFAKIPEAMIRGYKPGRFSFNVAGGRCETCKGGGLRVIEMNFLPDVYVECETCQGKRFNRETLEIRYKGKSISDVLDMTINEGVDFFENIPKIHKKLKTIKDVGLGYITLGQQSTTLSGGETQRIKLATELSKRDTGNTLYILDKPLRSSF

SEQ ID NO: 22257 - DNA, 687 bp, Unknown
  Obtained from environmental sample
  misc_feature (1)..(687): n is a, c, g, or t
atgtattatggcatcgaaaatgtggagatacttatggaatggttaaaaatttcagacgaactggacaagttgatcgaggacagaactacccctgagtctggactgaaactcttactgaaacaggggtttaggccagaggatattacgaagacccgcctcaactatttagttaccttaggtgctttacggcagcccaggccagaatatcatggtaggggacggggcggtcatcgattatttcagcgggacattttcgaggtgttactattcattattgatcttaaacagcaatttacgttaaacgagatttctggaattgtccagcaggaaagagaggaccgcacaaaaaaggcatttaaagaattgaagattaccgaacttattcctgagacatctggtcttttcaagtccgcaataaaagagactaattcactgagcctttttggatatgatattgttaagggcaatgtaattaggctttctatcattgaacttaataatatcattgaaaatttggagaatgatatgaaggcgatagcaacgtttcaagatgagactgctgaaatcatttctgagaaaagcggaaaagttttatctggctatatttcaaagaaaaaaaaacaaaaacagcgtttagtaaagaagattgaacaaatggcaaaacaaggaaaggcaattacagcataa

SEQ ID NO: 22258 - protein, 228 aa, Unknown
  Obtained from environmental sample
  misc_feature (1)..(228): Xaa is any amino acid
MYYGIENVEILMEWLKISDELDKLIEDRTTPESGLKLLLKQGFRPEDITKTRLNYLVTLGALRQPRPEYHGRGRGGHRLFQRDIFEVLLFIIDLKQQFTLNEISGIVQQEREDRTKKAFKELKITELIPETSGLFKSAIKETNSLSLFGYDIVKGNVIRLSIIELNNIIENLENDMKAIATFQDETAEIISEKSGKVLSGYISKKKKQKQRLVKKIEQMAKQGKAITA

SEQ ID NO: 22259 - DNA, 372 bp, Unknown
  Obtained from environmental sample
  misc_feature (1)..(372): n is a, c, g, or t
atgcaatacattaaagatgggtgcattgtttttaaaaaaggtagcgaagcatgtagacctttatcaatttttacagaaaaagacatatgggatttagtaaaaagagaaaatatagatgtatgtagtatttattatgatcaaataataaatggggaactggtgactggtgaaaaaacaacagggtgttctatgtgtgggttcggaattcataatgaagacaatgcaaataataggttaacaaggctacataaaaggcagcctaatgtgtacaagtcttacatggataaattgggttatagaagtgtttttaattttatgaaaattaatctaccagacgaggataagcaaacaaaactaaatttaacaccatga

SEQ ID NO: 22260 - protein, 123 aa, Unknown
  Obtained from environmental sample
  misc_feature (1)..(123): Xaa is any amino acid
MQYIKDGCIVFKKGSEACRPLSIFTEKDIWDLVKRENIDVCSIYYDQIINGELVTGEKTTGCSMCGFGIHNEDNANNRLTRLHKRQPNVYKSYMDKLGYRSVFNFMKINLPDEDKQTKLNLTP

SEQ ID NO: 22261 - DNA, 639 bp, Unknown
  Obtained from environmental sample
  misc_feature (1)..(639): n is a, c, g, or t
ttggccagtggtattggttctaatgacattgggttagatagaggacaattaggctccgaacgccttgtgaaattcaagaaagcgggtaataagttgcttttggtgcagcccaatcagagtttcagggcaattaccgataatccattagagaagaagagtattgagcaagcttttgcaatatcagtattgtttggttttaagattgaagataccattaacggcaactatgtgatcgatttaactccttttttaatgcaggatgcccatggtgtggcagaccgactgaaatctcaaaatgagggtacctataagttagatctttctaaaagtgcgctgtctttggaacgcaccaaagcatttcctaaaaatgtagagtttgaagccttgttaacctttgatggcgaagccaaaggccgaaatataaaaagcgtgacgcctacatcgtccttaataagcgttattcaacaccattcatttgttgaacttccggatcataattataaacctaggacctttgatccgcgtagtggcgccatttcaatatcgtatatggactatgccacacctattgaagagcctattgtgaagcggtttaccatcagacaccgattggaaaagaaaaacctgaactcccaatga

SEQ ID NO: 22262 - protein, 212 aa, Unknown
  Obtained from environmental sample
  misc_feature (1)..(212): Xaa is any amino acid
MASGIGSNDIGLDRGQLGSERLVKFKKAGNKLLLVQPNQSFRAITDNPLEKKSIEQAFAISVLFGFKIEDTINGNYVIDLTPFLMQDAHGVADRLKSQNEGTYKLDLSKSALSLERTKAFPKNVEFEALLTFDGEAKGRNIKSVTPTSSLISVIQHHSFVELPDHNYKPRTFDPRSGAISISYMDYATPIEEPIVKRFTIRHRLEKKNLNSQ

SEQ ID NO: 22263 - DNA, 594 bp, Unknown
  Obtained from environmental sample
  misc_feature (1)..(594): n is a, c, g, or t
ttgcttaccattacagatattaaagcaattgccaatttaggtaaacaaaaaaacattgtaacaagtatagataatacgtttgcaagtccagtaaatcaaaacccaatagattttggtattgatttagtaatgcactcggcaactaaatattttggaggtcatagtgatatttgtgcaggagcagtagcaggaagtaaagatcatttagataaaatatggaatgtatctaaaaattatggaggtagtttaagcgattttacggtttggatgttggagcgtagcatgaaaactatgggtttacgtgtaaaagcacaaactaaaaatgctaacaaattagcaaaatggttatataaacaaacatttgttaaacaagtgtattatccaggcttaaaaagtcatccagaacataagttagcaaaatctcaaatgaaaggttttggagctatgttatcttttgaacttatagataatataaattctgatcaattcatgaagcaattacagttaattaaagcttctatngagtttagcagggtattagcaaagcacaatggttatncctccaacacaaacattcacactcgntnntattaa

SEQ ID NO: 22264 - protein, 197 aa, Unknown
  Obtained from environmental sample
  DOMAIN (1)...(181): Cys/Met metabolism PLP-dependent enzyme
  misc_feature (1)..(197): Xaa is any amino acid
MLTITDIKAIANLGKQKNIVTSIDNTFASPVNQNPIDFGIDLVMHSATKYFGGHSDICAGAVAGSKDHLDKIWNVSKNYGGSLSDFTVWMLERSMKTMGLRVKAQTKNANKLAKWLYKQTFVKQVYYPGLKSHPEHKLAKSQMKGFGAMLSFELIDNINSDQFMKQLQLIKASXEFSRVLAKHNGYXSNTNIHTRXY

SEQ ID NO: 22265 - DNA, 387 bp, Unknown
  Obtained from environmental sample
  misc_feature (1)..(387): n is a, c, g, or t
atgaaactaaaaataaatttacctaaaagcatttgtactctcgctgctttatttttttcaatcttattaattgcttgcggaaccagtaaaaatgatactattaaacttagcttagaacagcaacaaataaagccgtttgagatttctaagaatttctatgatgcagtaaaaaatggaggtaatgcagataaatatgcaaaacaattagttcaactttctcccgaagtgcttaaaaacactttaaaaacagatgcacagaaaaaagcgttttggttaaatacttacaacacttatgtacaataccttttaaaagataatcccgatttatataaagatagatctgctttctttaaagaaaagcgttttgttattgtaggggaagagtaa

SEQ ID NO: 22266 - protein, 128 aa, Unknown
  Obtained from environmental sample
  misc_feature (1)..(128): Xaa is any amino acid
MKLKINLPKSICTLAALFFSILLIACGTSKNDTIKLSLEQQQIKPFEISKNFYDAVKNGGNADKYAKQLVQLSPEVLKNTLKTDAQKKAFWLNTYNTYVQYLLKDNPDLYKDRSAFFKEKRFVIVGEE

SEQ ID NO: 22267 - DNA, 852 bp, Unknown
  Obtained from environmental sample
  misc_feature (1)..(852): n is a, c, g, or t
gtgggaaaaaagtgtcccnntcttggtttaccgggtaaggcctttcagggtgacaatttttatacagcaacaaatctggggcctgaagtaatgattacatattactataatgacaaatacgaatcgctcaaagataaacgccaaaaaaaggataaaaagttagttaagaattcaaaagacaccccttaccccaattataatttgttgaaagccgaggttgatgaaattactccgcaattaatttttactttcaaagatgctagtggaaaagtggttaaaaaaatatttcaaaaaccggcattagggctacaacggttcaactggaatctacgatatgagcaaccaaacccaattgattttagaaaatcatctttttataatccttttgtcggaaaacaggaagggtcgttaattaatccaggcacatacaccgtagagatgcacctttttcaagatggaaacatccaatcattagtagcacctgtttcttttatagtaaaaagtttaaataatactgtgatgcctgctgaagacaggacatcaaaagtagcctttcaaagaaatgtggccttattacatgctcaaatacaagaaagtcaaagaaagatcgatgatatgactgataaattaaaatatataaaagaagccataaaactttctgaacaacccataggggtgttatcccaaactgtattggagattgaatctaagatcaaaaaatcaactgttttattaaacggagatcctgtaaagagaagattggctattgaacaggttccggggccggcgatgagaataggaagtattaattttgagcaaaatattcaacggaggtcctacgaaacccattag

SEQ ID NO: 22268 - protein, 283 aa, Unknown
  Obtained from environmental sample
  misc_feature (1)..(283): Xaa is any amino acid
MGKKCPXLGLPGKAFQGDNFYTATNLGPEVMITYYYNDKYESLKDKRQKKDKKLVKNSKDTPYPNYNLLKAEVDEITPQLIFTFKDASGKVVKKIFQKPALGLQRFNWNLRYEQPNPIDFRKSSFYNPFVGKQEGSLINPGTYTVEMHLFQDGNIQSLVAPVSFIVKSLNNTVMPAEDRTSKVAFQRNVALLHAQIQESQRKIDDMTDKLKYIKEAIKLSEQPIGVLSQTVLEIESKIKKSTVLLNGDPVKRRLAIEQVPGPAMRIGSINFEQNIQRRSYETH

SEQ ID NO: 22269 - DNA, 447 bp, Unknown
  Obtained from environmental sample
  misc_feature (1)..(447): n is a, c, g, or t
atggatgagagtggcttcgaggctgagaccatccgctctcatggctatgcacctattggtaccccttgcatcgatagctataactggcaaggtaaaaaacgcaccaatgttattggtgccttatatgaaaaagcgttatttgcacttgattacttcgaaaagaatatcaatggcgacatattctacaactggtgcaaaaacacgctaataccaagtcttaaaataaaatgcgtaatcgtcatggataacgccagctttcataaacgcgttcagagattactcaacaggcatggtcatcgcttgttatttctaccgccttacagccctgatttaaaccctattgaaaaaaaatgggcacaggctaagtttctacgacaagggtggatggagaataatttacctaagctgtttcatgatatgggttgtaccaattttattctggattga

SEQ ID NO: 22270 - protein, 148 aa, Unknown
  Obtained from environmental sample
  misc_feature (1)..(148): Xaa is any amino acid
MDESGFEAETIRSHGYAPIGTPCIDSYNWQGKKRTNVIGALYEKALFALDYFEKNINGDIFYNWCKNTLIPSLKIKCVIVMDNASFHKRVQRLLNRHGHRLLFLPPYSPDLNPIEKKWAQAKFLRQGWMENNLPKLFHDMGCTNFILD

SEQ ID NO: 22271 - DNA, 348 bp, Unknown
  Obtained from environmental sample
  misc_feature (1)..(348): n is a, c, g, or t
ttgaaaaaaaatgggcacaggctaagtttctacgacaagggtggatggagaataatttacctaagctgtttcatgatatgggttgtaccaattttattctggattgactatagcgaattttctgaatatttaacttttttaggctatataggtagaattgatgagatctatttctcattaagagtaattgataaaagttacattaataataataaaaatgatctacttaactttaatacctataaaaacttagagtcattaatcataagagtcgaagaggaaaatgcttatgacattaaaaaatacctattaaacacaaactataaaaaagttgaaattttaatttag

SEQ ID NO: 22272 - protein, 115 aa, Unknown
  Obtained from environmental sample
  misc_feature (1)..(115): Xaa is any amino acid
MKKNGHRLSFYDKGGWRIIYLSCFMIWVVPILFWIDYSEFSEYLTFLGYIGRIDEIYFSLRVIDKSYINNNKNDLLNFNTYKNLESLIIRVEEENAYDIKKYLLNTNYKKVEILI

SEQ ID NO: 22273 - DNA, 519 bp, Unknown
  Obtained from environmental sample
  misc_feature (1)..(519): n is a, c, g, or t
gtgctttctaaaaatcaaatcaaaaatataacgcgtttaaagcaaaaaaaatatagacaacaagaaggtttatttattgctgaaggcggaaaagtcatcaaagagtttttaaactctacttttaaacttgtggatttatttacaacagagacctttaatgtagaaaacgaatgcatcgtgtccgaagctgatttaaaaaaaattagctgtttaactacaccaaacacagccttagctatttttaaaattccagaaacagatactataataaacgaaggtctgatattagcgttggatgatatacgcgatcctggtaatttaggtactattatacgtttgtgtgattggtttggaatcaagcaattagtatgtagtcttaaaactgtggattgttataatccaaaagtagtgcaggcaactatgggatctttgactagagtaaatattgtttataccgacttaagcatttatttaaaagaagtcgatgtacctagtttttggtgcctttatggatggtaa

SEQ ID NO: 22274 - protein, 172 aa, Unknown
  Obtained from environmental sample
  misc_feature (1)..(172): Xaa is any amino acid
MLSKNQIKNITRLKQKKYRQQEGLFIAEGGKVIKEFLNSTFKLVDLFTTETFNVENECIVSEADLKKISCLTTPNTALAIFKIPETDTIINEGLILALDDIRDPGNLGTIIRLCDWFGIKQLVCSLKTVDCYNPKVVQATMGSLTRVNIVYTDLSIYLKEVDVPSFWCLYGW

SEQ ID NO: 22275 - DNA, 762 bp, Unknown
  Obtained from environmental sample
  misc_feature (1)..(762): n is a, c, g, or t
ttgattttgacaaaagtaaatccatacaaagatagcgacttaggaaagaaagaacaggtaactaaaatgtttgataccatttctggtgaatatgatggtttaaaccgagtaatttcttttggaatagatattaaatggcgaaaaaaagtagttgacattgttaaagctactaatccagataatgttttagatattgccacaggaactggtgatttagctattaaccttgctgaaaccagcgcaaaaaaaattattggtttagacattagtagtggtatgctagaagttggaaagcttaaaataaaagctaaaaaactagatcaaaaaattgatatggttattggtgattccgaaaacatgccttttgacgacaatacctttgatgccatcactgttgcctttggtgtgcgtaactttgaaactttagaaaatggtctaaaagacattttacgtgttttaaaaccaggtggtatttttgttattttagaaacttctgtcccaactaagtttccttttaaacaagggtatcaattccattctaaggttattttacctaccgtcggaaaattattttctaaggacaaaacagcttacaaatatttaagcgaaagcgctaatgcgtttccatatggagaggctttaaacaatattttacgtaaaattgggttcagtaatgtcacagacatgcctcagacatttggtgttgctacaatttacaaagcatttaaaactcatcgatacaaacatatatcancttactga

SEQ ID NO: 22276 - protein, 253 aa, Unknown
  Obtained from environmental sample
  DOMAIN (13)...(243): ubiE/COQ5 methyltransferase family
  misc_feature (1)..(253): Xaa is any amino acid
MILTKVNPYKDSDLGKKEQVTKMFDTISGEYDGLNRVISFGIDIKWRKKVVDIVKATNPDNVLDIATGTGDLAINLAETSAKKIIGLDISSGMLEVGKLKIKAKKLDQKIDMVIGDSENMPFDDNTFDAITVAFGVRNFETLENGLKDILRVLKPGGIFVILETSVPTKFPFKQGYQFHSKVILPTVGKLFSKDKTAYKYLSESANAFPYGEALNNILRKIGFSNVTDMPQTFGVATIYKAFKTHRYKHISXY

SEQ ID NO: 22277 - DNA, 633 bp, Unknown
  Obtained from environmental sample
  misc_feature (1)..(633): n is a, c, g, or t
ttggaattcaacgaattttaccatccattaataaaaaagtgtattaaaaatgatttaaatttaattgataaaagtatgttattaacaggttcaaatatgtctggtaaaagcacttttataagaacagttgctttaaatagtattttagcacaaactttacatttttgttttgctgatgcttataatgctcctttttataaactttattcttcgataagaattaccgatgatttattagatagtacaagttattatttacaagaagttttaaacattaaagaattaattgatgcttctatagatgaaaaaccttgtttatttgttttagatgaaatttttaaaggtacaaatacaatagaacgaatttctggaggaaaagcaattttatcttttttaaataaaaagcatcacacagttttagtttctacacatgatattgaacttacagaactactccaaaaagaagcttataatcttttccattttagtgaatctatagaaaataatgaactaaattttgatcataaaataaaagcgggaaagctaaaaacaaggaatgctataaaaatccttgagatttataaatatccatcagaattactgacaatccctcggccgattcttgatccgtag

SEQ ID NO: 22278 - protein, 210 aa, Unknown
  Obtained from environmental sample
  DOMAIN (2)...(194): MutS domain V
  misc_feature (1)..(210): Xaa is any amino acid
MEFNEFYHPLIKKCIKNDLNLIDKSMLLTGSNMSGKSTFIRTVALNSILAQTLHFCFADAYNAPFYKLYSSIRITDDLLDSTSYYLQEVLNIKELIDASIDEKPCLFVLDEIFKGTNTIERISGGKAILSFLNKKHHTVLVSTHDIELTELLQKEAYNLFHFSESIENNELNFDHKIKAGKLKTRNAIKILEIYKYPSELLTIPRPILDP

SEQ ID NO: 22279 - DNA, 723 bp, Unknown
  Obtained from environmental sample
  misc_feature (1)..(723): n is a, c, g, or t
gtggtaattggtgctatcgttatagggatctggtccataatttttttggtaggtatggttaatggaatgatagacagttatgtggataacgccataaaaaatgaagtttctcatattaaaattcaccatcatgagtttataaaagacaaggaaagtaaattctatatttctgatgtaaataatgtcaaaactattgtggatactatatctggtattaaagcagtttcgtataaaactattctaaatgctatgatcagctctagtcatgccggaagaggaatctctgccattggcgtagtacctaaagatgaggttttagtctctggagtatccagtagaattaatgaaggtacttatctttctgacaaaaaaaagaatcaaattatagttagtaaaagaacggctgaaaaattaaaggtaaaacttcgctcaaaagttgtgttgacttttcaaaatttagaaaatgaaattacgatgggagcattcaggattgttggcttgttcgaaaccggaaataatatttatgatgaatcagttgttttcattaatcaaaaggatatcaacaagttattagagtttgaaggctatggtcatgaggttgctattttaattaatgatttatcagatcttgaaaaaattcagaaaagcattgcaaacttatttcctgatcttttagttagaacttataaagaaactcaaccagaattagncccgtctncatga

SEQ ID NO: 22280 - protein, 240 aa, Unknown
  Obtained from environmental sample
  misc_feature (1)..(240): Xaa is any amino acid
MVIGAIVIGIWSIIFLVGMVNGMIDSYVDNAIKNEVSHIKIHHHEFIKDKESKFYISDVNNVKTIVDTISGIKAVSYKTILNAMISSSHAGRGISAIGVVPKDEVLVSGVSSRINEGTYLSDKKKNQIIVSKRTAEKLKVKLRSKVVLTFQNLENEITMGAFRIVGLFETGNNIYDESVVFINQKDINKLLEFEGYGHEVAILINDLSDLEKIQKSIANLFPDLLVRTYKETQPELXPSX

SEQ ID NO: 22281 - DNA, 678 bp, Unknown
  Obtained from environmental sample
  misc_feature (1)..(678): n is a, c, g, or t
ttggaattaattaaaggggaaatacctcaaaataaatcagacctttttgaaggtattgatacctcttggaatcgtattaaaggcggacaagtaattggaacacttttagaaaaagtacaacgtgattacgattttaaaaatccttcagcttcaattgaaggattaaccaaagcctattcactaattcaatctatagaagacaaacattggaggactttaaaatctgaagaaataaaaaatatcatttcagcttgtgctggtctatatttagaagctgttgcaaatacggcacagtctacagttaacgataaagtaaaattagagctagaaattataaatagaagtgctcaaaacatcacattaacttcaatagttgttcctaataatctcagcatttctaaaaaaatccctttattagaaaatataaaaatagagcttcaagaaacctttattccttcatataaaaaagtaattacaancccctattggctaaccgaaaaaggcactttaggaatgtataaagtaaataataaagacctcattggacttccagaaaccccgagttattttaatgttgtctttaatattactattaatggtgttaccattccgtatataaaacccgtggtttataaaacaaacgatcctgtaacaggagaaacctataaaccgcttnna

SEQ ID NO: 22282 - protein, 226 aa, Unknown
  Obtained from environmental sample
  misc_feature (1)..(226): Xaa is any amino acid
MELIKGEIPQNKSDLFEGIDTSWNRIKGGQVIGTLLEKVQRDYDFKNPSASIEGLTKAYSLIQSIEDKHWRTLKSEEIKNIISACAGLYLEAVANTAQSTVNDKVKLELEIINRSAQNITLTSIVVPNNLSISKKIPLLENIKIELQETFIPSYKKVITXPYWLTEKGTLGMYKVNNKDLIGLPETPSYFNVVFNITINGVTIPYIKPVVYKTNDPVTGETYKPLX

SEQ ID NO: 22283 - DNA, 621 bp, Unknown
  Obtained from environmental sample
  misc_feature (1)..(621): n is a, c, g, or t
ttgcccagaaaacgccactattgcagatttattaatccaaagaaaaaaagaaaaagcaatttaatgaagttaagaaaaagatattttttgcttatttttatagcaattgctcctttctataaatttgttcatccagaaaattattgttttggtgatacagatttggttattattggaggatttatggtattgtttgcaattacgtttttagtaattttctttaataatttatatttaataacgataaaaagagaactttttaactatagaccagtattaattgcagttgtgtttttaatagccttatatactactttaggattgcatgatcagaatatttttaaagaacaagtaaaggtttataatggtttttctaaagaaaaagatttattagaaataaatttatatagcgataatacctttgaattaaagataatttatgataaatcgtattgtgttgaaaaaggagaatatagttttaaaaacgatactttacgtttagataaatacaacaaagtaaaaggaaatattatttttgatgatatgtatgtttttaataacacttataaaagtttaaatccaatttattctagtcttcctgcttttgtgttaaagaaataa

SEQ ID NO: 22284 - protein, 206 aa, Unknown
  Obtained from environmental sample
  misc_feature (1)..(206): Xaa is any amino acid
MPRKRHYCRFINPKKKRKSNLMKLRKRYFLLIFIAIAPFYKFVHPENYCFGDTDLVIIGGFMVLFAITFLVIFFNNLYLITIKRELFNYRPVLIAVVFLIALYTTLGLHDQNIFKEQVKVYNGFSKEKDLLEINLYSDNTFELKIIYDKSYCVEKGEYSFKNDTLRLDKYNKVKGNIIFDDMYVFNNTYKSLNPIYSSLPAFVLKK

SEQ ID NO: 22285 - DNA, 558 bp, Unknown
  Obtained from environmental sample
  misc_feature (1)..(558): n is a, c, g, or t
atgtgggttgcaatgtctgattatcaatctgatttaaaaatctctgatggtattttaaagcagatggcagagcaatatagaaaaataagaaatactggaaaaattctacttggtaatatcaatgatttagaagagatagcatctcttgatactatgagtgaagttgatttatggattttagataaagcacaaaaagtatttacagaagttgatgagagctttagagagtatgattatagccgtggtttaaatagattgaatcactttttagtagcagagttatcaaatgtatatattgatgtatgtaaagataaaatgtattgtgatggaaaagattcaacaacaagagttgcaagtgtaagtgctatggcaatgattgcaaaagctttcataactactttagcaccggttttaacatacacaatggatgagttgattcaacacgcaccaaaagttatcactgatggtgtgacatctatttttgatatgaaaaaatattatttacctgaagttaaaataaatcttaatgaaatacatttattagaagcaaaaagtaaa

SEQ ID NO: 22286 - protein, 186 aa, Unknown
  Obtained from environmental sample
  misc_feature (1)..(186): Xaa is any amino acid
MWVAMSDYQSDLKISDGILKQMAEQYRKIRNTGKILLGNINDLEEIASLDTMSEVDLWILDKAQKVFTEVDESFREYDYSRGLNRLNHFLVAELSNVYIDVCKDKMYCDGKDSTTRVASVSAMAMIAKAFITTLAPVLTYTMDELIQHAPKVITDGVTSIFDMKKYYLPEVKINLNEIHLLEAKSK

SEQ ID NO: 22287 - DNA, 315 bp, Unknown
  Obtained from environmental sample
  misc_feature (1)..(315): n is a, c, g, or t
atgatgggtctattaaaagatatgtctcatgtaaatgtagaagcattagatgcaatagaatataaagattttcaagagttagtattaagtcgtggttcatttagagaagcctatcaagatattatgtttagtacaaaagttgcgattacttcaaaagatgatttgattgattttatagataaacttattgaaaataattttagtaatacagcttatacatatttagatggttttaatgaatttttctcttatgatgaggagcttacagcactatataaaaaactagagagaaaaaatattgaaaataaccaatag

SEQ ID NO: 22288 - protein, 104 aa, Unknown
  Obtained from environmental sample
  misc_feature (1)..(104): Xaa is any amino acid
MMGLLKDMSHVNVEALDAIEYKDFQELVLSRGSFREAYQDIMFSTKVAITSKDDLIDFIDKLIENNFSNTAYTYLDGFNEFFSYDEELTALYKKLERKNIENNQ

SEQ ID NO: 22289 - DNA, 750 bp, Unknown
  Obtained from environmental sample
  misc_feature (1)..(750): n is a, c, g, or t
ttgtacagaatattgcaagctactttaacccacttggaatacgctagtgatttatcagatgagtttggccacaagcacttttataatactccttcgtgttatccagaccctaatgaagacacttacaacttagaagagcacagctcattttatttctttattgaaaactttaaacgattagttgataagtttccttcacaggcaaaagcgcttagctttaatttaaatttaaaaaactccttatattttaataaactaagcttatattcatttgggtttaactctattttctccgcttcagaagccgcaaactacgtattatcaattgatctagaatacttttggaatagaagttatcaactcgatttgcttcgtttattagaaaaacgatggaaagatttttctaatacaaataaagaaaagctagttaaaaaaatcttagatggtcctaataaatctaaacaaataacagatgaagaatttcaaattttcaagaacttagagatatttcgctacattaaatggtgtgaactcagtcaattggtactgcctgaaaagtacagaaaaaaaatcgatatgatcatatccatgcatcaagactggcaggttaaagaaccggcagagctggtgcataacacatctgtaaaagttcatggaattacaattgatgaagaagctgatttaatcattaatgcgcctattagtgaagtaattaaaagatncattacagtttataatagaggcttttga

SEQ ID NO: 22290 - protein, 249 aa, Unknown
  Obtained from environmental sample
  misc_feature (1)..(249): Xaa is any amino acid
MYRILQATLTHLEYASDLSDEFGHKHFYNTPSCYPDPNEDTYNLEEHSSFYFFIENFKRLVDKFPSQAKALSFNLNLKNSLYFNKLSLYSFGFNSIFSASEAANYVLSIDLEYFWNRSYQLDLLRLLEKRWKDFSNTNKEKLVKKILDGPNKSKQITDEEFQIFKNLEIFRYIKWCELSQLVLPEKYRKKIDMIISMHQDWQVKEPAELVHNTSVKVHGITIDEEADLIINAPISEVIKRXITVYNRGF

SEQ ID NO: 22291 - DNA, 624 bp, Unknown
  Obtained from environmental sample
  misc_feature (1)..(624): n is a, c, g, or t
atgaagccaaagattactcatctattccccaaaatttatgaatgggcttgggatcagagactcatagaggccacatcacataaaataattgagcttgccttaccttcatataaaggtaaggataaaataaacgcttcagatgctaaaaattgctttagaaatatgagagaaaaagaaagagcagcggtaattcgttatttgagtaagggctttgcaaaaaattctaatgaatgtcttagagacgtaactactattatcgagagtatttggcccagagagagaaaatacagaactaaagaacaaacttctgcatggattaacttattagagaagtctggtagctattttcccaacttatttcactctatggagtggtgtttaacaccattggaagttcaacatcattggttaaattcatttgcacgcaatacttcagattcaattccattagcatctcaatttcccaatgaggttctaagcctgtgtgatttgataataccaaaagagacacgttcatccctttatcacttaaaagaagttctagatcttatagagcaagcaaacaatgatattgttaataatcagcaatttatgaaactaactaaaatatgtgaaaataattaa

SEQ ID NO: 22292 - protein, 207 aa, Unknown
  Obtained from environmental sample
  misc_feature (1)..(207): Xaa is any amino acid
MKPKITHLFPKIYEWAWDQRLIEATSHKIIELALPSYKGKDKINASDAKNCFRNMREKERAAVIRYLSKGFAKNSNECLRDVTTIIESIWPRERKYRTKEQTSAWINLLEKSGSYFPNLFHSMEWCLTPLEVQHHWLNSFARNTSDSIPLASQFPNEVLSLCDLIIPKETRSSLYHLKEVLDLIEQANNDIVNNQQFMKLTKICENN

SEQ ID NO: 22293 - DNA, 645 bp, Unknown
  Obtained from environmental sample
  misc_feature (1)..(645): n is a, c, g, or t
atgagaaaatcatttaaaattatattgttttctattttaggtattcttttattgcttttagcagctattataatagttaatacgctattaaagaataaatttgaaaacttcttactcacacgtcttcccagtcacatcactcaagagcataaaaacatttctttaaatactttggatggaaccataacggttagtgatttttctgtccttatttcgaataaggaaaatagtttagtgcatacaaaagtaacggttgataagctcattgttgaaaatgtaagctattgggattatttagtaaattctaaaatccatattgaggatattaaaattaaatcaccctccattttttattacacgcacaaacaaattaaaaatgaggattccacgtcatcttcgggtccagtaaaactctataagcccctttttgtcgatgcattaagtataaataatgctatgcttcatatatatgatgaggaaaaagattctttggttttatatgttgaaaacagcacgataaatatcagtgatataatgatggataaagacattataaaccgccgataccagttgagtttaaaaagtataagcgagtgcagattctatatttgtaaaaacaaatgcttaatgaaatctaacgggtag

SEQ ID NO: 22294 - protein, 214 aa, Unknown
  Obtained from environmental sample
  SIGNAL (1)...(20)
  misc_feature (1)..(214): Xaa is any amino acid
MRKSFKIILFSILGILLLLLAAIIIVNTLLKNKFENFLLTRLPSHITQEHKNISLNTLDGTITVSDFSVLISNKENSLVHTKVTVDKLIVENVSYWDYLVNSKIHIEDIKIKSPSIFYYTHKQIKNEDSTSSSGPVKLYKPLFVDALSINNAMLHIYDEEKDSLVLYVENSTINISDIMMDKDIINRRYQLSLKSISECRFYICKNKCLMKSNG

SEQ ID NO: 22295 - DNA, 681 bp, Unknown
  Obtained from environmental sample
  misc_feature (1)..(681): n is a, c, g, or t
atgaagtctgcttttgaagtagataaaaaagtagaacctacaatttcaaaccattcaaaaatagaaaccacaaataatatagaactaacgcaagaagttagtacgcctgaggtctcttcaaaagaaataaaaacagaaataacaacgcctgagattgaaatagaagaacctcaagtagaaattgaggtagaatctgttacagaagaaatatcagaaactgataatcttgccaataagttagtagaagattttgggcagtttgatcctactttagaattgggtaaatatcaatttccgcctttagacttacttaaaaagtatgataacgaaggcgttacaatcaaccaagaagaattagaagaaaataaaaaccgaattgttgacactttaaataattacaaaattggaattgctagtattaaagctaccattggaccaacagtcacgttatatgaaattgttccggaagctggaatcagaatttcaaaaatcaaaaatttagaagatgacattgctttatcactgtctgctttaggtatacgtattattgcaccaattcctggaaaaggaaccattggtattgaagtgcctaataaaaatgcaaccatcgtttccatgcgctctgtaattgcatctcaaaaatttcagaaaaccgaaatgcatttaccaatagcaatctga

SEQ ID NO: 22296 - protein, 226 aa, Unknown
  Obtained from environmental sample
  misc_feature (1)..(226): Xaa is any amino acid
MKSAFEVDKKVEPTISNHSKIETTNNIELTQEVSTPEVSSKEIKTEITTPEIEIEEPQVEIEVESVTEEISETDNLANKLVEDFGQFDPTLELGKYQFPPLDLLKKYDNEGVTINQEELEENKNRIVDTLNNYKIGIASIKATIGPTVTLYEIVPEAGIRISKIKNLEDDIALSLSALGIRIIAPIPGKGTIGIEVPNKNATIVSMRSVIASQKFQKTEMHLPIAI

SEQ ID NO: 22297 - DNA, 786 bp, Unknown
  Obtained from environmental sample
  misc_feature (1)..(786): n is a, c, g, or t
ttggtggagaaaactaatcaattagttgcagatcagatcattattgatcttgaggatgccgttgaaaaggataatctaaatagttatctgcaaaagctaaaaaagattgaaaacagatcgaaattttatattagaccatctttatttgaggagaatagatttaataaggctatacttctaaatttgatagaaattggattcaccaaatttatgatccctaaattttcctccttggaagatcttcaaaagattgaacaagctatagaaaagtttcctttatctaatttcaggtttatattattgatagagaatcctaaaagcctttttcaattgtctaatattttagatggcacaaaattaattataaaaggtatggcatttggtagtcacgactattgtggagagaccggtatgactcatcgattagacatattatattatccacgttttactttagtgagtttggctaaagcccatggttttgttgcaattgatatagttcatacaaatttaagtaacgataaagagtttttggaagaacttgaaaatgggtatgatttaggttttgacgcaaaagcattaatacatccaaaacaattgaaacttttgaatagatttaaaaaatcaaaaaaaaataaatatgatgaggcgctatctattttaaataaatttgaaactttagggaaacctccagtatttatttttaatgggaaaattattgaagctccacacatcaaattttacaataatgttaaaaataaattaggagattatggaaataaataa

SEQ ID NO: 22298 - protein, 261 aa, Unknown
  Obtained from environmental sample
  misc_feature (1)..(261): Xaa is any amino acid
MVEKTNQLVADQIIIDLEDAVEKDNLNSYLQKLKKIENRSKFYIRPSLFEENRFNKAILLNLIEIGFTKFMIPKFSSLEDLQKIEQAIEKFPLSNFRFILLIENPKSLFQLSNILDGTKLIIKGMAFGSHDYCGETGMTHRLDILYYPRFTLVSLAKAHGFVAIDIVHTNLSNDKEFLEELENGYDLGFDAKALIHPKQLKLLNRFKKSKKNKYDEALSILNKFETLGKPPVFIFNGKIIEAPHIKFYNNVKNKLGDYGNK

SEQ ID NO: 22299 - DNA, 687 bp, Unknown
  Obtained from environmental sample
  misc_feature (1)..(687): n is a, c, g, or t
atgtttgaatttgtctataaaatgtttggtgatggtttggctgttttgcctaaaaacggaattcaagaaatatcaaatcagctaaaatcaaacctaaaaaatactacttttaaatttaattcgcctgtaaaagaggtaaaggacaaagagatcattttgcaaaacgatgctgctttaaaaagtaatattaccattattgcaacagaagcaagttctttaatatcaaatttaaaaaaccaagaaacattctggaaaagctgtgaaaatttgtattttgaaactgataaaagagttattcaaaaacctttaattggtttaattgcagatgaaaactcgttgattaataatattttttatcacacaagtttagcaacatcaaccaaaaataataaagaattactttctgtaacagtagtaaaagagcataaattaaacgatttagacttgattttacgagtaacagaagatttaaaaaggtactgtaatattgatgtaaaaaagttcttaaaacactatcatattaaaaaagcattgccaaaattaacgaacttacaatatgagatttctagcactgaaactaaattaaaatcaaccatatttttagctggagatcaactgttaaatggctctttaaatgcagctatgattactggagaaagagcagctttgggcgttattcaaccttag

SEQ ID NO: 22300 - protein, 228 aa, Unknown
  Obtained from environmental sample
  misc_feature (1)..(228): Xaa is any amino acid
MFEFVYKMFGDGLAVLPKNGIQEISNQLKSNLKNTTFKFNSPVKEVKDKEIILQNDAALKSNITIIATEASSLISNLKNQETFWKSCENLYFETDKRVIQKPLIGLIADENSLINNIFYHTSLATSTKNNKELLSVTVVKEHKLNDLDLILRVTEDLKRYCNIDVKKFLKHYHIKKALPKLTNLQYEISSTETKLKSTIFLAGDQLLNGSLNAAMITGERAALGVIQP

SEQ ID NO: 22301 - DNA, 306 bp, Unknown
  Obtained from environmental sample
  misc_feature (1)..(306): n is a, c, g, or t
atgaataaacagcaaaaaataaaacactggcaaggcatttttgagcagcaaaaatcgagtggtttagccatcattcaattttgtcgtgataacaacattaacgcatcgactttctatgtttggcgtaaacgcctttctgacgaaacgataagggttaaaaagcaacaggtgatcccgtttgttattcatgagcaagcctttacacacccttcaatcattaaactcaccacaccaaacggctatcaaatagacttcgagtcgacattagcgcaccaagcactcgccaaattattgagcgtactgtga

SEQ ID NO: 22302 - protein, 101 aa, Unknown
  Obtained from environmental sample
  misc_feature (1)..(101): Xaa is any amino acid
MNKQQKIKHWQGIFEQQKSSGLAIIQFCRDNNINASTFYVWRKRLSDETIRVKKQQVIPFVIHEQAFTHPSIIKLTTPNGYQIDFESTLAHQALAKLLSVL

SEQ ID NO: 22303 - DNA, 651 bp, Unknown
  Obtained from environmental sample
  misc_feature (1)..(651): n is a, c, g, or t
atgggagatgcttcaattatcaaagactctattcagcaagcagaaatgcctgactcaggacaacctgttgttcattttaagtttcaattagaacaacctgtaaaagatgatttatacaattacataacagctgttaacagagagaaactacctctaaaaaaccttaaacctaaaatacaattaacagaaaaagaagaaaacatatcaaaatttacagttcctttatacaattttcatgcagctgctggtagttttagcgaaatgcaagacgaaaaagaatacaacttaatatctgtaccagaaaaatatgccacagatgattatttcgcttgtaaagtaattggagaatcaatgaataaaacaattcaaaataactcaatatgcatcttcaaaaagaatgttatgggttctcgtagcggaaaaattttacttatagaaaatagagattcatttgacccagattttaactcagcttttacggtaaaaacctactcaagtgaaaaaacagttacagaagaaggttggcagcataattcaattgcattgaaacccaattcctatgatgatagttttaaaagcattatcattaatgaagaaaatagtaaggacatgagaataattggagaatttgttgaagttttaaaaaactaa

SEQ ID NO: 22304 - protein, 216 aa, Unknown
  Obtained from environmental sample
  misc_feature (1)..(216): Xaa is any amino acid
MGDASIIKDSIQQAEMPDSGQPVVHFKFQLEQPVKDDLYNYITAVNREKLPLKNLKPKIQLTEKEENISKFTVPLYNFHAAAGSFSEMQDEKEYNLISVPEKYATDDYFACKVIGESMNKTIQNNSICIFKKNVMGSRSGKILLIENRDSFDPDFNSAFTVKTYSSEKTVTEEGWQHNSIALKPNSYDDSFKSIIINEENSKDMRIIGEFVEVLKN

SEQ ID NO: 22305 - DNA, 756 bp, Unknown
  Obtained from environmental sample
  misc_feature (1)..(756): n is a, c, g, or t
atgtacttttacgctgcacgccaaccgatcttagatcgcgataaaaagcttattggctatgaattactatttcgtgatggtgtaaataacgtgtttcccgatatagatggagatgaggcaacaacacgcctaatagaaggcagccagtttaattttggccttgaggatttaactgacaataaaccagcatatatcaattttactctagaaactttactaaaaggctaccctactttactgagtaaagacgctgtggtggtagagatactcgaaacggtgcaacctggtaagcgtttacttgctattgttaaagacttaaaagaaaaaggttatacattagccttagacgactacattcatcaacctgtgtggcgccacttttatccatttattgatattataaaaattgactttttaacctgtaatatagaaacaattaaaacaattattgatgatttaaaaccttatccacatctaaaattacttgctgaaaaagttgaaacccatgaggtgtataaccaagcattggaacttggctttgattatnttcaagggtttttcttttcaaaaccagagatgatccaaagtaaagcgcttcccccctctggtatgacattagccgaactactttatgagacctcaacgcttgatatggatctaaaaaagatcaccgatatatttgagcgagatgtaaatctatctaatagttactgcgttatttcaaatctgcagcatttgctagacgtgcaaaaataa

SEQ ID NO: 22306 - protein, 251 aa, Unknown
  Obtained from environmental sample
  DOMAIN (3)...(191): EAL domain
  misc_feature (1)..(251): Xaa is any amino acid
MYFYAARQPILDRDKKLIGYELLFRDGVNNVFPDIDGDEATTRLIEGSQFNFGLEDLTDNKPAYINFTLETLLKGYPTLLSKDAVVVEILETVQPGKRLLAIVKDLKEKGYTLALDDYIHQPVWRHFYPFIDIIKIDFLTCNIETIKTIIDDLKPYPHLKLLAEKVETHEVYNQALELGFDYXQGFFFSKPEMIQSKALPPSGMTLAELLYETSTLDMDLKKITDIFERDVNLSNSYCVISNLQHLLDVQK

SEQ ID NO: 22307 - DNA, 630 bp, Unknown
  Obtained from environmental sample
  misc_feature (1)..(630): n is a, c, g, or t
atgaagatttttttaaaaaaattagcattcttttttattcctattatactctatgtgataatagttttatccttagatatttttaaaatttttaaagattataataactattataatcaagacatcactactttaaatagaacttacgtatcaacaaagatttttcaaaaaaataaagacagtgtaaattatgatagctttatttttggtagctcaagatctcaagcctttaaaactccaatctggaagcactatttaccagaaaaatcgattccgtttcattatgatgcacatagcgaagatttatatggtatttataaaaaattagaatttttagacgatgtaaattcaccaataaaccatgctttaattattattgatagagccgtattgtctggcaccataaaaagactaaatcacctatacattaacccagtggagtttaatgatgtttcaaaatacgaattttatagcagttttattttagcaaatcttaatccacgatttatgatggcatacgccgatttttactgttttaaaacgtatagaaattatatggaaaattatgtacgtatggacaaatatccagatacgtttacaccaatttataatgactcttattacggatag

SEQ ID NO: 22308 - protein, 209 aa, Unknown
  Obtained from environmental sample
  misc_feature (1)..(209): Xaa is any amino acid
MKIFLKKLAFFFIPIILYVIIVLSLDIFKIFKDYNNYYNQDITTLNRTYVSTKIFQKNKDSVNYDSFIFGSSRSQAFKTPIWKHYLPEKSIPFHYDAHSEDLYGIYKKLEFLDDVNSPINHALIIIDRAVLSGTIKRLNHLYINPVEFNDVSKYEFYSSFILANLNPRFMMAYADFYCFKTYRNYMENYVRMDKYPDTFTPIYNDSYYG

SEQ ID NO: 22309 - DNA, 945 bp, Unknown
  Obtained from environmental sample
  misc_feature (1)..(945): n is a, c, g, or t
ttggttttccttaattttgtaaatagattgataaaatattttccattagtaattttactttttgctagtctaggttttagtcagagttccgactcaatatactattacagaaacttagccaaaaatgaccaaataactacggaagatagaattatctatgctaaaaaagcaattacattatctgctaaaactgatagtgattctactttattaaatagtcaaagggtcttatcttttttatacattattgatgggcaaatagataatatcaaatcaataaatcttgataatttatctcttgctaaaaaaataaaagattcggtatcaatagcaaatgcatactataatctaggctactcttatggtaaaacacaaaaagtagatagtgcttattattattactttaacgcagttaagctttacgataagttagaagattttaaaaattatgctgctgttttattaaatatggcaaatatccaagagtctgaaagagattatattggagcacaaaataatgtaattaaggccataaatgttgttgataaacttcaaaaaaacgactataatgtagatacagaatggtccttatataaccttattggtataatatcaggagagcttcagcaatatgataactcaatagaatatcacaacaaagcgattaatagtagtaataaactaaaggataattatttctacaaaatctattctaacgtaaatatagcttcgacttatcgaaaaaaaggggattacaatcttgctattgataagtacaatcaaattttagaaagtagtaaactgttatcagaggatgcttcgacttatgcttatgtaataaacgatttggcgtattctaaattttgcgtggtaaggattctaataaagaaaatgaaaccccttataagacagcgtttagggcttagggacttcctttttcgataa

SEQ ID NO: 22310 - protein, 314 aa, Unknown
  Obtained from environmental sample
  misc_feature (1)..(314): Xaa is any amino acid
MVFLNFVNRLIKYFPLVILLFASLGFSQSSDSIYYYRNLAKNDQITTEDRIIYAKKAITLSAKTDSDSTLLNSQRVLSFLYIIDGQIDNIKSINLDNLSLAKKIKDSVSIANAYYNLGYSYGKTQKVDSAYYYYFNAVKLYDKLEDFKNYAAVLLNMANIQESERDYIGAQNNVIKAINVVDKLQKNDYNVDTEWSLYNLIGIISGELQQYDNSIEYHNKAINSSNKLKDNYFYKIYSNVNIASTYRKKGDYNLAIDKYNQILESSKLLSEDASTYAYVINDLAYSKFCVVRILIKKMKPLIRQRLGLRDFLFR

SEQ ID NO: 22311 - DNA, 369 bp, Unknown
  Obtained from environmental sample
  misc_feature (1)..(369): n is a, c, g, or t
ttgggtgatgcacaaatgaatgtttataaaatagagtacactttttatggcgacgatagtattgattgggatgcattaaataataaagtaaaaattcacctgtatcgtattttgcaagaaacaatgcaaaatgcatataaacatgctgaagcaactaaggtggatatttcatttaaaatggaagctaatgcattagtnttttgcatttcggataacggaaaagggtttgatacacataaagctaaaaaaggcattggattaaaaaatatagaggatagaatacaagaaattaatggcgagcttaaaataaaaagccatgaaaatacaggaactaaaattataattattgtccctacaattaataattaa

SEQ ID NO: 22312 - protein, 122 aa, Unknown
  Obtained from environmental sample
  DOMAIN (29)...(120): Histidine kinase-, DNA gyrase B-, and HSP90-like ATPase
  misc_feature (1)..(122): Xaa is any amino acid
MGDAQMNVYKIEYTFYGDDSIDWDALNNKVKIHLYRILQETMQNAYKHAEATKVDISFKMEANALVFCISDNGKGFDTHKAKKGIGLKNIEDRIQEINGELKIKSHENTGTKIIIIVPTINN

SEQ ID NO: 22313 - DNA, 516 bp, Unknown
  Obtained from environmental sample
  misc_feature (1)..(516): n is a, c, g, or t
ttgatttgnagttggactggaatatcaggtcccacatctttcaagcctttggggagggcaattgtaaaagatagtgaacaaactagaatgagtcaatacatcaaatcatttcaatggccttttctaccagaaaaaatgataagaaaaaatgattttgaattgttcagaaaattatggaaccatagtagtaaagctgaaatagaagattatctttcagtatttagggacaaaaagaaactgaccgccgttcttaattattatcgtagtaattataagcttttgaaaaaagctgcccaaagacaaatactaggtgaaatcaatgttgagaccctatttatttggggagaaaaagatatggcaatcggatctgttgctgttgaaaatggtcataaatttatgaagaatgattatgtgtttttgaagctggatgcaggtcactggttaattcaaacgaattatcaagaaattaaatccgcgttgagcgaacaccttttaaaatataaagaccgaatctaa

SEQ ID NO: 22314 - protein, 171 aa, Unknown
  Obtained from environmental sample
  misc_feature (1)..(171): Xaa is any amino acid
MIXSWTGISGPTSFKPLGRAIVKDSEQTRMSQYIKSFQWPFLPEKMIRKNDFELFRKLWNHSSKAEIEDYLSVFRDKKKLTAVLNYYRSNYKLLKKAAQRQILGEINVETLFIWGEKDMAIGSVAVENGHKFMKNDYVFLKLDAGHWLIQTNYQEIKSALSEHLLKYKDRI

SEQ ID NO: 22315 - DNA, 471 bp, Unknown
  Obtained from environmental sample
  misc_feature (1)..(471): n is a, c, g, or t
atgctggacagtggcgataaaatcaggcgtgctaacgtatattataattttaaggtcagggatatatccatgtttgatatcaaatcattttttaaaagagaagtagaaaaaaaactcatcaatgtagacgattatatttttatgcctgagcgagtagagatggagctagagggcggattattaaattgtgtactcaacagtgatggtcgagtcgatattttttatagtaagcaaggcgtgacagaggttagctcggcatcacgtaagcacccctttacggcaatcgaaactgagctatatcatggtgtttatgatgacgttataaatgatttgatcaaagaagtagacaagattatcgatggctcttctaagtattttaatcgccacaaaatactgcccctttacagcagcccctttcccagagtcccagttgaaaaaaacaaggttctaaaccaagcccaattcgcctga

SEQ ID NO: 22316 - protein, 156 aa, Unknown
  Obtained from environmental sample
  misc_feature (1)..(156): Xaa is any amino acid
MLDSGDKIRRANVYYNFKVRDISMFDIKSFFKREVEKKLINVDDYIFMPERVEMELEGGLLNCVLNSDGRVDIFYSKQGVTEVSSASRKHPFTAIETELYHGVYDDVINDLIKEVDKIIDGSSKYFNRHKILPLYSSPFPRVPVEKNKVLNQAQFA

SEQ ID NO: 22317 - DNA, 903 bp, Unknown
  Obtained from environmental sample
  misc_feature (1)..(903): n is a, c, g, or t
ttgttgtctgagaacatgcgtcgatacgagcacgataaaacgttttttgtttacaaagacatggcctcactacttaaagatatcaagacgttcgaagagtttaactggatcaaagcattcgattctgcggcagctcaacaagttgcccgcgacctggaattagcgctcaagaatgtttttactaaaggtcgcttgcaacgctttccaaagcacaagatctcatataaaaagaaaaaacgtcacaacgatagttttcgagcggtcaataactcgaactgtatccgcattgaaaatggcgctatcagtatcccaaaggtaggcaagatacccattatcttgcatcgcaaactagcaagtaaaatcaagactgtaactatccagtatcaccacggaaaatggggatgcagcatcactcaggaagttgagtgcaaaacagctaaacaagttttaaaaacaatcacaggttttgacattaactcaaagcaaactgttgttggctcagatggttttgtggtcgataaccccaagtttttaaagcagtcaaaaacaaagttaaatcaattgcaacgccagcttgcacgccgaactaaaggttcaaatcgctggcaaaaaaccaaacaacgcatcaacaaattacacggcaaaatctcacggcaaaggctcgactttgcacacaaaatttcacgccagataaccaatgaaaatgacattttagtgttcgaagatttaaacgtaaaagggatgcaaaagttcaatggcagcatggttgccgacaatgtgatgggcttaattactcagctttcaaaatacaaaactgagcttgaaggtaaactctatcacgagattggcaggtttgaaaaatccactggggtttgttctgaatgcggccaacatcatgtttaa

SEQ ID NO: 22318 - protein, 300 aa, Unknown
  Obtained from environmental sample
  DOMAIN (1)...(251): Probable transposase
  misc_feature (1)..(300): Xaa is any amino acid
MLSENMRRYEHDKTFFVYKDMASLLKDIKTFEEFNWIKAFDSAAAQQVARDLELALKNVFTKGRLQRFPKHKISYKKKKRHNDSFRAVNNSNCIRIENGAISIPKVGKIPIILHRKLASKIKTVTIQYHHGKWGCSITQEVECKTAKQVLKTITGFDINSKQTVVGSDGFVVDNPKFLKQSKTKLNQLQRQLARRTKGSNRWQKTKQRINKLHGKISRQRLDFAHKISRQITNENDILVFEDLNVKGMQKFNGSMVADNVMGLITQLSKYKTELEGKLYHEIGRFEKSTGVCSECGQHHV

SEQ ID NO: 22319 - DNA, 369 bp, Unknown
  Obtained from environmental sample
  misc_feature (1)..(369): n is a, c, g, or t
atggcattacgttatagaattaccaaaagagccaataatataggcaataaagaaaataaatatattttacaagctattaatactggcactatagatttagataaattaagtgaatacattagcgatgaatgtaccttgcacagtgtagatgtaaaagcagtattaatagcattaggtaaaaaattggatttttatttaaaggatggtaaaattgtagatttaggtgatgttggtaaatttaaaatgggttttaaaggtactgcagcagatagccctgaattattaagtgtaaagaaaaacatacagaaattccacatcaattaccaacccttcctaaaattaaaaaaaacactaaaaggagggtattga

SEQ ID NO: 22320 - protein, 122 aa, Unknown
  Obtained from environmental sample
  misc_feature (1)..(122): Xaa is any amino acid
MALRYRITKRANNIGNKENKYILQAINTGTIDLDKLSEYISDECTLHSVDVKAVLIALGKKLDFYLKDGKIVDLGDVGKFKMGFKGTAADSPELLSVKKNIQKFHINYQPFLKLKKTLKGGY

SEQ ID NO: 22321 - DNA, 561 bp, Unknown
  Obtained from environmental sample
  misc_feature (1)..(561): n is a, c, g, or t
atgaaattaagtagaaagcaatggataaatattgtatttattattgggataatcttgattctttttaccccagtaggtttttatgcccgagtgttcgttggtaggttgttatcaacaagtgccgcagttttaaagtcggaattacaaatgcctatagaaaactatgattggcagttggtagatgccaagggtaatgaaatcaattttgaaaatgttaagggcaaggttgttttggttaatttttgggcaacttggtgtcccccttgtgtcgctgaaatgccaagccttcagagtttgtactatgattacaatgaagaggttgtttttgtgttcgttgcacaggataaagttgaaaaggtatctgcctttattgcaaaaaatggttatatgcttcctgtttattattcaaaaactgaagctccaaatgttttgacctcgaaaacgattccaacaacttatgtgattaataaagaaggtaagattattattgcagagacgggtgtagcggattggaacagcgataagatccgaaaaatattgaatgagttgttggccgaataa

SEQ ID NO: 22322 - protein, 186 aa, Unknown
  Obtained from environmental sample
  DOMAIN (17)...(168): SCO1/SenC
  misc_feature (1)..(186): Xaa is any amino acid
MKLSRKQWINIVFIIGIILILFTPVGFYARVFVGRLLSTSAAVLKSELQMPIENYDWQLVDAKGNEINFENVKGKVVLVNFWATWCPPCVAEMPSLQSLYYDYNEEVVFVFVAQDKVEKVSAFIAKNGYMLPVYYSKTEAPNVLTSKTIPTTYVINKEGKIIIAETGVADWNSDKIRKILNELLAE

SEQ ID NO: 22323 - DNA, 705 bp, Unknown
  Obtained from environmental sample
  misc_feature (1)..(705): n is a, c, g, or t
atgaataaaaatattatcattatcggttcaggattttcctcattatcagcctcatgttatttggccaaatggggttatgatgtatcggtgtatgaaaaaaatgatactattggtggaagagctggtcaacttgcaaaaaacggctttacttttgatttaggacctagctggtattggatgccggatatctttgacaagttttttgccgattttgaaaaaaaaaccagtgactactacgatttgcaaaaattaagtcctgcttataaaattttctttttagatgacacgattaccattggggattgcatggatgaaatctgtttggaattcgatagaattgaattgggaagttcaatacatttaagaaaatttatttccaaggcgcaaaaaaactatgatatcgctataaataaagtggtattaaaaccgggattgtcaccctttgaattggtgacaaaagatactgtaaccaaggttgaccaatttttcaaatcaataagtggcgaaatacggaagaaatttaaaaacccaaaactgatttccacattggaattcccagttctttttcttgggcaaaacctagcaaacaccttcattttacagttttatgaacttttgccgattttggtttgggcacatggcatcctaaaggttggcatgtatgaaatcataaaagccatgcataaccttggctttaaaacctag

SEQ ID NO: 22324 - protein, 234 aa, Unknown
  Obtained from environmental sample
  misc_feature (1)..(234): Xaa is any amino acid
MNKNIIIIGSGFSSLSASCYLAKWGYDVSVYEKNDTIGGRAGQLAKNGFTFDLGPSWYWMPDIFDKFFADFEKKTSDYYDLQKLSPAYKIFFLDDTITIGDCMDEICLEFDRIELGSSIHLRKFISKAQKNYDIAINKVVLKPGLSPFELVTKDTVTKVDQFFKSISGEIRKKFKNPKLISTLEFPVLFLGQNLANTFILQFYELLPILVWAHGILKVGMYEIIKAMHNLGFKT

SEQ ID NO: 22325 - DNA, 645 bp, Unknown
  Obtained from environmental sample
  misc_feature (1)..(645): n is a, c, g, or t
atggaactactactattaaaatccagtgtttgccttttagctttgctattgttttacaaagtagctttagaaccattaagcattcataaatttaaacgtgtgtatttattggttgctgttgcagtcgcagcaatcatcccttttataacgtttgtaaaatatgtcgaccctacttttgacaattcatcatttatttttgatacttcggcaacaataccattagacacaaattttaaaatagtagaagaaaccaactacttatccatcattttatggagtatttatgctttaggagtcggtttattctttattagattttgcgctaatctatttaaaatagtttcaaaaatcagaaaacatactaaagttaaaagccaatcttttatcaatgttttaatggagcatttagaaattccgcataccttttttaattatatctttttaaataaaaacaagtttgaaaacaaacaaattcctgctgaagtcttattacacgaacaaacgcatgccaaacaaaaacacagtttagacatcataaatatagagttacttcaagtcgtctttttggtttacccattagtatattggctaaaaaaagaagtgaaacttaatcctgaggtttttagcagatcaacatggttataa

SEQ ID NO: 22326 - protein, 214 aa, Unknown
  Obtained from environmental sample
  misc_feature (1)..(214): Xaa is any amino acid
MELLLLKSSVCLLALLLFYKVALEPLSIHKFKRVYLLVAVAVAAIIPFITFVKYVDPTFDNSSFIFDTSATIPLDTNFKIVEETNYLSIILWSIYALGVGLFFIRFCANLFKIVSKIRKHTKVKSQSFINVLMEHLEIPHTFFNYIFLNKNKFENKQIPAEVLLHEQTHAKQKHSLDIINIELLQVVFLVYPLVYWLKKEVKLNPEVFSRSTWL

SEQ ID NO: 22327 - DNA, 807 bp, Unknown
  Obtained from environmental sample
  misc_feature (1)..(807): n is a, c, g, or t
atgttttctgctacgatgactaaagatgttgatgatttaattaccgatttctttaccaatcctacaaaaatatcgattgctgtttctggtacacctttagagaatattaagcaagaacgttacgatgttcctaacttttacaccaaagtaaacctattagagcatttacttagagataaagaaactttttcaaaagtcttaatctttgtggcttataaacgaatggctgaccgactttttgataatttggaagaattatttccaggtgaaacttgtgttattcattctaacaaaacacaaaattacagattacgtagtattgaacaatttagagaaggtgaaaaccggttattagttgcaacagacgtaatggctagaggattagatattgaaggtgtttcgcacgttattaattttgatacaccagattatcctgaaaactatatgcatagaatcggtagaactggtcgtgctgaaaaagaagggcatacgattttaatgtctacagaaagtgaaaaagaaggactagaacgtattgaggaattaatgcaaatgaaaattgaaacactctctatacctgaagatgttgagatttcagctgaattgattgaagaagaacgtccacagattagagaacataacaatcctatcaaaaaacgtgatgaagatgcgccaggaccagcttttcatgaaaaatctgagaaaaactctaaagaaaacttaggtggttcttacaaatttaagatggctgcaaaatataagaagccaaaaactagaggtgataagaattataatcaacgtaaatag

SEQ ID NO: 22328 - protein, 268 aa, Unknown
  Obtained from environmental sample
  DOMAIN (86)...(159): Helicase conserved C-terminal domain
  misc_feature (1)..(268): Xaa is any amino acid
MFSATMTKDVDDLITDFFTNPTKISIAVSGTPLENIKQERYDVPNFYTKVNLLEHLLRDKETFSKVLIFVAYKRMADRLFDNLEELFPGETCVIHSNKTQNYRLRSIEQFREGENRLLVATDVMARGLDIEGVSHVINFDTPDYPENYMHRIGRTGRAEKEGHTILMSTESEKEGLERIEELMQMKIETLSIPEDVEISAELIEEERPQIREHNNPIKKRDEDAPGPAFHEKSEKNSKENLGGSYKFKMAAKYKKPKTRGDKNYNQRK

SEQ ID NO: 22329 - DNA, 474 bp, Unknown
  Obtained from environmental sample
  misc_feature (1)..(474): n is a, c, g, or t
atgacagatcggctgaggattgcaaatggtattgatgaggctaaagatttaactcaagatgtttttttaagggtttttgttaaattggctagttttaaagggaaatcaaaattttcaacatggttgtatgcatttacttataatcattgtgtaaattatgttactcgaaatacggctaagaagattgaaaaacaatccatagattctgaacgtatagagaatataggtgaagatattgattctactcacgagtttcaaaacatgagagttgaacaattaaaacgggttatggaattaatctcaccagatgagaaaatgatattattgctaaagtatcaagataatttatctattagagagttgtcagaagctttagatattggagaaagtgctgtgaaaatgcgcttaaaaagagcaaaagaaaaacttgtagacaagtataataattataagaaagatggaaaatccatttaa

SEQ ID NO: 22330 - protein, 157 aa, Unknown
  Obtained from environmental sample
  DOMAIN (1)...(60): Sigma-70 region 2
  misc_feature (1)..(157): Xaa is any amino acid
MTDRLRIANGIDEAKDLTQDVFLRVFVKLASFKGKSKFSTWLYAFTYNHCVNYVTRNTAKKIEKQSIDSERIENIGEDIDSTHEFQNMRVEQLKRVMELISPDEKMILLLKYQDNLSIRELSEALDIGESAVKMRLKRAKEKLVDKYNNYKKDGKSI

SEQ ID NO: 22331 - DNA, 792 bp, Unknown
  Obtained from environmental sample
  misc_feature (1)..(792): n is a, c, g, or t
atgactgaacaaataaaaacgattgctgaatcgaataatttcatcgttttaaataaatataccaagtgcgatcagcctgatggggggtatcagactgaagatgatctagagcgtgaactactcaaagacttacaaaaccagggatatgagtttgtccctggtttaaattcacctgaaacgatgcttgctaacgtacgtgtacagctgcagatcttaaatgaggtacagtttacagatgctgagtggcagcgctttgtgatggagtatcttgataatcctagtgataacatcacggacaaagctcgaaagattcatgatgaccatatctatgacttcacctttgatgatggacacctgcagaacattgccctgctggacaaaaaaaacatcccacgtaacaaagtacaggtcattaaacagtttgctcaaaaaggcacacaagccaatcgctacgatgtgactatcttggtcaatggcttgccgcttgtgcaaattgagcttaaaaaacgtggtatcgccattcgcgaagcatttaaccaagtacatcgttatagcaaagagagctttaactccgataactccttatataaatacctacagctgtttgtgatctcaaatggcaccgatacccgttactttgccaataccaccaagcgcaataaaaacagctttgatttcaccatgaattgggcgagatcagacaaaaccttaatcaaagatttaaaagactttaccgcgacattcttccgaaaaaagacctatttaacggctgatgcattaaaccggctttga

SEQ ID NO: 22332 - protein, 263 aa, Unknown
  Obtained from environmental sample
  DOMAIN (30)...(221): Type I restriction enzyme R protein N terminus (HSDR_N)
  misc_feature (1)..(263): Xaa is any amino acid
MTEQIKTIAESNNFIVLNKYTKCDQPDGGYQTEDDLERELLKDLQNQGYEFVPGLNSPETMLANVRVQLQILNEVQFTDAEWQRFVMEYLDNPSDNITDKARKIHDDHIYDFTFDDGHLQNIALLDKKNIPRNKVQVIKQFAQKGTQANRYDVTILVNGLPLVQIELKKRGIAIREAFNQVHRYSKESFNSDNSLYKYLQLFVISNGTDTRYFANTTKRNKNSFDFTMNWARSDKTLIKDLKDFTATFFRKKTYLTADALNRL

SEQ ID NO: 22333 - DNA, 351 bp, Unknown
  Obtained from environmental sample
  misc_feature (1)..(351): n is a, c, g, or t
atgattaaacgtaaaatttcgcataggagtttattgatattgtatactaatttcgagcatatttcagccttaaaaaggcaattaccttttctaaaagccattgccagacaacatttattagttactgtattttttgaaaacacagaaatagatgaattaattactaaaaacgctgaagatctacaaagtatttaccatcaaactattgctgaaaaatttgcctatgaaaaaagactaattgtgaaagaattagaaagtaggggagttcatgccattttaaccaagcctaagaatcttacagtgaatgtcatcaataaatatttagaattcaaagcgaaaggatatatttag

SEQ ID NO: 22334 - protein, 116 aa, Unknown
  Obtained from environmental sample
  misc_feature (1)..(116): Xaa is any amino acid
MIKRKISHRSLLILYTNFEHISALKRQLPFLKAIARQHLLVTVFFENTEIDELITKNAEDLQSIYHQTIAEKFAYEKRLIVKELESRGVHAILTKPKNLTVNVINKYLEFKAKGYI

SEQ ID NO: 22335 - DNA, 477 bp, Unknown
  Obtained from environmental sample
  misc_feature (1)..(477): n is a, c, g, or t
atgaagcaaatagctgttttcttactgtgtttgattttggcctcttgtcaatattttgatgtagagaagacctcttctgaagctattttaaaaaaagaactcaaaacttttaattggaaagaagtagacagttatccaagttttaaaacttgcgatactttacagtcaaaattagatgctaaacagtgttttgagacaaccttagctaatcatatctcaagtaaattgcaagaacaaactattattgtgtctcaggatataaatgacacaattttattatccttattaatttcagaaaaaggagaattagttataaatgctatagaaatagatagtattactaccctagaaattccagaaattaaaactataattactaatagcctgaatacgctacctacaatttatccagctatcaaacgtggacaacaggtaaagtctcagtttaaattacctatagttttacgggttaattaa

SEQ ID NO: 22336 - protein, 158 aa, Unknown
  Obtained from environmental sample
  misc_feature (1)..(158): Xaa is any amino acid
MKQIAVFLLCLILASCQYFDVEKTSSEAILKKELKTFNWKEVDSYPSFKTCDTLQSKLDAKQCFETTLANHISSKLQEQTIIVSQDINDTILLSLLISEKGELVINAIEIDSITTLEIPEIKTIITNSLNTLPTIYPAIKRGQQVKSQFKLPIVLRVN

SEQ ID NO: 22337 - DNA, 570 bp, Unknown
  Obtained from environmental sample
  misc_feature (1)..(570): n is a, c, g, or t
atgaagaaaattatcacattagttgctttggtctttttttcggtcagcaccttcgcacaaacgcaatggactgtagatccatatcattcctcattaaatttcaacatttcgcattctggaattagtatcgtgaatgggaaatttttagattataccggaagcttaattacaaaaggagatgcgcttaatgatgcaagtttcgattttagggttaaaattgaaagtattaatacccatgtagaagatagggataaccatttaagaagtgctgacttttttgaagttgaaaaatatcctgaaatgacttttaaaagcacgaaaatttcaactaccgaaaaaagtaatcaatacattttaaaaggacaactaactattaaaggtgtgacgaaagacgtcgtttttgatgttcattatggcggtaaagtgaaaaacaaccaaggtgaaaaattaggaatgaaagctgaaacaacgataaatagatttgactataatattgattatgaccctactgctacaggcgttgggaaggaggttaatattgtgattcaccttcaatttgcaaaacagtaa

SEQ ID NO: 22338 - protein, 189 aa, Unknown
  Obtained from environmental sample
  SIGNAL (1)...(19)
  DOMAIN (20)...(189): YceI like family
  misc_feature (1)..(189): Xaa is any amino acid
MKKIITLVALVFFSVSTFAQTQWTVDPYHSSLNFNISHSGISIVNGKFLDYTGSLITKGDALNDASFDFRVKIESINTHVEDRDNHLRSADFFEVEKYPEMTFKSTKISTTEKSNQYILKGQLTIKGVTKDVVFDVHYGGKVKNNQGEKLGMKAETTINRFDYNIDYDPTATGVGKEVNIVIHLQFAKQ

SEQ ID NO: 22339 - DNA, 357 bp, Unknown
  Obtained from environmental sample
  misc_feature (1)..(357): n is a, c, g, or t
atgttagacgaaattaaggaggcttgtccagaagtgtctgtagtaaatattaaaaagtttaaatcagatatttcggcagtcagagcaggagcaagatatatgtccaaccaatttgatttaaatcaattaggatatgtgtctgcaaatatgctaaacatcaagtatcatggcttaaatggtttgatagatgccataaacgaaaatcaagaactactatctaagtttaatatcgaagagcttaaaaaacgtaaaattaaagtatctctgtttcaaagcttgttttcaattattgattatttaaaaaaaataaaagtcaaaaaccagtttatcgaactacaatatttaagtaaattttaa

SEQ ID NO: 22340 - protein, 118 aa, Unknown
  Obtained from environmental sample
  misc_feature (1)..(118): Xaa is any amino acid
MLDEIKEACPEVSVVNIKKFKSDISAVRAGARYMSNQFDLNQLGYVSANMLNIKYHGLNGLIDAINENQELLSKFNIEELKKRKIKVSLFQSLFSIIDYLKKIKVKNQFIELQYLSKF

SEQ ID NO: 22341 - DNA, 642 bp, Unknown
  Obtained from environmental sample
  misc_feature (1)..(642): n is a, c, g, or t
atgcttaaaacttttaagcctaaatcaatttgtacctttggtcttttattgatttatttaatgattagcgacccaaaacagttttataataccttatcagaaaaatttccctttacgccaactacagttcaggatagtcttttagagatgttgtctgaatttttttttgataccaataaccgaaaaatttttttacttaaaggttatgccggtactggtaaaacaacaactatgagtactgtggtgaataatctttggcgggcaggtatgaaatctgtattattagctcctactggaagggcagcaaaggttattgcaaattattccaataggcaggcctatactatacataaaaaaatttaccatccgcgaaaagagaagaatggtagtgtttcttttgttttgcaaaataataagcatacaaacactatttttattgttgatgaggcctcaatgatacctgatagggctgcggatgccaaattgtttgaaaacggatcattactagatgatttactgttttatgtttattccggtaaaaattgcaaattaatttttattggagatacggcacaattaccaccggttaaattagaaatgagtcctgcgttacaggctgatacactcaaaattaaattatga

SEQ ID NO: 22342 - protein, 213 aa, Unknown
  Obtained from environmental sample
  misc_feature (1)..(213): Xaa is any amino acid
MLKTFKPKSICTFGLLLIYLMISDPKQFYNTLSEKFPFTPTTVQDSLLEMLSEFFFDTNNRKIFLLKGYAGTGKTTTMSTVVNNLWRAGMKSVLLAPTGRAAKVIANYSNRQAYTIHKKIYHPRKEKNGSVSFVLQNNKHTNTIFIVDEASMIPDRAADAKLFENGSLLDDLLFYVYSGKNCKLIFIGDTAQLPPVKLEMSPALQADTLKIKL

SEQ ID NO: 22343 - DNA, 687 bp, Unknown
  Obtained from environmental sample
  misc_feature (1)..(687): n is a, c, g, or t
gtgatggagcgtgttgaaatcgatcataccgctcttgatttgatcttgcttgatgataccttgaatatacctattggaaggccatttataaccgtcttgattgatacatttagtaaatgtatcgtaggtttttatttaagctttagagggccgagctataattctgtaaggtgtgcagtattaaatgcgtgcttagataaaaaagacttgttggaaaagtatccagatgtcgaaaaagattggccatgtcaagggcgtattgaaacacttgttgttgataacggcgcagagttttggtcgaaagatcttgagaggttttcttcctcaataggaatgagcgttgagtacaatccagttggaaaaccatggaagaaacctttagtcgagagaatatttaacacttataatacagaatttattcatcaaataccgggaaaaactttctcgagtgcaaaagatttagaaggttatgagcctgagaaagatgcgctattaccattttccaggtttttacatctactgcatatatgggttgtagatatttataatcagcagccagataaacgtagaaccatattactgtttgtcttggcacttgcgtgtaagatttccngcgattgtttacantgtctgaaaaaccagattaaatcgaagtttcccacgttatcggatttcgacattggataa

SEQ ID NO: 22344 - protein, 228 aa, Unknown
  Obtained from environmental sample
  DOMAIN (7)...(191): Integrase core domain
  misc_feature (1)..(228): Xaa is any amino acid
MMERVEIDHTALDLILLDDTLNIPIGRPFITVLIDTFSKCIVGFYLSFRGPSYNSVRCAVLNACLDKKDLLEKYPDVEKDWPCQGRIETLVVDNGAEFWSKDLERFSSSIGMSVEYNPVGKPWKKPLVERIFNTYNTEFIHQIPGKTFSSAKDLEGYEPEKDALLPFSRFLHLLHIWVVDIYNQQPDKRRTILLFVLALACKISXDCLXCLKNQIKSKFPTLSDFDIG

SEQ ID NO: 22345 - DNA, 585 bp, Unknown
  Obtained from environmental sample
  misc_feature (1)..(585): n is a, c, g, or t
ttgattcggtcgagaaaacatgtattgaagactgaaattgaaaactgtattgccattttaaaaaaaggaggaataattctttaccccacggacaccgtttggggaattggctgcgatgccacaaaccccgatgccattgataaagtttttaaactgaaaagaagaagcgacgaaaaatcgctgatttgtttagtgaacgatttcagaatgttgaatgaatatgttgaaaacgtacctgaagtagcttatgatattttgaaatacgccaaaaaaccaactacaatcatttatgacgatccaattcgcgtagctgagaatattattgctgaagacaattcgctcgccattcgggtaaccaaggatgaattctgcaaaaagttaatacagaaattccgcaagccactggtttcaacatcggccaatatttcaggaaaaaaaaccccgcaaagttatgccgaaatagaccccttaattttggaaggcgtggactatgttgtaaatttgcatcaccaaaaaaaatcagaaaaaccctccgctattatcaaattgaaaaatgatggttccgtgaaggtaatcagaaaataa

SEQ ID NO: 22346 - protein, 194 aa, Unknown
  Obtained from environmental sample
  DOMAIN (17)...(187): yrdC domain
  misc_feature (1)..(194): Xaa is any amino acid
MIRSRKHVLKTEIENCIAILKKGGIILYPTDTVWGIGCDATNPDAIDKVFKLKRRSDEKSLICLVNDFRMLNEYVENVPEVAYDILKYAKKPTTIIYDDPIRVAENIIAEDNSLAIRVTKDEFCKKLIQKFRKPLVSTSANISGKKTPQSYAEIDPLILEGVDYVVNLHHQKKSEKPSAIIKLKNDGSVKVIRK

SEQ ID NO: 22347 - DNA, 813 bp, Unknown
  Obtained from environmental sample
  misc_feature (1)..(813): n is a, c, g, or t
ttgattcggtcgagaacacgatgtgtgtataatacagacgaatacgacgtccttttactgaagaaaacgtatttactatttatttctaacttagataccatagcaattcaaaaaatatctatctatggttttaccgatgatagaggctctaatgactataatttagagttatcacaaaacagagcaaatacaattaaagagttgttttccggttacggaattgacgaaaatttaattaccaatgtaaacggaaaaggtgaaatactactaaaagttttaaacgaagaagaagtccaccaaataagaggtttaaaccgtaaggtagaaattattgttacgccaaaacttcccgaaaaaaagaccattactaaacctgaagaagtcactgaaaatgatacagatgatagtaaaaaaactacagatgacatagctaaaggcaccataaaaaaaggcgataaaataacgctagataaaatttattttaaaaccagttatagttacgtaacctcagagtctaaaaaaactttagaagatttagctaaaattttagtcgctaaaaaaaacatctattttaccatacaaggtcatgtatgttgcacgcaaatgagtcgtgatgcggtagataaaaaaaccaaaaaacgcaatctatctgtagccagagctaaatatatttatgattatttagctagaaaaggcgttgataaaaaacgaatgaaatacgtaggaatgcgtcgtaaatttccacttggtggagctccagaactagacagacgtgtggaaatcttagtaacctatgtaggtaacgaagattaa

SEQ ID NO: 22348 - protein, 270 aa, Unknown
  Obtained from environmental sample
  DOMAIN (9)...(106): OmpA family
  misc_feature (1)..(270): Xaa is any amino acid
MIRSRTRCVYNTDEYDVLLLKKTYLLFISNLDTIAIQKISIYGFTDDRGSNDYNLELSQNRANTIKELFSGYGIDENLITNVNGKGEILLKVLNEEEVHQIRGLNRKVEIIVTPKLPEKKTITKPEEVTENDTDDSKKTTDDIAKGTIKKGDKITLDKIYFKTSYSYVTSESKKTLEDLAKILVAKKNIYFTIQGHVCCTQMSRDAVDKKTKKRNLSVARAKYIYDYLARKGVDKKRMKYVGMRRKFPLGGAPELDRRVEILVTYVGNED

SEQ ID NO: 22349 - DNA, 453 bp, Unknown
  Obtained from environmental sample
  misc_feature (1)..(453): n is a, c, g, or t
atgttttttcaaacaatgtccttgagatttactacagacaagaacgtattgctatccatacccagaattaaaagtaaatatcagtatagcactatagatgaacacattcgttcttttcatcgctttgttagtgattggagtccagagaaatttattaactggncgggatatattgnccaagaatgcaaatactttatcaccaaaatattagataaaaaacaacatccagaacaatcctataaatcttgtttaggtgttttacatctagcaaagaaagtgggtaacactcggttaaataacgcctgtaaaagagctttgaattaccaggcatataactataagattattgagcggattttagaaaaaggttgggataacattgaggaatctaccgaagaaactacagaaattccatatcataaaaacattagaggaagaaattattacaaataa

SEQ ID NO: 22350 - protein, 150 aa, Unknown
  Obtained from environmental sample
  misc_feature (1)..(150): Xaa is any amino acid
MFFQTMSLRFTTDKNVLLSIPRIKSKYQYSTIDEHIRSFHRFVSDWSPEKFINWXGYIXQECKYFITKILDKKQHPEQSYKSCLGVLHLAKKVGNTRLNNACKRALNYQAYNYKIIERILEKGWDNIEESTEETTEIPYHKNIRGRNYYK

SEQ ID NO: 22351 - DNA, 714 bp, Unknown
  Obtained from environmental sample
  misc_feature (1)..(714): n is a, c, g, or t
atgaataaacaaaaacaagcattattaaatgagttggcttatcaaaatcaagaacttagtgattatgcacacatggtatctcatgatttaaaatcgccacttcgtagtattgacgctttaacgtcatggttatctgaagactatgcagaggtttttgatagtaatggaaaaaacaccttagatctaatacgagataacgttgaaaaaatggatacgcttattagtggtattttagagtactctaccataggtaaaaatcaaatagaaacctacgatgtggatgctaatttgctaatagataatattctaaaaattattcatgtaccaactaatattagtattacaaaaaccaatttgcctgttctaagaggtgataaatataggttgcaacaattatttcaaaaccttattagtaatgccattaaatacaatgataaagaccaaggtactattaaaattggagcagaagataaaaccgactattggcagttttatataaaagataacggtaaaggtatagataaatcctactttgataaaatattcaaaacctttataaaattagaaaacaatccagattcaacaggaattggattgtctatagttaaaaaaattgtcgaattatatggtggtacaatctggctagaatctcaagtcaatgttggtacaacattttatttcactttaaaaaaatccccaaatggaacaacctaa

SEQ ID NO: 22352 - protein, 237 aa, Unknown
  Obtained from environmental sample
  DOMAIN (18)...(86): His Kinase A (phosphoacceptor) domain
  misc_feature (1)..(237): Xaa is any amino acid
MNKQKQALLNELAYQNQELSDYAHMVSHDLKSPLRSIDALTSWLSEDYAEVFDSNGKNTLDLIRDNVEKMDTLISGILEYSTIGKNQIETYDVDANLLIDNILKIIHVPTNISITKTNLPVLRGDKYRLQQLFQNLISNAIKYNDKDQGTIKIGAEDKTDYWQFYIKDNGKGIDKSYFDKIFKTFIKLENNPDSTGIGLSIVKKIVELYGGTIWLESQVNVGTTFYFTLKKSPNGTT

SEQ ID NO: 22353 - DNA, 588 bp, Unknown
  Obtained from environmental sample
  misc_feature (1)..(588): n is a, c, g, or t
ttgagtgagaaagatgataacactccaaaaagcatgaatacgcatttacatattttagaggcttacacaaacttgtacagatgtattccttctaaaagaattggtaaatctatttcagatttactagacatttttattgatcacataattgataaagaaagaaaatcgttaaacaattttttcgatgagaaatgggaatcaaagtcagatgtgatttcctatggtcatgatatcgaggcaagttggttactaaatgaagctgaaaaagtgattgagagctatcatagaaaagaagaattaaatgaattattagtttctatttcaaaaaaggtgcttaaagatggaattgacgatgactttggtatactcaatgaaaaagaaataaataaaccacttgataaggataaagactggtggccacaagctgaaggcatcgttggatttttgaatgcttatcagctaacaaataatattgaatttactgaagcttctatcaacgtctgggaatttatcaaaaggaatataattgatgagacatttggagagtggcatgaaaaagtttccagttcggtgatgtgtatcagttag

SEQ ID NO: 22354 - protein, 195 aa, Unknown
  Obtained from environmental sample
  misc_feature (1)..(195): Xaa is any amino acid
MSEKDDNTPKSMNTHLHILEAYTNLYRCIPSKRIGKSISDLLDIFIDHIIDKERKSLNNFFDEKWESKSDVISYGHDIEASWLLNEAEKVIESYHRKEELNELLVSISKKVLKDGIDDDFGILNEKEINKPLDKDKDWWPQAEGIVGFLNAYQLTNNIEFTEASINVWEFIKRNIIDETFGEWHEKVSSSVMCIS

SEQ ID NO: 22355 - DNA, 720 bp, Unknown
  Obtained from environmental sample
  misc_feature (1)..(720): n is a, c, g, or t
atgattgacttttacaaaagaaaacaggttattgaacttttatctgatatcaagctaaaagccatacaaaaaaagtcaatatcacattctgattcggaaaaatacactttgcagatttttgaaaaaattggaattccaattcaaaatgattccgctaaactttttggaaaacctggaatattacaggagctaattttagacattcatagttcagcttactttacaattgatgaacgtaaattatttaatgaagactttaatgaatttttaaaactattcccaaaaccacaatctaaagaagaacttaaattcagaattttggggaataatggattatacccaaatgtagatataaaaagaggaaaagtatggtataagaatttcaattcaagaccaagaatcgttacagtaaacaagataaattccgaaaaggaatactcaaatgaatcttccatttactggattgctagaactgaattaaaatttgcaacgtcattaatattatctgattcaggaacccgattatttccatattttaatccttacgacacgatttcattaaattatgaatatgtaaaagacattccgaatgaagaaatttactatttcctaaataggtggatggatattaaaaatgtattcattcaacctgacggtagtatgtttaatcggaatccaagacctgatattcaacttatgattactcaaaatttgacttga

SEQ ID NO: 22356 - protein, 239 aa, Unknown
  Obtained from environmental sample
  misc_feature (1)..(239): Xaa is any amino acid
MIDFYKRKQVIELLSDIKLKAIQKKSISHSDSEKYTLQIFEKIGIPIQNDSAKLFGKPGILQELILDIHSSAYFTIDERKLFNEDFNEFLKLFPKPQSKEELKFRILGNNGLYPNVDIKRGKVWYKNFNSRPRIVTVNKINSEKEYSNESSIYWIARTELKFATSLILSDSGTRLFPYFNPYDTISLNYEYVKDIPNEEIYYFLNRWMDIKNVFIQPDGSMFNRNPRPDIQLMITQNLT

SEQ ID NO: 22357 - DNA, 522 bp, Unknown
  Obtained from environmental sample
  misc_feature (1)..(522): n is a, c, g, or t
ttgacaactattataactaacaaagcattacctatatatagcttaatttttatttttacctttttagtatcttgtaaggatactaaaaaggtaaacaatgaccatttagtttttagatataacgaacacaaaaatataggatcactagatcctgcatttgcaaaagacaacgcagatatttgggcaatccatcaattatttaatggattggttcaaatggatgacagtttacatgttaaacccagcattgctaaaaactggacactatcagataatggtttaagctataattttgtactaaaaaacaatgtctattttcataaacataaattatttggtaaggattctaccagactagttactgcttctgactttgaatatagttttaaccgattgttggataaaaatatagcgtcgtcaggtcagtggatttttaataaagtaaacacctttaaagcgataaacgacaccatttttaatattactttaaaacaaccttttcctgcatttttgggtttgtaa

SEQ ID NO: 22358 - protein, 173 aa, Unknown
  Obtained from environmental sample
  misc_feature (1)..(173): Xaa is any amino acid
MTTIITNKALPIYSLIFIFTFLVSCKDTKKVNNDHLVFRYNEHKNIGSLDPAFAKDNADIWAIHQLFNGLVQMDDSLHVKPSIAKNWTLSDNGLSYNFVLKNNVYFHKHKLFGKDSTRLVTASDFEYSFNRLLDKNIASSGQWIFNKVNTFKAINDTIFNITLKQPFPAFLGL

SEQ ID NO: 22359 - DNA, 399 bp, Unknown
  Obtained from environmental sample
  misc_feature (1)..(399): n is a, c, g, or t
atgaagattgtacaaaaaagtttagctattgtcggcttaggcgttttaggattgttatttattaacgcctatcaagacgctcctactgacgagaattttgagaaaaaaataataaacgattataatgtatacgcaattcaaatgccaagctatttagagtttgcaggagaagctgtaccattatcaaatccagatatttatgagcgcatggataaagagcttttagttaatacctattggcaatctaatggtttgttaatgtttaagcgtgccaaaaaatatttccctattatcgagcctattttagcaaaaaacgggataccagacgattttaaatatttgcagttattaaagtgtttaactgatcacgtctccagcagacactcgaccgattcttga

SEQ ID NO: 22360 - protein, 132 aa, Unknown
  Obtained from environmental sample
  misc_feature (1)..(132): Xaa is any amino acid
MKIVQKSLAIVGLGVLGLLFINAYQDAPTDENFEKKIINDYNVYAIQMPSYLEFAGEAVPLSNPDIYERMDKELLVNTYWQSNGLLMFKRAKKYFPIIEPILAKNGIPDDFKYLQLLKCLTDHVSSRHSTDS

SEQ ID NO: 22361 - DNA, 675 bp, Unknown
  Obtained from environmental sample
  misc_feature (1)..(675): n is a, c, g, or t
ttgcgtagatcattaattaaatttaacagaatcattatgataacatttgttcttattgcaatagctgcaatactcgtaactattggcttagtttggctaattgataaatttgtaccaattaaaattaaaccagttattacaatagtcctttgggtattaatagcgtatttagggtatacgacctttatgtctgtatacaatcctattttatttaacaaagtaaaagaaaagcgttatgctaaagttattgaaaaactagtagatattagagattctgaattagcatataacgaggttaacggatcttttacagataacttcgatagtttagtaaactttatcgaaaaaggtcaatttgcgattatagaacgtagagattctactattgtagatgaagaattaacaaaactgtatcgtggtgttgaaatgaaaaaagatataagaattattgatacattaggatttgttagtgtaaaagattctttatttaaaacttcagagcgttataaaacgatgatgaatgttccttttgcaaaagaaggcactaaatttaaattggaatctggagaacttggagaagaaggtgagaaaatagctgtatttgaagcgtctattctaaaaagtcaaattttacacgatcaagttccagctctcgaccgattcttgatccactag

SEQ ID NO: 22362 - protein, 224 aa, Unknown
  Obtained from environmental sample
  misc_feature (1)..(224): Xaa is any amino acid
MRRSLIKFNRIIMITFVLIAIAAILVTIGLVWLIDKFVPIKIKPVITIVLWVLIAYLGYTTFMSVYNPILFNKVKEKRYAKVIEKLVDIRDSELAYNEVNGSFTDNFDSLVNFIEKGQFAIIERRDSTIVDEELTKLYRGVEMKKDIRIIDTLGFVSVKDSLFKTSERYKTMMNVPFAKEGTKFKLESGELGEEGEKIAVFEASILKSQILHDQVPALDRFLIH

SEQ ID NO: 22363 - DNA, 528 bp, Unknown
  Obtained from environmental sample
  misc_feature (1)..(528): n is a, c, g, or t
atgaaaagacttataatggtaatattcctttttttaggtgtacaatccatagcccaagagggtatagaaaaaaatattggagattttgatgcactgaaagtttacgatttaatcaatgtgactttggtgaaggcaaatgaaaataaagcgatcatttccggagaccacaaaagcgatgtggaattggtcaacaaaaatggtaccctgaaaataaaaatgcgcttaggagaaaaatttgatggtaacaaaactaatgtgactttgtattatagaaatattagggttgtggatgtcaatgaaggggcctatgtgagttctgaagacatctttaaacagcacaaaatggaactcagagcccaagaaggcggaatcattaaattgaagctggatgttagtgaaaatgaagttaaagccgttacaggtggtgaagtacaagttgctggtaatgccgtcggacaggatatttccccatatacacgggtggcctttccatgggaaactttgggaaccggaggttacccatgtann

SEQ ID NO: 22364 - protein, 176 aa, Unknown
  Obtained from environmental sample
  SIGNAL (1)...(18)
  misc_feature (1)..(176): Xaa is any amino acid
MKRLIMVIFLFLGVQSIAQEGIEKNIGDFDALKVYDLINVTLVKANENKAIISGDHKSDVELVNKNGTLKIKMRLGEKFDGNKTNVTLYYRNIRVVDVNEGAYVSSEDIFKQHKMELRAQEGGIIKLKLDVSENEVKAVTGGEVQVAGNAVGQDISPYTRVAFPWETLGTGGYPCX

SEQ ID NO: 22365 - DNA, 576 bp, Unknown
  Obtained from environmental sample
  misc_feature (1)..(576): n is a, c, g, or t
ttggacaatagtgtttatgctataaccaagtatggtgcagagcttgaagtttggcgtggtacacaagaaggcttggatgctgttattgtaaatcctggaattataattggtcctggaatatggaattatggtagtggatcgcttattactatgataaataaaggcatgacctattacactacgggaagtacaggttacgtggatgttaatgatgttgtaagttgtatggttacacttatgaaaagcaacattattaatgaacgctacatactggtatctgaaaacttaagctttaaagactttatttacaaaactgccaactacctaaatgtagtccctccaaaaaagaaagccacaaaactactattagctttaggttggcgattggattggataaaacagaaacttactggtaaacgacgcttgttgtctaaacaaacagcacattcgactttgtcccaaagtcaatttagtaatagtaaaattacaactgctatagattataattttacaagtatagacattagtttaaaacaaactactttggcgtttgcacgcgatcaagcttttgtttaa

SEQ ID NO: 22366 - protein, 191 aa, Unknown
  Obtained from environmental sample
  misc_feature (1)..(191): Xaa is any amino acid
MDNSVYAITKYGAELEVWRGTQEGLDAVIVNPGIIIGPGIWNYGSGSLITMINKGMTYYTTGSTGYVDVNDVVSCMVTLMKSNIINERYILVSENLSFKDFIYKTANYLNVVPPKKKATKLLLALGWRLDWIKQKLTGKRRLLSKQTAHSTLSQSQFSNSKITTAIDYNFTSIDISLKQTTLAFARDQAFV

SEQ ID NO: 22367 - DNA, 774 bp, Unknown
  Obtained from environmental sample
  misc_feature (1)..(774): n is a, c, g, or t
gtgatcaagaatcggtcgaggagatacgtcgttaatacaaaatatggacttgttgtacattcggctggattagctcatatgataccaaaaactaagattgaatcacagcgtttttttgatgtcaattatcaaggaacaattaatttatgtacagctttagaatcaacccctccagtcactttcgtttttataagtaccatagcagtgtatggaaaagagattggaaaaaagatagaagaagatacctacttgggtggtaaaactccttatgcaaaaagcaaaatacaagcagaattttatttgcagacatggtgcgaaaaatttagtataaacctagttatattaagattaccccttgtagcaggtagtgatgcaaaaggaaaccttggggccatggtcgaaggaatcaaaaaaggatattatttcaatataaaagactcagaggcaaaaaaatcaattgtgttagccgaagatgttgcacatctgattccaaatttaacgggtcataaaggaatttataaccttgcaggagataaggattacacatttcaagagatttctgatattgtcagtcaccaattaggaaataaaaaagtgttaagcttgccaaactggattgtaaaattgttatcaaaaattggagatatgtttagattttcccctttgaataaggctacatatatgaaaatgaccaatgatttaactgtttcagctgaaaaagcgaaaaatgaattgggatggaatccaaaagccttaagtaattatagaatctga

SEQ ID NO: 22368 - protein, 257 aa, Unknown
  Obtained from environmental sample
  DOMAIN (1)...(257): 3-beta hydroxysteroid dehydrogenase/isomerase family
  misc_feature (1)..(257): Xaa is any amino acid
MIKNRSRRYVVNTKYGLVVHSAGLAHMIPKTKIESQRFFDVNYQGTINLCTALESTPPVTFVFISTIAVYGKEIGKKIEEDTYLGGKTPYAKSKIQAEFYLQTWCEKFSINLVILRLPLVAGSDAKGNLGAMVEGIKKGYYFNIKDSEAKKSIVLAEDVAHLIPNLTGHKGIYNLAGDKDYTFQEISDIVSHQLGNKKVLSLPNWIVKLLSKIGDMFRFSPLNKATYMKMTNDLTVSAEKAKNELGWNPKALSNYRI

SEQ ID NO: 22369 - DNA, 414 bp, Unknown
  Obtained from environmental sample
  misc_feature (1)..(414): n is a, c, g, or t
ttgaacttaaagcaagttaactttaagcgtcaaattgatgaaattgataacgaaactgttacgatttctatttcaggacaagatcaaattactgctggtgatttccagaaattcatttcaggctttcaagtgcttaacaaagatttggtaatctgtaatttagattccaaagtaagcattaatatggagttgactattgaaaaaggtagaggctatgttcctgctgaagagaataaaaaagcttctgcaccaattggaaccatctttacagattcaatttatacaccaataaaaaatgtaaaatacggaattgaaaacttccgtgttgagcaaaagacagattatgagaagttggtttttgaaatccaaacggacggatcaatcaatcctaaggatgccttaactgaagcgggg

SEQ ID NO: 22370 - protein, 138 aa, Unknown
  Obtained from environmental sample
  DOMAIN (1)...(95): RNA polymerase Rpb3/RpoA insert domain
  misc_feature (1)..(138): Xaa is any amino acid
MNLKQVNFKRQIDEIDNETVTISISGQDQITAGDFQKFISGFQVLNKDLVICNLDSKVSINMELTIEKGRGYVPAEENKKASAPIGTIFTDSIYTPIKNVKYGIENFRVEQKTDYEKLVFEIQTDGSINPKDALTEAG

SEQ ID NO: 22371 - DNA, 570 bp, Unknown
  Obtained from environmental sample
  misc_feature (1)..(570): n is a, c, g, or t
atgattaatactaaaaaaacatattcatcattccctttcgactggacgataaaatcaacctcttaccagattcggtacagaaaggcttttgacatcaatgaaattgatgagatattttgttcaatcatcaatgctaaaggtaacgaaatcaaattttcagagttggggaattttttgggctttaacttacaagacttagctgaaaatgatattttcaacacctatctgaaagggattatagaatacaatttaattgcgataaacgaagaaataattcaactatctgattttggacaagaagcactacgaagtaaactgaaatacaagtactactttacaataaccgaattgtttgaaaatcaaaccggcataggtgaaaacttcgatttctctttcgaaaaagtgtttgatttggaaaacagattatccctagaaagagaaattaaaagcgaaacttttgacgatcctgaattaaaaaagaaacttcaatttcagctttttgaaaacgacatttacaaaggcgaaataattgaaatctacgatagtaaaccgaatattagttacaaaacc

SEQ ID NO: 22372 - protein, 190 aa, Unknown
  Obtained from environmental sample
  misc_feature (1)..(190): Xaa is any amino acid
MINTKKTYSSFPFDWTIKSTSYQIRYRKAFDINEIDEIFCSIINAKGNEIKFSELGNFLGFNLQDLAENDIFNTYLKGIIEYNLIAINEEIIQLSDFGQEALRSKLKYKYYFTITELFENQTGIGENFDFSFEKVFDLENRLSLEREIKSETFDDPELKKKLQFQLFENDIYKGEIIEIYDSKPNISYKT

SEQ ID NO: 22373 - DNA, 573 bp, Unknown
  Obtained from environmental sample
  misc_feature (1)..(573): n is a, c, g, or t
ttgtatatttgcaggctcaaaatagatgtgaaaatgaagccattgaaagagtttacaattccatttgtaggtttaaaagtagggaaacatcattttgattatgaaattaaaaaagagttctttgattattttgagtacgaagattttaatagtagtgatctaaaaatagatttggattttgtaaagaaatcaacacttttagaattgcattttgaagtaacaggaacagtaaatgttaattgtgacgttactaacgagccttacgaccaagaaattaaaaatagttttgatttagtggttaattttggtgaagagtttaacgacgagtatatagacatacttattctacctcacggagaatatgaggttaatgttcaacaatacatttacgaattaattgtgttagctatgccactaaaacgaattcacccaggagttgaagacggcacactagattcagacatacttaataaattagaagaattaagtccaaaaataaaggacataaaaaaagaccaagaggagtcagatcctcgctggaataaattaaagcaactattaacggataaataa

SEQ ID NO: 22374 - protein, 190 aa, Unknown
  Obtained from environmental sample
  DOMAIN (26)...(185): Uncharacterized ACR, COG1399
  misc_feature (1)..(190): Xaa is any amino acid
MYICRLKIDVKMKPLKEFTIPFVGLKVGKHHFDYEIKKEFFDYFEYEDFNSSDLKIDLDFVKKSTLLELHFEVTGTVNVNCDVTNEPYDQEIKNSFDLVVNFGEEFNDEYIDILILPHGEYEVNVQQYIYELIVLAMPLKRIHPGVEDGTLDSDILNKLEELSPKIKDIKKDQEESDPRWNKLKQLLTDK

SEQ ID NO: 22375 - DNA, 825 bp, Unknown
  Obtained from environmental sample
  misc_feature (1)..(825): n is a, c, g, or t
ttgaatagcaaatttgatattcaaaaatttacatttggttcttctctacaaattttagacagtttaacttttaaagatggtcaaaccaatatttctgacggaattcttggagtacaaaatttacagaaagataaaatttctcctatacttttaatttctgatggaaaccaaactattggtcaagattatgaatttatcaatagtaaacagccaatttacccaatagttattggagataccacaacttatgtagatgttaaaatatcgcaattaaacgtaaataaatacagttatatcaaaaataaatttcctgtagaagttattttaaattatgaaggtcgtgaaaatgttaacacacaattttcaatatttagtgaaggtaaaactgtttttagaaaaaatatttctttttcttcggataaaaaatcggctacagttttggcaaatttaacatcaaccaaagaagggttacaatattatactgcatctatttcgaaaattaagaatgagaaaaacatcaaaaataatagtaaaagtttctctgtagaagttatagatgagcaaacaaaagtgttgctattaacgtcagttttgcatccagatttgggcgcttttaaaaaatcgatagaaagtaataaacaacgttctgtaaaaattgctacgattgataaatttactgatgaattacaagagtttcagttagtaattttatatcaancttcagctagttttaattcagtatttactaaaataaaagaaaataatagtaattatttattggtttctggagccaatacagattggaatttatcaagcaaaaaaggn

SEQ ID NO: 22376 - protein, 275 aa, Unknown
  Obtained from environmental sample
  misc_feature (1)..(275): Xaa is any amino acid
MNSKFDIQKFTFGSSLQILDSLTFKDGQTNISDGILGVQNLQKDKISPILLISDGNQTIGQDYEFINSKQPIYPIVIGDTTTYVDVKISQLNVNKYSYIKNKFPVEVILNYEGRENVNTQFSIFSEGKTVFRKNISFSSDKKSATVLANLTSTKEGLQYYTASISKIKNEKNIKNNSKSFSVEVIDEQTKVLLLTSVLHPDLGAFKKSIESNKQRSVKIATIDKFTDELQEFQLVILYQXSASFNSVFTKIKENNSNYLLVSGANTDWNLSSKKG

SEQ ID NO: 22377 - DNA, 735 bp, Unknown
  Obtained from environmental sample
  misc_feature (1)..(735): n is a, c, g, or t
ttgtgtttgatgcttataagtcgtaaatttgataaaattaaaaaaacagtaaatatggcaaataaccaaatggatattaaattcccaaaaggtggagttttctttattattatagcaattgcagtaatgattttattctcaaaatctacagtaactattggtcctggagaaggaggtgtaatttttgaaacgttaggaagtggtattgataccgaaaatacgtatggagaagggtttcatattgtggcaccttggaatagaatgattgtaagaaaagttcgtcagcaatctatctcaaacgaaatgaatgtgctttctgtaaacggattagaagttaaagttaatggtacaatttggtacgaaccagaattttcaaatttaggaagtttaattaaaacaaaaggtgaagattatgaacgtgaattgttagatcctgcagttaatgcagcagcaagaagtgttgtaggacgttatacacctgagcaattatattctagtaaaagagatgttattgagcaagaaattttagatgaagtgcagttggttttaaaagatcaatacttatctgttaaaagagttttagtagaagatgtaaaattaccaagtactattagaattgctattgaaacaaaattaaagcaagaacaagagtctttagaatatgaatttagattatttaaagctaaaaaagaagctgaaagacnaaagattctcgaccgattcttgatccactag

SEQ ID NO: 22378 - protein, 244 aa, Unknown
  Obtained from environmental sample
  DOMAIN (50)...(236): SPFH domain / Band 7 family
  misc_feature (1)..(244): Xaa is any amino acid
MCLMLISRKFDKIKKTVNMANNQMDIKFPKGGVFFIIIAIAVMILFSKSTVTIGPGEGGVIFETLGSGIDTENTYGEGFHIVAPWNRMIVRKVRQQSISNEMNVLSVNGLEVKVNGTIWYEPEFSNLGSLIKTKGEDYERELLDPAVNAAARSVVGRYTPEQLYSSKRDVIEQEILDEVQLVLKDQYLSVKRVLVEDVKLPSTIRIAIETKLKQEQESLEYEFRLFKAKKEAERXKILDRFLIH

SEQ ID NO: 22379 - DNA, 582 bp, Unknown
  Obtained from environmental sample
  misc_feature (1)..(582): n is a, c, g, or t
atgcatggacaggagcttacattgtggctaaaaatattaagatttaatatggagacttttattgtgtttttaagaggtattaatgttggaggacacaacaaaataaaaatgctagatttacgtcaagtgttatcagagataggctttaatgatgtaaaaacgtatattcaaacaggtaatattatactaaaaacggatttaaaagacaaagcaattataaccagtaagatagaggagtctattttaattcattttggttttaacataccaactctagtaaaaacaaaagcagaccttgatttaatatttaaaaaatgtccttttactgatgcagaaaaagaaaacagctattttgctctactttataacgctccaagtcaaagtcaaatcacagcattatcaaattatgattttccaaatgaaaaatttactataactaaccagtgtatctatctttattcaagtgtaggttatggaaggactaaggcaaatagtaatttttttgaaactaaattaaaaatcaaaactaccgctagaaattttaaaacacttactaaggtagtatcgctaataaaaaattag

SEQ ID NO: 22380 - protein, 193 aa, Unknown
  Obtained from environmental sample
  misc_feature (1)..(193): Xaa is any amino acid
MHGQELTLWLKILRFNMETFIVFLRGINVGGHNKIKMLDLRQVLSEIGFNDVKTYIQTGNIILKTDLKDKAIITSKIEESILIHFGFNIPTLVKTKADLDLIFKKCPFTDAEKENSYFALLYNAPSQSQITALSNYDFPNEKFTITNQCIYLYSSVGYGRTKANSNFFETKLKIKTTARNFKTLTKVVSLIKN

SEQ ID NO: 22381 - DNA, 354 bp, Unknown
  Obtained from environmental sample
  misc_feature (1)..(354): n is a, c, g, or t
atgttgatgattaatatattaggcgcattactcataattgcgattgtgtactggttttggctttttaagccaaagcaagtgcaaagtaacgacaataaggtagttatagtggttgataacggtatataccagccggcgcaaattaaagttgttgcaggtaaagagttaacacttaacttcgatcgccaagatagtgcaccatgtagcgaaacagtcatatttccacagcttgatataagtaaaaccctcgtaatgggcgatgctaataccttaaaaatacccgagcttaaagtaggtgagtacgactttcactgccaaatgcaaatgtataaaggtaagctaatagtgcagtaa

SEQ ID NO: 22382 - protein, 117 aa, Unknown
  Obtained from environmental sample
  misc_feature (1)..(117): Xaa is any amino acid
MLMINILGALLIIAIVYWFWLFKPKQVQSNDNKVVIVVDNGIYQPAQIKVVAGKELTLNFDRQDSAPCSETVIFPQLDISKTLVMGDANTLKIPELKVGEYDFHCQMQMYKGKLIVQ

SEQ ID NO: 22383 - DNA, 867 bp, Unknown
  Obtained from environmental sample
  misc_feature (1)..(867): n is a, c, g, or t
ttgaatcggctcgaggcagcactaattagcanagaaganaatgatcagttaaaaagtttactgagtcttttaacaagaataaaaagtgataagtttaaagattctgaaattattatggcggatatgcagctattaaaagatgcattaaagattaagacaactactgaactttttaagttgttatttatagctcagaaatttaaacttattattcttgataggaatattaaattagaaattagtgtcaatcgtacacctgaattaaaatcatgggattattatgtgaaatcaccaagaattgatgctgtgtttgattttgccactgaaattgtaaaagctactgttcctggtagtcaagtagcgttagaagatcaagagttaaattctaatataaaagaggttattaactctaattttttaccagaaaatatattttgggaagaaataaagaaaaatagtgagcgtaagactaaagttgaaataattaaagggttagttgaagatttcaagaaagttagagcaaagtttgcctttaaattggtgaattttttacctggattaaagcatgagagtcatattgagtataaaaacgaaaatgcttttgtgtctcaattaatttataatagctatgacactaatgttattcctttagaaggattaaaagccttcaaaattgatttaattaaattaattacgcatatttctaaagagaacctagaagaagataaaaggacctttaatattgtagacttaattaacgaactaggaatagaagaaaaaggggatgactactttcaaaaactagtgtntatatctaaaggcttaggatatctaaaggagatggaggaattagtcctatgggaatga

SEQ ID NO: 22384 - protein, 288 aa, Unknown
  Obtained from environmental sample
  misc_feature (1)..(288): Xaa is any amino acid
MNRLEAALISXEXNDQLKSLLSLLTRIKSDKFKDSEIIMADMQLLKDALKIKTTTELFKLLFIAQKFKLIILDRNIKLEISVNRTPELKSWDYYVKSPRIDAVFDFATEIVKATVPGSQVALEDQELNSNIKEVINSNFLPENIFWEEIKKNSERKTKVEIIKGLVEDFKKVRAKFAFKLVNFLPGLKHESHIEYKNENAFVSQLIYNSYDTNVIPLEGLKAFKIDLIKLITHISKENLEEDKRTFNIVDLINELGIEEKGDDYFQKLVXISKGLGYLKEMEELVLWE

SEQ ID NO: 22385 - DNA, 525 bp, Unknown
  Obtained from environmental sample
  misc_feature (1)..(525): n is a, c, g, or t
ttggtttctcacgataaaatgtttttagataacgtaactaacagaactatagaaatttctcttgggcagatttacgattataaaaaaccatattctcaattcttattattaagaggagaaattaaggaaaagcaattacaagcacagaaaaaccaagagaaagaaataaagcaaaagcaagacttaattaacaagtttaaagcaaaagcaagtaaagcatctatggcacaatctttaatgaaacagcttgataaagttgagttgattgaagtagatcaagatgataaccaagccatgaatgtgcgttttgcaatttctaaagagccaggtaaaattattgtggaagcagaaaatctttctaaaagttatggtgataaacatgttttagaaggagtagatttattgatagaaagaaactctaaaattgcttttgttgggcaaaatggacaaggaaaatcgactttagcaaaaatgatggttggtgaaattccttttgaaggatatttaaacttgggcacaatgtag

SEQ ID NO: 22386 - protein, 174 aa, Unknown
  Obtained from environmental sample
  misc_feature (1)..(174): Xaa is any amino acid
MVSHDKMFLDNVTNRTIEISLGQIYDYKKPYSQFLLLRGEIKEKQLQAQKNQEKEIKQKQDLINKFKAKASKASMAQSLMKQLDKVELIEVDQDDNQAMNVRFAISKEPGKIIVEAENLSKSYGDKHVLEGVDLLIERNSKIAFVGQNGQGKSTLAKMMVGEIPFEGYLNLGTM

SEQ ID NO: 22387 - DNA, 744 bp, Unknown
  Obtained from environmental sample
  misc_feature (1)..(744): n is a, c, g, or t
ttggggaaatgtgccattcgtcaaatatttcatgtagctttagaaaacagaactgaagccaataagaaagatttaggcgcttttgtttctcgtttacgttggcaagctcattttattcaaaagttcgaaatggaacataccatggaagaagcaagcgtaaataaaggttatcataaattaaagaaaagcatttctgaaacctatcaaaaagcatggaaaaaagggcaaactggttttcctttgatagatgctagcatgcgttgtttgaatgaaactggatatttaaattttagaatgcgagctatgttagtttcgtttttcacacatattttatggcaaccttggcaagatgcaacacaccatttatcgcaacattttttagattttgaaccaggaattcattttcctcaattacaaatgcaagcctcagaaactggcacaaatactatcagaatttatagtccgttaaaaaatagtattgagcatgatacagatgcaaatttcataaaaaaatgggttccagaattggcgacattatcaacaggttttattcatgaaccgtatttaatgacacctttagatcagcaatttgcaaattttgaattgggtgtaaattatccaaaaccaattgtagatattaaaatctcaagaaaaaaagctagcgatatcttgtacaacatgcgtaaagacccagaggtaattatggaaactagaagaatcttaaaaaagcacaccactttctga

SEQ ID NO: 22388 - protein, 247 aa, Unknown
  Obtained from environmental sample
  DOMAIN (3)...(228): FAD binding domain of DNA photolyase
  misc_feature (1)..(247): Xaa is any amino acid
MGKCAIRQIFHVALENRTEANKKDLGAFVSRLRWQAHFIQKFEMEHTMEEASVNKGYHKLKKSISETYQKAWKKGQTGFPLIDASMRCLNETGYLNFRMRAMLVSFFTHILWQPWQDATHHLSQHFLDFEPGIHFPQLQMQASETGTNTIRIYSPLKNSIEHDTDANFIKKWVPELATLSTGFIHEPYLMTPLDQQFANFELGVNYPKPIVDIKISRKKASDILYNMRKDPEVIMETRRILKKHTTF

SEQ ID NO: 22389 - DNA, 633 bp, Unknown
  Obtained from environmental sample
  misc_feature (1)..(633): n is a, c, g, or t
atgaggcacccaatgcaatcaaacttagaaaaaaagcaccaagatgagaagctagaagctctaaaagaagggaaaacacaaaagactaaagatacacttgataaattgaacttaattttatctaattattttgagcaaggaaatgttgatttttcaataacaaatatcggaatgataagttataaaaatagcggtcccagttacgaaacgcttcgtgcaacaaaaaatgtgcactatagaaagctaattagttattgggctgaattaatcaaaagtcaatcggttgacaataaagtggtattaccagctacggataatgagcttttaaatacgatacccgatattgcggctcgcgcatactttgcaagaattttagctgaaagaaagaaatttaaaaccgagctgaatatcttaaaaagtcaatcggaaatagtaatcgataagcgtaatcaatatacccaaactacagactttattcctaacttaaaactaactaataatgagttatcagcgcttacttatgctgtatcggatgagtgtattaagctcaatggtttggtaaaaactgaattaggccaaataaaaggaagtgaatattccaatgaaatatcccaagaaggtttatacaagcnn

SEQ ID NO: 22390 - protein, 211 aa, Unknown
  Obtained from environmental sample
  misc_feature (1)..(211): Xaa is any amino acid
MRHPMQSNLEKKHQDEKLEALKEGKTQKTKDTLDKLNLILSNYFEQGNVDFSITNIGMISYKNSGPSYETLRATKNVHYRKLISYWAELIKSQSVDNKVVLPATDNELLNTIPDIAARAYFARILAERKKFKTELNILKSQSEIVIDKRNQYTQTTDFIPNLKLTNNELSALTYAVSDECIKLNGLVKTELGQIKGSEYSNEISQEGLYKX

SEQ ID NO: 22391 - DNA, 669 bp, Unknown
  Obtained from environmental sample
  misc_feature (1)..(669): n is a, c, g, or t
atgaattcgacaaaaactttggtttacgatggtagctttaatggttttttgactgcagtttttattggttacgaacagaagcttgcctatgcagatattcaaaaaaaagggcaattacaaagtggactttttactgagacagaaacgatttttaccaatttagaaaaagcacagcgtgtttggaacggtgttaaaaacaaaagtaattctgctattaagaatatttattttgcttttttaagtgaacaaaataatatggaggcactactctaccgttatattcaaaaattaatgggtagtacatacaagggcgctacagactttagcgatgattgtgttttaaaaataaattcattagcacaaaaagtaggtagggaaaaacacagaatggaagcttttgtacgctttcaattaactaaggatgaagtctattttgctaatattgaaccagattttgatgttttaccattgatatctaaacactttagaaaccgctacgcagatcaatcttggattatttatgacgttaagcgtaaatacggactttactatgatttacagacggttgaaataatttcattagacttaaccgatatacataccaatagtcttgagaaaagtgctgtcttcactgattctgaatatgaataccaagacctttggaacaan

SEQ ID NO: 22392 - protein, 223 aa, Unknown
  Obtained from environmental sample
  misc_feature (1)..(223): Xaa is any amino acid
MNSTKTLVYDGSFNGFLTAVFIGYEQKLAYADIQKKGQLQSGLFTETETIFTNLEKAQRVWNGVKNKSNSAIKNIYFAFLSEQNNMEALLYRYIQKLMGSTYKGATDFSDDCVLKINSLAQKVGREKHRMEAFVRFQLTKDEVYFANIEPDFDVLPLISKHFRNRYADQSWIIYDVKRKYGLYYDLQTVEIISLDLTDIHTNSLEKSAVFTDSEYEYQDLWNX

SEQ ID NO: 22393 - DNA, 318 bp, Unknown
  Obtained from environmental sample
  misc_feature (1)..(318): n is a, c, g, or t
ttggatattgctgaaaaaagattggcccacaggatggcaggatcaatatcagtacacccactgaagagtatgatattcgtgtttcttcattacctaccctacacggcgaaaaactggtattacgtttactttcgaaagaacgccaccaatatccagttagaaaccttaggttttaccatagatgaattaaaacgttataaaagcagtgttaaaaatcaaaacggtattgtattgatctccggaccaaccggttcaggtaaaaccactacgttgtatgctacgttgaaactattgatacggatgatacaaatattataa

SEQ ID NO: 22394 - protein, 105 aa, Unknown
  Obtained from environmental sample
  misc_feature (1)..(105): Xaa is any amino acid
MDIAEKRLAHRMAGSISVHPLKSMIFVFLHYLPYTAKNWYYVYFRKNATNIQLETLGFTIDELKRYKSSVKNQNGIVLISGPTGSGKTTTLYATLKLLIRMIQIL

SEQ ID NO: 22395 - DNA, 420 bp, Unknown
  Obtained from environmental sample
  misc_feature (1)..(420): n is a, c, g, or t
atgaaaaaattaactacaattttattcaaaaaatttcctgcatttaacctgcaagaattattagtagtattagtgatcataggtattctattactactagccttacctaacttaatgcctcttatttctaaaactaaaagccttgaggctcaaacacaattgaagcatatttacaatcttgaaaaacagtacttcttcatgcactcaaagtacagcacagattttaatactattgattttgaagcacccaaaacagtacaagaaaatggcaatgccaattacacgtacgaaattatcgaaacatctaatactgcttttaaagcacgtgcgacttcgattaccgattttgacggtgatggtatattcaacgtttgggaaatagatcataatgattcacctagagaaatagttaaagattaa

SEQ ID NO: 22396 - protein, 139 aa, Unknown
  Obtained from environmental sample
  misc_feature (1)..(139): Xaa is any amino acid
MKKLTTILFKKFPAFNLQELLVVLVIIGILLLLALPNLMPLISKTKSLEAQTQLKHIYNLEKQYFFMHSKYSTDFNTIDFEAPKTVQENGNANYTYEIIETSNTAFKARATSITDFDGDGIFNVWEIDHNDSPREIVKD

SEQ ID NO: 22397 - DNA, 387 bp, Unknown
  Obtained from environmental sample
  misc_feature (1)..(387): n is a, c, g, or t
atgggtgatttatttttcttcgaaaacatgattattacacaagttaatgaaggcgaacatgtaagttttaatagcacaaaattaccttttaaatgtatttatgattattatgaagcattaaaaaaaccgtttggtataatttcaaatagattaaataagtactccttagaggttttagatttacctaagtacagtaaaaatttacctaatttaaaattttatggcgtagttggaaatactaattttaataacgtaaatattagcttagaaaaacaatttagcaaaatacctgtattagattttgataacatttcagaagcttataatacaattaatgattatatattaaattcaaccaatgatagcgtgacatttgatataccctaa

SEQ ID NO: 22398 - protein, 128 aa, Unknown
  Obtained from environmental sample
  misc_feature (1)..(128): Xaa is any amino acid
MGDLFFFENMIITQVNEGEHVSFNSTKLPFKCIYDYYEALKKPFGIISNRLNKYSLEVLDLPKYSKNLPNLKFYGVVGNTNFNNVNISLEKQFSKIPVLDFDNISEAYNTINDYILNSTNDSVTFDIP

SEQ ID NO: 22399 - DNA, 402 bp, Unknown
  Obtained from environmental sample
  misc_feature (1)..(402): n is a, c, g, or t
gtggatcaagaatcggctcgaggtgctgagcttactacatatattatagaaaaaagtgaatctgcagcgcattatattttaaaacaaccggaaccctatcgttctatattattgcatttgcaggttattattgagcatgcaataatcaactttgaattaaagtacaaatggagcattccgttttattacgtaaacggaatgccattttgttatttaaatgcaagtcataaaaaacaatttgttgatttggtttttgttaaaggcaatcaattaactgtttttaagacacatcatgttattgaaaacaggaaaaaaatgatatcattaagatacaagtctttggacaaaatagatgataccgtaattaatgctgtattgcaagaagctttaacgttgcaatag

SEQ ID NO: 22400 - protein, 133 aa, Unknown
  Obtained from environmental sample
  misc_feature (1)..(133): Xaa is any amino acid
MDQESARGAELTTYIIEKSESAAHYILKQPEPYRSILLHLQVIIEHAIINFELKYKWSIPFYYVNGMPFCYLNASHKKQFVDLVFVKGNQLTVFKTHHVIENRKKMISLRYKSLDKIDDTVINAVLQEALTLQ

SEQ ID NO: 22401 - DNA, 471 bp, Unknown
  Obtained from environmental sample
  misc_feature (1)..(471): n is a, c, g, or t
ttgaacaaaaatcataaattggaaactctgacaaccgaaaaaataaagcggaattttatgctgattaattcatcatatttttcagagattatttatgacggaaatcgcagattttttgacttgtatttaaatgttggaacaaatggagttttagaaaatcaaacaaaaacgtataacgaactaattgataacctgaatgaatatttgactaaaattagtgaatatataaagtcgacttactcaaactctgaaaagaaaaaagcagctgaactgaataataagaaactgaatattgaagtcgttcagattactgaaaataataaaaactttgacgctgttattgtttgcggaaaggaatacaaaaatttcggaatttttaaaaaaaatattggaattagaactgaaataaaagatggtagaataataacaatggaaagaaaaacggatactttaaaagaaaatctgaaataa

SEQ ID NO: 22402 - protein, 156 aa, Unknown
  Obtained from environmental sample
  misc_feature (1)..(156): Xaa is any amino acid
MNKNHKLETLTTEKIKRNFMLINSSYFSEIIYDGNRRFFDLYLNVGTNGVLENQTKTYNELIDNLNEYLTKISEYIKSTYSNSEKKKAAELNNKKLNIEVVQITENNKNFDAVIVCGKEYKNFGIFKKNIGIRTEIKDGRIITMERKTDTLKENLK

SEQ ID NO: 22403 - DNA, 633 bp, Unknown
  Obtained from environmental sample
  misc_feature (1)..(633): n is a, c, g, or t
atgataccaattaacgatttactattatttggcttagcagcactgattatggttctttcacctggaccgaatatgatttatctgatttcaagatcattatctcaaggaaaaaaagcagggattatctctcttttgggaatcatgtgtggatttctatttcatatactaatggtttctttcgggcttacggctatattttttgccgttccttatgcattcgtagtcgttaaatttcttggagtagggtacttattgtatttagcttatcatactgttaaatctgaaaacaaaatttttgacgcagaccaaaacctaaaatcggacaagcctcttaaactttttaatatcggactgctaacgaatattctgaatcctaaaatggcagtattttatctttcatttttcccacaatttattaaacctgagtacggttccattttagttcaaagttttcagctcggagttattcaaataataattagtttttcgattaattttttgattgtaatatctgctgctaaaatggcgagctggttctcaagaaagccaatttggttaagaatacagaaatggtttatggggtctgtattaactggacttgctgtgaagatggcattgacaaaagcgaaataa

SEQ ID NO: 22404 - protein, 210 aa, Unknown
  Obtained from environmental sample
  DOMAIN (15)...(208): LysE type translocator
  misc_feature (1)..(210): Xaa is any amino acid
MIPINDLLLFGLAALIMVLSPGPNMIYLISRSLSQGKKAGIISLLGIMCGFLFHILMVSFGLTAIFFAVPYAFVVVKFLGVGYLLYLAYHTVKSENKIFDADQNLKSDKPLKLFNIGLLTNILNPKMAVFYLSFFPQFIKPEYGSILVQSFQLGVIQIIISFSINFLIVISAAKMASWFSRKPIWLRIQKWFMGSVLTGLAVKMALTKAK

SEQ ID NO: 22405 - DNA, 744 bp, Unknown
  Obtained from environmental sample
  misc_feature (1)..(744): n is a, c, g, or t
ttggggttaattgataataacnatagcaaaaagtatttatttgaagcaactcccgacatttctaggcaaataaagtctttaaaaaaagatggtattcaaaataccaatgaaatggtcgatggcatttttttaactcatgcccatatggggcattatacggggcttatgtatttagggaaagaagctacagatgcgaaaagtgtgaatgtgtttgccatgccaagaatgaaaaaatatttagaaacaaacggtccttggagtcagcttgtttctagtaaaaatatagtattgacagaaattgaaaacgaacaatctatttcactgacatcaaatataaaagtaacacctcttttagtgcctcatcgagatgaatattctgaaactgttggttataagattaaagggccaaataaaagtgttttatttataccagatattgataaatggagcaaatgggataaaaatattatagaagaaatcaagaaagtagactatgcttttttagatgctacattttatagcggaaaagaattaaacaatcgtgacatgtcccaaatccctcatccttttattcttgaaagccttgaaacgtttaaagaacttgatttacaagaaagaaagaaagtcatatttattcatttcaaccatacaaatcctgtccttgacttacatagtaaagccgctaaaaatgtcttaaatcaagggttcggaattggaaaaattaacgatgtttatgaattataa

SEQ ID NO: 22406 - protein, 247 aa, Unknown
  Obtained from environmental sample
  DOMAIN (6)...(213): Metallo-beta-lactamase superfamily
  misc_feature (1)..(247): Xaa is any amino acid
MGLIDNNXSKKYLFEATPDISRQIKSLKKDGIQNTNEMVDGIFLTHAHMGHYTGLMYLGKEATDAKSVNVFAMPRMKKYLETNGPWSQLVSSKNIVLTEIENEQSISLTSNIKVTPLLVPHRDEYSETVGYKIKGPNKSVLFIPDIDKWSKWDKNIIEEIKKVDYAFLDATFYSGKELNNRDMSQIPHPFILESLETFKELDLQERKKVIFIHFNHTNPVLDLHSKAAKNVLNQGFGIGKINDVYEL

SEQ ID NO: 22407 - DNA, 360 bp, Unknown
  Obtained from environmental sample
  misc_feature (1)..(360): n is a, c, g, or t
atgttacagataatcgaattaaaagaaaaaaatattgttgcaacaaaagcttcgggcaaattgagaaaagaagatatagaaaaaatccatccacttatccacgccatactggacaaaggaatgaaagtccggtggtattttgagatggtcaactttacaggttgggatttacctggtttatgggaagacctaaaaatggacacagcccacgccacggactatgaaaaaatagcaatggtaggagataaaaaatggcagaattggataacacaatttatgaagccttttaccaatgccgatattaagtatttcaatatagaccaaaaggaagatgccaaaaattggattgagagccagtaa

SEQ ID NO: 22408 - protein, 119 aa, Unknown
  Obtained from environmental sample
  misc_feature (1)..(119): Xaa is any amino acid
MLQIIELKEKNIVATKASGKLRKEDIEKIHPLIHAILDKGMKVRWYFEMVNFTGWDLPGLWEDLKMDTAHATDYEKIAMVGDKKWQNWITQFMKPFTNADIKYFNIDQKEDAKNWIESQ

SEQ ID NO: 22409 - DNA, 372 bp, Unknown
  Obtained from environmental sample
  misc_feature (1)..(372): n is a, c, g, or t
gtgatattatcttgggaagattttatgattggctataaaatagaagatgataatcttaatttaggtatacacgaatttatacacgcactacacttaagttatttacaaaccgagtttaaaaacgatgtaactgcatatctatttttaacaggtttaaaggagttgcaaagttatattaatgacaatccagtttataaaagtaaactagtaaattcaaattattttagggcatatgcttttgaaaacaattttgagtttattgctgttgttgtcgagtcttttatcgaaacgcctcaagattttaaagcacaatttccggagctttataaaaaggttaagcaaatgcttaactttaattttaaaggttattaa

SEQ ID NO: 22410 - protein, 123 aa, Unknown
  Obtained from environmental sample
  misc_feature (1)..(123): Xaa is any amino acid
MILSWEDFMIGYKIEDDNLNLGIHEFIHALHLSYLQTEFKNDVTAYLFLTGLKELQSYINDNPVYKSKLVNSNYFRAYAFENNFEFIAVVVESFIETPQDFKAQFPELYKKVKQMLNFNFKGY

SEQ ID NO: 22411 - DNA, 642 bp, Unknown
  Obtained from environmental sample
  misc_feature (1)..(642): n is a, c, g, or t
atgtctgcggcatatgtcgatccagaaatgcaatcagaatttggaaaattacctccaagttttttacctttaggtaatcgtaggttgtttatacatcagttgaaattagctgaaaaatatgaagatatatgtatttcattacctgattcatatgaaataaataaatttgatcgtgattacttaattgataataacattaaaattctaaaaacacctgataatttacctcttggtgaggctctaatggcagcagtaagtttatcaggggttaattttgataaaccattacaggttctgtttggtgataccttgtttaaaaagctacctgagcagactgacgtaatatgcgtttctggatcaaaaggggactataattggtctttttttgagaaagataccgaacattttatagagtccaaaaatgagctaaacactggtgataacgaagctatatctggctttttttcatttagtaaaccgcaaaagctaatatctgcattaatacattcaaactggtcttttttagaaagtgtgaattattataaaaatgaaattgggcttacagcttttaaaaacgaagggtggttggattttggtcatgtcaacacgtattatcgttctaaaagccattttacgaacgnt

SEQ ID NO: 22412 - protein, 214 aa, Unknown
  Obtained from environmental sample
  misc_feature (1)..(214): Xaa is any amino acid
MSAAYVDPEMQSEFGKLPPSFLPLGNRRLFIHQLKLAEKYEDICISLPDSYEINKFDRDYLIDNNIKILKTPDNLPLGEALMAAVSLSGVNFDKPLQVLFGDTLFKKLPEQTDVICVSGSKGDYNWSFFEKDTEHFIESKNELNTGDNEAISGFFSFSKPQKLISALIHSNWSFLESVNYYKNEIGLTAFKNEGWLDFGHVNTYYRSKSHFTNX

SEQ ID NO: 22413 - DNA, 378 bp, Unknown
  Obtained from environmental sample
  misc_feature (1)..(378): n is a, c, g, or t
gtgtatggagacagggatagaattcagcaggttttaaccaatttgattgtgaattctattaaatatggaaaggaagacgggactactgaaattagtatagaaaaccttataaaaaataaggtgatcgttcgggttaccgataatggagaaggaatagaaaaagaaaatctgccgcgtgtttttgaacgtttttaccgtgtagataaaagtggctccaggaaagaaggaggttctggtttaggactttctattgtaaaacatattatagaagcccacgatgagaaaatctacgtggaaagtgtttttggagtaggtagcgaattttcatttacccttgaaaagagcaaaaatatccctgaaactgacactgaaatctag

SEQ ID NO: 22414 - protein, 125 aa, Unknown
  Obtained from environmental sample
  DOMAIN (3)...(115): Histidine kinase-, DNA gyrase B-, and HSP90-like ATPase
  misc_feature (1)..(125): Xaa is any amino acid
MYGDRDRIQQVLTNLIVNSIKYGKEDGTTEISIENLIKNKVIVRVTDNGEGIEKENLPRVFERFYRVDKSGSRKEGGSGLGLSIVKHIIEAHDEKIYVESVFGVGSEFSFTLEKSKNIPETDTEI

SEQ ID NO: 22415 - DNA, 684 bp, Unknown
  Obtained from environmental sample
  misc_feature (1)..(684): n is a, c, g, or t
ttgcaatttgctaaaacctatatgtctttgcttaaaatgcgatttgaagacagtattatttttgatataccagatcaagctaaggatcctgaaagtaaagtcgtaccactagcattgcagttattgctagaaaatgcagtaaaacataatattgtaactagcagtaaaccgttacatattaaaatttatgaaaccgatcaaaacctagttgtagaaaacaatttacaacctaaacaaatagtaaaaaagagtagtggtgtgggattagaaaacatcaaacaacgctaccaattattaaccaataaacgcgtaagtattagccagaatacagctagctttatagtggcaatacctatgctaagtaaagaagtatcagttatgaaaccaataccaaaacaacaattagacgactcatatgtaagagcacgtaaacatgtggaagagttaaaagaattttattacaacctaatttcatattgtatagtcatcccgtttttaatatttataaattataaaaccagttgggactacaaatggtttttctttccaatgtttggttgggcagtaggactatcatttcatgcttataaagtctttgtaaacgatggtgtgtcaggtaaatcttgggaagacaaaaagattaaaaagtttatggaagaggataaccaacaacgttggacttaa

SEQ ID NO: 22416 - protein, 227 aa, Unknown
  Obtained from environmental sample
  misc_feature (1)..(227): Xaa is any amino acid
MQFAKTYMSLLKMRFEDSIIFDIPDQAKDPESKVVPLALQLLLENAVKHNIVTSSKPLHIKIYETDQNLVVENNLQPKQIVKKSSGVGLENIKQRYQLLTNKRVSISQNTASFIVAIPMLSKEVSVMKPIPKQQLDDSYVRARKHVEELKEFYYNLISYCIVIPFLIFINYKTSWDYKWFFFPMFGWAVGLSFHAYKVFVNDGVSGKSWEDKKIKKFMEEDNQQRWT

SEQ ID NO: 22417 - DNA, 678 bp, Unknown
  Obtained from environmental sample
  misc_feature (1)..(678): n is a, c, g, or t
atgatggttaccaaagtggatagtaaaacttttataggcaaaaatattatacacgtagcagtctttaaaaagaaagacaagcgtaccatttataatttaatttatcgtgatggcacaaaaggtccagcgtatgttaagcgttttgctgtaacgtctattacacgagataaagaatatgatttaaccaacggaaacaaaggctctaaaacctggtatttttctgctaatccaaatggagaagctgaggtcgtttcaataagtttacgtcaggttggtagcattaaaaagttaaaatgggatttagattttgcggatattttaattaaaggtcgtgcgtctaagggtaacgtggtgactaaacatgctattaaatctgtagagttaaaagaaaaaggaatttcgactttaaagccaagaaaaatatggtttgacgacactgtacagcgtttaaatgttgacggtagaggtgagttggttggcgagtttagaggagaggataaactgttaataataaatcaaaaaggtatagtaaaaacggttactccagaggtaacgcttcattttgatgatgatatgattgtcatggaaaaatggttgcctaaaaagcctgtatctgctatttattatgatggagaaaaggagcgatactatgttaagcgatttttaattgaaaattga

SEQ ID NO: 22418 - protein, 225 aa, Unknown
  Obtained from environmental sample
  misc_feature (1)..(225): Xaa is any amino acid
MMVTKVDSKTFIGKNIIHVAVFKKKDKRTIYNLIYRDGTKGPAYVKRFAVTSITRDKEYDLTNGNKGSKTWYFSANPNGEAEVVSISLRQVGSIKKLKWDLDFADILIKGRASKGNVVTKHAIKSVELKEKGISTLKPRKIWFDDTVQRLNVDGRGELVGEFRGEDKLLIINQKGIVKTVTPEVTLHFDDDMIVMEKWLPKKPVSAIYYDGEKERYYVKRFLIEN

SEQ ID NO: 22419 - DNA, 357 bp, Unknown
  Obtained from environmental sample
  misc_feature (1)..(357): n is a, c, g, or t
atgaaaaataaatttggatttcaagttctcataaatggaaaaaaaatatgtcgagctggatttgaaaatgaaaacactatagttacctgtattctagattctgtaagacgagaaaaggataattcagaagaattaaacatctcaattagcggattaaactcggatactcaacaacacgctaattggtttagtaataaattacaggaaggtgataagatttctatagaaataatatctaacaattttgatactccaatttcaataagtaaagtttactcagaaaaagatatattatcccaaaaattaaaatcttatcataaattaaaggaggaattaaaagattatctgaaggaataa

SEQ ID NO: 22420 - protein, 118 aa, Unknown
  Obtained from environmental sample
  misc_feature (1)..(118): Xaa is any amino acid
MKNKFGFQVLINGKKICRAGFENENTIVTCILDSVRREKDNSEELNISISGLNSDTQQHANWFSNKLQEGDKISIEIISNNFDTPISISKVYSEKDILSQKLKSYHKLKEELKDYLKE

SEQ ID NO: 22421 - DNA, 585 bp, Unknown
  Obtained from environmental sample
  misc_feature (1)..(585): n is a, c, g, or t
gtgctaattttagatttgcgtggtcatggaaatagcaaaccaagtttaaaagacacctttaattctaaatacaccttcgattctattacagaagatattgttgaagttattgattttttaaaaattgaaaaatctcattttattggtatttctttgggtacaattttaataagaaatttagctgaaaaaagacctgagttagtacaaagtatgattatgggtggtgctattattaaaatgaatttccgttctcaagttttaatgaaagttggtaatatttttaaatctgtggtgccttatatgctactttacaggttatttgcttttattattatgcccaataaaagtcataaaaaatcacgttctttatttgtaaacgaagctaaaaaactatatcaaaaagaatttattcgttggtttaaattaacgtcagaaatcaatccacttttacgtttttttagaacaaaagatataaaaatcccaacattatatattatgggagcagaagatcatttgtttttaccatccataaaaaacattgtttctaaacacaaaacctcttctttagtagtggttgataaatgt

SEQ ID NO: 22422 - protein, 195 aa, Unknown
  Obtained from environmental sample
  DOMAIN (2)...(195): alpha/beta hydrolase fold
  misc_feature (1)..(195): Xaa is any amino acid
MLILDLRGHGNSKPSLKDTFNSKYTFDSITEDIVEVIDFLKIEKSHFIGISLGTILIRNLAEKRPELVQSMIMGGAIIKMNFRSQVLMKVGNIFKSVVPYMLLYRLFAFIIMPNKSHKKSRSLFVNEAKKLYQKEFIRWFKLTSEINPLLRFFRTKDIKIPTLYIMGAEDHLFLPSIKNIVSKHKTSSLVVVDKC

SEQ ID NO: 22423 - DNA, 396 bp, Unknown
  Obtained from environmental sample
  misc_feature (1)..(396): n is a, c, g, or t
atgccgagctatggatcaagaattcggtcgagccatgtcttaaaaggattggcagtaaggaattttgccgatgcagaaactattgtagaaagtgttattgaggtggacgaaaagcgaaaagcaactcaaactgaattagatactattttagccgaatcaaacaaaatttcaaaaaaaataggtttattgnttcaaatctggccaacaaaaaaagcggccattttaaaggaaaaaacaggtaagcttaaggaacaatcaaagttttttaatgagcagctatcttcaatcctaaatgagttgaatgaattattatatcaaatcccaaatattccaaatgtgctagtgccatccggtactacagaagatgataatgacagaagtttttatcgaaggtga

SEQ ID NO: 22424 - protein, 131 aa, Unknown
  Obtained from environmental sample
  DOMAIN (7)...(111): Seryl-tRNA synthetase N-terminal domain
  misc_feature (1)..(131): Xaa is any amino acid
MPSYGSRIRSSHVLKGLAVRNFADAETIVESVIEVDEKRKATQTELDTILAESNKISKKIGLLXQIWPTKKAAILKEKTGKLKEQSKFFNEQLSSILNELNELLYQIPNIPNVLVPSGTTEDDNDRSFYRR

SEQ ID NO: 22425 - DNA, 510 bp, Unknown
  Obtained from environmental sample
  misc_feature (1)..(510): n is a, c, g, or t
atgaagtatgctgttattattcctgctcgctatcagtctagccgcttccctggaaaaccacttatagatttatgtggtaagccaatgatacagcacgtttgggagcgctgttgtgcagcagttggagctgagcttgtttatattgctacagatagtgaaaaaattgaaaaagtatgtatcagttttggtgcaaatgtattaatgacttcatcaagttgtatgacaggaactgatcggttagctgaagctaataaaaaactaaatgctgacttcataataaatgttcaaggtgatgagcctttaatcgaaccaaacgatatttgtaaaattattgatgcatataaaaaaaagcctaatacaataattaatgctatgtgtaaaattgaaaatgaagaagaatttcgctcctttacagtacctaaagtagttgttagtcagtctaataagcttttatatatgagccgatcacctatcccacttagtaaactaatggtttcatttttcatttaa

SEQ ID NO: 22426 - protein, 169 aa, Unknown
  Obtained from environmental sample
  DOMAIN (4)...(167): Cytidylyltransferase
  misc_feature (1)..(169): Xaa is any amino acid
MKYAVIIPARYQSSRFPGKPLIDLCGKPMIQHVWERCCAAVGAELVYIATDSEKIEKVCISFGANVLMTSSSCMTGTDRLAEANKKLNADFIINVQGDEPLIEPNDICKIIDAYKKKPNTIINAMCKIENEEEFRSFTVPKVVVSQSNKLLYMSRSPIPLSKLMVSFFI

SEQ ID NO: 22427 - DNA, 390 bp, Unknown
  Obtained from environmental sample
  misc_feature (1)..(390): n is a, c, g, or t
ttgcaaaaattattttttctgaaaaagctatttacaatattattgtttttatcctttgcaatacgtcctatgtattacgttggttatgtggcctattttcagttaaatatagattacattatagatacctattgtgttaataaagaaaaaccacaattagcttgtaatggtaaatgtcatttagcanaacaaattgcatcaccaataagtgatgataatgatagtaaagctataactactttggcagaatcttttttcccctgtatttactcggaataccaatatactctagacgcttcctcgctagtgttttttaatcaaaaaatacacgatttatacccaaaggattcctacaactttgattatttcattttaacctccataaaataa

SEQ ID NO: 22428 - protein, 129 aa, Unknown
  Obtained from environmental sample
  misc_feature (1)..(129): Xaa is any amino acid
MQKLFFLKKLFTILLFLSFAIRPMYYVGYVAYFQLNIDYIIDTYCVNKEKPQLACNGKCHLAXQIASPISDDNDSKAITTLAESFFPCIYSEYQYTLDASSLVFFNQKIHDLYPKDSYNFDYFILTSIK

SEQ ID NO: 22429 - DNA, 465 bp, Unknown
  Obtained from environmental sample
  misc_feature (1)..(465): n is a, c, g, or t
gtgttaccaaagatagatgctatatttaatcatgcattgaaatttcaaaaggcagcatatcttttgaacagaaacttagagcaagataattatgccttactcgtaccctacattacgaatatatctttttcaatagaattatactttaaagccttattatctactgaaggtaaagagataaagcaacacgacttaaaacttctttttgggtcgctttctgaactaagtcaaaaaagaattaatgctttgttcgtccaacttataggtaatagcaaaagtccaactttcaatgatgataattccttagaagctgttttggaagatatttctaatgcctttgttaaatctagatattattatgaaagtaatttagggggagtaagatatctcaaagaagttctcaactccgtaaaactaactttactagaaagacacgaggaattagagaagtacataaaaaactga

SEQ ID NO: 22430 - protein, 154 aa, Unknown
  Obtained from environmental sample
  misc_feature (1)..(154): Xaa is any amino acid
MLPKIDAIFNHALKFQKAAYLLNRNLEQDNYALLVPYITNISFSIELYFKALLSTEGKEIKQHDLKLLFGSLSELSQKRINALFVQLIGNSKSPTFNDDNSLEAVLEDISNAFVKSRYYYESNLGGVRYLKEVLNSVKLTLLERHEELEKYIKN

SEQ ID NO: 22431 - DNA, 648 bp, Unknown
  Obtained from environmental sample
  misc_feature (1)..(648): n is a, c, g, or t
atgttaaaatcaaagcatcaagatatcattgttagaatgnttgattcctttatgttttttatggataaatcaattgatattaccaaccaattaggaattattgggatgattataccagatgtaattctataccaaaaagataatactaaactgcgagaaaagattttaaaagaaactcatttgaatatcgcaattaatgtcggcgatggaatttttgatgaagtagcaaggccatcagcgattgttgtttactctaaaacgcaaaacgatagccctagtatcgttggtaatttcaataaatataatgatgtcgacattaatactattgacgtttgtgaggttgaaaaagatctgttttattcaatacctaatacagtatttgcgactcaaaacttaggtggatatgaaattttgaaaagacacaaaagcaagacccttaatgattttattgataaagatggaattcaaagaggtgttagccctgatcttaaagaggcattcatcgtagactctgaaactattaatcgtgagaaattagaaatagattatataaaaaagacggtaactggaggtgttgacgtgaaacgttattatacaattgatgtagataaaaccttttctatacatctaagagtgatgatcctttaa

SEQ ID NO: 22432 - protein, 215 aa, Unknown
  Obtained from environmental sample
  misc_feature (1)..(215): Xaa is any amino acid
MLKSKHQDIIVRMXDSFMFFMDKSIDITNQLGIIGMIIPDVILYQKDNTKLREKILKETHLNIAINVGDGIFDEVARPSAIVVYSKTQNDSPSIVGNFNKYNDVDINTIDVCEVEKDLFYSIPNTVFATQNLGGYEILKRHKSKTLNDFIDKDGIQRGVSPDLKEAFIVDSETINREKLEIDYIKKTVTGGVDVKRYYTIDVDKTFSIHLRVMIL

SEQ ID NO: 22433 - DNA, 645 bp, Unknown
  Obtained from environmental sample
  misc_feature (1)..(645): n is a, c, g, or t
ttgtgcataatagatgatggtaaaactattgcagttgtagaacttaagggaacaaacacaaaagaccttgagagcataagaagacaagcttttgattacaaagtaaatcataaaggctgtcgctttgtcattacctctaattttgaaaaattgcgtttgtacatagatgatgcaacggagcacgaaccctttgatttatttcaactgactttagaagattttagcttattgtatttatgtcttcacaaaaataatttacttaatgccttaccacttaaaatcaaacaagattctattgttaaggaagaagaaatcaccaaggatttctataaggattactcacgctttaaaagggaattgtatcgtgatcttgtaaaacggaataagaaaacgctcaaaattactttagccaatgaacaaggcaaaagcgaagacctagaacagcagggcgatattgaccgtttagagaaaaatgtaaagctaaccttgtttaaaaaatcgcaaaaacttattgatagattcttatttatattttttgctgaagaccgagacctactggattttaattacaccaaaaaggttttgcaggactggacagaagtgcgcaaactggatgtagatgagcctttgtacacaacgttttaa

SEQ ID NO: 22434 - protein, 214 aa, Unknown
  Obtained from environmental sample
  misc_feature (1)..(214): Xaa is any amino acid
MCIIDDGKTIAVVELKGTNTKDLESIRRQAFDYKVNHKGCRFVITSNFEKLRLYIDDATEHEPFDLFQLTLEDFSLLYLCLHKNNLLNALPLKIKQDSIVKEEEITKDFYKDYSRFKRELYRDLVKRNKKTLKITLANEQGKSEDLEQQGDIDRLEKNVKLTLFKKSQKLIDRFLFIFFAEDRDLLDFNYTKKVLQDWTEVRKLDVDEPLYTTF

SEQ ID NO: 22435 - DNA, 432 bp, Unknown
  Obtained from environmental sample
  misc_feature (1)..(432): n is a, c, g, or t
gtgtttttagggtttaatgctttaaatgaagcagaagaaaaaataatacaacaactactacataataaattagcaaccatttattgggacactgacaagcaatttatgaataataaaattcatgacgctggattgtttttaagacaacacaaaaacaaatggagctattttaatgatcatgattttaactggatcaacgaccattactcatctaaaaaaaacattaatatttttggtgtaccaaaaaatataggtcaagcaaaagcaataggaacaatactacaggatttaagtaaaaacgatgccagtttaaaaaatacagatgtagttttaggtgacgaaaacttattaattcccgtattaaattccngtacagaaatccgttcgacgttatatattaccatgcgaatttctttaaaaaccatccattag

SEQ ID NO: 22436 - protein, 143 aa, Unknown
  Obtained from environmental sample
  misc_feature (1)..(143): Xaa is any amino acid
MFLGFNALNEAEEKIIQQLLHNKLATIYWDTDKQFMNNKIHDAGLFLRQHKNKWSYFNDHDFNWINDHYSSKKNINIFGVPKNIGQAKAIGTILQDLSKNDASLKNTDVVLGDENLLIPVLNSXTEIRSTLYITMRISLKTIH

SEQ ID NO: 22437 - DNA, 510 bp, Unknown
  Obtained from environmental sample
  misc_feature (1)..(510): n is a, c, g, or t
atgaatcaagaagtaatacctgtttatctaatgcctggtatggctgctaatcctacgatatttgagcacattaaattgccggaaaatcaatttaaaatttactggttagaatggaaattacccaatccaaatgaaacattatcaagctatgcaaaacgcatgtgtgaagatgtaaaacatgataatccagtacttttaggtgtatcttttggagggattttagtgcaagaaatgagtaagtatattaagtacaataaaattataatagtatccagtgtaaagaccaaacacgagttgcctaaaagaatgcgtctgttgcgaatgacaaaagcatataaaatactacccacacaattacttagtaatngtgatttgtggnctaaatatgcgtttggtaatactataactaaacgtattgagttatataaaaaatatttgtcgggtagcgataaaatgtatctggattgnngcatacagcaagtggtttgttgggatcaagaccagcattaa

SEQ ID NO: 22438 - protein, 169 aa, Unknown
  Obtained from environmental sample
  misc_feature (1)..(169): Xaa is any amino acid
MNQEVIPVYLMPGMAANPTIFEHIKLPENQFKIYWLEWKLPNPNETLSSYAKRMCEDVKHDNPVLLGVSFGGILVQEMSKYIKYNKIIIVSSVKTKHELPKRMRLLRMTKAYKILPTQLLSNXDLWXKYAFGNTITKRIELYKKYLSGSDKMYLDXXIQQVVCWDQDQH

SEQ ID NO: 22439 - DNA, 438 bp, Unknown
  Obtained from environmental sample
  misc_feature (1)..(438): n is a, c, g, or t
gtgatggtcataaagtcaggcgtgctaacgtatattataattgaggtcagggatatatccatgtttgatatcaaatcattttttaaaagagaagtagaaaaaaaactcatcaatgtagacgattatatttttatgcctgagcgagtagagatggagctggaggacggattattaaattgtgtactcaacagtgatggtcgagtcgatattttttatagtaagcaaggcgtgacagaggtcagctcggcatcgcgtaagcatccctttacggcattcgaaaccgaactatatcatggtgtttatgatgacgttattaatgatttgatcaaagaagtagacaagattatcgatggctcttctaagtattttagtcgcagtaaaatactgccttttacagcagctctgtcacagagtccagttgacaaaaacaagttctaa

SEQ ID NO: 22440 - protein, 145 aa, Unknown
  Obtained from environmental sample
  misc_feature (1)..(145): Xaa is any amino acid
MMVIKSGVLTYIIIEVRDISMFDIKSFFKREVEKKLINVDDYIFMPERVEMELEDGLLNCVLNSDGRVDIFYSKQGVTEVSSASRKHPFTAFETELYHGVYDDVINDLIKEVDKIIDGSSKYFSRSKILPFTAALSQSPVDKNKF

SEQ ID NO: 22441 - DNA, 582 bp, Unknown
  Obtained from environmental sample
  misc_feature (1)..(582): n is a, c, g, or t
gtgctaaacgtgtatttcgtagatattatattaccaattcccatcgagaatttatttacgtatagcataacgcaagcggaatctacatttctaaaaaatggaatgcgcgtatctgttccgtttggtaaatcaaaaatttacacgggcattgtggggcatattcacaatacaccgcctattttatatgaagctaaagatattcatcaaattttagatgaagaacctattgttaacgagaagcaaatcgaattatggcaatggatttcgaaatattatatgtgcactattggcgaagtaatgcgtgctgcactacctaatgcttttattttagaaagtgaaaccattgtaagtttaaacaaagccacggttataaatgatgccgatttaaaagatgatgagtttttagtttacgaagctttaaatcagcagtcagcattaaaaatacaagacgtttctagcattttaaataagaaaaatgtgcttccaattattaaacggttaattgaaaaagaagccatttatgttgaacaagaaatttacgaaaatacaaagcaaatacgtaagatacgtgaagctaaatga

SEQ ID NO: 22442 - protein, 193 aa, Unknown
  Obtained from environmental sample
  misc_feature (1)..(193): Xaa is any amino acid
MLNVYFVDIILPIPIENLFTYSITQAESTFLKNGMRVSVPFGKSKIYTGIVGHIHNTPPILYEAKDIHQILDEEPIVNEKQIELWQWISKYYMCTIGEVMRAALPNAFILESETIVSLNKATVINDADLKDDEFLVYEALNQQSALKIQDVSSILNKKNVLPIIKRLIEKEAIYVEQEIYENTKQIRKIREAK

SEQ ID NO: 22443 - DNA, 606 bp, Unknown
  Obtained from environmental sample
  misc_feature (1)..(606): n is a, c, g, or t
atgactaaccatattattgataataaatacataaacagagagttaagttggctacaatttaaccatcgtgttttacaagaagctgccgacgagtctgtacctttgattgaaagacttcgttttttaggaattttttctaataatctagacgaatttttcaaggttagatacgcaaccgttaaacgtatcgattacgctggtagagctggtaaaagccagcttggtggaataaaagcttctgagttgttggagattattaccaacatagttataaagcatcaaaccgaaagtttaaagattttaagtgatattcaaaaaaagttagaagcagagaatattttcattttaagagaatctaaaatcacaaaagctcaaaagcaatatcttagaaagtactttttagaaaaagttagcccagctcttgttaccattgttttaaataccgaaatcaagttacctaatcttaaagatagtgcagcttatctagcggtaaatatgcatttaaaagatggagaaaatcaatacgctttaatagaaatatctaaaaatatggatcgatttatcgtgttgccaaaagttggcgatactgatatattatcctgttag

SEQ ID NO: 22444 - protein, 201 aa, Unknown
  Obtained from environmental sample
  misc_feature (1)..(201): Xaa is any amino acid
MTNHIIDNKYINRELSWLQFNHRVLQEAADESVPLIERLRFLGIFSNNLDEFFKVRYATVKRIDYAGRAGKSQLGGIKASELLEIITNIVIKHQTESLKILSDIQKKLEAENIFILRESKITKAQKQYLRKYFLEKVSPALVTIVLNTEIKLPNLKDSAAYLAVNMHLKDGENQYALIEISKNMDRFIVLPKVGDTDILSC

SEQ ID NO: 22445 - DNA, 510 bp, Unknown
  Obtained from environmental sample
  misc_feature (1)..(510): n is a, c, g, or t
atggtctctatggagattcaagcacgttttgacgaagaagctaatatcgcttacgcggaacaaatgcagcgtgaaggtgtacaattaatatttggagtacaaggtcttaaagtgcatagtaaaatgtgtattattgaaagggaagaggacaagaaaataaagcgatatggatttataagcactggtaactttaacgagtctacagccaaaatatatacagactatactttatttactgctaaccaaagaatacttaaagacgtcaataaagtgtttaacttttttgaagttaattataaaatttacagatttaaacatataattacatcacctcattacacaaaaaataagttttttaatcttatagatagagagattaataatgttaaagaaggtaaacctggttatataaaacttaaaatgaatagtatatctaactatccaatgatagataactatacgaagcaagtcaagcaggagttaaatacaaatgatagttcgtgnatttaa

SEQ ID NO: 22446 - protein, 169 aa, Unknown
  Obtained from environmental sample
  misc_feature (1)..(169): Xaa is any amino acid
MVSMEIQARFDEEANIAYAEQMQREGVQLIFGVQGLKVHSKMCIIEREEDKKIKRYGFISTGNFNESTAKIYTDYTLFTANQRILKDVNKVFNFFEVNYKIYRFKHIITSPHYTKNKFFNLIDREINNVKEGKPGYIKLKMNSISNYPMIDNYTKQVKQELNTNDSSXI

SEQ ID NO: 22447 - DNA, 369 bp, Unknown
  Obtained from environmental sample
  misc_feature (1)..(369): n is a, c, g, or t
atgaacgctccaagtggaggacctttagtacaacatgctgttattgcacttttagaaaaggtaaaagaaggcgtaattccgattgaaaaattggtggaaaaaatgagccataatcctgctaaattgtttcaaattgaaaaacgtggttttataaaagaaggtttttatgcagatttggttttaattgataccaacaaagcacaaattgtttctaaagataatattttatacaaatgtggttggtctccttttgaaggaactaccttttcatcaaccataactcatacatttatcaatggaaatttaatgtataataatggcgtttttaatgatgaaattaagggaaaacgaatcacttttaatcgttaa

SEQ ID NO: 22448 - protein, 122 aa, Unknown
  Obtained from environmental sample
  misc_feature (1)..(122): Xaa is any amino acid
MNAPSGGPLVQHAVIALLEKVKEGVIPIEKLVEKMSHNPAKLFQIEKRGFIKEGFYADLVLIDTNKAQIVSKDNILYKCGWSPFEGTTFSSTITHTFINGNLMYNNGVFNDEIKGKRITFNR

SEQ ID NO: 22449 - DNA, 441 bp, Unknown
  Obtained from environmental sample
  misc_feature (1)..(441): n is a, c, g, or t
atggcgtttttaatgatgaaattaagggaaaacgaatcacttttaatcgttaatatgaaaaacatactttatatatttttactgattttattggtttcttgtacaagtaataccatttttgaaaaaccagacgatttaattccaaaagacaccatgagtcttttggtacaggaaatgtctattgctacctctgcaaaatatatcaacaataaaaacttagaaacaagggtacattatatgcctttggtgtatgagcgtcctggaattgattctgtccgttttcaaacaagtaatttgtattacatgtctaaaatagatgattatcacgaaatttttgcaaacgctaaaaacaanttagaaaatccaaaatctgcgtctgatacaattaagaaaagaccagattcgttaagagcagattctattcacaaggtaaagatttga

SEQ ID NO: 22450 - protein, 146 aa, Unknown
  Obtained from environmental sample
  misc_feature (1)..(146): Xaa is any amino acid
MAFLMMKLRENESLLIVNMKNILYIFLLILLVSCTSNTIFEKPDDLIPKDTMSLLVQEMSIATSAKYINNKNLETRVHYMPLVYERPGIDSVRFQTSNLYYMSKIDDYHEIFANAKNXLENPKSASDTIKKRPDSLRADSIHKVKI

SEQ ID NO: 22451 - DNA, 357 bp, Unknown
  Obtained from environmental sample
  misc_feature (1)..(357): n is a, c, g, or t
atgacagatacagaatttccattctttttttgttacgcctttgacttagaaataggagaatatgagagcgaaattttatcttttgcagaaactgtagatattcgagatattacaaaagtatccactactctacaagatgatggtaactttctaatttcagtttatctttcaggcaaatatccatcagtacgttacttgaaaaatagtaatacaaaagaaataagaattaaagaatatttaccaaaaatgaaaatacaacttggttcgaatagggaggcttcattgcaaattaaaaaagcattaattcacttaggtaagattaataatatatccattaaagacggagatttattttaa

SEQ ID NO: 22452 - protein, 118 aa, Unknown
  Obtained from environmental sample
  misc_feature (1)..(118): Xaa is any amino acid
MTDTEFPFFFCYAFDLEIGEYESEILSFAETVDIRDITKVSTTLQDDGNFLISVYLSGKYPSVRYLKNSNTKEIRIKEYLPKMKIQLGSNREASLQIKKALIHLGKINNISIKDGDLF

SEQ ID NO: 22453 - DNA, 312 bp, Unknown
  Obtained from environmental sample
  misc_feature (1)..(312): n is a, c, g, or t
ttggggatacttcactatatttatcactttaaaacaaaattaacatatgtattatattatcgttgctttgcaagtgtattgcatctatcatcttataaaaaacagggatcagtactattggatttttttaatttattcattccagccattgggtctgctatctattttataacacaagtgtataataagcgtgatgccgaaaaaatacagacggtttactgctgttttacaccgtctaaaaataaagatttaagaaaagctgagttttcaaaacgttcaaataaatcatttagcgaagcctattcgaaatga

SEQ ID NO: 22454 - protein, 103 aa, Unknown
  Obtained from environmental sample
  misc_feature (1)..(103): Xaa is any amino acid
MGILHYIYHFKTKLTYVLYYRCFASVLHLSSYKKQGSVLLDFFNLFIPAIGSAIYFITQVYNKRDAEKIQTVYCCFTPSKNKDLRKAEFSKRSNKSFSEAYSK

SEQ ID NO: 22455 - DNA, 414 bp, Unknown
  Obtained from environmental sample
  misc_feature (1)..(414): n is a, c, g, or t
atgaaaaccgtactactacttttatcaatactagtctctagttacagtttagctcaggataaaaacacacattattatacatttaatttagagcaagaagtatctaaacaggaatttcaaaaaatatattctaactatgacacatatcagaatgttgttgaaataagaaaaaatgatagtactattattaaaatgtttcatcctagaaaacaatttgatgtattagatcccatagttttagattccttaaaagggtatttaaactatctaactaataaaaaaaacgtctttaaagattatattgttattaactacttttctggaaacgaaccttttagagagtttcctactgaatcaaatcagtatgtagaagattataattacagcaaaaaaataaataaactactccattga

SEQ ID NO: 22456 - protein, 137 aa, Unknown
  Obtained from environmental sample
  SIGNAL (1)...(18)
  misc_feature (1)..(137): Xaa is any amino acid
MKTVLLLLSILVSSYSLAQDKNTHYYTFNLEQEVSKQEFQKIYSNYDTYQNVVEIRKNDSTIIKMFHPRKQFDVLDPIVLDSLKGYLNYLTNKKNVFKDYIVINYFSGNEPFREFPTESNQYVEDYNYSKKINKLLH

SEQ ID NO: 22457 - DNA, 546 bp, Unknown
  Obtained from environmental sample
  misc_feature (1)..(546): n is a, c, g, or t
atgattggatctattcttcaaagagcaacaaaaaattcaattatttggggaagtggatttattgcagctgatgtagaatgtgctgaaataccaaaaaaagtattggccgttagagggccattgacaagacgtaaattactccaatcaggtatcgaatgtcctgaaatatatggcgatccagctttattattgccagaaatatatccaggggaaaagaaaaaaccaatatataaaataggaatcattccacactacttagacaaaaaagaccaagaacttcaaaaatttacgaaacatcctgatatcaatattatcgaccttcaaaatataaatcccatgaaggttgttgatcaaatgctgaactgtgaaagaatactatctagctcattacttggagtcattgtggctgatgcctataaaataccatcgatctgggtccaatttccattcctttggagggctggaatttcacatttcaagattatttcattctgtgaaaagaacagttcagtcctattcattcaaggtttcaagtttaacgcatga

SEQ ID NO: 22458 - protein, 181 aa, Unknown
  Obtained from environmental sample
  misc_feature (1)..(181): Xaa is any amino acid
MIGSILQRATKNSIIWGSGFIAADVECAEIPKKVLAVRGPLTRRKLLQSGIECPEIYGDPALLLPEIYPGEKKKPIYKIGIIPHYLDKKDQELQKFTKHPDINIIDLQNINPMKVVDQMLNCERILSSSLLGVIVADAYKIPSIWVQFPFLWRAGISHFKIISFCEKNSSVLFIQGFKFNA

SEQ ID NO: 22459 - DNA, 549 bp, Unknown
  Obtained from environmental sample
  misc_feature (1)..(549): n is a, c, g, or t
ttggaaatagaagaagcaataaaaagagccaaacaaaacgaccaaaaagcgtttaattatttacttcataattattgggataaggtttatggttttcaacttaaacgcatccaaaatgaaaacgatgcagaagacattaccattcaaactttctctaaagcttttgacaaaataaaaacttacgacagcaaatacgcatttaatacttggttaattacaatttctaaaaacattcatattgatattattagaaaacaaaaaaacagcattaaacaagctatttcaagtacagatgacaatgctgtctatcaagttttagacgaaacaccatctgttgaagacaaactaattacagaacaaaatttagctaaattacttcgtgacattaaaaagctaaaaccacattatcaagaagtaataaacctaagatactttcaagaattaagttacaaagaaatttctgacgagctaaaagagccaattaataatataaaagtaaagttacttcgtgctaaaaaattattagcagaaattattcaaaaaaagtaa

SEQ ID NO: 22460 - protein, 182 aa, Unknown
  Obtained from environmental sample
  DOMAIN (2)...(180): ECF sigma factor
  misc_feature (1)..(182): Xaa is any amino acid
MEIEEAIKRAKQNDQKAFNYLLHNYWDKVYGFQLKRIQNENDAEDITIQTFSKAFDKIKTYDSKYAFNTWLITISKNIHIDIIRKQKNSIKQAISSTDDNAVYQVLDETPSVEDKLITEQNLAKLLRDIKKLKPHYQEVINLRYFQELSYKEISDELKEPINNIKVKLLRAKKLLAEIIQKK

SEQ ID NO: 22461 - DNA, 546 bp, Unknown
  Obtained from environmental sample
  misc_feature (1)..(546): n is a, c, g, or t
ttgctatacgcgcgggcaagtgatgcttacagttacaatacaggcgataaaatgataagctataacgatgagcaaattaaagacttaattataagcgattttaaaggtaagcgcataaatattttagcgcctgtagtccgttctcgtaaaggacattatcgcgaactattcgagcaaatcgcaaaacaaggttttgtaaaggtaagaacagacggtgagattgtagaccttaaaaaagggatgaaactggatcgctataaaatgcatgatatcgaaattgtaatcgatagactaaaaatagacgatagtacggaaaatgataaacgtttagccgaaaccataaatacagcaatgtatcatggagacgatgtgcttttagtaatcgatcaagatacgcaagaagcacgttattttagtcggaatttaatgtgtccgagttctggtatatcatatcccaatccagaaccaaataatttttctttcaactctccaaaaggtgcttgtagcaactgtaatggtattggcgaactctatctaggtaaatga

SEQ ID NO: 22462 - protein, 181 aa, Unknown
  Obtained from environmental sample
  misc_feature (1)..(181): Xaa is any amino acid
MLYARASDAYSYNTGDKMISYNDEQIKDLIISDFKGKRINILAPVVRSRKGHYRELFEQIAKQGFVKVRTDGEIVDLKKGMKLDRYKMHDIEIVIDRLKIDDSTENDKRLAETINTAMYHGDDVLLVIDQDTQEARYFSRNLMCPSSGISYPNPEPNNFSFNSPKGACSNCNGIGELYLGK

SEQ ID NO: 22463 - DNA, 393 bp, Unknown
  Obtained from environmental sample
  misc_feature (1)..(393): n is a, c, g, or t
gtggaacctctaacaggaactgtattatacggcggtattacaacagttgatgcttttaagcaatgcaagaacagtttccatctatcgatcaattttatgattggtcgcggtttaattgccgatccgtttttgccgagtatgattaaaaataacacgacagaatatcctaaaaaccgctggtttatttttaaagagtttcacgatgaaatttatcaccaatacgatgcaacactttcgggtcctacacctataaaaatgaaaatgttaggcttttgggaatacttttctcagtcatttactaatccgcagaaaacctataagaaaatcaaaaaagcatcaaatcctgcaaaatatcaagcggcggttgctgaaattctgtcttcagaaaaataa

SEQ ID NO: 22464 - protein, 130 aa, Unknown
  Obtained from environmental sample
  misc_feature (1)..(130): Xaa is any amino acid
MEPLTGTVLYGGITTVDAFKQCKNSFHLSINFMIGRGLIADPFLPSMIKNNTTEYPKNRWFIFKEFHDEIYHQYDATLSGPTPIKMKMLGFWEYFSQSFTNPQKTYKKIKKASNPAKYQAAVAEILSSEK

SEQ ID NO: 22465 - DNA, 693 bp, Unknown
  Obtained from environmental sample
  misc_feature (1)..(693): n is a, c, g, or t
gtgacctttggtaataccgacacgaaacaggtaatgcgacctcgtattgatatttttgctcttaatgaacaaatgaaatttctagaggtaataggtgaaataaagaaacacggttattctcgaattcccgtatttggtgaaaacatagacactgtcaaaggcgtgttgtatgtaaaagatttgttgccttatttagatagaaagacatttaattggatgaccttaatacgtgaaccgtatttcgttcctgaaaataagaagcttgatgatttattagcagaatttcaggaaaagaaaaatcacttagcaattgtggtcgatgaatatggtggaacttctgggttggtcacattagaagatattattgaggaaatagttggtgatattagtgatgaatttgatgatgaagatttgattttttctaagttagatgattttaattacgtttttgaaggtaaaactccactcaaagatttttaccgtgtaataaaattagaagacaacgatttctttgaagaaaataaaggagaatcggaaactcttgcaggatttgtcttagagaaagcgggaagttttccaaagcgaggtgaaaagatattatttgaatcttacacttttatggttgagagcatggataacaaaagattgaaccacattaaagtaaccctgcctcatgaagctttaaatcgttag

SEQ ID NO: 22466 - protein, 230 aa, Unknown
  Obtained from environmental sample
  DOMAIN (141)...(225): Transporter associated domain
  misc_feature (1)..(230): Xaa is any amino acid
MTFGNTDTKQVMRPRIDIFALNEQMKFLEVIGEIKKHGYSRIPVFGENIDTVKGVLYVKDLLPYLDRKTFNWMTLIREPYFVPENKKLDDLLAEFQEKKNHLAIVVDEYGGTSGLVTLEDIIEEIVGDISDEFDDEDLIFSKLDDFNYVFEGKTPLKDFYRVIKLEDNDFFEENKGESETLAGFVLEKAGSFPKRGEKILFESYTFMVESMDNKRLNHIKVTLPHEALNR

SEQ ID NO: 22467 - DNA, 855 bp, Unknown
  Obtained from environmental sample
  misc_feature (1)..(855): n is a, c, g, or t
atggctcggatgagaatttcagtgcttttttttatgttttgtgtatttgcttcttgcgaatattttcaagttgaagaaaaagaaagcacaacatcagaaattgtagcgattgtaaataccgaaaaactttttagagacgatttagtaaatgtagtgccaaataataccagcagagaagatagtattgttttggtaaaaggttttattaatgattgggctgtaaaacaattattgttaagtaacgcagaaagtaacagctctttagaagaagttacagaaattaactctttagtaaaagattacaaagaaagtttacttattaatagttacaaagaaaggcttataaatcagcaattagatactgttattagtgaaactgaaatagctcttttttatgaaaataataaagagaattttaaactgaatgaggagttattaaaaataaaataccttcattttgataacaatattatcaataaaaaagaatttataaaactttttcaatctgataaaattgaagatttagaagcattagaaaaacaacaattaagttttaaatattaccaatttaacgattcaatttggacacaattagataaggttttgttaaaactgccattttctaaagaaaatctgttaaataaaacaaaattcctccaaaaacaagattcattaggtttatatttggtggctataaacgatgttttaattaggaatgatacagctcctttaagctatatagaacccaccataaaacaaatgattttacacagacgtaaaattgaattaattagagatatagaaaaaatattagtaaaagatgcaacaaaaaacaacaattttaaaacatactaa

SEQ ID NO: 22468 - protein, 284 aa, Unknown
  Obtained from environmental sample
  SIGNAL (1)...(17)
  misc_feature (1)..(284): Xaa is any amino acid
MARMRISVLFFMFCVFASCEYFQVEEKESTTSEIVAIVNTEKLFRDDLVNVVPNNTSREDSIVLVKGFINDWAVKQLLLSNAESNSSLEEVTEINSLVKDYKESLLINSYKERLINQQLDTVISETEIALFYENNKENFKLNEELLKIKYLHFDNNIINKKEFIKLFQSDKIEDLEALEKQQLSFKYYQFNDSIWTQLDKVLLKLPFSKENLLNKTKFLQKQDSLGLYLVAINDVLIRNDTAPLSYIEPTIKQMILHRRKIELIRDIEKILVKDATKNNNFKTY

SEQ ID NO: 22469 - DNA, 723 bp, Unknown
  Obtained from environmental sample
  misc_feature (1)..(723): n is a, c, g, or t
atgaaagcgattattaattctgatgatcctacagtagctcaaaatggtggaaacttaggagaaattaccaaagaaactacttttattaaagagtttaaagaaatggctttttctttagatccaaatcaaatttcaaaaccttttaaaacagattttggttatcatattataaagttgcacgaaattaaaggaaatgcaagagtagtttctcatattttaatgcaaccagaaattcctgatgcaaaacttacggaaacaagagaaactgcagaaaaattaatcgctgatattagtgaaggtaaaattacttttgaagaggctgtaaaaaaatactcagatgatgctgaaactaataataatggaggtttaatccttaacccttatacaggtgaatctacattcgaattaacaggtatggatcctgctttatatgcaagagttgcagaattaaagaaaggtgagtttacagaagtttttttcgatcaaaatagaagtggtgaaaaaatgtacaaattcatgattatgagagatagaacagatactcatattgcagatattgtaaatgattatgtaaaaattcaagaattagctttaaccaaaaagaaagaagaaaccattacaaaatgggcaaaaagcaaaattcaagatacttacattaaaatggcagatgaccatagaaaatgtacgttcgaaaaaaattggaaaaaagaaacaggtaaataa

SEQ ID NO: 22470 - protein, 240 aa, Unknown
  Obtained from environmental sample
  DOMAIN (71)...(163): PPIC-type PPIASE domain
  misc_feature (1)..(240): Xaa is any amino acid
MKAIINSDDPTVAQNGGNLGEITKETTFIKEFKEMAFSLDPNQISKPFKTDFGYHIIKLHEIKGNARVVSHILMQPEIPDAKLTETRETAEKLIADISEGKITFEEAVKKYSDDAETNNNGGLILNPYTGESTFELTGMDPALYARVAELKKGEFTEVFFDQNRSGEKMYKFMIMRDRTDTHIADIVNDYVKIQELALTKKKEETITKWAKSKIQDTYIKMADDHRKCTFEKNWKKETGK

SEQ ID NO: 22471 - DNA, 498 bp, Unknown
  Obtained from environmental sample
  misc_feature (1)..(498): n is a, c, g, or t
atgaaacaattaaaaataggtattcaaattatttttattgttgctgtaataattcattttacggttaaagattacttctatgcgtctgccatcatcttttatgcatttccgcttccaattatcatgctattaacttctttttcaattatagttaataagaaatggcgcaaaatctccatgttatttctactagttttaagtgttatctggtattttaaaagctatgtttcaaaccataataacacaagtaaaaatggtttggaaattgtggtttggaatgctggacataatcaaagttttgaagaggcttttattgaaaacaaacaaattccagatgtcttggttttaatagaatgtaatttaaaatccattcaaaaaacgcaaaatacatatccaaattattactttcacttatcggaagaagaaattggcattttctcaaaaacacctttaaaaatcattagtgaaataacttctgaaccaattctaccgttttaa

SEQ ID NO: 22472 - protein, 165 aa, Unknown
  Obtained from environmental sample
  misc_feature (1)..(165): Xaa is any amino acid
MKQLKIGIQIIFIVAVIIHFTVKDYFYASAIIFYAFPLPIIMLLTSFSIIVNKKWRKISMLFLLVLSVIWYFKSYVSNHNNTSKNGLEIVVWNAGHNQSFEEAFIENKQIPDVLVLIECNLKSIQKTQNTYPNYYFHLSEEEIGIFSKTPLKIISEITSEPILPF

SEQ ID NO: 22473 - DNA, 654 bp, Unknown
  Obtained from environmental sample
  misc_feature (1)..(654): n is a, c, g, or t
atgattgacaaggtgttattagaacatttagaaagttatttaacaccacatcggttggagcgttttaattacgttatcaatcagcgcaccaaacattttacagtggctaccgaagatgtgtatcaattacataatacgagtgctgttattcgtanctgtgatgtgtttggtattcaagaagtgaatattgtagaggaaataaattctaagcgcatagaccgcgaaattgctatgggagctcagaaatgggtagatttaaatcgctaccattctataaaagattgtattgccgatgtgaaaagtaaaggctaccaaattgtagcaacgacaccgcataccgacgactgtgaactacacgattttgacgtgacaaaaaagtcttgttttttcttcggaagagaaacagaagggttgtcgcaagaagttttagatgaagcagatgtgtttttaaaaatcccgatgtctggatttaccgagagtttaaatatttcggtttctgcagccattattttacaacacgttaccacaaaattgaaaaaaacaactctagagtggggcttaaccgaagatgaaaaacttcaaaaacgattggattggtgtaccaaaacaataaaaagtcacgaagaaattatagctcgattttataataaatag

SEQ ID NO: 22474 - protein, 217 aa, Unknown
  Obtained from environmental sample
  DOMAIN (32)...(172): SpoU rRNA Methylase family
  misc_feature (1)..(217): Xaa is any amino acid
MIDKVLLEHLESYLTPHRLERFNYVINQRTKHFTVATEDVYQLHNTSAVIRXCDVFGIQEVNIVEEINSKRIDREIAMGAQKWVDLNRYHSIKDCIADVKSKGYQIVATTPHTDDCELHDFDVTKKSCFFFGRETEGLSQEVLDEADVFLKIPMSGFTESLNISVSAAIILQHVTTKLKKTTLEWGLTEDEKLQKRLDWCTKTIKSHEEIIARFYNK

SEQ ID NO: 22475 - DNA, 468 bp, Unknown
  Obtained from environmental sample
  misc_feature (1)..(468): n is a, c, g, or t
gtgattaaaccaagagaaaaagcaccagaattacaaatcaaattagtaaacaatacaacatggaaattaagcgatcagtcgccagaaaatttcacgttagtattattttatagaggtaaacattgtcctgtttgtaaaagtcagttagaagaacttcaaaaaaagttagataaatttacagatagaggcgtaaatgttattgccatcagttctgatacagaagacgtcgcaaaagcaacacataaagcatgggacatttcaaatattccgttaggctacgatttttcaattgacgaagctagaaaatggggattatttatttcttcaggaattaaagaagaaccagaattatttacagagcctggattatttttaattacaccagatcaaaccgtgtattgggaatctatccaatccatgccatttggaagaccaggttttaatgatgttttaggtggtattgnnngn

SEQ ID NO: 22476 - protein, 156 aa, Unknown
  Obtained from environmental sample
  DOMAIN (4)...(152): AhpC/TSA family
  misc_feature (1)..(156): Xaa is any amino acid
MIKPREKAPELQIKLVNNTTWKLSDQSPENFTLVLFYRGKHCPVCKSQLEELQKKLDKFTDRGVNVIAISSDTEDVAKATHKAWDISNIPLGYDFSIDEARKWGLFISSGIKEEPELFTEPGLFLITPDQTVYWESIQSMPFGRPGFNDVLGGIXX

SEQ ID NO: 22477 - DNA, 627 bp, Unknown
  Obtained from environmental sample
  misc_feature (1)..(627): n is a, c, g, or t
gtggcatcagacatcaataaacctaatggacaaaaaacaatacctccagaagaagttattgcttttttagaagagctacctattgaaaaattttatggtattggaaaagttactgctgctaaaatgtacaatttaggaatttttacagggaaagacttaaaagaaaaatcgttaacgtttttgactaaacattttaaaaaatcggggagccattattttaacatagttagaggaatacaacatagcgttgttaaaccagataggatacgaaaatcagtagcaactgagcatacatttaatacaaaccttacttcagagatctatatgctggaaaaacttgaacatatagctacagaattggaaattcgcctgaaaaaatcaaaaatcttaggtaaaaccattaccttaaaaattaagtatagtgatttttcattgcagaccagaagtaaaacgttgcaatttttttttaatgataaagaaatattgctcaaagtgaccgaagagcttttatttcaagaaaaaatgaacgactctgttagattattaggaatatctcttacaaatttaaatacgaatctaaaatatacagaggaggcttttgatatacaattaaaattggagttttaa

SEQ ID NO: 22478 - protein, 208 aa, Unknown
  Obtained from environmental sample
  DOMAIN (1)...(191): impB/mucB/samB family
  misc_feature (1)..(208): Xaa is any amino acid
MASDINKPNGQKTIPPEEVIAFLEELPIEKFYGIGKVTAAKMYNLGIFTGKDLKEKSLTFLTKHFKKSGSHYFNIVRGIQHSVVKPDRIRKSVATEHTFNTNLTSEIYMLEKLEHIATELEIRLKKSKILGKTITLKIKYSDFSLQTRSKTLQFFFNDKEILLKVTEELLFQEKMNDSVRLLGISLTNLNTNLKYTEEAFDIQLKLEF

SEQ ID NO: 22479 - DNA, 867 bp, Unknown
  Obtained from environmental sample
  misc_feature (1)..(867): n is a, c, g, or t
atggatactaaagaattactaaaaaaagtacgtaagattgagatcaagacacgccgtttgtctgatcatatttttggaggagaataccattctacctttaaagggcgtggtatgactttttctgaagtgcgacagtatcaatttggtgatgatgtaagaaatatagattggaacgttaccgcgcgttataacgaaccttatattaaagtttttgaagaagaacgcgaactcactatgatgcttctcgtcgatgtgtcggcatctaatgcctttggaacacaagaacaatttaaaaatgaaatggctaccgaaattgcggcaaccctagctttttcagcaacacagaataacgataaaattggactcattttattttcggatgatattgaactttatattccaccaaaaaaaggccgttctcacgtattaagaattatacgcgaactcatagaatttaaaccgaagagtaagcataccgatttcgctaaagcattaaagtttttacacaacgtaatgaagaaaaaagcgattgtatttattttgagtgattttatttctgaagattataaacaaacgctaaaaatagcagctaaaaagcacgacattaccggtattcgcgtgtacgataagagtgaaggggctattcctaatttaggactcgtgcaaatggaagatgccgaaacaggagctttacaatacataaatacggcctccaaaaaagtaagaaccgagtatggcgcattctataacagtaaagtagattattatagaactagtttttcgaaatctggtgcaggagcaattagctgtgccacaaacgaaagctatgtaaaaaaattattagggtattttaaacgcagaagataa

SEQ ID NO: 22480 - protein, 288 aa, Unknown
  Obtained from environmental sample
  misc_feature (1)..(288): Xaa is any amino acid
MDTKELLKKVRKIEIKTRRLSDHIFGGEYHSTFKGRGMTFSEVRQYQFGDDVRNIDWNVTARYNEPYIKVFEEERELTMMLLVDVSASNAFGTQEQFKNEMATEIAATLAFSATQNNDKIGLILFSDDIELYIPPKKGRSHVLRIIRELIEFKPKSKHTDFAKALKFLHNVMKKKAIVFILSDFISEDYKQTLKIAAKKHDITGIRVYDKSEGAIPNLGLVQMEDAETGALQYINTASKKVRTEYGAFYNSKVDYYRTSFSKSGAGAISCATNESYVKKLLGYFKRRR

SEQ ID NO: 22481 - DNA, 870 bp, Unknown
  Obtained from environmental sample
  misc_feature (1)..(870): n is a, c, g, or t
ttgaatttaagcaccaacgatattagaaatatagaaactattttaaagcgtgccgatttagtaaaattcgcaaaatctgcgcccgatgtggcactagctgaaatagatagaaaaacggtagatttagaaattgatcaagtaaagagtgcacttccagagcctacagaagtagagaaattacaagacaaacgttataaagaagaacaagagcgacgtaaaaagaagaaaaaagtggtgttaaccgtaatcctttctttagtgttagtttttgcaacattcgttggttttattgcaacctatgggtttacttatgtaaaagatacgattattggtaacgaaactaaagccttgcttgaaggccattgggtgactagtgagtatggttttccaccgattacgatctctactccagaagtgttaaaacgtgtggaagcgccaattccagatgcactgaaagcgcaagtaaaaaatacaatgtttagctatggtcgtttaattggtaatttaaatattgtggtgacaacaacaacatttactgcgccacaacagcaacaaggcgaaacacagcaagaaccaaaaatcgatttaaatcaagcggtcgacggtgctctaaaagaatgggaaaatcgcggggctataaatatagtacttaataaagaaaaatttgtaacaccacgaggagccgaaggtttaaaagcatttggtactgccgatttgccctcagtactctctgaaaaaactgaaaaaggaaaatatgttatttttagttttacctctcaaaatgtgttgcaacaagtgctattaagttggaaagataatgacgattatgccgaagatattatagaacgtattatcaattcaattgaataa

SEQ ID NO: 22482 - protein, 289 aa, Unknown
  Obtained from environmental sample
  misc_feature (1)..(289): Xaa is any amino acid
MNLSTNDIRNIETILKRADLVKFAKSAPDVALAEIDRKTVDLEIDQVKSALPEPTEVEKLQDKRYKEEQERRKKKKKVVLTVILSLVLVFATFVGFIATYGFTYVKDTIIGNETKALLEGHWVTSEYGFPPITISTPEVLKRVEAPIPDALKAQVKNTMFSYGRLIGNLNIVVTTTTFTAPQQQQGETQQEPKIDLNQAVDGALKEWENRGAINIVLNKEKFVTPRGAEGLKAFGTADLPSVLSEKTEKGKYVIFSFTSQNVLQQVLLSWKDNDDYAEDIIERIINSIE

SEQ ID NO: 22483 - DNA, 342 bp, Unknown
  Obtained from environmental sample
  misc_feature (1)..(342): n is a, c, g, or t
atgaaaatgagacatggcttgtacgtcgatggtggtgtacttaacaactttcctgtggacgtgctacaaaaagaatgcgatcaaattattggcgtttatttaaatttatataaaaccaaaacagaagcgcaattaaaacattttcataatattattgagcgttccattactttaggtgctgtaaaaacagatatggaaaagttttcaaattgtgatgttttaatagcacctcaagcactaagtcaatttgcactttttgacaaaaaaaatatcgatgctatttataaaattggttacgatagcatgaaagacgtcttaaaaaaccaaaaatcaaagacttaa

SEQ ID NO: 22484 - protein, 113 aa, Unknown
  Obtained from environmental sample
  misc_feature (1)..(113): Xaa is any amino acid
MKMRHGLYVDGGVLNNFPVDVLQKECDQIIGVYLNLYKTKTEAQLKHFHNIIERSITLGAVKTDMEKFSNCDVLIAPQALSQFALFDKKNIDAIYKIGYDSMKDVLKNQKSKT

SEQ ID NO: 22485 - DNA, 720 bp, Unknown
  Obtained from environmental sample
  misc_feature (1)..(720): n is a, c, g, or t
atgattggtagtcaggttattgaaattagaaatttaaaatctccaaaaggaacattcttattagggcatttaccacaatttaatacctataataagcatcaggttttagaacggtgggtcgaagagtccggcgaattatttaaaatacattttgttgggaaggaatttgtggtttctgcaaatccagattttaataataaaatgttgagattaagaccagaaggatttaaacgtttctctaagattgatgaaattttaaaggaaatgggagtcgatggtgtttttaacgcagaaggaacgtcgtggaaacgacatagaaaaccaacagctgaagctttaagtgtaaaaaatgtgaaagcattttaccctataattcttgataagaccaagatcattctcgaaaaatttaaaaactattcgcatgaaagtacgatagtagatgtgcaaaaagaatttatggcatttacaatcgatgtgactaccgagattgctttcggacataagctggatactataaataacaagtcgaatcgttttcaaaagcatttagaagtcatttttccaatgattaatgcacgtgttacagcgccatttcctatatggaggtactttaaaagaaaaaaagataaaacacttgataactcattaaagtctattgaaaaagtaatctatgaatttattgatgatgctaaaaagagaatagcagaaaatccgaaataa

SEQ ID NO: 22486 - protein, 239 aa, Unknown
  Obtained from environmental sample
  misc_feature (1)..(239): Xaa is any amino acid
MIGSQVIEIRNLKSPKGTFLLGHLPQFNTYNKHQVLERWVEESGELFKIHFVGKEFVVSANPDFNNKMLRLRPEGFKRFSKIDEILKEMGVDGVFNAEGTSWKRHRKPTAEALSVKNVKAFYPIILDKTKIILEKFKNYSHESTIVDVQKEFMAFTIDVTTEIAFGHKLDTINNKSNRFQKHLEVIFPMINARVTAPFPIWRYFKRKKDKTLDNSLKSIEKVIYEFIDDAKKRIAENPK

SEQ ID NO: 22487 - DNA, 435 bp, Unknown
  Obtained from environmental sample
  misc_feature (1)..(435): n is a, c, g, or t
atgtcttggccgcttcacactatgttaattaataacgtcattccaaaaacagaaacggctgaaaaggtcattgcgagtggtgattgtgttgcaattactttgttattagaaatgtatgactttaatgaaatgatcgttgagttcgcacaaactataattgatgatggtgataactacgaaaaagataactattggttattactttatcaactatacctaaagggcctaattgataatccgtatgatgacaaagtatttgagtgtttgaaaaaatacaaggttaattttatacctcgaaatacgaaaactaaagctgaaaaaaactgtgatagaattcaaagtgaaatgacatcaaatgcactaaaaaacgtattttcagaagtgaaaatacctgctgtacataaaaaaacagatgaaaactcgacggttttctag

SEQ ID NO: 22488 - protein, 144 aa, Unknown
  Obtained from environmental sample
  misc_feature (1)..(144): Xaa is any amino acid
MSWPLHTMLINNVIPKTETAEKVIASGDCVAITLLLEMYDFNEMIVEFAQTIIDDGDNYEKDNYWLLLYQLYLKGLIDNPYDDKVFECLKKYKVNFIPRNTKTKAEKNCDRIQSEMTSNALKNVFSEVKIPAVHKKTDENSTVF

SEQ ID NO: 22489 - DNA, 642 bp, Unknown
  Obtained from environmental sample
  misc_feature (1)..(642): n is a, c, g, or t
atgagcattacgcaacgaattaaagtggttctcagcgagttagcgtgggttgaaaatgcaattcaattaaaaacctatacttctagacgccacgctttttataaaaaaataaacaacgcaccggcattaacacaagttattaatgacctaaaagagctacagcctagcattgacgacatttatgcgctgtttcatagtgcacgctataatcgtttaatactgtcgttaacaacctggttaatagacaaacaatggcgcaagttttgggatcaaaagcaattacaaaacgctgaccaatcggtagccagcattgctaaccgtttgtttgataaagattggcgaaatttgcataagctgttacctaaagaacaaactttaaccgcgaatgattaccttaatatacgcacacaattagagaacagtttactaagtggtaattgtttaggtgcgttatttgataaagaagagcgcttagagtttagactcccttggcttgatatttctcatggtatgtacgagcttagtacccttgactatttaaagcagctttgcggtggtcaagaagatgaaaagctagctaaaattcaaacatggctagcacaaaagacagaatatctggtaagtgcaatggagcaaaagtag

SEQ ID NO: 22490 - protein, 213 aa, Unknown
  Obtained from environmental sample
  misc_feature (1)..(213): Xaa is any amino acid
MSITQRIKVVLSELAWVENAIQLKTYTSRRHAFYKKINNAPALTQVINDLKELQPSIDDIYALFHSARYNRLILSLTTWLIDKQWRKFWDQKQLQNADQSVASIANRLFDKDWRNLHKLLPKEQTLTANDYLNIRTQLENSLLSGNCLGALFDKEERLEFRLPWLDISHGMYELSTLDYLKQLCGGQEDEKLAKIQTWLAQKTEYLVSAMEQK

SEQ ID NO: 22491 - DNA, 357 bp, Unknown
  Obtained from environmental sample
  misc_feature (1)..(357): n is a, c, g, or t
atgaaaaaaaaactatttctgttacttctattagtaaccagcgcaacttttgcacaagtaaaatttgaaggtaccgtaaaagatagtatcggtacgcctttagaattagccaatgtggtagctataaaccaaaccactaaaattatggattcttatggtattactaatgccgacggaaaatataaattagctttagagaaaaacacaacctataatattcaaattagttatatcggttataaaaccgaacaacggattattgaagttaaagaggacgatttacaacgcgattacaaccttcaaaccgataactcgctggacgaagtagaaatagtttacgaaatgcctgaaccgtaa

SEQ ID NO: 22492 - protein, 118 aa, Unknown
  Obtained from environmental sample
  SIGNAL (1)...(18)
  misc_feature (1)..(118): Xaa is any amino acid
MKKKLFLLLLLVTSATFAQVKFEGTVKDSIGTPLELANVVAINQTTKIMDSYGITNADGKYKLALEKNTTYNIQISYIGYKTEQRIIEVKEDDLQRDYNLQTDNSLDEVEIVYEMPEP

SEQ ID NO: 22493 - DNA, 534 bp, Unknown
  Obtained from environmental sample
  misc_feature (1)..(534): n is a, c, g, or t
atggatactaaagaattactaaaaaaagtacgaaaaatagagattaagacacgtcgtttgtctgatcatatatttggaggagagtaccactcaacctttaagggtcgaggtatgactttttctgaagtaagacaataccaatatggtgatgatgttagaaacatagattggaatgttactgcacgtaccaatcaaccacatattaaagtttttgaagaagaaagagaattgaccatgatgttaatggttgatgtctctggatcagaattatttggtacagaaaaccaatttaaaagtgaaattgttactgaaattgctgcaacattagccttttctgcaacgcaaaataacgataaaattggattgattttattttccgatccagtcgaattatatatacctcccaaaaaaggggttctcacgtttacgaatcataagagacttatagaatttgaggctaaaagcaaacaaccaatatgtcgaagtttaaagttttacgtaggtgatgacaagaagggatgttttgaccgctga

SEQ ID NO: 22494 - protein, 177 aa, Unknown
  Obtained from environmental sample
  misc_feature (1)..(177): Xaa is any amino acid
MDTKELLKKVRKIEIKTRRLSDHIFGGEYHSTFKGRGMTFSEVRQYQYGDDVRNIDWNVTARTNQPHIKVFEEERELTMMLMVDVSGSELFGTENQFKSEIVTEIAATLAFSATQNNDKIGLILFSDPVELYIPPKKGVLTFTNHKRLIEFEAKSKQPICRSLKFYVGDDKKGCFDR

SEQ ID NO: 22495 - DNA, 339 bp, Unknown
  Obtained from environmental sample
  misc_feature (1)..(339): n is a, c, g, or t
gtgtccttttccgatttgaaaaaggcttttgttcaaaagagcgaaaccaataaaacagcaaacagaactaccttttatcgcaacctcaaaatttttgaggataaaaggctaattcatcagattaatgatggggtcggagtggcaaaatatgcgatttctgatgaaaacgccaaagttaaatatggtatagatttacatatgcactttcattgcaccgattgtaggagaacaatctgtttaccgaataagatatcggaagaaagcttgccagacgattatgaagtgagcgatgtgaatctggtattaaagggaatatgtgaaaaatgcaggcaaaaataa

SEQ ID NO: 22496 - protein, 112 aa, Unknown
  Obtained from environmental sample
  misc_feature (1)..(112): Xaa is any amino acid
MSFSDLKKAFVQKSETNKTANRTTFYRNLKIFEDKRLIHQINDGVGVAKYAISDENAKVKYGIDLHMHFHCTDCRRTICLPNKISEESLPDDYEVSDVNLVLKGICEKCRQK

SEQ ID NO: 22497 - DNA, 738 bp, Unknown
  Obtained from environmental sample
  misc_feature (1)..(738): n is a, c, g, or t
atgggaacaatgatcgctagcggtttggctattgctactgtgacccatattggtaacgaaactaaattagggaaaataggaaaaagccttgaaggtgtattagaagagaagacgccgttggaattacaaatcaacaattttgtaaagaaaatggtcatagcaggtatttttatatttgcaattgtttgggctataaattattttaaatcttataatatattagatagtttacttaaagcactcacattggctatgagtattttgcctgaagaaataccagtagcatttaccacctttatggcaatgggagcttggaggttaatgaaaatgggagtggttgtaaaacaaatgaaaaccgttgaaactttagggagtgccacagtaatctgtaccgataaaacaggaactattactgaaaacaaaatgagtcttgctaaactttatagtgaagctagtaagagaataatttcaccgaatgaagtactaaataaagatgagaaagaattggtacgcattgcaatgtgggcaagtgaacctattcctttcgatcctatggagatagctctacacgacaactataaaaaactttttactatagacgaaaggcctttgtataaaatgtattacgagtatccattgggtggaaaaccaccaatgatgacccttattttcaagattaatccggtactagaattattgcagctcaaggagctccataagcttattacaagtatctaa

SEQ ID NO: 22498 - protein, 245 aa, Unknown
  Obtained from environmental sample
  DOMAIN (1)...(122): E1-E2 ATPase
  misc_feature (1)..(245): Xaa is any amino acid
MGTMIASGLAIATVTHIGNETKLGKIGKSLEGVLEEKTPLELQINNFVKKMVIAGIFIFAIVWAINYFKSYNILDSLLKALTLAMSILPEEIPVAFTTFMAMGAWRLMKMGVVVKQMKTVETLGSATVICTDKTGTITENKMSLAKLYSEASKRIISPNEVLNKDEKELVRIAMWASEPIPFDPMEIALHDNYKKLFTIDERPLYKMYYEYPLGGKPPMMTLIFKINPVLELLQLKELHKLITSI

SEQ ID NO: 22499 - DNA, 516 bp, Unknown
  Obtained from environmental sample
  misc_feature (1)..(516): n is a, c, g, or t
ttgacctttacgggtttgcctgaacaggaacatcttgagtttatgataaaaacctatccgtcccataatggcgttaccgaaaaactactgtccttaaaggcaggagatcgggtgatcctgaatgatgtgtttggtgcgattgcctacaaaggtgaaggcacatttattgccggtggggcaggggtgacgccttgtatttcaattttaagacatttgaaatcgcagggtaaattaggggataacaaacttgtttttgcaaataattcggaaaaagatatcattcttaaaaatgaatttcaaaccatgttgggtgataattttattaatatcctgtcggaagatacggttggaggcatagcgcatggacgcatcacagagaaattcttaaaaaattgcggactggcctatgataaaccattttacatttgtggcccaccgccaatgatggaagccgtagaagagcagttagcgcatttgaatgtgtctaaagatcagatggtgaccgaagcgttttaa

SEQ ID NO: 22500 - protein, 171 aa, Unknown
  Obtained from environmental sample
  DOMAIN (50)...(155): Oxidoreductase NAD-binding domain
  misc_feature (1)..(171): Xaa is any amino acid
MTFTGLPEQEHLEFMIKTYPSHNGVTEKLLSLKAGDRVILNDVFGAIAYKGEGTFIAGGAGVTPCISILRHLKSQGKLGDNKLVFANNSEKDIILKNEFQTMLGDNFINILSEDTVGGIAHGRITEKFLKNCGLAYDKPFYICGPPPMMEAVEEQLAHLNVSKDQMVTEAF

SEQ ID NO: 22501 - DNA, 711 bp, Unknown
  Obtained from environmental sample
  misc_feature (1)..(711): n is a, c, g, or t
gtgtttactaactggacattccgtattagtaaacaatcttctaacgacaaacaccttctaccctatttagccaaatatttagaacatataactccagatctaaaaggaaaaataacctttacagaagataaattacaaaactttgacgcagtaattgctacaggaagcaataacacagcacgctattttgagttttattttaagaataaaccttcaataattagaaaaagccgaaactcggctgcaatattaacagggtctgaaacaccagaacagttagacgccttatctgatgatatttttagatactatggtttaggttgcagaaatgtttctaaaatgtttatacctagagattataattttgatgctttttttaatgccatgtataaatggaatccgattattaaccaagccaaatacgctaacaattacgactataataaagcagtatatataatgagtgaatttgatatgctagaaaatggttttttaatgattaaagaagaccaaagctacgcatcaccaatagccactgtgttttatgagtattatgattctattgaaactttaaaacaaaaattacaacttgataaagatttaatacaatgtattgtcgctaataattttgatgattcagaagtttcgtttggaaaaacacaacaaccagactttcagatacgcagacgatgtgacacatgcattttataa

SEQ ID NO: 22502 - protein, 236 aa, Unknown
  Obtained from environmental sample
  misc_feature (1)..(236): Xaa is any amino acid
MFTNWTFRISKQSSNDKHLLPYLAKYLEHITPDLKGKITFTEDKLQNFDAVIATGSNNTARYFEFYFKNKPSIIRKSRNSAAILTGSETPEQLDALSDDIFRYYGLGCRNVSKMFIPRDYNFDAFFNAMYKWNPIINQAKYANNYDYNKAVYIMSEFDMLENGFLMIKEDQSYASPIATVFYEYYDSIETLKQKLQLDKDLIQCIVANNFDDSEVSFGKTQQPDFQIRRRCDTCIL

SEQ ID NO: 22503 - DNA, 408 bp, Unknown
  Obtained from environmental sample
  misc_feature (1)..(408): n is a, c, g, or t
atgaaattaaaatattcaactttttctataattgcatttactacaataattttatttagttgtaaaacagaagaaaaaaaacaaaaaacaccttttactcaaataagtcaattagtagatggttatgcaaaaaacactttacagaatggcaatataaattcgattgctttggccatttatagaaatggaaaagtgtataaaaattattttggagaaattgacaaagggaaaagcaacaccccaaatgacaatacattatatgaaattgcatcaatcacaaaagtttttacaggttctttagctgcaaaagccgttttggaaaataaaattaatctagaggatgatattagaaaatatttagaaggaaattttgataatttagaatttgaaacattccaattactataa

SEQ ID NO: 22504 - protein, 135 aa, Unknown
  Obtained from environmental sample
  misc_feature (1)..(135): Xaa is any amino acid
MKLKYSTFSIIAFTTIILFSCKTEEKKQKTPFTQISQLVDGYAKNTLQNGNINSIALAIYRNGKVYKNYFGEIDKGKSNTPNDNTLYEIASITKVFTGSLAAKAVLENKINLEDDIRKYLEGNFDNLEFETFQLL

SEQ ID NO: 22505 - DNA, 549 bp, Unknown
  Obtained from environmental sample
  misc_feature (1)..(549): n is a, c, g, or t
gtgattgaaatttttacaantgaaaaatggaaacctgtccagtttgatgacaatgtttctgaaaatatgtcttttaaaatatcaaaccatggacgacttagtaaagttgaagatggagttgatgttttgatagaaaaccaataccctattaatgggtatagtacagttcctgttataaaaaaagatggtaagcgtacagcaagatatattcacaaattagttgcacaacatcatttagataaaccagaagacgcaaaatttgtgctccacttagattacgataaaagtaataatgcagtcgaaaatttaaaatgggcaactaaacgtgaaaaggaaatccatcaatttaaaaatccgcattatcttactagaaaaaaagtaataacatcctctaagttaaccgaaacagaggtgattagacttaaaaagcgtctttttgatccaaatagacgtactagattaaagattttagcgcgacaatttggagtttcagaaatgcaattacatcgtattaaaactggtgaaaattggggacacgtaaaagtgtaa

SEQ ID NO: 22506 - protein, 182 aa, Unknown
  Obtained from environmental sample
  misc_feature (1)..(182): Xaa is any amino acid
MIEIFTXEKWKPVQFDDNVSENMSFKISNHGRLSKVEDGVDVLIENQYPINGYSTVPVIKKDGKRTARYIHKLVAQHHLDKPEDAKFVLHLDYDKSNNAVENLKWATKREKEIHQFKNPHYLTRKKVITSSKLTETEVIRLKKRLFDPNRRTRLKILARQFGVSEMQLHRIKTGENWGHVKV

SEQ ID NO: 22507 - DNA, 555 bp, Unknown
  Obtained from environmental sample
  misc_feature (1)..(555): n is a, c, g, or t
ttggcacacgagctgggacactataacattgactcccacaggataggattaaaaaaaggactattggaaccacatccgtccagaactaatcagaagcagtttaaccaaatagaaagagaagcagatttttttgcatcctgtttgctgatgccagaggaaaggttctcaaaagatttttatcgtaaaacctttagtattgaattggtagattatttgaaggacgagtataaagtcagcaggactgcctgtgcattcaggtttgcagatataggaaatcacgatattatgattgtctatggcgagaatggaaaaatacgttggaaatattgtagcgaacattttccctataaatacctgttatatgaaaacaaggtggcgccaaattcagtaatgggcgaatactttaaaaacattactgataacctgtttaaaaaagaagagatttgggcagttgatattttcaactacgttaaggaagacaatattcaaagaaagttttttgagcattgcattacttttaagggtagagctcttagcattatttgggaagaatag

SEQ ID NO: 22508 - protein, 184 aa, Unknown
  Obtained from environmental sample
  misc_feature (1)..(184): Xaa is any amino acid
MAHELGHYNIDSHRIGLKKGLLEPHPSRTNQKQFNQIEREADFFASCLLMPEERFSKDFYRKTFSIELVDYLKDEYKVSRTACAFRFADIGNHDIMIVYGENGKIRWKYCSEHFPYKYLLYENKVAPNSVMGEYFKNITDNLFKKEEIWAVDIFNYVKEDNIQRKFFEHCITFKGRALSIIWEE

SEQ ID NO: 22509 - DNA, 513 bp, Unknown
  Obtained from environmental sample
  misc_feature (1)..(513): n is a, c, g, or t
atgaaaaaaacactattttttattgccatacttctcacctttaattcgaacgcgcaggagacactttcagaattattaaaaaaaaacacgacacatagcgtcccttatattacagttcaagaattagcgatgccaacaaataaggctatcattatcgatgcaagagaaattgaagaattccaagtaagtcatattaaaaaagcacttcacgtgggatttaaggattttaaaattgaagacgttcagcaaaaaatcccaaataaaaatcaggttattgtcatctactgttctttaggtatccgctcggaaaaaatagctgaaaaactaaaaaaagtagggtatacaagtattaaaaatctatatggaggtatttttgagtggaaaaataacaattttgaagtatataatacatttaataaacctacggatagcattcacgcttttagtaaatcgtggagtagttatttaaacaaggggataaaagtgtatggcactcaaaaaaataaacattaa

SEQ ID NO: 22510 - protein, 170 aa, Unknown
  Obtained from environmental sample
  SIGNAL (1)...(18)
  DOMAIN (38)...(130): Rhodanese-like domain
  misc_feature (1)..(170): Xaa is any amino acid
MKKTLFFIAILLTFNSNAQETLSELLKKNTTHSVPYITVQELAMPTNKAIIIDAREIEEFQVSHIKKALHVGFKDFKIEDVQQKIPNKNQVIVIYCSLGIRSEKIAEKLKKVGYTSIKNLYGGIFEWKNNNFEVYNTFNKPTDSIHAFSKSWSSYLNKGIKVYGTQKNKH

SEQ ID NO: 22511 - DNA, 366 bp, Unknown
  Obtained from environmental sample
  misc_feature (1)..(366): n is a, c, g, or t
atgtattatcaagaattttatagaaaaagtatagaccaaccagagcaattttggcaagaacaagcctcgcaattggattggtttaaagcgcctaaaaacatattgtctaaagataaatatgactatgatcaatggtttcaggatggagagcttaatctaagttatttgtgtattgacaaacatatcaaagaaggatttggagatcaaaatgcaatcatttacgactcgccagttaccaatataaaacagcatattacttttaatcaattacaccacgaagtatcaagacttgcgggtggattacaagctttaggattgcaaaaaggcgatacgtgctatatctcgagccgattcttgatccactag

SEQ ID NO: 22512 - protein, 121 aa, Unknown
  Obtained from environmental sample
  misc_feature (1)..(121): Xaa is any amino acid
MYYQEFYRKSIDQPEQFWQEQASQLDWFKAPKNILSKDKYDYDQWFQDGELNLSYLCIDKHIKEGFGDQNAIIYDSPVTNIKQHITFNQLHHEVSRLAGGLQALGLQKGDTCYISSRFLIH

SEQ ID NO: 22513 - DNA, 669 bp, Unknown
  Obtained from environmental sample
  misc_feature (1)..(669): n is a, c, g, or t
atgaagaaaatattgaccggagtaatcctaaccttggcagcggtacttatcttccgttcttgtgcggaggataaagagaataagtccatattaaaagagaattccatgctcattcaagagcagataaataacgtttcaaaacttatagttacggaggggcattttgcggaagtttataactataaggattcccaacaattgttcggccccttaattacggcccataaaaaggccttggtggtggtaaatgcagaggtaacggtgggttacgatttaagtttgataaaatttgatattgacgaggttactaagacacttcgaataatcgatgtcccggcaccagaaattaagataaaccccgattttgaatattacgatgttacttcagattatttaaatcagttcaatgccgaagactataataaaattaaacgcaacgtaaatgcctctttgctgaaaaaaatagaggcctctactttaaagtccaatgcggagaaccgactccttagtgagctttccaaattcctggtacttaccaattctatgggatggaccctggtttatggggatgtgaacattgaaaatttggatgaattaaggctgttggattacatgactctagttaaggttagtctttccactatttcacaaacgcatttgcccacatga

SEQ ID NO: 22514 - protein, 222 aa, Unknown
  Obtained from environmental sample
  SIGNAL (1)...(13)
  misc_feature (1)..(222): Xaa is any amino acid
MKKILTGVILTLAAVLIFRSCAEDKENKSILKENSMLIQEQINNVSKLIVTEGHFAEVYNYKDSQQLFGPLITAHKKALVVVNAEVTVGYDLSLIKFDIDEVTKTLRIIDVPAPEIKINPDFEYYDVTSDYLNQFNAEDYNKIKRNVNASLLKKIEASTLKSNAENRLLSELSKFLVLTNSMGWTLVYGDVNIENLDELRLLDYMTLVKVSLSTISQTHLPT

SEQ ID NO: 22515 - DNA, 660 bp, Unknown
  Obtained from environmental sample
  misc_feature (1)..(660): n is a, c, g, or t
ttgtttatgttttcaattgcagttgcagtcctaatagcttattttcttaaacgctcaaaaaaaagcaataagcaattacaaatactgtcttcagaaaacgaatttttactaagtgaagcaaaccacaggattaataataacttacaattagtagtaatacttattaccaatcaacttaaaaaagcttctgagacagaaaaaattcaactaaaaaatattttaataaaggtggaagctatttctactttacataaacatttatataaaaacgaagacaaacaaactatagatattgctaattacttaaaagatgtaaaaactagtttttttgatgtgtttaaagaaaatgatattactactaactttgatgtcaattctttagaaatagccacagatcaagcgatgtattttggattattactaactgagttattaattaattctatcaaacatgcctttaaagaacaagattataaggtgatagattttacattaagggttaataatgggttgctattatttatatatagtgataatggtataagcttggctaataaatcaataaaacctaaactggtagataccatttgtcgtccattagaaatggattatcatattactacagataatggttttaatttttcgatgtctaaaaaataa

SEQ ID NO: 22516 - protein, 219 aa, Unknown
  Obtained from environmental sample
  DOMAIN (39)...(124): Histidine kinase
  misc_feature (1)..(219): Xaa is any amino acid
MFMFSIAVAVLIAYFLKRSKKSNKQLQILSSENEFLLSEANHRINNNLQLVVILITNQLKKASETEKIQLKNILIKVEAISTLHKHLYKNEDKQTIDIANYLKDVKTSFFDVFKENDITTNFDVNSLEIATDQAMYFGLLLTELLINSIKHAFKEQDYKVIDFTLRVNNGLLLFIYSDNGISLANKSIKPKLVDTICRPLEMDYHITTDNGFNFSMSKK

SEQ ID NO: 22517 - DNA, 531 bp, Unknown
  Obtained from environmental sample
  misc_feature (1)..(531): n is a, c, g, or t
atgactgcttttttacctgatattattttaatggatattaatttacaagggaaaaatgagggtattgagttagccaaagttaaaaataataatgcgaccattatttttatcacaggtcaaaacgacttagttttaatgaatgaagcattaaaatccaatccagacgcttacttaaccaaacctataaaacgattagatctattagcttcaataaatttagcgttttataaaaagcaatcgcaaatctttcaatttaaagatggatacgatattgttaatttaaacttttcggacattagatattttgttgcagaaggtaattatgtaaatatttatacgcttactaaaagatttactattagacaatcattgatgggtgtaatggataaacttcctacagatagttttaaacaaacgcatcgttcttatttagtaaataaaaataagatagagaaagtaacatcaaacacagtagttattaatggtttagatattcctttatcaaggacgtatgccaaacaatttaaatag

SEQ ID NO: 22518 - protein, 176 aa, Unknown
  Obtained from environmental sample
  DOMAIN (89)...(176): LytTr DNA-binding domain
  misc_feature (1)..(176): Xaa is any amino acid
MTAFLPDIILMDINLQGKNEGIELAKVKNNNATIIFITGQNDLVLMNEALKSNPDAYLTKPIKRLDLLASINLAFYKKQSQIFQFKDGYDIVNLNFSDIRYFVAEGNYVNIYTLTKRFTIRQSLMGVMDKLPTDSFKQTHRSYLVNKNKIEKVTSNTVVINGLDIPLSRTYAKQFK

SEQ ID NO: 22519 - DNA, 363 bp, Unknown
  Obtained from environmental sample
  misc_feature (1)..(363): n is a, c, g, or t
atgaaagttttagtatctgtcgtaggaaggtttcatgcttttgatttggctattcagttagaaaaacatggcgttttaaaaaaaataaatactacctatcctaaacatattgttgctaaatggtgtattagtaaagatacaattacaagtaatattatactagaaattttaaacagatacatcaaaaggtctgttcctaacagttttaaaaagtttttaacctttacattccaaagcaccaggcaagcagtactatcacgctgttcactgatgttgactgtttnactacgtcggagtgcgtcaagtttaaaagcgataattgaagccaaaaacgaggtgttatcacattttagaccgtggtag

SEQ ID NO: 22520 - protein, 120 aa, Unknown
  Obtained from environmental sample
  misc_feature (1)..(120): Xaa is any amino acid
MKVLVSVVGRFHAFDLAIQLEKHGVLKKINTTYPKHIVAKWCISKDTITSNIILEILNRYIKRSVPNSFKKFLTFTFQSTRQAVLSRCSLMLTVXLRRSASSLKAIIEAKNEVLSHFRPW

SEQ ID NO: 22521 - DNA, 849 bp, Unknown
  Obtained from environmental sample
  misc_feature (1)..(849): n is a, c, g, or t
ttgtccgaacttatcacaaaaaagcaaaatatagagcaccttaaaaatatactgttcgaatacagtagtcttgaaaagcacattgaactttttaaaagaaaggacgagctacttagattcaaaattggcgatagcttaaaaggtcttactgaagattcttttaaacttcatatgttggcacataagaacaaaaccgatatcctcaaaaaatacaattctttacaaaaggaatatgaggaatttacaagcagaaagaacctgctagaaaattaccaaaaaagaattaaaaaattagagaccaaccttttcgaaaataatatcactattgatgctcaactaatagaagaaaaaattgcatcggaggaaaaatgtttggcagagaaagaagaaagcctgaaagaaaaggaatttgatgaaaagtcatttttagataaacaaaccaaagacatcattaatcaacagaaattatccgacttaaaatatcaacttttaagtactattaaagacttagatatagaaattgagcagaaggaaaagcaactcacattagcacaaaatcaaataacggaaactaggcaattaaatgaacagctttttaaatcaaaaattgtatttaatgaaaatattgaagaaaccgtagatcctgataatggcggaaacaattcttttcaagctaaagcaaataaagcacaagtcgcatatatagaatatctaaagataataaccaaagaccttccgtatgatgaaacgggttcaataggacaattagcaaattacctcttacctacagtatttcctactatagacgtggacgaagatttattacaaacgatatcgtcgataggttaa

SEQ ID NO: 22522 - protein, 282 aa, Unknown
  Obtained from environmental sample
  misc_feature (1)..(282): Xaa is any amino acid
MSELITKKQNIEHLKNILFEYSSLEKHIELFKRKDELLRFKIGDSLKGLTEDSFKLHMLAHKNKTDILKKYNSLQKEYEEFTSRKNLLENYQKRIKKLETNLFENNITIDAQLIEEKIASEEKCLAEKEESLKEKEFDEKSFLDKQTKDIINQQKLSDLKYQLLSTIKDLDIEIEQKEKQLTLAQNQITETRQLNEQLFKSKIVFNENIEETVDPDNGGNNSFQAKANKAQVAYIEYLKIITKDLPYDETGSIGQLANYLLPTVFPTIDVDEDLLQTISSIG

SEQ ID NO: 22523 - DNA, 807 bp, Unknown
  Obtained from environmental sample
  misc_feature (1)..(807): n is a, c, g, or t
ttgattttaatgaaaattataaatagaccttggtggtggaccattttactagttttacctagtgtaaacttaattttgtttccggtantttgggtagaaattgctagaagttttaaaaaaaatactgcattagatacttttttagccatatttacactaggtttttatagcttttatttaaactatgctgccaaagacctaaatcacgttaaagacagaagtttacaaccaagaacagaattaggtgattgggtaagttctatattatttgcagttgtagctgctactattgtccatacttattttatacaaccttttgttattcctacgtcctctttagaaaaaacattattagttggtgatttcttatttgttagtaaagttcactatggtgcacgtacgccagaaacaactgttgctttaccaatgattcatgacgctattcctggaacatcaataccttcatattttaaattcccacaactacctaagtttagatttcctgcatttcaatctataaaacgtaacgatattgtagtttttaattggcctgtagatactctagttgatattaataatgaaaatggtggtgttagatataaaccagtagataaaaagactaattacgtaaaacgttgtgttggattaccaggtgatacattatcaattaaagatggttatgtatacataaatggtaagaaaaatgaattaccagacagagctaaattacagtttttttataaagttattctcaacgatgtttctgctgagtccatttaccaaaaatatgtatcacagaaattatga

SEQ ID NO: 22524 - protein, 268 aa, Unknown
  Obtained from environmental sample
  DOMAIN (107)...(233): Peptidase S24-like
  misc_feature (1)..(268): Xaa is any amino acid
MILMKIINRPWWWTILLVLPSVNLILFPVXWVEIARSFKKNTALDTFLAIFTLGFYSFYLNYAAKDLNHVKDRSLQPRTELGDWVSSILFAVVAATIVHTYFIQPFVIPTSSLEKTLLVGDFLFVSKVHYGARTPETTVALPMIHDAIPGTSIPSYFKFPQLPKFRFPAFQSIKRNDIVVFNWPVDTLVDINNENGGVRYKPVDKKTNYVKRCVGLPGDTLSIKDGYVYINGKKNELPDRAKLQFFYKVILNDVSAESIYQKYVSQKL

SEQ ID NO: 22525 - DNA, 618 bp, Unknown
  Obtained from environmental sample
  misc_feature (1)..(618): n is a, c, g, or t
ttgagtacggaacactattttggagtacctgtggtctcacgctactttaatgtggaaaacggaattttggcacaaaagaacgcagcgtctggagagtatcaaattaattgggccagttatttattagaaatattggatatgcataccaatgctcctgtcaagcctggagtttttggtcgtattgtaatcacggatttatataattattgcatgccaatgattagatatgacactggagatataggacagttgtccatttctcataagaatggcgcaaagcataggattctggaaagagtggaaggccggaaaatggatatgatctataaaaccaatggagaaatgacgtctccttttatggtctatcatatattaaaatatccacatatcagacagtaccaatttattcaagaaaataagacccaatacaaattaaaacttaatgttctacctgaattccgaagtgctgataatattgtgactgaatttaaaaagcacttgggtagtgacgccgaaatttctttagactatgtagatgacattcctttactttcttctggaaaacgaaaatttgtgattaataaattcagagggggtaaagaaaaagagcacgtgtaa

SEQ ID NO: 22526 - protein, 205 aa, Unknown
  Obtained from environmental sample
  misc_feature (1)..(205): Xaa is any amino acid
MSTEHYFGVPVVSRYFNVENGILAQKNAASGEYQINWASYLLEILDMHTNAPVKPGVFGRIVITDLYNYCMPMIRYDTGDIGQLSISHKNGAKHRILERVEGRKMDMIYKTNGEMTSPFMVYHILKYPHIRQYQFIQENKTQYKLKLNVLPEFRSADNIVTEFKKHLGSDAEISLDYVDDIPLLSSGKRKFVINKFRGGKEKEHV

SEQ ID NO: 22527 - DNA, 579 bp, Unknown
  Obtained from environmental sample
  misc_feature (1)..(579): n is a, c, g, or t
atgccaagaaaagtaaaatccggattgatacaaatgagccttcctatgacagaaggagaaggtaccatccaagaaattatggatgccatgtataacaagcatattccatatattgaaaatgctggaaaacaaggggttcagattttatgccttcaagaaatttttaacaccccatatttctgtcctggacaggataataaatggtatgcctcggccgaagctgtaccgggaccaactatagaaaagatgcaggcctatgccaaaaagtataatatggtaatgatagtgcctatttatgaaaaagaacaggcgggtgtactttacaatactgccgncgtaattgatgccgatgggaaatatttaggaaaatatcgtaaaaatcatattcctcatactacggggtttcgggacaaatatttctttaaaccaggtaatttagggtatcctgtatttcaaacaaaatacgccaaagttgcggtccatatccgttatgacagacatttccctgattgtgcaagaatattaggattaaatggtcttgaaattagatatattcctagtgcaacagtagagggannn

SEQ ID NO: 22528 - protein, 193 aa, Unknown
  Obtained from environmental sample
  DOMAIN (9)...(188): Carbon-nitrogen hydrolase
  misc_feature (1)..(193): Xaa is any amino acid
MPRKVKSGLIQMSLPMTEGEGTIQEIMDAMYNKHIPYIENAGKQGVQILCLQEIFNTPYFCPGQDNKWYASAEAVPGPTIEKMQAYAKKYNMVMIVPIYEKEQAGVLYNTAXVIDADGKYLGKYRKNHIPHTTGFRDKYFFKPGNLGYPVFQTKYAKVAVHIRYDRHFPDCARILGLNGLEIRYIPSATVEGX

SEQ ID NO: 22529 - DNA, 681 bp, Unknown
  Obtained from environmental sample
  misc_feature (1)..(681): n is a, c, g, or t
atgccaacaaaaagcatactaaacaaaaagtctatggactttttagaaacatatttaaacaatgcatcaccaactggctacgaatgggatggtcaaaaaatatggatggattacctaaaaccttatgtagacacgttttttacagacacctacggaactgctgtgggagttataaatcctgatgcaaaatttaaagtggtaattgaaggtcatgctgacgaaatctcttggtacgttaactatatttctgataacggattaatttatgtggttagaaatggaggtagcgaccaccaaattgcacctagtaaagtcgttaatattcatactaaaaacggtattgttaaaggtgtttttggatggcctgcaatacatacacgtaataaatctaaagaagaagcaccaaaaccagacaacattaccattgatgttggcgctaaagacaaagatgaagtcttaaaaatgggtgtgcacgttggatgtgttattacttatccagatgagtttcatattttaaatggcgacaaatttgtttgtcgtgctttagacaaccgtatgggtggttttatgattgctgaagtcgcgcgtttacttaaagaaaataaaaaaacgttaccatttggactttacattactaactctgttcaagaagaattgtttacacgtctggaccgatcttga

SEQ ID NO: 22530 - protein, 226 aa, Unknown
  Obtained from environmental sample
  DOMAIN (52)...(223): M42 glutamyl aminopeptidase
  misc_feature (1)..(226): Xaa is any amino acid
MPTKSILNKKSMDFLETYLNNASPTGYEWDGQKIWMDYLKPYVDTFFTDTYGTAVGVINPDAKFKVVIEGHADEISWYVNYISDNGLIYVVRNGGSDHQIAPSKVVNIHTKNGIVKGVFGWPAIHTRNKSKEEAPKPDNITIDVGAKDKDEVLKMGVHVGCVITYPDEFHILNGDKFVCRALDNRMGGFMIAEVARLLKENKKTLPFGLYITNSVQEELFTRLDRS

SEQ ID NO: 22531 - DNA, 732 bp, Unknown
  Obtained from environmental sample
  misc_feature (1)..(732): n is a, c, g, or t
ttgagcaatgtcaaattattcagaatgtttaaatatgcttctaaaataatttcagtatcaaaagtaatgtctgataaccttttgaatttaggttgtccgaaagaaaaattgttttataatgtgtatggtcctaatccattgtttgaaaaagtacaacctactttttctaaaaaacaatttatttcaataggaaggtttactgataaaaaagcgccttattatttaattcttgcatttaaagatgttgttaaatcccataaagaggcacagcttttaattggtggaaatggcgagttatataatacttgtaaaaatttaatagattattataatttacaagataatattaggttattaggagtggttactcctcaaaaatttaccacgttattagaagaaagtttagcttatgtacagcattctattacagctttaaatggagatatggaaggtacacctttatccattttagaagcaagtgtagcaggtttgccagtaatctctacttatcactcaggtatttcggatgtaataataaacaataaaacaggtctcttggtccatgagcatgatgtttctggtatgactgaagctatgattagtttgttagataacatagatttagctaaatcgttaggtcataatggaaaacagaatattctttccaatttttccatgaatagacatattaaacaattgaatataattctatcagatagcgtaaatccataa

SEQ ID NO: 22532 - protein, 243 aa, Unknown
  Obtained from environmental sample
  DOMAIN (45)...(219): Glycosyl transferases group 1
  misc_feature (1)..(243): Xaa is any amino acid
MSNVKLFRMFKYASKIISVSKVMSDNLLNLGCPKEKLFYNVYGPNPLFEKVQPTFSKKQFISIGRFTDKKAPYYLILAFKDVVKSHKEAQLLIGGNGELYNTCKNLIDYYNLQDNIRLLGVVTPQKFTTLLEESLAYVQHSITALNGDMEGTPLSILEASVAGLPVISTYHSGISDVIINNKTGLLVHEHDVSGMTEAMISLLDNIDLAKSLGHNGKQNILSNFSMNRHIKQLNIILSDSVNP

SEQ ID NO: 22533 - DNA, 771 bp, Unknown
  Obtained from environmental sample
  misc_feature (1)..(771): n is a, c, g, or t
gtgaaggcagatataacgtattctgatgatcctttaaggatgatgagagctattcgttttgcaacacaagtaaattttgaaattgaagaaaattcgctgactgcaatttctaaaaactcaaatcgattacaaataattaccaaagagagaattgttgttgaactgaataaaataatgtcttcgattaaaccatcaattggttttttattattagaacaaacaaatttattacctcaaattctacctgaattaatcgcattaaaaggcgttgaagaagttgaaggtcagaaacacaaggataatttttatcacactttagaagttgtagacaatatttcagagtatacagaagacctttggttaagatgggctgcacttttgcatgatgttggaaaagcccctacaaaaagattcagtaaaaaagtaggttggacttttcatggacatgaatttgtgggttctaaaatggtctataaaatatttaaaaagcttaaattaccactgaacaacaaaatgaaatttgttcagaaaatggtattattaagttcaagaccaattgtattggcaagtgatgtaacagattctgctgtaagacgtttggtttttgatgcaggtgatgacatcaactctttaatgacgttgtgtgaagcagatattaccacacaaaatccaaagaaatttaaattatatcatagaattttgattagttcgctcnaaattaacgatggactcgaccgatcaaacgcaagtaccaannnnnnnnnncaatag

SEQ ID NO: 22534 - protein, 256 aa, Unknown
  Obtained from environmental sample
  DOMAIN (1)...(90): Poly A polymerase family
  misc_feature (1)..(256): Xaa is any amino acid
MKADITYSDDPLRMMRAIRFATQVNFEIEENSLTAISKNSNRLQIITKERIVVELNKIMSSIKPSIGFLLLEQTNLLPQILPELIALKGVEEVEGQKHKDNFYHTLEVVDNISEYTEDLWLRWAALLHDVGKAPTKRFSKKVGWTFHGHEFVGSKMVYKIFKKLKLPLNNKMKFVQKMVLLSSRPIVLASDVTDSAVRRLVFDAGDDINSLMTLCEADITTQNPKKFKLYHRILISSLXINDGLDRSNASTXXXXQ

SEQ ID NO: 22535 - DNA, 495 bp, Unknown
  Obtained from environmental sample
  misc_feature (1)..(495): n is a, c, g, or t
atgataattgtaagaattgttggtggacttggaaatcaaatgtttcaatatgcatatgcaaaatctttgcaacaaaaaggttttgatgttcagattgatatttctaaattcaaaacgtacaaattacatggaggttatcatttagacacctataaaatcgatttaaaaaaagcaggttttttcgacacatttttgtctttaataaaattaaagaagaatgtaaaagaaaaaagtttgttgtttgatgaccaattgtttcatttatctggtaacgaatttgtaaaaggatattttcaaaccgaaaaatatttttcatctattagagaaattctgttaaaacaatttacgattaaaacagagctttctgattctacaaaggaatattcaaaagaaattcatcaacataaaaattcttgttctttacatattagaagaggagattatattactgataaaaaagcaaatagtgttcatggaacttgcgatttaaattaa

SEQ ID NO: 22536 - protein, 164 aa, Unknown
  Obtained from environmental sample
  misc_feature (1)..(164): Xaa is any amino acid
MIIVRIVGGLGNQMFQYAYAKSLQQKGFDVQIDISKFKTYKLHGGYHLDTYKIDLKKAGFFDTFLSLIKLKKNVKEKSLLFDDQLFHLSGNEFVKGYFQTEKYFSSIREILLKQFTIKTELSDSTKEYSKEIHQHKNSCSLHIRRGDYITDKKANSVHGTCDLN

SEQ ID NO: 22537 - DNA, 312 bp, Unknown
  Obtained from environmental sample
  misc_feature (1)..(312): n is a, c, g, or t
atgcagatcacaattatgactgatacaaataaaccagagttaccagaccaactttcgattaatccacgcagcaagttttatgtagaagaagtattcgaacatgaaattggtgtaactctgaacggcaaagagcgttttgacgttgaagaatactgcatcagagaaagctggatcaaagttgccgcacctaaagcgctagatcgtcgtggacaaccattacttattaaagtcaaaggccttggagacgttatttttaataaattctgttgcggacaagaagccaggtacgtgggtttaaaccatgtgctctaa

SEQ ID NO: 22538 - protein, 103 aa, Unknown
  Obtained from environmental sample
  misc_feature (1)..(103): Xaa is any amino acid
MQITIMTDTNKPELPDQLSINPRSKFYVEEVFEHEIGVTLNGKERFDVEEYCIRESWIKVAAPKALDRRGQPLLIKVKGLGDVIFNKFCCGQEARYVGLNHVL

SEQ ID NO: 22539 - DNA, 504 bp, Unknown
  Obtained from environmental sample
  misc_feature (1)..(504): n is a, c, g, or t
atgactaggtgtataaaaataaagattacagaaaatcagttaggatantcggtgcattggacttttgaagattcattattgtatatgtcaagttccaaaaccaatgaaatatttatatataatttggataacttttgtggtgaaaaactgcaatttgattcgttaaaaaaaataaagaatgatgattcgattgtaagttattttttaacggagtttgattatttaaatgaggataaggatttactccataatttaaaaaaccgtgagtttattccggcttattatgacttaaaagctgaaggcagcaagttgtatttagttgtatttaattatgactcaaaaaaccaagaaatactaatgatagatttgaagacaaacgaggttaaaagaatttccagcctaaatatttttgatatacaagatataaagggaggagtcatctacggaatatatagagatgacgagattggaagaaaaaccatcaggtacatagacggggaataa

SEQ ID NO: 22540 - protein, 167 aa, Unknown
  Obtained from environmental sample
  misc_feature (1)..(167): Xaa is any amino acid
MTRCIKIKITENQLGXSVHWTFEDSLLYMSSSKTNEIFIYNLDNFCGEKLQFDSLKKIKNDDSIVSYFLTEFDYLNEDKDLLHNLKNREFIPAYYDLKAEGSKLYLVVFNYDSKNQEILMIDLKTNEVKRISSLNIFDIQDIKGGVIYGIYRDDEIGRKTIRYIDGE

SEQ ID NO: 22541 - DNA, 666 bp, Unknown
  Obtained from environmental sample
  misc_feature (1)..(666): n is a, c, g, or t
gtggttggttatagtgtttcttctgctgataaatctctaacaaccattcaaaaatctggcataaaagtaatttataatggagattggctagaagaaactcctctaggaagagctgaatggattaagttttttggagttttgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgaaacaggtggcgcaatttactatgaattagcaggaacaagaccagatttggttttaaaagatttgattaaaattacaaatcctgaagtattaccaaattatgagtttaccttttttgacaaactgaaataa

SEQ ID NO: 22542 - protein, 221 aa, Unknown
  Obtained from environmental sample
  misc_feature (1)..(221): Xaa is any amino acid
MVGYSVSSADKSLTTIQKSGIKVIYNGDWLEETPLGRAEWIKFFGVLFDKEKQADSIFKVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGETGGAIYYELAGTRPDLVLKDLIKITNPEVLPNYEFTFFDKLK

SEQ ID NO: 22543 - DNA, 531 bp, Unknown
  Obtained from environmental sample
  misc_feature (1)..(531): n is a, c, g, or t
gtggctaataaacgtgccatagttgattactataaagtgcaaaatgacaacattaatgcatcattaatagacagcacttttgtagagcaaaaacgcgaaagccatgtatctgtacatacgtttagttttggaggaaagttaacacgtaacaatttaaacttctatcaaaacggagaatatatggactctacattaaatggagttaccattattggagataaacaacatgttgaccacaacactttagtacatcacatagagcctaattgtgaaagtcaccaagattataaaggaatttttaatgatagctcaacaggagtttttaatggtaaggttgttgtaaacaaggaagcacaaaaaaccaatgcatttcaatcaaataacaatatattattaagcgataaagcaacaataaactctaaacctcaactagaaatttttgcagatgatgtaaaatgttctcatggttgtaccataggaccaattagacgaaagtgctttgttttatatgaaatcaagaggtattcctga

SEQ ID NO: 22544 - protein, 176 aa, Unknown
  Obtained from environmental sample
  DOMAIN (1)...(167): Uncharacterized protein family (UPF0051)
  misc_feature (1)..(176): Xaa is any amino acid
MANKRAIVDYYKVQNDNINASLIDSTFVEQKRESHVSVHTFSFGGKLTRNNLNFYQNGEYMDSTLNGVTIIGDKQHVDHNTLVHHIEPNCESHQDYKGIFNDSSTGVFNGKVVVNKEAQKTNAFQSNNNILLSDKATINSKPQLEIFADDVKCSHGCTIGPIRRKCFVLYEIKRYS

SEQ ID NO: 22545 - DNA, 309 bp, Unknown
  Obtained from environmental sample
  misc_feature (1)..(309): n is a, c, g, or t
atgacagattggctgagtgatccaganatgccagaattaaataaattagcagacaattttaaatctaaaaaagtaaaatttttggcaattacttttaatcaaaaagacaatatcgagcagtttttaaaaacccaagactttaaatttactattttaccaaatgccaataacatcatatcgttatatggtgtaggcaccttcccgaccactattgtaattaataaaaagggtgaaattgtaaccaaagaagttggttacagaactaatataaaatctgtacttactaaagctattaatgcagcactttaa

SEQ ID NO: 22546 - protein, 102 aa, Unknown
  Obtained from environmental sample
  misc_feature (1)..(102): Xaa is any amino acid
MTDWLSDPXMPELNKLADNFKSKKVKFLAITFNQKDNIEQFLKTQDFKFTILPNANNIISLYGVGTFPTTIVINKKGEIVTKEVGYRTNIKSVLTKAINAAL

SEQ ID NO: 22547 - DNA, 594 bp, Unknown
  Obtained from environmental sample
  misc_feature (1)..(594): n is a, c, g, or t
atgcagcactttaaaacaaaaaaacaaaagtattggttagtaatgttgtgctttatttgcatgacgttttcttgggcacaaacacctgagaaaaacctaaaagttagtgacactaccaaatctagtgaacttttaaaacaaataggaaatggttttttccctaccaaagtatggaattttgacctgaggtatcttattaaatttaatcaatacgaaggatttagaacaggtttaggcggaattactaatgattcgttttctgaaaaatacagaatagattcttatttagtttatggatttagagatgatagttttaaatataaaattggtggtggttttagagtaaacgaaaaatcaaaaacctggataaacatttcttacattgatgatttaaaagaaactggtagctctgactttttaacagacagtagatctttttcattttttgaacctagattgttaaacatagatttatttcataaacacattacatctgcaatatctttagaacacgaaataaccgcaaaactatactcaaaatctgaaatagcaataaagtaccatagacctacttacacttataactacgactaa

SEQ ID NO: 22548 - protein, 197 aa, Unknown
  Obtained from environmental sample
  misc_feature (1)..(197): Xaa is any amino acid
MQHFKTKKQKYWLVMLCFICMTFSWAQTPEKNLKVSDTTKSSELLKQIGNGFFPTKVWNFDLRYLIKFNQYEGFRTGLGGITNDSFSEKYRIDSYLVYGFRDDSFKYKIGGGFRVNEKSKTWINISYIDDLKETGSSDFLTDSRSFSFFEPRLLNIDLFHKHITSAISLEHEITAKLYSKSEIAIKYHRPTYTYNYD

SEQ ID NO: 22549 - DNA, 471 bp, Unknown
  Obtained from environmental sample
  misc_feature (1)..(471): n is a, c, g, or t
atgactgagtttaaagtgggcgatgataaactgtatctgtcacccatactcgattgctttaataatgagatcatcagttatgaattatcaagacgacccgtatatgacttggtgaaacagatgcttgatcgcgcgctcaaaggcatatcattaaagcgcaggctcaaggagcagctaacgctgcattcagatcaagggtggcactatcagatgaaaccgtttgcaacaacgctaaaagccaataacatccagcaaagtatgagccgaaaaggtaactgcttagacaatgcgctgatggagagcttcttcggtacgctcaagtgtgagactatttatattgaaaagccatcgagtattgaggcgttagagcaacagattcataagtatgtgcattactacaatcatgaaagaattcagcttaaactaaaaggactgagccctgtacaatacagagctcagtcctatctttaa

SEQ ID NO: 22550 - protein, 156 aa, Unknown
  Obtained from environmental sample
  DOMAIN (2)...(152): Integrase core domain
  misc_feature (1)..(156): Xaa is any amino acid
MTEFKVGDDKLYLSPILDCFNNEIISYELSRRPVYDLVKQMLDRALKGISLKRRLKEQLTLHSDQGWHYQMKPFATTLKANNIQQSMSRKGNCLDNALMESFFGTLKCETIYIEKPSSIEALEQQIHKYVHYYNHERIQLKLKGLSPVQYRAQSYL

SEQ ID NO: 22551 - DNA, 561 bp, Unknown
  Obtained from environmental sample
  misc_feature (1)..(561): n is a, c, g, or t
atgaaaattattttaagactggcaatttttttgatactcctaaattcaattaattcaaattgtcagtctaaaattgtaaaaattaaaggaggagaatatattcctttatatggtagagattcattgatggtttctattgataatttttggatagatgtttatcctgtaaccaataaagagtatttagattatgtgataaaaaatccaaaatggcaaagatctaaagctataaaattatttgttgatgcaagttatttaagagattggcaaaatgataccttgttaaatacgaatcaaaaaatgaattcaccaattactaatatatcttggtttgcagccaaaagttattgtgaaaatcaaggaaaaaggttaccaacagtagatgaatgggagtatgttgctatggcaaataaaacaatgccagatgctagatccttaaaaaactacaacgaatttatattaagttggtacgaaaaaccaaaaacattcaatcaaccaattggttcaacttttaaaaattattggcaagtgtacgaactacatggattggtttgggaatga

SEQ ID NO: 22552 - protein, 186 aa, Unknown
  Obtained from environmental sample
  DOMAIN (21)...(186): Domain of unknown function (DUF323)
  misc_feature (1)..(186): Xaa is any amino acid
MKIILRLAIFLILLNSINSNCQSKIVKIKGGEYIPLYGRDSLMVSIDNFWIDVYPVTNKEYLDYVIKNPKWQRSKAIKLFVDASYLRDWQNDTLLNTNQKMNSPITNISWFAAKSYCENQGKRLPTVDEWEYVAMANKTMPDARSLKNYNEFILSWYEKPKTFNQPIGSTFKNYWQVYELHGLVWE

SEQ ID NO: 22553 - DNA, 900 bp, Unknown
  Obtained from environmental sample
  misc_feature (1)..(900): n is a, c, g, or t
gtgacgagtgtttttcaaattcctcaactgtttatatattccatggtatcttttgtgggtttatttttattcaggattttggttaaacaagtctttgaagtttaccaacgttacaatgatgaagaagcaagactaaatgttttaatttatggtaccagtgaaaatgcaatagcaatagcaagtgcattaaaatcggaaaaaccttcgcgatacaaggttttaggatttattgataaggatggtaaaaataaaagtaaagaaatattaggtctaccaattatttatctaaaacgcaaaaccgcagtattacttaggatatataatgcacaagcacttattatagcagatagctccttaacaaaagaggaaagtattaaaattgttgatagctgtttagagtttaactacaaggtttttagagcgcctttaatttccgatatagaaaaaaacactacactttctaatcaaattcaaaaaatacaaattgaagacattttagaaagagaaccaatacagttagataacaagttagttgcaaaagaaattttcaataaatgtattctagttacaggtggagcaggttccattggaagtgaaattgttagacaagtagccagctataaacccagtaaactattgatttttgatcaagcagaatcgcctttatacgaaattcagcaagaaattaaacatgattttccagatctaaacttcgaagcaattataggagatgtaagaaaagtagatgttttagaagatgtttttaaaaaatataatccacaagtagtttatcatgctgcagcatacaaacatgtaccattaatggaaaaacacccatcggaagctatttttgctaacataatgggatcaaaaaatgtagcggatttatctataaattaa

SEQ ID NO: 22554 - protein, 299 aa, Unknown
  Obtained from environmental sample
  DOMAIN (1)...(299): Polysaccharide biosynthesis protein
  misc_feature (1)..(299): Xaa is any amino acid
MTSVFQIPQLFIYSMVSFVGLFLFRILVKQVFEVYQRYNDEEARLNVLIYGTSENAIAIASALKSEKPSRYKVLGFIDKDGKNKSKEILGLPIIYLKRKTAVLLRIYNAQALIIADSSLTKEESIKIVDSCLEFNYKVFRAPLISDIEKNTTLSNQIQKIQIEDILEREPIQLDNKLVAKEIFNKCILVTGGAGSIGSEIVRQVASYKPSKLLIFDQAESPLYEIQQEIKHDFPDLNFEAIIGDVRKVDVLEDVFKKYNPQVVYHAAAYKHVPLMEKHPSEAIFANIMGSKNVADLSIN

SEQ ID NO: 22555 - DNA, 552 bp, Unknown
  Obtained from environmental sample
  misc_feature (1)..(552): n is a, c, g, or t
atgagtacattaaaagcagagctattagcaaaaagctataaaggccgtgaagttgttaaaaatgtaggacttgaagtaaaagctggcagcattgttggtttacttggcccaaatggcgcaggtaaaaccactaccttttacatgattgtaggcttagttcctagcgacaaaggtaaaatattaattgatgataacgatattaccttacttcctatgcacagccgtgctcgtttaggtattggttatttaccacaagagtcttctatttttagaaagctcactgtgtatcaaaatttaatggctattttagaaacgcgtaagcaactaaataaacaagccagggaagaaaccctaaatagtttgttggacgaatttagcctgcaacatattcgcgacagcttaggtatggcactatctggtggtgaacgtcgccgcgtagaaatagcacgtgctttagctgcagatcctaaatttatattgcttgatgagccctttgctggcgtggatcctatttcagtactcgatattaaaaaaattatagaacacctttaa

SEQ ID NO: 22556 - protein, 183 aa, Unknown
  Obtained from environmental sample
  DOMAIN (29)...(183): ABC transporter
  misc_feature (1)..(183): Xaa is any amino acid
MSTLKAELLAKSYKGREVVKNVGLEVKAGSIVGLLGPNGAGKTTTFYMIVGLVPSDKGKILIDDNDITLLPMHSRARLGIGYLPQESSIFRKLTVYQNLMAILETRKQLNKQAREETLNSLLDEFSLQHIRDSLGMALSGGERRRVEIARALAADPKFILLDEPFAGVDPISVLDIKKIIEHL

SEQ ID NO: 22557 - DNA, 324 bp, Unknown
  Obtained from environmental sample
  misc_feature (1)..(324): n is a, c, g, or t
atgtctgtttatcattatatattagcatggtctgaaaataagccattgtatctaagagacagtcttcgaagaattttaaatgcttctattgataatgatgatattaatgagctaactttattagttaagaaagaacacggtgatgatacagtcaatattcaacctattttttatgatcaaacgcatattccgacaagtattcaaactaataatgactatccaaaattactaggtttgaaaaatcctaaaaatatatctgctttacatagtgaagcagatgttaagttttcagaagatggtctaaccgtcatttacggtaaataa

SEQ ID NO: 22558 - protein, 107 aa, Unknown
  Obtained from environmental sample
  misc_feature (1)..(107): Xaa is any amino acid
MSVYHYILAWSENKPLYLRDSLRRILNASIDNDDINELTLLVKKEHGDDTVNIQPIFYDQTHIPTSIQTNNDYPKLLGLKNPKNISALHSEADVKFSEDGLTVIYGK

SEQ ID NO: 22559 - DNA, 885 bp, Unknown
  Obtained from environmental sample
  misc_feature (1)..(885): n is a, c, g, or t
atggtacgcaaaaactcaaactctaagaagtatgcgctatacggtcaagaagccattggctcgacatgggcactggccaagatgaatatgttcctacacggtgaggacaaccaccgtatcgagtggggcgataccatccgtaatccgctgctactcgataaagacggcaagcacttattacagttcgatgtggtcactgccaatccgccgttttcactggataaatggggtcatgaggatgccagcagcgatccttatggtcgcttccatcgcggtgtaccgcccaagaccaagggcgactatgcctttatcagtcatatgattgaaacgctcaagccaagtactggcagaatgggtgtagttgtaccacatggcgtgctgttccgcgcgtctagtgaaggcaaaatccgtcagcaactcatcgaagaaaacctgcttgatacggtgattggtttacctgagaagctgttttttggcacgggtattccagccgcaattctcatctttaaaaagaataagtctgacgacaaagtcctgtttatcgatgccagtaatgaatttaaatcaggtaaaaaccaaaaccagcttactgaggataatattgctagggttattgagacgtataaagcgcgggaaagcgtcgataaatatgcgtatctagcgagctttgatgagataaaagagaacgactttaacctaaacattccccggtatgtcgatatctttgaggaaaaggcggagattgatttggaggccggtcgtgctgaacgttggcgcttaaagcgagttaatctgttaaaaatgagatggcgaattttaaaggagttggttatatgcctaagggtggagcataatgggtcgaagtgtatgtcgaatttacaggng

SEQ ID NO: 22560 - protein, 295 aa, Unknown
  Obtained from environmental sample
  DOMAIN (74)...(232): N-6 DNA Methylase
  misc_feature (1)..(295): Xaa is any amino acid
MVRKNSNSKKYALYGQEAIGSTWALAKMNMFLHGEDNHRIEWGDTIRNPLLLDKDGKHLLQFDVVTANPPFSLDKWGHEDASSDPYGRFHRGVPPKTKGDYAFISHMIETLKPSTGRMGVVVPHGVLFRASSEGKIRQQLIEENLLDTVIGLPEKLFFGTGIPAAILIFKKNKSDDKVLFIDASNEFKSGKNQNQLTEDNIARVIETYKARESVDKYAYLASFDEIKENDFNLNIPRYVDIFEEKAEIDLEAGRAERWRLKRVNLLKMRWRILKELVICLRVEHNGSKCMSNLQX

SEQ ID NO: 22561 - DNA, 399 bp, Unknown
  Obtained from environmental sample
  misc_feature (1)..(399): n is a, c, g, or t
ttgagaacgagcaaattactatctgcaattcaagcgcaaattcagcctatatctagtgggcttacttctcaaaacgcttttgatattcattatctcaacaaggtattacaaacagtaaaccgtgaagttttagtacttaaaaccagtactgcctctcgatatgcagaccaaatttataagtcttggggaagttggtatcaaggtggcgatgatgaagaacaagtctacggagtcttccgcaagatgaaggataaagttcaggtctctcaagtggcaaaagcgtatcaagaaacctattcaaaaaacctaattgacacgctcaaagaccgctttgataaggaagaaataaccatagtgctcaacattgttaaggcactacctaattacagaacagcttaa

SEQ ID NO: 22562 - protein, 132 aa, Unknown
  Obtained from environmental sample
  misc_feature (1)..(132): Xaa is any amino acid
MRTSKLLSAIQAQIQPISSGLTSQNAFDIHYLNKVLQTVNREVLVLKTSTASRYADQIYKSWGSWYQGGDDEEQVYGVFRKMKDKVQVSQVAKAYQETYSKNLIDTLKDRFDKEEITIVLNIVKALPNYRTA

SEQ ID NO: 22563 - DNA, 438 bp, Unknown
  Obtained from environmental sample
  misc_feature (1)..(438): n is a, c, g, or t
ttggaaaattcaaaagaaagcaatgaaattgatataagtattgtagttccgctgtttaacgaagaagaatcgttaactgagctagcatttagaattgacgaagcgatttcatctcaatactcttacgagattatattcgtggatgatggttcaacggatacttcttttcatgtgataaaaaaactttctgtagaaaaagagaacatcagaggaatttgctttggtcataattatggaaaaagtgtagctcttcaggcaggattcgaaaaagtcaggggtaaatatgtagtaacgatggatgcagatcttcaggacgaccctgatgaagttcctgagatgattcaaatgctgaaagacggattagatatggttagcggctggaagaaagagcgttttgatcctatttcaaaaacagttccttccaaattttttactttn

SEQ ID NO: 22564 - protein, 146 aa, Unknown
  Obtained from environmental sample
  DOMAIN (13)...(146): Glycosyl transferase
  misc_feature (1)..(146): Xaa is any amino acid
MENSKESNEIDISIVVPLFNEEESLTELAFRIDEAISSQYSYEIIFVDDGSTDTSFHVIKKLSVEKENIRGICFGHNYGKSVALQAGFEKVRGKYVVTMDADLQDDPDEVPEMIQMLKDGLDMVSGWKKERFDPISKTVPSKFFTX

SEQ ID NO: 22565 - DNA, 336 bp, Unknown
  Obtained from environmental sample
  misc_feature (1)..(336): n is a, c, g, or t
ttggagcttccaaaatgttttatttatcagcctactcaggaagaatacgtagtcatcaattttcatgactccattcatgcttataccagtagaaaacctattaaatatgttgaaaaagtagctacaggagttattaccaataatatttcagaaactttagaagagcaagggttaagtcaacgcttagcatataaaatggcagatgaaatttatgcttggactattgattttagacgtcttcaaaaaggagatcgattcaaagtgatttatacagataagtatattgacgatactatttatactggggttcataatataaaagcgggcattttttga

SEQ ID NO: 22566 - protein, 111 aa, Unknown
  Obtained from environmental sample
  misc_feature (1)..(111): Xaa is any amino acid
MELPKCFIYQPTQEEYVVINFHDSIHAYTSRKPIKYVEKVATGVITNNISETLEEQGLSQRLAYKMADEIYAWTIDFRRLQKGDRFKVIYTDKYIDDTIYTGVHNIKAGIF

SEQ ID NO: 22567 - DNA, 603 bp, Unknown
  Obtained from environmental sample
  misc_feature (1)..(603): n is a, c, g, or t
atgggttctcgtcgttatgcctcccttggctcatatcttgcgtgtaaagcagtgtgtactaccttacgtgagaccaatttcaatgagcctgaaaaaagtgtagtaaaaagaatataccagcaatggctaatgtacttgaaagattatcttcctcgtacccctcctaaagatgccgccacaacatgcctgtttgcctggggagactcctcagggaaagtaaggctttttcagctaggtgacggtgctatttactatatgacagatactttcggcgttaatcatgaaaaatctgacaatatgtttggtaatgaaacaactgctttaggatattcaatacgttggcaagattggacttaccgagaaattcaattagattttggtgccacaattacattaatgacagatggaattagtgatgatatagataagcctcaacaatttttagattttctgtctggtaaattcatagctattagccctcgtcaaggtaagaaatacctaattaatgagctcaataattggcaaacccctcatcatagtgatgataaaagtattggggtaattatttggaaaaaacaacatggcagtagcacaaaagaataa

SEQ ID NO: 22568 - protein, 200 aa, Unknown
  Obtained from environmental sample
  misc_feature (1)..(200): Xaa is any amino acid
MGSRRYASLGSYLACKAVCTTLRETNFNEPEKSVVKRIYQQWLMYLKDYLPRTPPKDAATTCLFAWGDSSGKVRLFQLGDGAIYYMTDTFGVNHEKSDNMFGNETTALGYSIRWQDWTYREIQLDFGATITLMTDGISDDIDKPQQFLDFLSGKFIAISPRQGKKYLINELNNWQTPHHSDDKSIGVIIWKKQHGSSTKE

SEQ ID NO: 22569 - DNA, 654 bp, Unknown
  Obtained from environmental sample
  misc_feature (1)..(654): n is a, c, g, or t
ttgatggttaatcagtttcaagatgaaaaatcacaacccatctattctatcgttgatactggtcgtataatgaaaatgccttttaatggcttaaaactattagattatgcgataaactcaactttagcattcagtaatgttgctttaaagaaacatgataaagtaggtctgatttccttttcaaaaaagatcgaaaccttcttacctgccattcaaaaaatcacctatctcaatcgtattcttgaaactttatataatatagatacacaatttaacgatagtgattttggtttgctttacgctcaactaaaacgaaaagtaacccatcgtagtctgcttttattatatactaattttgaacacattagtggtttaaagcgtcaaatgccctatttgcaagccatttctaaaaagcacatgcttgtcgttgttttgtttgaaaacacagaattagacactattattaatgagaatgctgaagatttacaatccatttatcataaaactatagccgaaaaatttgctttcgaaaaacgattgatggttaaagaacttcaaaaacatggcattcaatccatattgactgctccagaaaacttaacgattaacacaattaataagtatttagagattaaggctagaggacttttgtaa

SEQ ID NO: 22570 - protein, 217 aa, Unknown
  Obtained from environmental sample
  misc_feature (1)..(217): Xaa is any amino acid
MMVNQFQDEKSQPIYSIVDTGRIMKMPFNGLKLLDYAINSTLAFSNVALKKHDKVGLISFSKKIETFLPAIQKITYLNRILETLYNIDTQFNDSDFGLLYAQLKRKVTHRSLLLLYTNFEHISGLKRQMPYLQAISKKHMLVVVLFENTELDTIINENAEDLQSIYHKTIAEKFAFEKRLMVKELQKHGIQSILTAPENLTINTINKYLEIKARGLL

SEQ ID NO: 22571 - DNA, 603 bp, Unknown
  Obtained from environmental sample
  misc_feature (1)..(603): n is a, c, g, or t
atgcagcgtgctcagggtaattattttattattttagatagcgattgtattttaccctctcaatatttaaacgaggttaataggagtttaaaacaagagtatgtagactgttttggaggtccagatgcggcgcatcaatcgttttctaaccttcaaaaagctattaattttagtatgacgtcctttttaacaacgggaggtattagaggacataaaaaaagtgtaaatacctttcagcctagaagctttaatatggggttatctaaaaaagcttttatagaaactgaagggtttggaagaatacacccaggtgaagatccagatttaacaatacggttgtggaaaaaaggatttaaaacaaaattaatacctgaagcttatgtgtttcataaacgccgaatatcttggtctaaattttacatccaagtaaataagtttggtatggtacggcctattttaaatttctggcacccagaaacaaaaaaaataacctattggtttccatctgtatttattttttctagtctattagcactaatatttgctgtttttggtgtagtatggccgttgtattgttttttattttactatattttgttttaa

SEQ ID NO: 22572 - protein, 200 aa, Unknown
  Obtained from environmental sample
  misc_feature (1)..(200): Xaa is any amino acid
MQRAQGNYFIILDSDCILPSQYLNEVNRSLKQEYVDCFGGPDAAHQSFSNLQKAINFSMTSFLTTGGIRGHKKSVNTFQPRSFNMGLSKKAFIETEGFGRIHPGEDPDLTIRLWKKGFKTKLIPEAYVFHKRRISWSKFYIQVNKFGMVRPILNFWHPETKKITYWFPSVFIFSSLLALIFAVFGVVWPLYCFLFYYILF

SEQ ID NO: 22573 - DNA, 405 bp, Unknown
  Obtained from environmental sample
  misc_feature (1)..(405): n is a, c, g, or t
ttggttgaagttgacagaagtagaactacgacagttttaaaggcgagtattatagagtatccaggtcatgttaataatgtttcagactggataacaaaatctagcgtatttgttcttccatcttattacagagaaggtgtgccgcgcagcactcaggaagcgatggcaattggaagacctattataactactgatgtacctggttgccgtgagacggttattgatggagtaaatgggtttttagtagaaaaatggaacccgaaagctttggcagaaaagatgatttactttatagaacatcctgaacagattaaagagatgggtgatgaaagctacaagctagcacaagagaaatttgatgcagataaagtcaataaacgactaataaatatgttgggtttataa

SEQ ID NO: 22574 - protein, 134 aa, Unknown
  Obtained from environmental sample
  DOMAIN (2)...(114): Glycosyl transferases group 1
  misc_feature (1)..(134): Xaa is any amino acid
MVEVDRSRTTTVLKASIIEYPGHVNNVSDWITKSSVFVLPSYYREGVPRSTQEAMAIGRPIITTDVPGCRETVIDGVNGFLVEKWNPKALAEKMIYFIEHPEQIKEMGDESYKLAQEKFDADKVNKRLINMLGL

SEQ ID NO: 22575 - DNA, 402 bp, Unknown
  Obtained from environmental sample
  misc_feature (1)..(402): n is a, c, g, or t
atgacgactcaaggctttctcatctctaaaagcacccgtattatcgattaccaaagcatctttgattccatattttgtataatcaatatcttctggattgtttgcagatataatatttactgtagtttcgttgatgataaatgcttggtttttcttcatcaactcttactgttccagaaaaatcgccatgaaacagaatcgttctttaaaatgagggcccgttttttcaaaaacgtcttattaatttcacttctcgaacaattggctctcaaacgcaatttgttttcccttttccgggtaaaccccatcattttcggaacccacccaatttacccaattttaaccaaatcccttaaaaaaaaccccacccctttgggctttaattggaaaccccaaaacccg

SEQ ID NO: 22576 - protein, 134 aa, Unknown
  Obtained from environmental sample
  misc_feature (1)..(134): Xaa is any amino acid
MTTQGFLISKSTRIIDYQSIFDSIFCIINIFWIVCRYNIYCSFVDDKCLVFLHQLLLFQKNRHETESFFKMRARFFKNVLLISLLEQLALKRNLFSLFRVNPIIFGTHPIYPILTKSLKKNPTPLGFNWKPQNP

SEQ ID NO: 22577 - DNA, 705 bp, Unknown
  Obtained from environmental sample
  misc_feature (1)..(705): n is a, c, g, or t
atgaccttctacaaaaaagccgatgggcaatattacgtaagaacgaaaggaggtattcaaaaaaacagaatacaaaacgatcctgcttttgaaaggactcgtgaaaacaatcaagagtttggcgaagtggcaaaaagcggaaaacgattaaggcgtgccctaatcgaagtcgtttcaaatgtcaaagatcggactaaaagtacgcgcttatcaagcaccttatttaaggtgaaaaatgctgataagacatcagcgcgtggagagagaaaagtaagtataggtattcaggaacctgaaggtaaattagccttaaatggtttcgattttaacaaaaacgcacctttagataccgtattattaaatgattatacattagacaccacagctaaagaaataacaataaacggttttattccaaatgtaatgctagcattgcctcaaggtgcaagtcatgtaacgctaaatgcggtgcacacaaatattgatttcgaatcaggagaaaaagaattagcaataagtaatgtagaaaccttaccgataaataatttaaatacagacctaacctttagctttacaacaccagcaacaggtagtggtattgaaatgtttttactcaaaattgaatttttacaggagttaaatacaaatctatatcctttaaaaaacggagcttttaatgcacttaaaatcattaaagtaatataa

SEQ ID NO: 22578 - protein, 234 aa, Unknown
  Obtained from environmental sample
  misc_feature (1)..(234): Xaa is any amino acid
MTFYKKADGQYYVRTKGGIQKNRIQNDPAFERTRENNQEFGEVAKSGKRLRRALIEVVSNVKDRTKSTRLSSTLFKVKNADKTSARGERKVSIGIQEPEGKLALNGFDFNKNAPLDTVLLNDYTLDTTAKEITINGFIPNVMLALPQGASHVTLNAVHTNIDFESGEKELAISNVETLPINNLNTDLTFSFTTPATGSGIEMFLLKIEFLQELNTNLYPLKNGAFNALKIIKVI

SEQ ID NO: 22579 - DNA, 711 bp, Unknown
  Obtained from environmental sample
  misc_feature (1)..(711): n is a, c, g, or t
atggttttaagaggtgcttatccagaaaaaggttttgatatatctttagctattattacaggagagttaagcgtgtttgatttcaaatttgatgattataatagctacaccaaaatttataaagatttagatagtgagtttaaaaagcataataataaaataagctatcaacgtgcttatgaagttgtgtatgaagacgcagtatctaacaatcaccaaataccaatagaaaataaaagagagacctacagaatattaaaaaaccaattagagtcgcaaaaaaattatatagactctatcccatttagggtaatggaaaataaaacgctattaaaggagtcttggaaaaaacttaggaatggtgttaatctaactaggtcgttttcaaatattatagtactatcattaaatgcagtatccaattggtttgggtcgtcttacattattggtttattatttacagtgtctattgcaggattcttttttagtttgtcattaaaccatattggtaattatgagtttacagccaaaattagcgattgggaatggcgctattttgtgcagtatttaaacccaacacatagatttgattatatgaagttagtagacgagaatccaagacaatggtttttcatatgggattttataggacgtatttttgttggatatggtatctatcaaactataacagcttataggaaatataagtaa

SEQ ID NO: 22580 - protein, 236 aa, Unknown
  Obtained from environmental sample
  misc_feature (1)..(236): Xaa is any amino acid
MVLRGAYPEKGFDISLAIITGELSVFDFKFDDYNSYTKIYKDLDSEFKKHNNKISYQRAYEVVYEDAVSNNHQIPIENKRETYRILKNQLESQKNYIDSIPFRVMENKTLLKESWKKLRNGVNLTRSFSNIIVLSLNAVSNWFGSSYIIGLLFTVSIAGFFFSLSLNHIGNYEFTAKISDWEWRYFVQYLNPTHRFDYMKLVDENPRQWFFIWDFIGRIFVGYGIYQTITAYRKYK

SEQ ID NO: 22581 - DNA, 333 bp, Unknown
  Obtained from environmental sample
  misc_feature (1)..(333): n is a, c, g, or t
ttgttttatcagttgttcttaaaacatcttatgtttagtaataaaaataacataataaataataataaagcaacaatacattgtggaattagagaaagaaaaataggtaataatgctattgtttgggatgcttttaataaaatagctgaatgtagtcatgcttattatgttggtctcattcctgcaacaaaaatggagattaaacaatttaaagaagcattagattataatatccatttgctgtcttggcaaaaagtagaaacgttttgcgaagaaaataaactagataaagtaaaagatatatttaaatataataaagggcaaatacattaa

SEQ ID NO: 22582 - protein, 110 aa, Unknown
  Obtained from environmental sample
  misc_feature (1)..(110): Xaa is any amino acid
MFYQLFLKHLMFSNKNNIINNNKATIHCGIRERKIGNNAIVWDAFNKIAECSHAYYVGLIPATKMEIKQFKEALDYNIHLLSWQKVETFCEENKLDKVKDIFKYNKGQIH

SEQ ID NO: 22583 - DNA, 456 bp, Unknown
  Obtained from environmental sample
  misc_feature (1)..(456): n is a, c, g, or t
atgagtgttaatgattttgatcattggaaatttcataggctcaccttatccagtgatttggtagaacacagtcaaaaccataaggcctatccagttattcatttctttcataataacaataaagaaaacgctataattctccaaatcgctaaattgaatgaagccatatatatcattaaaaattatgttaacacagatgttgaggccaatataagactcctctccaatatggaatccgctataaataattatatagaagttgttatagaagtgggtagcgcgcaactgaaagattataatgtggataaaatagaaatgaatgaactcaaaagaaaaggtctgttaaaacctaatctccaaaataaaaaacccgataaaaatatgcagcgccgacaatcagtactttatactctaataaagcatgatggctgggagtggaatgatgtcatacagtaa

SEQ ID NO: 22584 - protein, 151 aa, Unknown
  Obtained from environmental sample
  misc_feature (1)..(151): Xaa is any amino acid
MSVNDFDHWKFHRLTLSSDLVEHSQNHKAYPVIHFFHNNNKENAIILQIAKLNEAIYIIKNYVNTDVEANIRLLSNMESAINNYIEVVIEVGSAQLKDYNVDKIEMNELKRKGLLKPNLQNKKPDKNMQRRQSVLYTLIKHDGWEWNDVIQ

SEQ ID NO: 22585 - DNA, 768 bp, Unknown
  Obtained from environmental sample
  misc_feature (1)..(768): n is a, c, g, or t
atgttaaatgtacctttagctattgtggatgctactgtattaacagaagcgggttatgttggagaagatgtagaaagtttattaacacgtttacttcaagcagccgattataatttagagaaagccgaaaaaggaattgtttttatagacgaaatagataaaattgcacgtaaaagtgataatccctctattacgcgtgacgtttctggagaaggggtacaacaaggattattaaaacttcttgaaggtactgttgttaacgtgccaccaaaaggaggacgtaaacatccagaccaaaagtttatagaagtaaacacagagaatatattatttattgctggtggggctttcgacggtattaataaagtgatctctaaacgcttaaatatgcaagcggttggttatagcgcgtctatgagcgacaataaaatagatcacgataatttattacaatatattattcctaaagatttaaaagattttggattaataccagaaattattggtcgtcttcccgtattaacacatatgaatccgctagatggtgaaacgttaagagcgattttaaccgagcctaanaatgctattattaaacaatacaagaaattgtttgaaatggatgaaatcgatttaaagattacagaaggtgctctaggttatattgtagataaagccatcgaatataaattaggagctcgtggattacgttctttatgcgaagaagtattaaccgatgcaatgttcgaaattacctggaacagatgttaa

SEQ ID NO: 22586 - protein, 255 aa, Unknown
  Obtained from environmental sample
  DOMAIN (1)...(236): ATPase family associated with various cellular activities (AAA)
  misc_feature (1)..(255): Xaa is any amino acid
MLNVPLAIVDATVLTEAGYVGEDVESLLTRLLQAADYNLEKAEKGIVFIDEIDKIARKSDNPSITRDVSGEGVQQGLLKLLEGTVVNVPPKGGRKHPDQKFIEVNTENILFIAGGAFDGINKVISKRLNMQAVGYSASMSDNKIDHDNLLQYIIPKDLKDFGLIPEIIGRLPVLTHMNPLDGETLRAILTEPXNAIIKQYKKLFEMDEIDLKITEGALGYIVDKAIEYKLGARGLRSLCEEVLTDAMFEITWNRC

SEQ ID NO: 22587 - DNA, 372 bp, Unknown
  Obtained from environmental sample
  misc_feature (1)..(372): n is a, c, g, or t
atggaattaaaaaagaaagttatagctattgctacttgtacaaaaagttcgcactttaaacacgtattaaacgaggcgttaaaaaacgatatacatatagaaacctcttctgcttttgatattgatattgtagaaagccttaaagcagaaggtaaaattacagatgaaacatttgttataagtaacggttttaaacgtgctcaatatgttacaaatattgcgcgcttaattaacaacggtcaaaaaaactgtattcctattatagataactacgaagaaatcgaattgctttctgaagaagttaaagggaactataatattggtattcgtattgcttcagaagaagaacctaaatttgagttttacacgtag

SEQ ID NO: 22588 - protein, 123 aa, Unknown
  Obtained from environmental sample
  misc_feature (1)..(123): Xaa is any amino acid
MELKKKVIAIATCTKSSHFKHVLNEALKNDIHIETSSAFDIDIVESLKAEGKITDETFVISNGFKRAQYVTNIARLINNGQKNCIPIIDNYEEIELLSEEVKGNYNIGIRIASEEEPKFEFYT

SEQ ID NO: 22589 - DNA, 621 bp, Unknown
  Obtained from environmental sample
  misc_feature (1)..(621): n is a, c, g, or t
atgcaaaaaccaaaaatcgcttttattgatgacgagccgcgtatcttacgcagcttaaaaatgcattttcgccagtcacatgacgtatttattactaccgatgctactgagctgatggagtatgtcagccagaatgaggtacaagtggtcatcagcgaccaacgcatgccagataagcaaggtacggaggtattaagtgacattaaagcggcttcgccaaatactattcgtatcttgttaaccggttatgcggatctaaatgccgtgatggattctgtgaatgagggcgaaatttatcgctatatcactaagccatggcaaaatgatgaacttaaaaaaatcgttaataaagccacagaaattgctcagaaaacccaagaaataacgcaaaactctacggaaaaggatgcgactcaaaaccatgctgatagtggcactgttagcaatcgcaatatattggtattagatgacgatgagagcgtctatcaacaaataaaaagtcattttaagagtgcttataccgtgagctgggccagtaaccttgaacaggccgcgaagctattaccaaaaaaacgctttggcgtcacgattcacaatcctcgaccgattcttgatcagtaa

SEQ ID NO: 22590 - protein, 206 aa, Unknown
  Obtained from environmental sample
  DOMAIN (4)...(123): Response regulator receiver domain
  misc_feature (1)..(206): Xaa is any amino acid
MQKPKIAFIDDEPRILRSLKMHFRQSHDVFITTDATELMEYVSQNEVQVVISDQRMPDKQGTEVLSDIKAASPNTIRILLTGYADLNAVMDSVNEGEIYRYITKPWQNDELKKIVNKATEIAQKTQEITQNSTEKDATQNHADSGTVSNRNILVLDDDESVYQQIKSHFKSAYTVSWASNLEQAAKLLPKKRFGVTIHNPRPILDQ

SEQ ID NO: 22591 - DNA, 660 bp, Unknown
  Obtained from environmental sample
  misc_feature (1)..(660): n is a, c, g, or t
ttggtgaaagccgattaccaaattaaagatgatacgataaccaattcagatacaaccaaccaattaaatattggtattggagtttgntttangactttatttattaaactatatatttatatcatgaattttaaagcgagtttgatctttgttgtgacgatattttcaattggtttaatgtcatttcaattgcctgaaaaaatccaaaagaaagtagataaagaaataaagttaattttcaatattgatgttttcgtattagagccaattattgtgtctgaagaaattaatgccaaattgcgtactaagataaacgaaaatgatctttttaaaatttcattagatactgtttctttgggatatgcctatattggcaaagggtttggtaaagtagatgactttgattttttagtactatttgataccgatttaattattgttaagagcaagatactagtgtatcgggaagattatggaggagaaataggtagcaaacgctggcttaaacaatttaatggtaaaggcaaaaatgatactattgaatatgaaaaagatattattgcaatttctggagctactttgtcagcaaactctatgacagttgcagtcaacaatttgcttagaactataactattcttcataactataaagcaatttaa

SEQ ID NO: 22592 - protein, 219 aa, Unknown
  Obtained from environmental sample
  DOMAIN (121)...(210): FMN-binding domain
  misc_feature (1)..(219): Xaa is any amino acid
MVKADYQIKDDTITNSDTTNQLNIGIGVXFXTLFIKLYIYIMNFKASLIFVVTIFSIGLMSFQLPEKIQKKVDKEIKLIFNIDVFVLEPIIVSEEINAKLRTKINENDLFKISLDTVSLGYAYIGKGFGKVDDFDFLVLFDTDLIIVKSKILVYREDYGGEIGSKRWLKQFNGKGKNDTIEYEKDIIAISGATLSANSMTVAVNNLLRTITILHNYKAI

SEQ ID NO: 22593 - DNA, 477 bp, Unknown
  Obtained from environmental sample
  misc_feature (1)..(477): n is a, c, g, or t
atgtcagccttgttactgaaagtacatacgtcaggtataaaaattttaaataacgtagctgttgaagaactaagtgatttagggaacaaagtaaaattacaaactaattgtttcgatttttcatctcataaagtgtgtatagcaaccaacggatttacttcacaccttataaaaacggatgagataaaacccgcacgagcccaagtattaataaccaaacctatcgcaaatttgccttttaaaggcacgtttcatatggataaaggatattattattttagatctatagataacagggtgttgttaggtggcggaagacatcttgattttaaaacggaagaaaccacaaaatttgcccaaacaccactgatacaaaacacattagacgactttttaaaaaccgttattttaccaacaataccttttgaaatagaccaacgttggagtggaataatgggggttggaaataagaaaaan

SEQ ID NO: 22594 - protein, 159 aa, Unknown
  Obtained from environmental sample
  misc_feature (1)..(159): Xaa is any amino acid
MSALLLKVHTSGIKILNNVAVEELSDLGNKVKLQTNCFDFSSHKVCIATNGFTSHLIKTDEIKPARAQVLITKPIANLPFKGTFHMDKGYYYFRSIDNRVLLGGGRHLDFKTEETTKFAQTPLIQNTLDDFLKTVILPTIPFEIDQRWSGIMGVGNKKX

SEQ ID NO: 22595 - DNA, 483 bp, Unknown
  Obtained from environmental sample
  misc_feature (1)..(483): n is a, c, g, or t
atgcttacaagcagaaaaagtctagctaaaacatctggaagaccaggaaaaacccaactaatcaaccattttataataaataaagattggtttttagttgatttaccaggttatggttatgccaaagtatccaagagcacaaagaaggtgtttcaaaaatttataacacattattttgaaaaccgagagcaattagtaactgcatttgtacttgtggatattagacataaaccacaaccaatagatcaagaatttatgcaatatttaggagaaagcggaatacctttttctatcatatttacaaaagcagataagttaaaacctaaagctattgaaaatcacgttgaagactataaaacaatactgttagaaacatgggaagaaatgccaaattactttataacatcttctagcaaagacattggtaaagatgacgtactaaactacattgatggattaaatgaaaacatcataattgaatag

SEQ ID NO: 22596 - protein, 160 aa, Unknown
  Obtained from environmental sample
  misc_feature (1)..(160): Xaa is any amino acid
MLTSRKSLAKTSGRPGKTQLINHFIINKDWFLVDLPGYGYAKVSKSTKKVFQKFITHYFENREQLVTAFVLVDIRHKPQPIDQEFMQYLGESGIPFSIIFTKADKLKPKAIENHVEDYKTILLETWEEMPNYFITSSSKDIGKDDVLNYIDGLNENIIIE

SEQ ID NO: 22597 - DNA, 501 bp, Unknown
  Obtained from environmental sample
  misc_feature (1)..(501): n is a, c, g, or t
atgatttgcgaattcttaattgcatctcgtggtattattggtttacgtaaccaattattaactgcaactgctggtgagnctattatggcacaccgttataaagagtaccaacctgtaaaaggaagtattccaggacgtatttcaggatctttagtatctatggaaaacggaacggcgattccttattctatcgataaattacaagatagaggtaaattctttgtagagccaggagaaaatatttatgaaggtcaagttattggtgagaactctcgtcaagatgatatggctgtaaatattacaaaagcaaaaaaacagagtaacgtacgttcttctggagcagatgataaagcgaaaattgtaccagcaattaaattctctttagaagaagctttagaatatatccaaaaagatgagtatgttgaagtaacaccaaaccacttacgtattcgtaaaatttggttaaaagaaacagatcgtaaacgtaacaaaattgtttaa

SEQ ID NO: 22598 - protein, 166 aa, Unknown
  Obtained from environmental sample
  misc_feature (1)..(166): Xaa is any amino acid
MICEFLIASRGIIGLRNQLLTATAGEXIMAHRYKEYQPVKGSIPGRISGSLVSMENGTAIPYSIDKLQDRGKFFVEPGENIYEGQVIGENSRQDDMAVNITKAKKQSNVRSSGADDKAKIVPAIKFSLEEALEYIQKDEYVEVTPNHLRIRKIWLKETDRKRNKIV

SEQ ID NO: 22599 - DNA, 753 bp, Unknown
  Obtained from environmental sample
  misc_feature (1)..(753): n is a, c, g, or t
atggacgggattggaactttaaggagtttaaaagaaagtgctaccgctgaaaacaaaatggaactgctccaaaaatatttggaagaatttaaggtgcgtattgttttaaccgcccatcctacgcaattttacccaggatcagttttgggtattattacagatttgaccgaagctattaaagaaaatgatttgctccgcattaacgatctattggcacaattaggaaaaaccccattttttaaacataaaaaaccaacgccttatgatgaagcgattagtttaatctggtatttggagaacgttttttataagtcatttggagacatttatgattatatccaacaaaatatttttgatggtaaacagattgacaacaacatcatcaatattggtttttggccaggtggagatagagacgggaacccttttgtaacccctgaaattactcttaaggttgcagtacgtttaaaagaaaccatcattaaaaattactatcgcgacgtcagaagcctcaagcgtaaactcacgttttcaggtattgaagagcgtatgtcagtccttgaaaaagagctgtatgaactcatgattggcaatccttctgatttgacattagaaagttttaaagcagaattaatttcaattaaggaggtcatcattaaagaccaccaatccttataccattcagaaattaacagtgtacttaataaaatacatctatttggttccacctcgagccgattcttgatccactag

SEQ ID NO: 22600 - protein, 250 aa, Unknown
  Obtained from environmental sample
  misc_feature (1)..(250): Xaa is any amino acid
MDGIGTLRSLKESATAENKMELLQKYLEEFKVRIVLTAHPTQFYPGSVLGIITDLTEAIKENDLLRINDLLAQLGKTPFFKHKKPTPYDEAISLIWYLENVFYKSFGDIYDYIQQNIFDGKQIDNNIINIGFWPGGDRDGNPFVTPEITLKVAVRLKETIIKNYYRDVRSLKRKLTFSGIEERMSVLEKELYELMIGNPSDLTLESFKAELISIKEVIIKDHQSLYHSEINSVLNKIHLFGSTSSRFLIH

SEQ ID NO: 22601 - DNA, 552 bp, Unknown
  Obtained from environmental sample
  misc_feature (1)..(552): n is a, c, g, or t
ttgaatcatgaaagtgagctgaaaaaagttaagtcatggtattttgaaagtcagcaattaaaagtagcaatgttaaaaggcgaaagtattttacagctgcaaatagggcagttacgccacgatgcacaaacagatcctctaacggggcttcataatcgcagaagcttaaaagtatggcttgataaactaatccacgtacaaacgttatttaccattttagaaatagacatcgacttttttaaacgcgtaaatgacacatatggccatgacaaaggcgatgaaacactcaaagcattaaccgtgcttattcaaagtattgctcgcaaagacgatattgttgcgcgcattggcggcgaacagtttgtacttgtaatacccaatcaaaacagtgaaggtgcatttaaaatagctgaaaggttgcgccttgcagttgagtcgtcacatatagatacagttggttacataaccatatcaataggtattgctagttacccagagcacggcactaatattgagcaagtatttaaaaaagccgataacgcactttactnn

SEQ ID NO: 22602 - protein, 184 aa, Unknown
  Obtained from environmental sample
  DOMAIN (38)...(184): GGDEF domain
  misc_feature (1)..(184): Xaa is any amino acid
MNHESELKKVKSWYFESQQLKVAMLKGESILQLQIGQLRHDAQTDPLTGLHNRRSLKVWLDKLIHVQTLFTILEIDIDFFKRVNDTYGHDKGDETLKALTVLIQSIARKDDIVARIGGEQFVLVIPNQNSEGAFKIAERLRLAVESSHIDTVGYITISIGIASYPEHGTNIEQVFKKADNALYX

SEQ ID NO: 22603 - DNA, 339 bp, Unknown
  Obtained from environmental sample
  misc_feature (1)..(339): n is a, c, g, or t
atgagtacgctaaaaaacaaagtacagttaatcggaaacgttggacaagaaccaactattacaaaccttgaaagcggtaaaaaagtcgcacgcttatcattagccactaatgagaactacaaaaacgctaaaggtgaaaaacaaacagataccaattggcatacggttatcgcttggggtaaaacggctgatattattgaaaagtatgtaaccaaaggaaaggaaattgcagttgaaggcaaattaagttctaggtcttatgaggataaagacggcaacaaacgctatgtaaccgaagtcatagtaagtgaaatattattgctaggtaacgcagaataa

SEQ ID NO: 22604 - protein, 112 aa, Unknown
  Obtained from environmental sample
  DOMAIN (5)...(109): Single-strand binding protein family
  misc_feature (1)..(112): Xaa is any amino acid
MSTLKNKVQLIGNVGQEPTITNLESGKKVARLSLATNENYKNAKGEKQTDTNWHTVIAWGKTADIIEKYVTKGKEIAVEGKLSSRSYEDKDGNKRYVTEVIVSEILLLGNAE

SEQ ID NO: 22605 - DNA, 600 bp, Unknown
  Obtained from environmental sample
  misc_feature (1)..(600): n is a, c, g, or t
gtgttgataaaagtttctccaatgcttgacatcaaaaagacattagcgcagttccctgagtgttttaaagtgcaaattgtggctattgataatgaagttaaagaactgttgctgtatttgagtttgagctttgatgaagaagctcaaatcgaagtttggaatctttcttcaatgcataaagatgaagtccttagttttacatataccgaagaagaagaattgggttttgatcttggtaaaccagcgaagtatatatttgaacctaatgctgctttgatgaaatctggagcttttaaacttataagtgcacggtttgaaatccaaaagcttcattctaatacacatctttatagttctgatactttaatctcgggttttccgggaaagatcttattagtgaaagaagtattcaaaccttctaagaaagagattagaaagagaatcaaagacgggaaagtaaatgtgattgtccgaaattatccgatgggagcaaatgaaatcaagcggaaattcagcctcaaagatggtggagatgagtttcttgtgttctgcgaaatagaaaacgagggattcaaagcgatttggtgcagcagatcttaa

SEQ ID NO: 22606 - protein, 199 aa, Unknown
  Obtained from environmental sample
  misc_feature (1)..(199): Xaa is any amino acid
MLIKVSPMLDIKKTLAQFPECFKVQIVAIDNEVKELLLYLSLSFDEEAQIEVWNLSSMHKDEVLSFTYTEEEELGFDLGKPAKYIFEPNAALMKSGAFKLISARFEIQKLHSNTHLYSSDTLISGFPGKILLVKEVFKPSKKEIRKRIKDGKVNVIVRNYPMGANEIKRKFSLKDGGDEFLVFCEIENEGFKAIWCSRS

SEQ ID NO: 22607 - DNA, 573 bp, Unknown
  Obtained from environmental sample
  misc_feature (1)..(573): n is a, c, g, or t
gtgaggattaaagataatactcgcgatacgcttgtagtgacctctttcccaaaaaacgtaataaaatataatgaagattttagcttgactgcaaatataccgtttacgaatttcgacgaacagaaaatgacaattcgcgataaagattcggtaattgtaccctttaagaaatcgtacgatagcctacaaaacaaatatcgttttagttttgataaagttgaagataatagatacgctatcgaaatattaccggaagccattaccgattttttcgaaaataaaaatgacactttaaattatggattacgtacactttctgcaaacaaatatgcaaatattcgcgtaaatttaacaaatgcggtatatcctataattctgcaactcactaatgaaaaaggagaagtaaaagccgaagcttatgttacagaacctaaacctatagattttgaatttctagatgctagcacctattatttaagagctattttcgatcgtaataaaaatggtgtttacgatactggaaactacttaaaaggcatccaacccgtacgtgtaagtatgcgtataaagtag

SEQ ID NO: 22608 - protein, 190 aa, Unknown
  Obtained from environmental sample
  misc_feature (1)..(190): Xaa is any amino acid
MRIKDNTRDTLVVTSFPKNVIKYNEDFSLTANIPFTNFDEQKMTIRDKDSVIVPFKKSYDSLQNKYRFSFDKVEDNRYAIEILPEAITDFFENKNDTLNYGLRTLSANKYANIRVNLTNAVYPIILQLTNEKGEVKAEAYVTEPKPIDFEFLDASTYYLRAIFDRNKNGVYDTGNYLKGIQPVRVSMRIK

SEQ ID NO: 22609 - DNA, 456 bp, Unknown
  Obtained from environmental sample
  misc_feature (1)..(456): n is a, c, g, or t
ttgataatgtggttgattggnacaaaaatatgcgaaaaatatatttttcaaagtgatagaaaacgtctaattgatgatatgatttattctggaaaagtcctatattttaaagatcgtgttattccttttaaaaccgacgctcaaaaaataagctatacccaagaacaattagattgggcaaaagctaatgaagcatatatttggagctattttgtagatcgcgaattgctttttagtaccgatacaaaattggcgaatcgttttataaattcggcacccttttctaaattttatttagaagaaatagataatgaatcacccgataaattagggcagtatatgggctggcaaatcgtaaagtcttatatggaaaacaacactgttacttttaaacaacttttaaataaaagtagcgatgaaatttttaataacgcaaaatttaaacctagtagataa

SEQ ID NO: 22610 - protein, 151 aa, Unknown
  Obtained from environmental sample
  misc_feature (1)..(151): Xaa is any amino acid
MIMWLIGTKICEKYIFQSDRKRLIDDMIYSGKVLYFKDRVIPFKTDAQKISYTQEQLDWAKANEAYIWSYFVDRELLFSTDTKLANRFINSAPFSKFYLEEIDNESPDKLGQYMGWQIVKSYMENNTVTFKQLLNKSSDEIFNNAKFKPSR

SEQ ID NO: 22611 - DNA, 528 bp, Unknown
  Obtained from environmental sample
  misc_feature (1)..(528): n is a, c, g, or t
atgcttggttacggtggtccacaaacactccaaaaaataatagaccatttaaagcaagtttattgccattctattggggtggagtatatgtacattcgcaaaccagaagaacttaaatggattcacgaaaaacttaatattgataataaccagcctaatttttctaacgagaataaaaaatatattcttagaaaattaaatgaagctgtttcttttgaaacttttttacacacaaaatatgtaggacaaaagcgtttctctttacaaggtggtgaaactttaatacctgctttagaagccttaattgaagaagctgctgaacacggcgttaaggaatttgtaatgggaatggnccaccgtggacgtttaagcacccttacaaacattttcggcaaatctgctaaagatatctttagtgagtttgatggtcaagattacgaagacaaggtcttcgatggtgattgtcaaataccacttaggttggacaagtcatcgcgaaaccaaatcttggcaccgaaatacacttaa

SEQ ID NO: 22612 - protein, 175 aa, Unknown
  Obtained from environmental sample
  misc_feature (1)..(175): Xaa is any amino acid
MLGYGGPQTLQKIIDHLKQVYCHSIGVEYMYIRKPEELKWIHEKLNIDNNQPNFSNENKKYILRKLNEAVSFETFLHTKYVGQKRFSLQGGETLIPALEALIEEAAEHGVKEFVMGMXHRGRLSTLTNIFGKSAKDIFSEFDGQDYEDKVFDGDCQIPLRLDKSSRNQILAPKYT

SEQ ID NO: 22613 - DNA, 741 bp, Unknown
  Obtained from environmental sample
  misc_feature (1)..(741): n is a, c, g, or t
atggcacaattagatggatataatacaatcggtacaatcaatattgtagtaaataaccaaattggttttacgacaacttatttagatgcacgatcaagtacgtattgtacagatgttggtaaagtaacattatctcctgttttacacgttaatgcagacgatgcagaagcggttgtacatgcgactttatttgctttagattttagaatgaaatttaaacgtgatgtgttcattgatttattaggctatagaaaatacggtcataatgaaggggatgaaccccgttttacacaacctaagttatataaagcaattgcaaaacataataacccgagagatatctacgccgctaaattaatagctagtggtattatagacgagaactatgttaaagacttagaaaaagcttataaagatgctctagaagaaaaattagaagattctagaaaagaagttaaaacagtgattacaccatttatgcacgacacttggaagaacttcgagcgtgtggatgagcataaaatgatggaacctgtagacaccactacaagcattgaaaaacttactgaaatcactaaggtgatttcaaatttgccaaaagataaaaagtttattcgtaaaattgaacgtttaatacaatctagacaaaaaatgttcgacgagaacaaactagattgggcaatggccgaacatttagcttacggaacacttttagatgaaggttacgatgttagaatttaa

SEQ ID NO: 22614 - protein, 246 aa, Unknown
  Obtained from environmental sample
  DOMAIN (1)...(157): Dehydrogenase E1 component
  misc_feature (1)..(246): Xaa is any amino acid
MAQLDGYNTIGTINIVVNNQIGFTTTYLDARSSTYCTDVGKVTLSPVLHVNADDAEAVVHATLFALDFRMKFKRDVFIDLLGYRKYGHNEGDEPRFTQPKLYKAIAKHNNPRDIYAAKLIASGIIDENYVKDLEKAYKDALEEKLEDSRKEVKTVITPFMHDTWKNFERVDEHKMMEPVDTTTSIEKLTEITKVISNLPKDKKFIRKIERLIQSRQKMFDENKLDWAMAEHLAYGTLLDEGYDVRI

SEQ ID NO: 22615 - DNA, 915 bp, Unknown
  Obtained from environmental sample
  misc_feature (1)..(915): n is a, c, g, or t
gtgtttcaggactctgaagtgtctaacacagaacattcgtttaaagacaatcaaacctttaggtttagtgatatctcattaaaactcttacacaatattacagaaaaagataaattacgttttacattattaaatgtatttaatcaactagattttgaggagtcctcaaatagtgatgcctcagtaaataacagtaatcaactaaaacaacaaaacagagcatctgctatacaatatcaacatatttggaataacaaattcaacaccacaattaaagggtattactcaaattacgatttaagatcttcggattatgatatggcaaataaccaacgtttaatacaagaaaataaagtagttgatactggttttaatattgatgcttactatgattttaatacctctttttcaattaatggaggttatcaatttaacgaagtttcggtaagtaatttagaagaaacaaatgactcttttttagatgttaacctaaagcgaaacttaacagcacatagtgtctatgccgaaacgatattacaatccaaaaacaaaaaatctttaattaaactagggtttcgtcataattacttcaaaaattttaaaataggtgtgttagaaccaaggttacatattagtcagcgctttttaaaacattttagagccgaactttcaggtgaatataaaagtcaaaccacttcacagttaatagatttacaaaacgactttttaggtgtagaaaagcgtcgatgggttttggctaacaataataccattccaattcaaaaaagtaagcagttaggtttagggctaacttataataaaaacaaattattattaagtattgaaggctattataaaacggtttatggcgtgactacccgaagtcaagaatgcaaaatcaatatcaatttataa

SEQ ID NO: 22616 - protein, 304 aa, Unknown
  Obtained from environmental sample
  misc_feature (1)..(304): Xaa is any amino acid
MFQDSEVSNTEHSFKDNQTFRFSDISLKLLHNITEKDKLRFTLLNVFNQLDFEESSNSDASVNNSNQLKQQNRASAIQYQHIWNNKFNTTIKGYYSNYDLRSSDYDMANNQRLIQENKVVDTGFNIDAYYDFNTSFSINGGYQFNEVSVSNLEETNDSFLDVNLKRNLTAHSVYAETILQSKNKKSLIKLGFRHNYFKNFKIGVLEPRLHISQRFLKHFRAELSGEYKSQTTSQLIDLQNDFLGVEKRRWVLANNNTIPIQKSKQLGLGLTYNKNKLLLSIEGYYKTVYGVTTRSQECKININL

SEQ ID NO: 22617 - DNA, 798 bp, Unknown
  Obtained from environmental sample
  misc_feature (1)..(798): n is a, c, g, or t
ttgagatgggatattgattttgcagatttagctgtaaaaggaagagctgtaagaggaaatagaattacaaaatatagtattaaatctgtcgattttaaaagtgaaggagtttctacattaaaacctcgtaaaatttggtttgatgatgctgttcaacgtttaaatgttgatgaaagaggtgagttgttaggtgaatttagagcagaagataagctgttaattattacacaaagtggaaaagccaaagctgtaaaaccaaatttagcaatgcattttgaagatgatatgattgtgttggaaaaatggaaacctaacaaaccaatttctgctatttattttgatggcgaaaaagaacgttattatgtaaagcgttttttaattgaaactacagaaaaggaagaagaatttatttctgatcatccaaaaagtcagttagaaattgtagctacagattataggccaattgcagaagtgcaattttctaaaagaagtttagaaaatgaagaagttaattttgaagagtttattgctgtaaaaggtattaaagctttaggaaatcaattaacaaccgataaaattaaacaggttaatttactagaatctttaccttttgaagaagaggaagaagaagagtcagcagaagcagaagaagttgatgaggaaattaacgaagataaattaccaattgatgttcctgaaactaaaaaaccagttttagaagaattatcagcagaagaaaaagcgaaaataggtttacaaaaatcgattgctagaaagaaagcgaacaaaagagaatga

SEQ ID NO: 22618 - protein, 265 aa, Unknown
  Obtained from environmental sample
  misc_feature (1)..(265): Xaa is any amino acid
MRWDIDFADLAVKGRAVRGNRITKYSIKSVDFKSEGVSTLKPRKIWFDDAVQRLNVDERGELLGEFRAEDKLLIITQSGKAKAVKPNLAMHFEDDMIVLEKWKPNKPISAIYFDGEKERYYVKRFLIETTEKEEEFISDHPKSQLEIVATDYRPIAEVQFSKRSLENEEVNFEEFIAVKGIKALGNQLTTDKIKQVNLLESLPFEEEEEEESAEAEEVDEEINEDKLPIDVPETKKPVLEELSAEEKAKIGLQKSIARKKANKRE

SEQ ID NO: 22619 - DNA, 717 bp, Unknown
  Obtained from environmental sample
  misc_feature (1)..(717): n is a, c, g, or t
gtgatcaagatcggtcgagaaacagaatcttattggattacaacaganatagtggtaggttatagtgtatcttctgctgataaatctctaacaancattcaaaaatctggcataaaagtaatttataatggagattggctagaagaaactcctctaggaagagctgaatggattaagtattttggagtattgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgaaacaggtggcgcaatttactatgaattagcaggaacaagaccagatttggttttaaaagatttgattaaaattacaaatcctgaagtattaccaaattatgagtttaccttttttgaaaaaatgaaataa

SEQ ID NO: 22620 - protein, 238 aa, Unknown
  Obtained from environmental sample
  misc_feature (1)..(238): Xaa is any amino acid
MIKIGRETESYWITTXIVVGYSVSSADKSLTXIQKSGIKVIYNGDWLEETPLGRAEWIKYFGVLFDKEKQADSIFKVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGETGGAIYYELAGTRPDLVLKDLIKITNPEVLPNYEFTFFEKMK

SEQ ID NO: 22621 - DNA, 558 bp, Unknown
  Obtained from environmental sample
  misc_feature (1)..(558): n is a, c, g, or t
ttgaaaaaaaataggttttttttatgtttcatgttatttgtgatgtttcaaatgatacacgctcagactgttgagctaaatgggacaatcactgctgaagacgatattgaaagtattcatatattaaataaaacctctttaactaatgcaacatcaagcaaagacggaagctttgttatcaaggctaaattaaacgataccattatattttctgcagtgcaatatacattactaaccaaagtagttagtcaagaggatataacatcaaaaacaatagcagttactttaaaattacaaaccaatcaattagatgaagtgtttttaaaaaggtctttgtcaggaaatttagaagacgatttgttgcttttagaggctaaaccagtaatcaatttttatgacgtaggcatacctggataccaaggaaaacaaaaaacatctgccgaaagagtcttacatgaagcaacaacaggaggaggttttataccattaaatccattgttaaacggtatatcaggtcgtactaaaaagctaaaagaaattgtaagactagaaaatgat

SEQ ID NO: 22622 - protein, 186 aa, Unknown
  Obtained from environmental sample
  misc_feature (1)..(186): Xaa is any amino acid
MKKNRFFLCFMLFVMFQMIHAQTVELNGTITAEDDIESIHILNKTSLTNATSSKDGSFVIKAKLNDTIIFSAVQYTLLTKVVSQEDITSKTIAVTLKLQTNQLDEVFLKRSLSGNLEDDLLLLEAKPVINFYDVGIPGYQGKQKTSAERVLHEATTGGGFIPLNPLLNGISGRTKKLKEIVRLEND

SEQ ID NO: 22623 - DNA, 402 bp, Unknown
  Obtained from environmental sample
  misc_feature (1)..(402): n is a, c, g, or t
gtgtcactcgagcgcagtcaagaggtaaaagaatatttaaaccaattaaagtgtcactcgagcgcagtcgagaggtcaattatgaaaagctattttgtttatatattaaaatgtaaagacgatttattatatattggaattacgaataatttaaatagaagactaatagagcataatcaaggtttaaataaaacatgctttacttttaaaaggagaccggttgaaattattttctatcaagattttaatgatgtaaatcaagtcatttattttgaaaagaaaattaaaaaatggagcggtaaaaagaagttggcattggcaaatggagattttgatatgttacaaatattggcggaatgtagaaatgctacacattcaaattataagcctgagaatgattga

SEQ ID NO: 22624 - protein, 133 aa, Unknown
  Obtained from environmental sample
  DOMAIN (30)...(111): GIY-YIG catalytic domain
  misc_feature (1)..(133): Xaa is any amino acid
MSLERSQEVKEYLNQLKCHSSAVERSIMKSYFVYILKCKDDLLYIGITNNLNRRLIEHNQGLNKTCFTFKRRPVEIIFYQDFNDVNQVIYFEKKIKKWSGKKKLALANGDFDMLQILAECRNATHSNYKPEND

SEQ ID NO: 22625 - DNA, 702 bp, Unknown
  Obtained from environmental sample
  misc_feature (1)..(702): n is a, c, g, or t
atgaaggatagaaaaagaatagtagagctgaaatcattatcaagattttcagacttaaacaaccctgaatctctggtgaattgggcattagataatttagaatttccactatcgcctattctggaaagtgttttaatctattttcaaaaatatggtaagattaaaccatcagaagataattcaagccgatacgtaccatttccagagcaactatttcataatatagattcaaatatcaaggataaaaatgaatacggattttggcttaaccttgatggtgtctatgagtttataactcattcagaacatcgtgctctaaatgttcaagacccaaatgatattataaaatcattatctaagctaaaggaaggtgttgaagaaaaattgtccgaacttatcacaaaaaagcaaaatatagagcaccttaaaaatatactgttcgaatacagtagtcttgaaaagcacattgaactttttaaaagaaaggacgagctacttagattcaaaattggcgatagcttaaaaggtcttactgaagattcttttaaacttcatatgttggcacataagaacaaaaccgatatcctcaaaaaatacaattctttacaaaaggaatatgaggaatttacaagcagaaagaacctgctagaaaattaccaaaaaagaattaacaaattagagaccaaccttttcgaaaataat

SEQ ID NO: 22626 - protein, 234 aa, Unknown
  Obtained from environmental sample
  misc_feature (1)..(234): Xaa is any amino acid
MKDRKRIVELKSLSRFSDLNNPESLVNWALDNLEFPLSPILESVLIYFQKYGKIKPSEDNSSRYVPFPEQLFHNIDSNIKDKNEYGFWLNLDGVYEFITHSEHRALNVQDPNDIIKSLSKLKEGVEEKLSELITKKQNIEHLKNILFEYSSLEKHIELFKRKDELLRFKIGDSLKGLTEDSFKLHMLAHKNKTDILKKYNSLQKEYEEFTSRKNLLENYQKRINKLETNLFENN

SEQ ID NO: 22627 - DNA, 399 bp, Unknown
  Obtained from environmental sample
  misc_feature (1)..(399): n is a, c, g, or t
ttgacgattacatacaatccctctcagatgatgaataagaatattacttggaaagaactgaaggctcttgatgatttgtatcgtcataaaaaaactaaagctatcattcaagaccatccttacgtaaattacttaatacacgaaagaggtattttggatttaaagccgaataacataaaggtcatcatttctaccgatagatttgaagcgttctatgaaaaggaattcaaaaaaacctatgaagaagccaagaggtttctcatagaaaatgatattaagccaactgccaataaaaaatttacaattgaagatataaaaaccttgatgttaatagctgaaaacaaacaagagcttaaaacaacccaacaaacattgaagacttctctaatgagtttttga

SEQ ID NO: 22628 - protein, 132 aa, Unknown
  Obtained from environmental sample
  misc_feature (1)..(132): Xaa is any amino acid
MTITYNPSQMMNKNITWKELKALDDLYRHKKTKAIIQDHPYVNYLIHERGILDLKPNNIKVIISTDRFEAFYEKEFKKTYEEAKRFLIENDIKPTANKKFTIEDIKTLMLIAENKQELKTTQQTLKTSLMSF

SEQ ID NO: 22629 - DNA, 642 bp, Unknown
  Obtained from environmental sample
  misc_feature (1)..(642): n is a, c, g, or t
atgaaaactttacaacaattaacactattactatttgtacttattcaaagtatgtcttttgctcaggaagacaaattagaccttattgatcagaaatttaatcccttgttaacccaacaaaataaaggtgttgctatacttataaaaaaagataatgagataaatacattaagtcttggtaactttagcttacatgaaaatcatgtttttaatattggtagtgcatcaaaaacctttactgctattttattgcttcaagaagtagaaaaaggcaaagtaaaactaagtgatagtataggtatgtatttgacaccactaaaaaatgtagataatggattaactatccaacaattactaactcatgtgagtggtttggatgaagttataggaaaaaacatccaagatgcattttatgctaaaaatgattctatttataatattgatcttttaaatcaaatagaacaaaacaatccaaaaatgataggtaagtatgattattgcaatacaaactacttgttattaggcagaattattgaaaaaataacggattcaagttatcttgatttggttagagagcgtatcattattcctttaaaaatgaattatatgataccttatttacacaaggtttaccaaatgtag

SEQ ID NO: 22630 - protein, 213 aa, Unknown
  Obtained from environmental sample
  DOMAIN (29)...(212): Beta-lactamase
  misc_feature (1)..(213): Xaa is any amino acid
MKTLQQLTLLLFVLIQSMSFAQEDKLDLIDQKFNPLLTQQNKGVAILIKKDNEINTLSLGNFSLHENHVFNIGSASKTFTAILLLQEVEKGKVKLSDSIGMYLTPLKNVDNGLTIQQLLTHVSGLDEVIGKNIQDAFYAKNDSIYNIDLLNQIEQNNPKMIGKYDYCNTNYLLLGRIIEKITDSSYLDLVRERIIIPLKMNYMIPYLHKVYQM

SEQ ID NO: 22631 - DNA, 324 bp, Unknown; identical to SEQ ID NO: 20651
  Obtained from environmental sample
  misc_feature (1)..(324): n is a, c, g, or t

SEQ ID NO: 22632 - protein, 107 aa, Unknown; identical to SEQ ID NO: 20652
  Obtained from environmental sample
  misc_feature (1)..(107): Xaa is any amino acid

SEQ ID NO: 22633 - DNA, 492 bp, Unknown
  Obtained from environmental sample
  misc_feature (1)..(492): n is a, c, g, or t
ttgttaaagggagatacatataagaccatagcaagatcgtcagacgaggttatatttaaggacagaggtagtaaatttttgggttatgcctatccgttgcaatgtgaagaaaaggttaaagagataattgaccgattaaaaaaaaatcaccataaggcacgccattggtgttacgcctggcaaataggaactgatgccgttcaatttcgagttaatgatgatggtgagcctaataattctgcaggacagcccatttatggtcaaattctttcaaaggaattaacaaatgttttagtggttgtagtgcgctattttggtggcacaaaattaggagttggaggtttggtgaatgcctatagaacagcagctcaattagcattagaatcatctcaaataattacaaaaactgtcgatattcatttncaacttatttttggatatccaataatgaataaagtgatgcgtgttattaaagaaataatgttgctttaa

SEQ ID NO: 22634 - protein, 163 aa, Unknown
  Obtained from environmental sample
  DOMAIN (21)...(128): Uncharacterized protein family UPF0029
  misc_feature (1)..(163): Xaa is any amino acid
MLKGDTYKTIARSSDEVIFKDRGSKFLGYAYPLQCEEKVKEIIDRLKKNHHKARHWCYAWQIGTDAVQFRVNDDGEPNNSAGQPIYGQILSKELTNVLVVVVRYFGGTKLGVGGLVNAYRTAAQLALESSQIITKTVDIHXQLIFGYPIMNKVMRVIKEIMLL

SEQ ID NO: 22635 - DNA, 540 bp, Unknown
  Obtained from environmental sample
  misc_feature (1)..(540): n is a, c, g, or t
ttggtagatcaaggattgttactgtattttattggtttacaaatggaattagcaaccatgtgtattgataaatctagagcacttttagccattacttatgaggaagatgtagaatatgaaattttagaatcgcttttaaatagccacgaaagtttaaatatttacaggtatagctttaaatcttacttaaatgtagaaaatgttgtgaatcttattttattggataaatcgtattcaagatccttaaaatatcaactaaatagaattaaaagagatgtttttaaattgccaaaaagaaatgaagatactgcattaacttctttacaaaaagcaattacagaggcttgtaatttaattgatgatgcaaaagcaacagatttaattaaggttgataaaaatgaagttactagaaaaaatttggagaatttattggctactttaagtgataaaatccatgatacctctatgtctttaacagatatgtattttaatcattctgatgaacaaaaacagttagttgatcaaaactatacactttaa

SEQ ID NO: 22636 - protein, 179 aa, Unknown
  Obtained from environmental sample
  misc_feature (1)..(179): Xaa is any amino acid
MVDQGLLLYFIGLQMELATMCIDKSRALLAITYEEDVEYEILESLLNSHESLNIYRYSFKSYLNVENVVNLILLDKSYSRSLKYQLNRIKRDVFKLPKRNEDTALTSLQKAITEACNLIDDAKATDLIKVDKNEVTRKNLENLLATLSDKIHDTSMSLTDMYFNHSDEQKQLVDQNYTL

SEQ ID NO: 22637 - DNA, 483 bp, Unknown
  Obtained from environmental sample
  misc_feature (1)..(483): n is a, c, g, or t
gtgtttggtaaaaaaaagcaagtaacaaataacgcttcattaaaacgcgttaatcacgctccttctattatttcagaagatatgcgccttaccgggtcaataataagccaaggtgaagtgcaacttgatggccgcattgatggcgacattaaagctactcatttagtaattggcactacaggtgtagttgagggtattgttgaagcgacaagcgtgattgttaagggcaaaataattggttcattaaatgccagtgaagttaacattaaaaataacgctcatgtgcatggtgatatttttcacgatacgcttagtatagaagctggtgcaattattgaaggtaatttaaaacagcgctttgaaaaagaaaacttaacactcattaatgatgagtcaaagccggtgagcgatgtaaaaccattaattaacgaggacgatatcggcttgtcattcgtaaataaacaagcctctaataaaagctag

SEQ ID NO: 22638 - protein, 160 aa, Unknown
  Obtained from environmental sample
  DOMAIN (12)...(122): Protein of unknown function, DUF583
  misc_feature (1)..(160): Xaa is any amino acid
MFGKKKQVTNNASLKRVNHAPSIISEDMRLTGSIISQGEVQLDGRIDGDIKATHLVIGTTGVVEGIVEATSVIVKGKIIGSLNASEVNIKNNAHVHGDIFHDTLSIEAGAIIEGNLKQRFEKENLTLINDESKPVSDVKPLINEDDIGLSFVNKQASNKS

SEQ ID NO: 22639 - DNA, 390 bp, Unknown
  Obtained from environmental sample
  misc_feature (1)..(390): n is a, c, g, or t
ttggaaacgaagacgaagattaaaatggaaaaaacactttttgaaataagcaaaatggattgtccatcagaggaaaatctaatccgaatgaaattggacggaatttcaagtattgcgaatttggactttgatattccgaaccgaaaattgaccgtttttcataacggagaaatggacaaaatcgagaagtcagttatcgaactgaatttaggcggaaagaaaatctctactgaacaaaccgaccaaacggaatttcaagaaaacgctaaccaaaaaaaactactttggtctgtacttgcaatcaattttgccttttttatcatcgaaatgactactggaattatctcaaaatctatgggacttgttgccgatagcttggatatgcttnng

SEQ ID NO: 22640 - protein, 130 aa, Unknown
  Obtained from environmental sample
  misc_feature (1)..(130): Xaa is any amino acid
METKTKIKMEKTLFEISKMDCPSEENLIRMKLDGISSIANLDFDIPNRKLTVFHNGEMDKIEKSVIELNLGGKKISTEQTDQTEFQENANQKKLLWSVLAINFAFFIIEMTTGIISKSMGLVADSLDMLX

SEQ ID NO: 22641 - DNA, 411 bp, Unknown
  Obtained from environmental sample
  misc_feature (1)..(411): n is a, c, g, or t
gtgaatgacatcatagnactcaatcaggctattggtgaagttgatcaagacacttacaagcgactgcaagtatcagatacagtagaagagcatctaggaaaagagctgaagtttgatcgagaaattaccactggagttgatccaatggatcactctaaggttcttagcaaaaaaggaattaaagttctcagcctattcttcattgacaaagtagccaattaccgcgggtacactgaagatggtgtacctgtacaaggtaagtttgctagttggtttgaagaagagtttataaaacagcttaaaaaaccaaagtatcgtgttttatacccttcagtatgggataaagatgatgctggaaagtcaattatcaatgaacaagctctcaaggaaaatggcaagctctgttcataa

SEQ ID NO: 22642 - protein, 136 aa, Unknown
  Obtained from environmental sample
  misc_feature (1)..(136): Xaa is any amino acid
MNDIIXLNQAIGEVDQDTYKRLQVSDTVEEHLGKELKFDREITTGVDPMDHSKVLSKKGIKVLSLFFIDKVANYRGYTEDGVPVQGKFASWFEEEFIKQLKKPKYRVLYPSVWDKDDAGKSIINEQALKENGKLCS

SEQ ID NO: 22643 - DNA, 501 bp, Unknown
  Obtained from environmental sample
  misc_feature (1)..(501): n is a, c, g, or t
ttgtcagtattaaaagatggttggttaatgataaacagaacacacagaagaagatacaatgaaaaaatcttaatcgttggtttaggaaacataggcgaaaaatatacaaataccagacataatattggttttaaaattctcgattatttagccgaaaccaatgacattacttttgaaaccgtaaaacttggcgatgttgctactctaaaaattaaaggacgaaccttaattcttttaaagccaagtacgtttatgaatctcagcggaaaatctataaaatactggctagagaaagaaaaaatccctttagaaaacttacttgtggttactgacgatttaaaccttccttttgggtctttaagattaaaaacaaaaggtagcgacggaggtcacaacggattaaaagacacgcaagacaaattacaaacttcaaaatacaaccgctttagatttggtattagcgctgaatttagccaaggacgccaagtcgattacgtttaa

SEQ ID NO: 22644 - protein, 166 aa, Unknown
  Obtained from environmental sample
  DOMAIN (24)...(166): Peptidyl-tRNA hydrolase
  misc_feature (1)..(166): Xaa is any amino acid
MSVLKDGWLMINRTHRRRYNEKILIVGLGNIGEKYTNTRHNIGFKILDYLAETNDITFETVKLGDVATLKIKGRTLILLKPSTFMNLSGKSIKYWLEKEKIPLENLLVVTDDLNLPFGSLRLKTKGSDGGHNGLKDTQDKLQTSKYNRFRFGISAEFSQGRQVDYV

SEQ ID NO: 22645 - DNA, 933 bp, Unknown
  Obtained from environmental sample
  misc_feature (1)..(933): n is a, c, g, or t
ttgattcggccgagcaggcaaagattaagaaaagcttacgagtcatctagaacactcaaacatgtctggcaagtcgtcgttaagttcgttgactatcaaaataagtaccatatgcttgctgagcatcactatcctaagataatcgcgccacagcctactaaaattaatccactaattacaaatacagcttggttaaaagacggtaaggcgctggtcaaaattattcgcgcagtagagcataattgggagcaaacagtcgattatagccaagatcagattataggttggctgatattctcaggaattgtatatggtggcatcaacgaggtacaaatgcttcaaggatggcttacctcattgctcgccaaagagtatcagccatttatcaaagacaggataatggtctcgccgcgctttgtgcagaagcgctttggtaacgagcgagaagaagaaagtgaccagctttataacaccaagcaaatcgttgtagatgtggtcagtcagtgttggctgatgcgttatcataaaaaaagcagtcaagcagagatcaaacctatcattgccaagctgtcagaagataagataaaacaatacttgactgtggctttgtctgacgtgatcaatcctttaggtattaagccacttcccttttcaaggtttttatattacgccagttattactgggaggagctgaagggcactaatattgatcatgcttcagttggggtgctgcgaggtatgcataatactgctggactgagtacacaggactttggtcggtttttgaaccaaaaatatcagtataaagaggagccgtatgatctagaacatattttgacgctgtctatcagnaaaaactctgttaattcaaacgagacatctagtagtagttctaaccaaaagatagaggttagaaagtctgatttattatga

SEQ ID NO: 22646 - protein, 310 aa, Unknown
  Obtained from environmental sample
  misc_feature (1)..(310): Xaa is any amino acid
MIRPSRQRLRKAYESSRTLKHVWQVVVKFVDYQNKYHMLAEHHYPKIIAPQPTKINPLITNTAWLKDGKALVKIIRAVEHNWEQTVDYSQDQIIGWLIFSGIVYGGINEVQMLQGWLTSLLAKEYQPFIKDRIMVSPRFVQKRFGNEREEESDQLYNTKQIVVDVVSQCWLMRYHKKSSQAEIKPIIAKLSEDKIKQYLTVALSDVINPLGIKPLPFSRFLYYASYYWEELKGTNIDHASVGVLRGMHNTAGLSTQDFGRFLNQKYQYKEEPYDLEHILTLSIXKNSVNSNETSSSSSNQKIEVRKSDLL

SEQ ID NO: 22647 - DNA, 720 bp, Unknown
  Obtained from environmental sample
  misc_feature (1)..(720): n is a, c, g, or t
gtgattaatttaagaatacacctatttaatttagccaaatccaaacacctaaccaaattgaacgccttttcaaaaagatctaatacaacaataagtattcatagtctgttatggttttttttcattgcctttactgcaattcaatcttactctaggtttagcacaattcctaatgagttttattttttaaattttatatttattaccgttttttacctgaattacattgttttagttcctaaatttttactgaataaaaaaattataatgtatgtagtaatttcacttgcattagtaattttaataaatatttttttagaaccatttttaaaatcatttttaaaaccaaattttcaaagagaaattattagagaaaatttttcaagacctagagaacattctataaatttaagacctcctattttattgcttttattctttgctttaagtacgtgtattaagctagtttctgaatggtataaaactgaaaaggaaagaagtttaataacttctcaaaaaattaactctgaattatcattcttaaaagcgcaattaaatccgcattttttattcaatacattaaatagtatttattctttagcaaacaaaaaatctgacgatacaacagttgccattgttacactttctgaagttatgaggtatatgatttatgaaggcaatgaagaattctatccttcgaaaaagagattgaattcttaa

SEQ ID NO: 22648 - protein, 239 aa, Unknown
  Obtained from environmental sample
  DOMAIN (177)...(238): Histidine kinase
  misc_feature (1)..(239): Xaa is any amino acid
MINLRIHLFNLAKSKHLTKLNAFSKRSNTTISIHSLLWFFFIAFTAIQSYSRFSTIPNEFYFLNFIFITVFYLNYIVLVPKFLLNKKIIMYVVISLALVILINIFLEPFLKSFLKPNFQREIIRENFSRPREHSINLRPPILLLLFFALSTCIKLVSEWYKTEKERSLITSQKINSELSFLKAQLNPHFLFNTLNSIYSLANKKSDDTTVAIVTLSEVMRYMIYEGNEEFYPSKKRLNS

SEQ ID NO: 22649 - DNA, 708 bp, Unknown
  Obtained from environmental sample
  misc_feature (1)..(708): n is a, c, g, or t
atgaaggtaatcgttatagatgatgagcttcttgctttagaattattagaagattttgtgtctaaaattccgtatttggaattagtggcaagttgctccaatgcttttgaagctactactattttacaaacacaaaaaatagatttaatttttacagatatagaaatgccagatttttctggaatcgattttataaaatctttagaggtaaaaccactttttatttttacaacagcgtattcgcattatgcagtagaaggttttaatttaaatgccatcgattatcttgtgaaaccaattccttttcatcgatttttaaaggcagtttcaagagctcaaaatttattacaattaaaggtcgatgaaaaaactccaactgtaaatactcaggttacgcctcattttatatttgtaaaatctgaatatgaaaatttaaaaataaacttggcagacattaaatatatagaatctttaaaagattatattaaaattcacacacacaaagaaaaaccaattttaacattaagtagcctaaagagttttgaagagaaattgggcaaatcaaattttattcgtgtacacaaatcttatattgtttctttaaaacacatttattctgtgcaaagaaatagaattattattgatgataattggattcctattggtttaaattatagagaagactttatcagaaaaattgacaattaa

SEQ ID NO: 22650 - protein, 235 aa, Unknown
  Obtained from environmental sample
  DOMAIN (142)...(234): LytTr DNA-binding domain
  misc_feature (1)..(235): Xaa is any amino acid
MKVIVIDDELLALELLEDFVSKIPYLELVASCSNAFEATTILQTQKIDLIFTDIEMPDFSGIDFIKSLEVKPLFIFTTAYSHYAVEGFNLNAIDYLVKPIPFHRFLKAVSRAQNLLQLKVDEKTPTVNTQVTPHFIFVKSEYENLKINLADIKYIESLKDYIKIHTHKEKPILTLSSLKSFEEKLGKSNFIRVHKSYIVSLKHIYSVQRNRIIIDDNWIPIGLNYREDFIRKIDN

SEQ ID NO: 22651 - DNA, 435 bp, Unknown
  Obtained from environmental sample
  misc_feature (1)..(435): n is a, c, g, or t
ttgcgtgaacctattagtggtaaaactcatgttgaaaactataaaaaatatcttgatacaatgaataagaaatcagtcaaaaataaactagctgtaaaagtttattttgagaattcaaacttagataaatcaagctatgttattcgatatgtagataaagcatcgccactcaaaaacagcatccaagaatatttgaacggcttaacgccagaagaacaaaaactaggatttgagtcaagtaattttggcaacaatagctccatagtcaaaattgaggacaatatcgctaaaattcacttgactgctgataacttggccacagatttgcgctcgccccaacaggttatagactttagccattctatatatatgatcgcagatcagtttgaaactgttaacgaaacagagatatgtattaatgatacctataactac

SEQ ID NO: 22652 - protein, 145 aa, Unknown
  Obtained from environmental sample
  misc_feature (1)..(145): Xaa is any amino acid
MREPISGKTHVENYKKYLDTMNKKSVKNKLAVKVYFENSNLDKSSYVIRYVDKASPLKNSIQEYLNGLTPEEQKLGFESSNFGNNSSIVKIEDNIAKIHLTADNLATDLRSPQQVIDFSHSIYMIADQFETVNETEICINDTYNY

SEQ ID NO: 22653 - DNA, 711 bp, Unknown
  Obtained from environmental sample
  misc_feature (1)..(711): n is a, c, g, or t
atgctagatgaagcactgaagcaatacgaactagtattgaagttaaaaggcaatgaagtagaaagtcttcataatatatcagtcattcaaaatagattaaataaccctactgcggctaaaatatatatcgataatgcttataacttagagcctcatagccaaataattatccatacaagaataaaaatatacttaaacttaagtctgtttactgatgttattttactttgtgacgcataccttaaattatttaatgaaaatatgagtgtttataattcaatgggtatagcctataaagctctttgcctatgggatgatgctatcgaagtgctaagtagagcagtagagttaaataatgactttatagagggaaagaaaaacctagcaagttgttatcatctgaacggtaactttaataaagctatagaattatataaagaggttattaagcaaagcccacttgatttagatacgcatcactggctaaacagtcttttatgggagttgggtgacaatacatttttagattcatatttgatagcaaggaagatttcatcaaacataggtattgatagtgatgtagccgaaaagctgtatcgttcaggtaaagaagaagaagcgtttgatattgtcaaaacgtatctaaaaagctcccaatgccccccaaagtgttttactagctgtgatatcttgaggctgaccgattcttga

SEQ ID NO: 22654 - protein, 236 aa, Unknown
  Obtained from environmental sample
  DOMAIN (122)...(155): TPR Domain
  misc_feature (1)..(236): Xaa is any amino acid
MLDEALKQYELVLKLKGNEVESLHNISVIQNRLNNPTAAKIYIDNAYNLEPHSQIIIHTRIKIYLNLSLFTDVILLCDAYLKLFNENMSVYNSMGIAYKALCLWDDAIEVLSRAVELNNDFIEGKKNLASCYHLNGNFNKAIELYKEVIKQSPLDLDTHHWLNSLLWELGDNTFLDSYLIARKISSNIGIDSDVAEKLYRSGKEEEAFDIVKTYLKSSQCPPKCFTSCDILRLTDS

SEQ ID NO: 22655 - DNA, 363 bp, Unknown
  Obtained from environmental sample
  misc_feature (1)..(363): n is a, c, g, or t
atgacaaaacgaatcctaataatactgccaattctcttaattttattcggactgatatactttaatctgccgactgaaataacaagaaaatcggatattgaatttggaaataaaattgtgaaaaatataaaagagtatgaaaaactgaataatacattgcctgaatctaataattggaaaacactcacgaaatttggttttataaatgaaacgctcggaacaaaaccagcatacgaaaaaataaatgataatgaatttgaattaatatatctctatggatttgatggaccatatttactttataattcaaaaagtgaaaaatggaaagttgattttccgaaaattcctgaaaaattaaaataa

SEQ ID NO: 22656 - protein, 120 aa, Unknown
  Obtained from environmental sample
  misc_feature (1)..(120): Xaa is any amino acid
MTKRILIILPILLILFGLIYFNLPTEITRKSDIEFGNKIVKNIKEYEKLNNTLPESNNWKTLTKFGFINETLGTKPAYEKINDNEFELIYLYGFDGPYLLYNSKSEKWKVDFPKIPEKLK

SEQ ID NO: 22657 - DNA, 426 bp, Unknown
  Obtained from environmental sample
  misc_feature (1)..(426): n is a, c, g, or t
atgactaagaatttaattttactgattttagttttgattttcaatattggatttgctcaagattcaactgaaacaaagaggataaaagatttttataatactaaaaatataaaaattgtatttgaattaggaacttacaatattaaaataaaaagaaataaactttattttaataaaactcacggtaatatttctagcccaattaaatataacaanctttatagagaatttaacttcaataatatatatcaaataaaagatagtttaaataataagtattattttagatttggatgggtttcttttaaagaaaatgaaactttttttcagacttacaatggaataggtaatcacaaggcaaaggaaactgacggtttttctgattttgaatttacagtaatcgacattgattatatccattttggn

SEQ ID NO: 22658 - protein, 142 aa, Unknown
  Obtained from environmental sample
  SIGNAL (1)...(19)
  misc_feature (1)..(142): Xaa is any amino acid
MTKNLILLILVLIFNIGFAQDSTETKRIKDFYNTKNIKIVFELGTYNIKIKRNKLYFNKTHGNISSPIKYNXLYREFNFNNIYQIKDSLNNKYYFRFGWVSFKENETFFQTYNGIGNHKAKETDGFSDFEFTVIDIDYIHFG

SEQ ID NO: 22659 - DNA, 819 bp, Unknown
  Obtained from environmental sample
  misc_feature (1)..(819): n is a, c, g, or t
gtggatcaagaatcggctcgagattttgcagttgaaaaaggaaacaagaaacaggacttaagggaaacaggacgaatattgaatattctttccgatgctgtcttgatttctgattcccttcagtcttgtttcaaaataaaaagcatgaaaatactagttacgggcgcagccggattcattggttcacatacttcggaaaggcttaaggaaataggccatgaggttattggggtcgataacttttcgccctattacgatattgctctcaaaaatttaaacgccaaagctctttcagaaaagaatattgaaatcctaaaagttgatttaagaagcgatgatttaactgaaaagcttccaaacgatttggattatattttccacttcgcggcgcatccgggaatttcaaatatgtctacgtttgaggattatttcagcaataatatattggcaacacagcgattggtggagtttgcggaaaacctgccgaagaagccgttttttgtaaatattgctacttcttcaatttatggattggaggctactttcccagagagtgttcctccaaaacctgcttcttggtatggcgttaccaagcttactgcagaacaattggtgcttgcaaaaagccgtgaaaataaattgaagggaacctcatttcgcctgttctccgtttacggcccgcgcgaaagaccagacaaactctacanccgactgatagattgtggcttgaacaataaacaattcccattgtttgaaggaagtgaaaaacatttgtctagctttacctatgtgcaggatattgtggatggaattgtgana

SEQ ID NO: 22660 - protein, 273 aa, Unknown
  Obtained from environmental sample
  DOMAIN (51)...(272): NAD dependent epimerase/dehydratase family
  misc_feature (1)..(273): Xaa is any amino acid
MDQESARDFAVEKGNKKQDLRETGRILNILSDAVLISDSLQSCFKIKSMKILVTGAAGFIGSHTSERLKEIGHEVIGVDNFSPYYDIALKNLNAKALSEKNIEILKVDLRSDDLTEKLPNDLDYIFHFAAHPGISNMSTFEDYFSNNILATQRLVEFAENLPKKPFFVNIATSSIYGLEATFPESVPPKPASWYGVTKLTAEQLVLAKSRENKLKGTSFRLFSVYGPRERPDKLYXRLIDCGLNNKQFPLFEGSEKHLSSFTYVQDIVDGIVX

SEQ ID NO: 22661 - DNA, 330 bp, Unknown; identical to SEQ ID NO: 21675
  Obtained from environmental sample
  misc_feature (1)..(330): n is a, c, g, or t

SEQ ID NO: 22662 - protein, 109 aa, Unknown; identical to SEQ ID NO: 21676
  Obtained from environmental sample
  DOMAIN (27)...(107): Ribosomal protein L31
  misc_feature (1)..(109): Xaa is any amino acid

SEQ ID NO: 22663 - DNA, 558 bp, Unknown
  Obtained from environmental sample
  misc_feature (1)..(558): n is a, c, g, or t
atgaccaacacacccgaaattcaagaaattgttgaaaatgcccgattgggtaaagaaagtgcttttaaaaaattattgaatacctattggagtgatgtctatcgatttcagtttgctaagaccaataatgaaaacgaagctgaagatattaccatcaaaactttttctagagcctttgataaaattgatttatacagtgacaattatccgtttaaatcttggttgattacgatttcaaaaaatatttttatagattctattcgcggtcaaaaaaaagaaaccctatccatcagcaaagaaaactctgaagctttttatatttctgacaatgaaccatcacctgaagataaaattattattgagcagaatttggctgaactactgaaccatatcaaaaaactaaataacaaacaacaacaaattattcagttgcgatattttcaagaattgagttataaagaaatttcattgtcgctaaatgaatcgatgagttcggtaaaagtgaacttgatgcgtgctaaaaaattattgtctgagataatcgagtctaaaaaataa

SEQ ID NO: 22664 - protein, 185 aa, Unknown
  Obtained from environmental sample
  DOMAIN (4)...(182): ECF sigma factor
  misc_feature (1)..(185): Xaa is any amino acid
MTNTPEIQEIVENARLGKESAFKKLLNTYWSDVYRFQFAKTNNENEAEDITIKTFSRAFDKIDLYSDNYPFKSWLITISKNIFIDSIRGQKKETLSISKENSEAFYISDNEPSPEDKIIIEQNLAELLNHIKKLNNKQQQIIQLRYFQELSYKEISLSLNESMSSVKVNLMRAKKLLSEIIESKK

SEQ ID NO: 22665 - DNA, 519 bp, Unknown
  Obtained from environmental sample
  misc_feature (1)..(519): n is a, c, g, or t
atgaaagtagaaaagaataaaatagtatgtgcagcggtattagtcgtgattttcatattcctaatttcctattctatgatggttatgggcgatgataaaagtgaaaatgaaaatcttgaacagactttagtgccagatttagatgaaaaccaaaaagagtatgattctaaactggatgctatcaatgatttaaaagaagtgcgtgaaaataatgcgcctagcatctacgatgaaaaatttttggattcaacaggtctttacaatcctgatctaccagaacaggaaaagaaacgtatcgtagatagtatttacgaggctggcaaaattcaatattccgaaaagcgacaccagagctttgggcaaaagaaaatcactcaaaatactgcacagcaaatagactcagccgatatcaaaagagaacaaaaaatagaagctaaagaatggggtttggaacatctaactgttctttgctgcttcgccgaaaccaaacgaagtttcgattattggcaatacagatga

SEQ ID NO: 22666 - protein, 172 aa, Unknown
  Obtained from environmental sample
  misc_feature (1)..(172): Xaa is any amino acid
MKVEKNKIVCAAVLVVIFIFLISYSMMVMGDDKSENENLEQTLVPDLDENQKEYDSKLDAINDLKEVRENNAPSIYDEKFLDSTGLYNPDLPEQEKKRIVDSIYEAGKIQYSEKRHQSFGQKKITQNTAQQIDSADIKREQKIEAKEWGLEHLTVLCCFAETKRSFDYWQYR

SEQ ID NO: 22667 - DNA, 777 bp, Unknown
  Obtained from environmental sample
  misc_feature (1)..(777): n is a, c, g, or t
ttgattgagagaaaaagtaatagcattaccatgagtaaaaaagcaaattattcttacgtaggtatttcattcattatattattattcggtattatttttattcctaaaattattgatagagtaagtaataaagatattaaccgtacggacgagagtagaagcaaaggtgttattgttaatccaaaaagcgatgcgccaaataaatcagatgtaggctatttagtgattaatgaagagcgtaaaaaagtaccagagtttagttttactaatcaagatggtaaaacaataactaacaaggactatttaggtcaagtgtatgtggtggatttcttttttacaacgtgtcctaccatttgcccaagaatgagctctaacttagcatctatacaaaacacatttaaagataatccagagtttggtattgcatcatttagtatcatgccagataacgacactccagaaatcctaaaggcttatgctgcagattatggtgttactagcccaaattggcatttaatgacaggagataaagaggctatttaccaattatcaaatatgggttttaatatctttgttaatattgaaaactttgaacattcaggagattttgctttagtagataaagaaggatacttaagatctagaacagatgcttttggtaatcctaaaatattctataaaggtgtaattagcgagcaagaaaaaatggatgaagatggtaatgaacaagaaattacaatcttaaaagaagacattgcaaaactattacaagagtaa

SEQ ID NO: 22668 - protein, 258 aa, Unknown
  Obtained from environmental sample
  DOMAIN (54)...(221): SCO1/SenC
  misc_feature (1)..(258): Xaa is any amino acid
MIERKSNSITMSKKANYSYVGISFIILLFGIIFIPKIIDRVSNKDINRTDESRSKGVIVNPKSDAPNKSDVGYLVINEERKKVPEFSFTNQDGKTITNKDYLGQVYVVDFFFTTCPTICPRMSSNLASIQNTFKDNPEFGIASFSIMPDNDTPEILKAYAADYGVTSPNWHLMTGDKEAIYQLSNMGFNIFVNIENFEHSGDFALVDKEGYLRSRTDAFGNPKIFYKGVISEQEKMDEDGNEQEITILKEDIAKLLQE

SEQ ID NO: 22669 - DNA, 564 bp, Unknown
  Obtained from environmental sample
  misc_feature (1)..(564): n is a, c, g, or t
atggattttaaaaagaaaaaatacaatgagaaacataccattggtgaagataaagtaggtaatgctggagtgagttctctaataggttacgaaacatgcgtgttattaaataatccattggaaaaaaaaggaaagttaaaaaatatttatataaaatttaaaaaaagaaataatgctgtttttacagcatctttaaatattaaattttataattatgataccaaaaataaaaaacctggatatgaactttacaccaaaaacttagtagtaaaaccaaagaacaaaaaatacactttgaatattaatctaaaagatatggacatattcatgccagaagaaggtatgtgtattggaattgaatttattgatcctaataacgagtccaaaaaatatgatgttataggtcctatgtatagatttacctatgctacagaggaaaatctaacttggtctaaatatagaggtaaagaatggaaaaaaggcattgttaagtttgattacaaaaacgataataggacaggtaatgttatgattggcgcagatgttttatttacaaatgaataa

SEQ ID NO: 22670 - protein, 187 aa, Unknown
  Obtained from environmental sample
  misc_feature (1)..(187): Xaa is any amino acid
MDFKKKKYNEKHTIGEDKVGNAGVSSLIGYETCVLLNNPLEKKGKLKNIYIKFKKRNNAVFTASLNIKFYNYDTKNKKPGYELYTKNLVVKPKNKKYTLNINLKDMDIFMPEEGMCIGIEFIDPNNESKKYDVIGPMYRFTYATEENLTWSKYRGKEWKKGIVKFDYKNDNRTGNVMIGADVLFTNE

SEQ ID NO: 22671 - DNA, 648 bp, Unknown
  Obtained from environmental sample
  misc_feature (1)..(648): n is a, c, g, or t
ttgatagaaatgaaaattatattcgagttggctttgctcaatagttccatcttcaagctgcagaaaaacgagggtaaaagccgatcaaaaaaaatattaaaagccaactccttgattacaacttttgaaagtggtttaacatttatcaatgaactattcaaacaagcatctcatgaactaggttatgagtttgttcagacaaagattaaaacattatccgatataacacccgaactgtaccccatagcggctaaaaactataatcgtgtaaaaggtgcagatttagatagattttttaaatacttacgcagcccagcttctgttaagtatgtatttggaaagcctattgctcatgtagagttagatagcctgaaatggaagagagtagcgaatgttgataaaaaaaagaaagatcaagtgttaccagacttggtctttgaatctttatcaaagactgcatcttttattgtagtagattttttaaacgctataggagacggaaaaaaaatatcagatgtcaactctttagaacgtttcaatacgagcgaatatttatcatgggctagtcaagaacgtgttacgcatgaaactctacatgggtacattgctatgcgatttacaccaaaagtattcttcacttttgtttaa

SEQ ID NO: 22672 - protein, 215 aa, Unknown
  Obtained from environmental sample
  misc_feature (1)..(215): Xaa is any amino acid
MIEMKIIFELALLNSSIFKLQKNEGKSRSKKILKANSLITTFESGLTFINELFKQASHELGYEFVQTKIKTLSDITPELYPIAAKNYNRVKGADLDRFFKYLRSPASVKYVFGKPIAHVELDSLKWKRVANVDKKKKDQVLPDLVFESLSKTASFIVVDFLNAIGDGKKISDVNSLERFNTSEYLSWASQERVTHETLHGYIAMRFTPKVFFTFV

SEQ ID NO: 22673 - DNA, 696 bp, Unknown
  Obtained from environmental sample
  misc_feature (1)..(696): n is a, c, g, or t
atgccattgggacaatttcctataaaaatatcttccttatactttaatgctgttaaagatgcttgggacttcattcacaaagatcttgaaaaacttggaattattgatccaaattataaaagcgttgctaaaagaacaagcgaagcgaacataaatagaaaaaatcatagtgaaagtcagatagaacgttttcatagactggccacaagagagttacatgctgctgataatttcttctttccttcaaaactagaaccttttattcaggttgagcaactgtttgcctgtactagtaaaattgtctcttcagaatcaggcaagagtaactatagaattgcgagtaattcctttatagatttcttatctgaactatatggtaattcacctttaaaaattgtcacagtttttgatgagcatctcctatctagatatcgaaaatatttagagaaaaagataataagtaaagaaatatcaagtcatcatgcaaatacacttttgagttcagtacgcagaacactgtgtaggctgacccaagtacgggatctggagtatagctttttcgatataaatggctttgctgtaagtagagaaacagacgcgaaaaagccatttacaacgaacgagcggattcaggtattagatgctatcgaaaaaggattgtgtcagtctaaagcagctcttataacatacgaaaag

SEQ ID NO: 22674 - protein, 232 aa, Unknown
  Obtained from environmental sample
  misc_feature (1)..(232): Xaa is any amino acid
MPLGQFPIKISSLYFNAVKDAWDFIHKDLEKLGIIDPNYKSVAKRTSEANINRKNHSESQIERFHRLATRELHAADNFFFPSKLEPFIQVEQLFACTSKIVSSESGKSNYRIASNSFIDFLSELYGNSPLKIVTVFDEHLLSRYRKYLEKKIISKEISSHHANTLLSSVRRTLCRLTQVRDLEYSFFDINGFAVSRETDAKKPFTTNERIQVLDAIEKGLCQSKAALITYEK

SEQ ID NO: 22675 - DNA, 744 bp, Unknown
  Obtained from environmental sample
  misc_feature (1)..(744): n is a, c, g, or t
ttgaataccaacaaacataagacttccctcgtgtttcaagaaaatttagaagctatacaggacatacttgagtttgagaacttaaaccagagagtaaaaataagtcttagtataaaagtgaacttcttattcatatctcagtcttttaacgatatgtttatagcatatgatgattcaaaaagcctaaaatactctctagatgataacttgaaaattcttaatagtgttaaggaggaaatgaaaactcacaaaatatcatcagtaaaaactactagttttgtaaatatttttgaagtttcctaccatagatattatgcaatgcttatgtttatgcagaaaaataatgaagaaggaattaaacaaatatttaattgcattagactaaattcatattttccttatgataactataatgactttaaaagacattttgccacgagatattatctagaaatactacctttattattatcagacgaagaaaatgaagaatctaatttttacgtagaagtgatgtcgacttacgatatactattatcaagaattgaagataatgtcatactattcactattgatatttttaaggaattcttagaaatcaaagatttgagcgaagcgcatatcgaactaatcgaactaaagctagaagaattggatgataatgtagccaacttactttttaaatctgaagtattaaagtttctaccgcaagggtacggaacaagtcatgaacatatatgttga

SEQ ID NO: 22676 - protein, 247 aa, Unknown
  Obtained from environmental sample
  misc_feature (1)..(247): Xaa is any amino acid
MNTNKHKTSLVFQENLEAIQDILEFENLNQRVKISLSIKVNFLFISQSFNDMFIAYDDSKSLKYSLDDNLKILNSVKEEMKTHKISSVKTTSFVNIFEVSYHRYYAMLMFMQKNNEEGIKQIFNCIRLNSYFPYDNYNDFKRHFATRYYLEILPLLLSDEENEESNFYVEVMSTYDILLSRIEDNVILFTIDIFKEFLEIKDLSEAHIELIELKLEELDDNVANLLFKSEVLKFLPQGYGTSHEHIC

SEQ ID NO: 22677 - DNA, 711 bp, Unknown
  Obtained from environmental sample
  misc_feature (1)..(711): n is a, c, g, or t
atgaattgcgaaacaagtaacaaagacactataaaatataaagggttaaaggaatacgagccttctaaaatgcatcagataattaaagatgaaaatatatctgaagtcgtaattgcaagctataattcagaaaacattacttctaatatatattccgatttaattactttattagaaaaagggtttccaataaaagagtatactcaggtttatgaagatataacctatcgtgttcctgtacagtttgttgggaaggatttttataaatattttccatttagtcgaaacaataaaaataaattatatttagcctacagacgtctttttgatattttgttatcactagttggtttgtttttaggattactaattttaccttttattttaattggtaacgctttgggtaatagaggtgcgttattttacactcaagaacgtgttggaaaaaacggaatccctttcaagatttttaagtataggactatggttaaaaatgcagaagcagcaggagctgtttgggcaacaaaaaatgatactagaattacagctttgggtaagtctttacgagttactagattggacgaaataccacaattttcaactattttacaaggtgatatgagtctgactggtcctagaccagagcgtccttatttggtacacgaattgtcccaagtcattcctttttacgaaaccagacctatcgttaan

SEQ ID NO: 22678 - protein, 237 aa, Unknown
  Obtained from environmental sample
  DOMAIN (106)...(236): Bacterial sugar transferase
  misc_feature (1)..(237): Xaa is any amino acid
MNCETSNKDTIKYKGLKEYEPSKMHQIIKDENISEVVIASYNSENITSNIYSDLITLLEKGFPIKEYTQVYEDITYRVPVQFVGKDFYKYFPFSRNNKNKLYLAYRRLFDILLSLVGLFLGLLILPFILIGNALGNRGALFYTQERVGKNGIPFKIFKYRTMVKNAEAAGAVWATKNDTRITALGKSLRVTRLDEIPQFSTILQGDMSLTGPRPERPYLVHELSQVIPFYETRPIVX

SEQ ID NO: 22679 - DNA, 441 bp, Unknown
  Obtained from environmental sample
  misc_feature (1)..(441): n is a, c, g, or t
ttgtggagaggatacgttgcgatatttgaggtcaaaaataataagcttttaattaaagaactagattggttgactgacataaattttaatatgcaatcatttcgagatgaattatttccaaataacaagtttgaatggtattctggacttataagaattgatgaatttagaggagaatttgacaaagaacctgaaaacggaatatttgaatatttggagattgaaaacggaaatttgatacagaaaagaacattcaattttgaggaacttcaaagatttaagaaagaacaatatgactattttttattgtcagatgaagtagaaagtctttatgaattttggggaagaaataatgaaaatggagttattaataaagaaagcgttaataaaatcattttgaaaaacattatggaatacactcaaaaagtatacgttgaataa

SEQ ID NO: 22680 - protein, 146 aa, Unknown
  Obtained from environmental sample
  misc_feature (1)..(146): Xaa is any amino acid
MWRGYVAIFEVKNNKLLIKELDWLTDINFNMQSFRDELFPNNKFEWYSGLIRIDEFRGEFDKEPENGIFEYLEIENGNLIQKRTFNFEELQRFKKEQYDYFLLSDEVESLYEFWGRNNENGVINKESVNKIILKNIMEYTQKVYVE

SEQ ID NO: 22681 - DNA, 696 bp, Unknown
  Obtained from environmental sample
  misc_feature (1)..(696): n is a, c, g, or t
atgaacaatcataccttacttttcacaccagatgaacatctagaacctgccacagagtacactgtaaatgttaagctaaatgacatttataagaacattccgaaaacatttgaagaatatacgtttcaattcaaaactattacgccaagttttaatatcaccacacaaaacctacaatcctatagtaaagaatggcagtatatgtttgcgcaattacgatcggctgatgtaatttcacttgccgaagctaaaaaattagtgtctgcttctcagaattcaaaatcattacaattagtgtggaatgacgctgctgaaacttcaaaattcttcgagtttaaaatagatagcatcaaccgtttagttgaggacagtaaaattgatatcgcatgggatggatctgccataaaagcggaaaataaaggtgaaaatttcatcactattccaggcaaaaataactttaccattgtgaatacggaggttgttcaaagtccggaacaattcttatccctaaacttttcagaccctttagtgaagcagcaaaatttcgcaggcttagtgtcacttcagggcgttaaaaaccctaaatatattgttgatggtaatgtgttgcgtgtctatccagatactaaattggttggcgatattcaagttgatgtcttccaaggcatcaaaaataccgatgttcctgagcgataa

SEQ ID NO: 22682 - protein, 231 aa, Unknown
  Obtained from environmental sample
  misc_feature (1)..(231): Xaa is any amino acid
MNNHTLLFTPDEHLEPATEYTVNVKLNDIYKNIPKTFEEYTFQFKTITPSFNITTQNLQSYSKEWQYMFAQLRSADVISLAEAKKLVSASQNSKSLQLVWNDAAETSKFFEFKIDSINRLVEDSKIDIAWDGSAIKAENKGENFITIPGKNNFTIVNTEVVQSPEQFLSLNFSDPLVKQQNFAGLVSLQGVKNPKYIVDGNVLRVYPDTKLVGDIQVDVFQGIKNTDVPER

SEQ ID NO: 22683 - DNA, 648 bp, Unknown
  Obtained from environmental sample
  misc_feature (1)..(648): n is a, c, g, or t
atgggaagtagccttcagtttgaagggtatgatgtttctatggacttaccacctgattttttaaaagacagtttaagcattaattatttatttacaattattggtaataatgacattaggggagattttatttttccaaacggcaaaacaactgaaattaaatattcattggttccacacaatgatacaatgactatttttatgaaaacatctaatggatggtatccttgggatagacttagaattgtaaacaataaattaactttttcgtatgattactggtattgcccttctgcaacaaaaattgatttagagatattagatttatccactgattatttgaaagattcaacaacctggcaccaaaaagatgatagaaattgcgatacggataaattgaacaaaatttggagtttattttgctcaataaaaattgcctctattgaaaaaacgggagcgtataatcatcgtggaacagtaattcaaacaacaagaaatgtaattggtgaattatatcctaaccatgtatacgtccatactttaatggattttaataatgattcatcgactagatttgaggatattagaagggtattaactattgtaaaagatagaattgaaaaggaattaaaaacgaatgaaaaataa

SEQ ID NO: 22684 - protein, 215 aa, Unknown
  Obtained from environmental sample
  misc_feature (1)..(215): Xaa is any amino acid
MGSSLQFEGYDVSMDLPPDFLKDSLSINYLFTIIGNNDIRGDFIFPNGKTTEIKYSLVPHNDTMTIFMKTSNGWYPWDRLRIVNNKLTFSYDYWYCPSATKIDLEILDLSTDYLKDSTTWHQKDDRNCDTDKLNKIWSLFCSIKIASIEKTGAYNHRGTVIQTTRNVIGELYPNHVYVHTLMDFNNDSSTRFEDIRRVLTIVKDRIEKELKTNEK

SEQ ID NO: 22685 - DNA, 543 bp, Unknown
  Obtained from environmental sample
  misc_feature (1)..(543): n is a, c, g, or t
atgccagatttttctggaatcgattttataaaatctttagaggtaaaaccactttttatttttacaacagcgtattcgcattatgcagtagaaggttttaatttaaatgccatcgattatcttgtgaaaccaattccttttcatcgatttttaaaggcagtttcaagagctcaaaatttattacaattaaaggtcgatgaaaaaactccaactgtaaatactcaggttacgcctcattttatatttgtaaaatctgaatatgaaaatttaaaaataaacttggcagacattaaatatatagaatctttaaaagattatattaaaattcacacacacaaagaaaaaccaattttaacattaagtagcctaaagagttttgaagagaaattgggcaaatcaaattttattcgtgtacacaaatcttatattgtttctttaaaacacatttattctgtgcaaagaaatagaattattattgatgataattggattcctattggtttaaattatagagaagactttatcagaaaaattgacaattaa

SEQ ID NO: 22686 - protein, 180 aa, Unknown
  Obtained from environmental sample
  DOMAIN (87)...(179): LytTr DNA-binding domain
  misc_feature (1)..(180): Xaa is any amino acid
MPDFSGIDFIKSLEVKPLFIFTTAYSHYAVEGFNLNAIDYLVKPIPFHRFLKAVSRAQNLLQLKVDEKTPTVNTQVTPHFIFVKSEYENLKINLADIKYIESLKDYIKIHTHKEKPILTLSSLKSFEEKLGKSNFIRVHKSYIVSLKHIYSVQRNRIIIDDNWIPIGLNYREDFIRKIDN

SEQ ID NO: 22687 - DNA, 552 bp, Unknown
  Obtained from environmental sample
  misc_feature (1)..(552): n is a, c, g, or t
atggaatattcaccgagactaaaagaagagtataaaagcaaagtaattgctgctcttacagaagaatttggatacagtaatgtaatgcaagtgccaaaattacaaaagatagtattatctagaggtgttggggctgcagttgctgataagaaattggttgaccatgcagttgatgaatttacaactatcacaggtcaaaaagctgtatctactttatctaaaaaagatgttgcaactttcaaattacgtaaagggatgccaattggtgctaaagttacgttaagaggagaaagaatgtatgagtttttagatcgtttaataacttctgcacttccacgtgttagagattttaacggaataaaagcgacaggttttgacggaaggggtaactacaatctaggagttactgaacaaattatctttccagaaataaatattgacaaagttaataaaattgacggaatggatattacatttgtaacttctgctgaaacagataaagaagcaaaatcattattaacagaattagggttaccttttcaaaaaaactaa

SEQ ID NO: 22688 - protein, 183 aa, Unknown
  Obtained from environmental sample
  DOMAIN (27)...(83): Ribosomal protein L5
  misc_feature (1)..(183): Xaa is any amino acid
MEYSPRLKEEYKSKVIAALTEEFGYSNVMQVPKLQKIVLSRGVGAAVADKKLVDHAVDEFTTITGQKAVSTLSKKDVATFKLRKGMPIGAKVTLRGERMYEFLDRLITSALPRVRDFNGIKATGFDGRGNYNLGVTEQIIFPEINIDKVNKIDGMDITFVTSAETDKEAKSLLTELGLPFQKN

SEQ ID NO: 22689 - DNA, 867 bp, Unknown
  Obtained from environmental sample
  misc_feature (1)..(867): n is a, c, g, or t
ttgatggcttcggtatcacaatcctattataatctatacgccaacaaagcaaagcaagaggttttagctgaaaacatcaaactattagaaacttacgaaacattagcactaacatctgttgaagttggtaaggcatcagcagtagatgtattacgattacagatgcgtcaaaacgaaatgcaacaactaaaagatgttttaagtcaacaatttttagcagaacaaactaacttcaataatctattaaatagagataatgatgttaacgtgaatgtggtagatagtttaatgataccttcagaagactttgatattaattctgaaaatttagcattacatcctgaattgctgaaatatgataaactctatcaatccatagagcaatcagaattattaaatcaaaaagaaagtagtccaatgattggatttggcttggattatataaacgtagaaaaacgtccagatatggattttagtgacaacggtaaggatattgtaatgccaatggtttcagtttctatcccaattttcaataaaaaatataaatcgcaaaccaagcaaaacgaattgcaacagcaagaaataacagctcaaaaacaggaacgtttaaatgcattggaaacgcttttagacaaagcgaataacgaacgcatttctgcaagaataagttatgctacccaaaccaaaaacctaaagcaggccaaagatgcagaagatattttaatcaaaagctatgaaacaggaacgattgattttaatgatgttttggatattcaagagttgcagttaaaatttcaaatgaaccaaatagaatctgtgaagacctactatgtgcaaagtacaatcattaattattttattcagtaa

SEQ ID NO: 22690 - protein, 288 aa, Unknown
  Obtained from environmental sample
  misc_feature (1)..(288): Xaa is any amino acid
MMASVSQSYYNLYANKAKQEVLAENIKLLETYETLALTSVEVGKASAVDVLRLQMRQNEMQQLKDVLSQQFLAEQTNFNNLLNRDNDVNVNVVDSLMIPSEDFDINSENLALHPELLKYDKLYQSIEQSELLNQKESSPMIGFGLDYINVEKRPDMDFSDNGKDIVMPMVSVSIPIFNKKYKSQTKQNELQQQEITAQKQERLNALETLLDKANNERISARISYATQTKNLKQAKDAEDILIKSYETGTIDFNDVLDIQELQLKFQMNQIESVKTYYVQSTIINYFIQ

SEQ ID NO: 22691 - DNA, 858 bp, Unknown
  Obtained from environmental sample
  misc_feature (1)..(858): n is a, c, g, or t
atgaaaaaagtactttttatagaccgggacggtaccatgatcagagaaactgaagatgaacagatcgattcttttgaaaaattggttttttatcctaaagcactagcttatctgccaaaaattgccaaggaattagattatgaattagtcatgataacgaatcaggatggcttaggaactgcaagtttacctgaaaaggatttttggcccgtacataattttattatgcgttcttttgaaaatgaaggtgtaatttttaatgaagtggttattgatagaacatttgccaaagacaatgcaccctccagaaagccaaatactggtttagtcactaaatatttttccacagcatatgatctcccaaattcatttgtgattggtgaccggctaaccgacatagaattggctaagaatcttggagcgaaagggatatttatcaatgataatacccacttgggaacttctgaaataacagtaaaacgagaagatttagatgcctatatttcattaaaaaccaatgattggcaaagaatttatgagtttttgaaattaaaagaccgtgttgctgaaataaaaaggaaaaccaatgaaacggatatttttatcaagctaaacctagatggtacaggtaaaagtgagatagataccggcatagcattttttgatcatatgttagatcaacttgcgcgtcatggacaaatggacatagttattgatgttaagggagatcttgaggtggatgaacatcacactatcgaagacacagcaatagcgttaggcgaagtatttaataaagccttagggagtaagttaggtatagagcgtactgagccgatctgtcttgtttnnnnnntctaa

SEQ ID NO: 22692 - protein, 285 aa, Unknown
  Obtained from environmental sample
  DOMAIN (216)...(283): Imidazoleglycerol-phosphate dehydratase
  misc_feature (1)..(285): Xaa is any amino acid
MKKVLFIDRDGTMIRETEDEQIDSFEKLVFYPKALAYLPKIAKELDYELVMITNQDGLGTASLPEKDFWPVHNFIMRSFENEGVIFNEVVIDRTFAKDNAPSRKPNTGLVTKYFSTAYDLPNSFVIGDRLTDIELAKNLGAKGIFINDNTHLGTSEITVKREDLDAYISLKTNDWQRIYEFLKLKDRVAEIKRKTNETDIFIKLNLDGTGKSEIDTGIAFFDHMLDQLARHGQMDIVIDVKGDLEVDEHHTIEDTAIALGEVFNKALGSKLGIERTEPICLVXXX

SEQ ID NO: 22693 - DNA, 738 bp, Unknown
  Obtained from environmental sample
  misc_feature (1)..(738): n is a, c, g, or t
atgaagtggattagaagtgatagcaaacgtactttttacgatttagacgaagatggaaatccagaaaaaatattaccaaccaataaaattagaattcctgtaaataaagaaaatgctttaaaatatggcattgttgctcaaaaagatgcagatttaattgtaccttatattgatattactattgatagggctcttggtaaaaacaccattttaatgctcgacattttaaataatttcgattggaaacaaccaatttattttactggcggttccaatacagacagcgaatatatttggttaaaagattatttacaattagatggtgttgcttttaaatttgtaccaattaaaactccaactaaaatttataacgaaaatggacagttagttcgtgaattaagtttgtttgatattggtagaattgataccgaaaaaatgtacaacaacattcagaaatggaattggagaaacattaacgatggtaagatttatttagatgaacaaactaaaagaagcgccatttctttaagaaatagcttaatgcgtttatcgtctgcttttgcaatggaaggtgataccattaaagcacttgaaattttagatttatctatagacaaaatgccaattgaagattttgaccattacagtttatcaatggaatacccagaaatgtattatagggttgggagatcagaaaaaaggaagagacactgcagaagatttaattcgtttatttaa

SEQ ID NO: 22694 - protein, 245 aa, Unknown
  Obtained from environmental sample
  misc_feature (1)..(245): Xaa is any amino acid
MKWIRSDSKRTFYDLDEDGNPEKILPTNKIRIPVNKENALKYGIVAQKDADLIVPYIDITIDRALGKNTILMLDILNNFDWKQPIYFTGGSNTDSEYIWLKDYLQLDGVAFKFVPIKTPTKIYNENGQLVRELSLFDIGRIDTEKMYNNIQKWNWRNINDGKIYLDEQTKRSAISLRNSLMRLSSAFAMEGDTIKALEILDLSIDKMPIEDFDHYSLSMEYPEMYYRVGRSEKRKRHCRRFNSFI

SEQ ID NO: 22695 - DNA, 534 bp, Unknown
  Obtained from environmental sample
  misc_feature (1)..(534): n is a, c, g, or t
ttgcatgaaaataaatttaaagattatagaagtataaaagtaagtttttgtaatttaggaaatcaaaattatgccaaaaattctatgcaatcttttatttcagaaacgatagatgatattttaaaaactacaaattcttttgaagatgttatttttattctaccatcacaaagagcaaaagtgtttgtaaaacaaacttttaaagataaaatttcagtaggttttttaccagagatgctcaatatagaacaatttattcagcaaatttctggtgttcaaaaagcagataatattcagttgctgtttcatttttatactatttataaaagtgttgagcaaactccagattcttttgatacgttttcttcttgggcattaacagtgttgcaagatttttatgaaatagatcagcatttaattaactctaaagatatttttatctatttaagagatattgaacgtcttaaaaaatggtctgtaaatggcacgtttacagaaacagctttgaataaagatcattattcttttttagaa

SEQ ID NO: 22696 - protein, 178 aa, Unknown
  Obtained from environmental sample
  misc_feature (1)..(178): Xaa is any amino acid
MHENKFKDYRSIKVSFCNLGNQNYAKNSMQSFISETIDDILKTTNSFEDVIFILPSQRAKVFVKQTFKDKISVGFLPEMLNIEQFIQQISGVQKADNIQLLFHFYTIYKSVEQTPDSFDTFSSWALTVLQDFYEIDQHLINSKDIFIYLRDIERLKKWSVNGTFTETALNKDHYSFLE

SEQ ID NO: 22697 - DNA, 375 bp, Unknown
  Obtained from environmental sample
  misc_feature (1)..(375): n is a, c, g, or t
atgaaaaaatctaactttatatcgcttgacagtttgtcattacaagattttgatgaaaattcagaattaatccctttaatgacgccagaagatgaagaaaaaatagcaaaagaggaattgccagaaacacttccaattttgtcattacgtaacacagtattgtttccaggtgttgtaatacctattactgcaggacgcgataaatctattaaattaattaacgacgctnataaaggcggtaaggtcattggtgttgtttctcanatagatgaagatgtagaagacccntangcagaggatttacatcaaattggtactgtagctagaattttaaagtttttaaaatgcctgatggtaacacacagttattataca

SEQ ID NO: 22698 - protein, 125 aa, Unknown
  Obtained from environmental sample
  misc_feature (1)..(125): Xaa is any amino acid
MKKSNFISLDSLSLQDFDENSELIPLMTPEDEEKIAKEELPETLPILSLRNTVLFPGVVIPITAGRDKSIKLINDAXKGGKVIGVVSXIDEDVEDPXAEDLHQIGTVARILKFLKCLMVTHSYYT

SEQ ID NO: 22699 - DNA, 519 bp, Unknown
  Obtained from environmental sample
  misc_feature (1)..(519): n is a, c, g, or t
ttgcatattaatacagatcgttttatattggaaatagttgatgcgaatgaaaatttatgcaagcatggagaacttggagaaatagtaattacagatctcgataattacgtttttcctttaattagatataaaattggcgacttagggatattgactgaaagggtttgtacatgtggaattaacttaccattattggaaaaagttgaaggaagagtttttgatttaatcataggtgtaaatggaaataccgtagcaggtactttttggactttattgagaaataaaataattggttggaaaaaatttcaagtaattcaagaaaaaattaatcaaatagatttcattttagaagacaatgatgaaatagaaaataatttgactgaaaaattatctctgatcgtaaaagaaaaacttggagatgaaatgaaaataaatctaaaaattgtaaataaaattccattgaccaaaacaggtaaatatcgatgggttgtatcgaaaatatcaccgtatgtccaataa

SEQ ID NO: 22700 - protein, 172 aa, Unknown
  Obtained from environmental sample
  misc_feature (1)..(172): Xaa is any amino acid
MHINTDRFILEIVDANENLCKHGELGEIVITDLDNYVFPLIRYKIGDLGILTERVCTCGINLPLLEKVEGRVFDLIIGVNGNTVAGTFWTLLRNKIIGWKKFQVIQEKINQIDFILEDNDEIENNLTEKLSLIVKEKLGDEMKINLKIVNKIPLTKTGKYRWVVSKISPYVQ

SEQ ID NO: 22701 - DNA, 636 bp, Unknown
  Obtained from environmental sample
  misc_feature (1)..(636): n is a, c, g, or t
atgaaaaaaattattgcattattagtattggtgtctttattttcttgcggaaatgatgctaataaattgacagtcaaagggactgtaaaaggattaaaaaaagggactatatacctaaaaaaggtaaatgatactgttttagtgactgtagactcaattgttgttaatggttctcctgaatttacgttacaatcagacatagatgagccagaaatgttttatttatatttaaataaaaacaccaaagaggatgataggatatccttttttgctgataaaggtgttactgaaattaatacaactttaaagggattttcttacgatgctaaaataaaaggatctaagcaacatgatgttttagaagagtatttaagtatgataggaaagtttaataataaaaatttagacttaactaaagaatatattgaagcagcaagagacaaagatactatcaagttaaagcaaactgaagccatattaaatagctttaagaaaagaaagtatttatacactgctaattttgctgtaacacataaggatagtgaagttgctccatatttagcactttcggaaatttacgatgctaatgttatttatttagacaccataagtaaagtgcttacgccagaaattaaa

SEQ ID NO: 22702 - protein, 212 aa, Unknown
  Obtained from environmental sample
  SIGNAL (1)...(17)
  misc_feature (1)..(212): Xaa is any amino acid
MKKIIALLVLVSLFSCGNDANKLTVKGTVKGLKKGTIYLKKVNDTVLVTVDSIVVNGSPEFTLQSDIDEPEMFYLYLNKNTKEDDRISFFADKGVTEINTTLKGFSYDAKIKGSKQHDVLEEYLSMIGKFNNKNLDLTKEYIEAARDKDTIKLKQTEAILNSFKKRKYLYTANFAVTHKDSEVAPYLALSEIYDANVIYLDTISKVLTPEIK

SEQ ID NO: 22703 - DNA, 387 bp, Unknown
  Obtained from environmental sample
  misc_feature (1)..(387): n is a, c, g, or t
ttgatttataaaaaaatagtttttctagttacgctacttgcttttgctacaagtttttctcaatctacagattttaaaccacttttaaaaacggattataccattaaaaaaaatgtagatacacttcatatcaaatatccattacacgctaacgttactagagacaaaaccataaaaagtaaggatacgaccgctttaagttttgttaaggattttgatttatttaaaaataattactttttaagacaatataaaagcttaatttttaagcaagatagtagtgcaataatttaccaatggaaagaacctattgttgtttactttgatcacaacattccgcaggaaatcacanaaaatataagtcagtttattttatcaattcccgaa

SEQ ID NO: 22704 - protein, 129 aa, Unknown
  Obtained from environmental sample
  SIGNAL (1)...(16)
  misc_feature (1)..(129): Xaa is any amino acid
MIYKKIVFLVTLLAFATSFSQSTDFKPLLKTDYTIKKNVDTLHIKYPLHANVTRDKTIKSKDTTALSFVKDFDLFKNNYFLRQYKSLIFKQDSSAIIYQWKEPIVVYFDHNIPQEITXNISQFILSIPE

SEQ ID NO: 22705 - DNA, 606 bp, Unknown
  Obtained from environmental sample
  misc_feature (1)..(606): n is a, c, g, or t
atgacagaaaaacttatgaaggatttaaaaatttcgaagaaaaaaccatcctacccaattaatgatagattgagtagttatttgtctgattataaccgaaactctaaaattacaatactgtatgatgaccttttgcgttttcaaggttctgtaaccgtttatgataaagatgataacgatacgctgtggatacgtgtttactttagtgaatttgatagagtagaaattgatttaagtctaaaaaaagtatacagtagactgcattctgatggtaacgaaaccagtaatgcctttttaaatattgacgctattgattattgtacttttggaaactctaaaccttttagaataaaaatccgaaatgttttaaatgacaactacacctatttttatgtcaaaaaagcagacgcttctcgtatttatggtctagaattagagcatatgttatctccatatcaattaaattttatggtacatggtaatactttaatcgaagagcatattgcaggaatccctggagatgtatttattgaaaaccatgtggatgactgttctgaatctgaaaaatcccaaatagcaaaagagtttgttaagtttaacgagcgt

SEQ ID NO: 22706 - protein, 202 aa, Unknown
  Obtained from environmental sample
  misc_feature (1)..(202): Xaa is any amino acid
MTEKLMKDLKISKKKPSYPINDRLSSYLSDYNRNSKITILYDDLLRFQGSVTVYDKDDNDTLWIRVYFSEFDRVEIDLSLKKVYSRLHSDGNETSNAFLNIDAIDYCTFGNSKPFRIKIRNVLNDNYTYFYVKKADASRIYGLELEHMLSPYQLNFMVHGNTLIEEHIAGIPGDVFIENHVDDCSESEKSQIAKEFVKFNER

SEQ ID NO: 22707 - DNA, 753 bp, Unknown
  Obtained from environmental sample
  misc_feature (1)..(753): n is a, c, g, or t
ttgaaaatgaaatctttgagggaacggaatttagggaacaacattaaggtaacaggtacgctggaacttttcccacaggataaggcgaatatcagtccgtttgttggtggaaatgtgagttccataaaagtaatacctggagataatgtaagtaaaggacaggtattggcatatatagaacacccagatatcattgcaatgcaacaggaatatcaggaaaaaaatgacgaactggtctttttgaaacaggattttgagcgcaagcagactctttatgacaaaggtgtttcttctggaaaggaatttcagatggcgcagtcaaaatttcgttccacaacatccagcgtcaatggtttgcggtcccaattgagactgttgggcattaatccggacaaagtggctgaaggccaaatatattccgctgttcccattaccacacccataagtggctatgtggatgaagtaatgattagccttggcgattacgtggcgcaacaatccaaaatgttctcaataagcgataattcaaagatttatgtcaacttcaaaatatatgagaaggacataaagcaaatcaagaaaggacaacagatatatttttctacggcctctcgtccagatgaactgcttaaagcaaccgttcggtctgtgggtaaaacatttaacaccgacccaaaagctttggaagttctggcagatatgaaaacgaggataaaaacctattgccgggtatgtacgtggaagggcgaatag

SEQ ID NO: 22708 - protein, 250 aa, Unknown
  Obtained from environmental sample
  misc_feature (1)..(250): Xaa is any amino acid
MKMKSLRERNLGNNIKVTGTLELFPQDKANISPFVGGNVSSIKVIPGDNVSKGQVLAYIEHPDIIAMQQEYQEKNDELVFLKQDFERKQTLYDKGVSSGKEFQMAQSKFRSTTSSVNGLRSQLRLLGINPDKVAEGQIYSAVPITTPISGYVDEVMISLGDYVAQQSKMFSISDNSKIYVNFKIYEKDIKQIKKGQQIYFSTASRPDELLKATVRSVGKTFNTDPKALEVLADMKTRIKTYCRVCTWKGE

SEQ ID NO: 22709 - DNA, 462 bp, Unknown
  Obtained from environmental sample
  misc_feature (1)..(462): n is a, c, g, or t
gtgagatacagtaacacatatttgagttttttaacgctaaatttcctaatacataaggatgtatttaacattgttcggtttaatgaatctattcccaacttacggcatgaagacacactattttcttacgatttaaaaacctctaacattaagattgaacatattgacaatacagtttatcatcttggcttagaagacagtaaaacatttttaaagaaatctttagaagcagtaaaagctatagatttatttgttaaacaaggtttattacctgcgcattacacccgaattacaaaactgtattctcaaatagaaaatagtcctatttcaaaattattatcatttatttatcgtaaatataatcgtatatttaagagaaatctgctaggtaaaaatccttcacttttaatatttgacttgtacagattaagttattattgcactataaactcaaaacaataa

SEQ ID NO: 22710 - protein, 153 aa, Unknown
  Obtained from environmental sample
  misc_feature (1)..(153): Xaa is any amino acid
MRYSNTYLSFLTLNFLIHKDVFNIVRFNESIPNLRHEDTLFSYDLKTSNIKIEHIDNTVYHLGLEDSKTFLKKSLEAVKAIDLFVKQGLLPAHYTRITKLYSQIENSPISKLLSFIYRKYNRIFKRNLLGKNPSLLIFDLYRLSYYCTINSKQ

SEQ ID NO: 22711 - DNA, 390 bp, Unknown
  Obtained from environmental sample
  misc_feature (1)..(390): n is a, c, g, or t
ttgcactataaactcaaaacaataatgtcttttttctcagtaatcatatccgtttataataaagaagaactcattgctcagaccattcagagtgttttaaatcaaacctttcaggattttgaaattatagtcgttaacgatggttctacagataaaagtgaggcaataataaatagttttaaagaccatcgtataaaattattttctataagtaatcaaggtgcttctaatgcccggaacacagggataaaaaaagcagcatcagactatattgcattattagatggcgacgatacttgggaaacaacttacttgcaatacatgtttgatgctatccgtaaatttccccgacctaaaaattttcacggctgccatagctcaaaaatatga

SEQ ID NO: 22712 - protein, 129 aa, Unknown
  Obtained from environmental sample
  misc_feature (1)..(129): Xaa is any amino acid
MHYKLKTIMSFFSVIISVYNKEELIAQTIQSVLNQTFQDFEIIVVNDGSTDKSEAIINSFKDHRIKLFSISNQGASNARNTGIKKAASDYIALLDGDDTWETTYLQYMFDAIRKFPRPKNFHGCHSSKI

SEQ ID NO: 22713 - DNA, 759 bp, Unknown
  Obtained from environmental sample
  misc_feature (1)..(759): n is a, c, g, or t
atgctacaaaaggtactgtgctttaatttatttgatttaaagcatagtcgcaatcaaaccaatgtctttgattttttggtctatttatttccttatctactaaaaaaggcgctctcgcaaggcttgtataaagagtatcaaaagaaaacttataacgatagtaatcttaaaggtgctatcgatatcaaagctcatttgcaacgaaacctgccttttcgaggtagcgttgcctaccgtgtacgcgagcacagctttgataatccgcttactcagctgattcgtcataccattgagcttatcaagcaaaaaccaaacttgcgagacgtgttgcatagcgatagcgagaccctagattttgttaatctgattgtccagcatacgccgtcctatcatgcgcgaggtcagcaaactgtcattaatgccaaccgcaaacctttcgtccatccttacttcaccgaatatagtggtctgcaaaaaatctgcctacaaatcctccgtcatgatggtctgaaatacgccaaaaatgatgataaagcctacggtatcttgtttgatggggcttggctatgggaggaatatttaaatacccttctgcgtgatatcggctttaaacatcctactaataataatcgaaaaggcggtatcaaggtttatgcacagaaattttcgggtaataacgtgcgccgttatcctgattttgtgaaagataaccgcattattttggacgcgaaatataagcgcagaaagacaatcacatag

SEQ ID NO: 22714 - protein, 252 aa, Unknown
  Obtained from environmental sample
  misc_feature (1)..(252): Xaa is any amino acid
MLQKVLCFNLFDLKHSRNQTNVFDFLVYLFPYLLKKALSQGLYKEYQKKTYNDSNLKGAIDIKAHLQRNLPFRGSVAYRVREHSFDNPLTQLIRHTIELIKQKPNLRDVLHSDSETLDFVNLIVQHTPSYHARGQQTVINANRKPFVHPYFTEYSGLQKICLQILRHDGLKYAKNDDKAYGILFDGAWLWEEYLNTLLRDIGFKHPTNNNRKGGIKVYAQKFSGNNVRRYPDFVKDNRIILDAKYKRRKTIT

SEQ ID NO: 22715 - DNA, 921 bp, Unknown
  Obtained from environmental sample
  misc_feature (1)..(921): n is a, c, g, or t
atggcattagttagtttggatggtcaaatacttacttcaaacaaaagctttagcgactatttaggctacacaaaagaggaacttagtggcttcccgataaatactttatctcatccagaagatgtcgatgtaatacctcaaaatataaaagatttaattgctggtaaaagcaataaatttcagtgtgaaaaacgatacatcagaaaagacaaatctatcatacattgtctattatcagtctctattttaagagatgaaaatttcaaacctgttcattttatatctcatataattgatataactaaacgtacaatagctaataaaaaggtagaaacgctgttaaaaaccacaaaactacaaaatgaaaggttacttaattttgcacatatattatctcataacttaagatcacattctggaaacatagaaatgttattagatttaatgtatacagaggtccctgaagccacaaataacgaatttgttccattaatattagaagctgtaaataaactaagcgaaaccattgataacctaaacgaagtatctaccattagcgcagataataacgatgatttgcaaccttacaatcttttagattacacaaaaaaagctttagcaaactttagcgcagaaattaaagaaaccaaagccataattaatatagatatagaagaggatatttatgtattagcaatacctgcttatttggatagcattttatttaattttatatccaatgccctaaaatacagacatcaggataggacacctaaaataaatttaagcgcagagcaaacaaaacactatattanaattgacattgaagataatggacttggcattgatttaatttacataaagataaagtttttggcttatataaaacttttcataatcacaaagacgctaaaggtttag

SEQ ID NO: 22716 - protein, 306 aa, Unknown
  Obtained from environmental sample
  DOMAIN (61)...(103): PAC motif
  misc_feature (1)..(306): Xaa is any amino acid
MALVSLDGQILTSNKSFSDYLGYTKEELSGFPINTLSHPEDVDVIPQNIKDLIAGKSNKFQCEKRYIRKDKSIIHCLLSVSILRDENFKPVHFISHIIDITKRTIANKKVETLLKTTKLQNERLLNFAHILSHNLRSHSGNIEMLLDLMYTEVPEATNNEFVPLILEAVNKLSETIDNLNEVSTISADNNDDLQPYNLLDYTKKALANFSAEIKETKAIINIDIEEDIYVLAIPAYLDSILFNFISNALKYRHQDRTPKINLSAEQTKHYIXIDIEDNGLGIDLIYIKIKFLAYIKLFIITKTLKV

SEQ ID NO: 22717 - DNA, 417 bp, Unknown
  Obtained from environmental sample
  misc_feature (1)..(417): n is a, c, g, or t
atgctggaaattctgaaaatttttaagcttttaccaaatgtggttgcaggtggtggaaaagtatataatgaaaagaacgagattctttttatttatagaaatgataaatgggatttaccaaaaggaaagactgaacgcaaagaatctattgaagaaacggctatacgagaagtagaggaggagacaggcgttgaaggtttaaaaataataaaacctctaccaacgacttatcatatttttaaacgtaacggtaagcatagaattaaagtgacctattggtttgaaatggcgaccagttttgaaggagcactttttccacaagaaaatgagggtataacaaaagtggaatggttagatgctaaggcatctcaagaagctttgggaaatagttatgctaatattcgcattttagtgtaa

SEQ ID NO: 22718 - protein, 138 aa, Unknown
  Obtained from environmental sample
  DOMAIN (13)...(137): NUDIX domain
  misc_feature (1)..(138): Xaa is any amino acid
MLEILKIFKLLPNVVAGGGKVYNEKNEILFIYRNDKWDLPKGKTERKESIEETAIREVEEETGVEGLKIIKPLPTTYHIFKRNGKHRIKVTYWFEMATSFEGALFPQENEGITKVEWLDAKASQEALGNSYANIRILV

SEQ ID NO: 22719 - DNA, 744 bp, Unknown
  Obtained from environmental sample
  misc_feature (1)..(744): n is a, c, g, or t
ttgannnaaagcgtgacagatcgctgggtaccaagtttgacagataatcctgttttaacaaattctgttacagaaattgttgctaataaacgtgccatagttgattactataaagtgcaaaatgacaacattaatgcatcattaatagacagcacttttgtagagcaaaaacgcgaaagccatgtatctgtacatacgtttagttttggaggaaagttaacacgtaacaatttaaacttctatcaaaacggagaatatatggactctacattaaatggagttaccattattggagataaacaacatgttgaccacaacactttagtacatcacatagagcctaattgtgaaagtcaccaagattataaaggaatttttaatgatagctcaacaggagtttttaatggtaaggttgttgtaaacaaggaagcacaaaaaaccaatgcatttcaatcaaataacaatatattattaagcgataaagcaacaataaactctaaacctcaactagaaatttttgcagatgatgtaaaatgttctcatggttgtaccataggacaattagacgaaagtgctttgttttatatgaaatcaagaggtattcctgaaaaagaagctaaagggctattaatgtacgcctttagtaataacgttttaaaatctgtgaaaattccagaattaaaacaacgaataactaanattattgccaacaaactgggtgttaatataggttttgacttgtaa

SEQ ID NO: 22720 - protein, 247 aa, Unknown
  Obtained from environmental sample
  DOMAIN (4)...(214): Uncharacterized protein family (UPF0051)
  misc_feature (1)..(247): Xaa is any amino acid
MXXSVTDRWVPSLTDNPVLTNSVTEIVANKRAIVDYYKVQNDNINASLIDSTFVEQKRESHVSVHTFSFGGKLTRNNLNFYQNGEYMDSTLNGVTIIGDKQHVDHNTLVHHIEPNCESHQDYKGIFNDSSTGVFNGKVVVNKEAQKTNAFQSNNNILLSDKATINSKPQLEIFADDVKCSHGCTIGQLDESALFYMKSRGIPEKEAKGLLMYAFSNNVLKSVKIPELKQRITXIIANKLGVNIGFDL

SEQ ID NO: 22721 - DNA, 867 bp, Unknown
  Obtained from environmental sample
  misc_feature (1)..(867): n is a, c, g, or t
gtggcacagggaaatgcagaatacatagataaattgttgcaaaacttctctccaagtgaagttttggttcaaaaacaacacaaacaacaatttttagagctttttgagaatagatattatacattttatttagatgattgggtttttcaaacagcatatgcaaatgaaacattacacaatcattttgaagtaaaaagtttaaaaggttttggaattcacgaagtaaaaaacggaattattgctgctggtgctgtgttgtattatttatcagaaacgcaacataatcagttaaaacacattcaatcgattagcagaatcgctgaagataattatgtttggatggacaggtttacagtcaggaatttggagttatataacccaaattctgtaaacgctgtaacgcttttagatgttattgacaaaaccatttcacctatgggtggacgattgttaaaacgctggttggctttgcctttaaaaaatattaatgagattcaaaatcgacatgaactggtaaagttttttatcaattctaatgatttttctaagactgtaacctatcaactaaaacaaatatcagatttagaaagattaatttctaaagtagccacaggtaaagcttcaccaagagaaattgtcttgttaaaagattctttaaaagcaattttaccgataaaatctgcatcagaaaaaagtaaaaataaaacggttcaaaatcttgggaaacaactccatacttgtgaagttttaatcacaaaaattacagaaaccttatttgatgaagctcctgtaaacatcaataaaggaaatgcaattgccaataatgtacaccaagaattagacgatttacgtgccattcatctctga

SEQ ID NO: 22722 - protein, 288 aa, Unknown
  Obtained from environmental sample
  DOMAIN (1)...(101): MutS domain II
  misc_feature (1)..(288): Xaa is any amino acid
MAQGNAEYIDKLLQNFSPSEVLVQKQHKQQFLELFENRYYTFYLDDWVFQTAYANETLHNHFEVKSLKGFGIHEVKNGIIAAGAVLYYLSETQHNQLKHIQSISRIAEDNYVWMDRFTVRNLELYNPNSVNAVTLLDVIDKTISPMGGRLLKRWLALPLKNINEIQNRHELVKFFINSNDFSKTVTYQLKQISDLERLISKVATGKASPREIVLLKDSLKAILPIKSASEKSKNKTVQNLGKQLHTCEVLITKITETLFDEAPVNINKGNAIANNVHQELDDLRAIHL

SEQ ID NO: 22723 - DNA, 531 bp, Unknown
  Obtained from environmental sample
  misc_feature (1)..(531): n is a, c, g, or t
atgagaaaattaaaaaataacgagttaggtagaatttcggttgatgaatttaaatcgacaaaaaaaacaccgttaataatcgttttagataatgttagaagtttaaataatattggttctgtattcagaacttcggatgcttttttgattgaaaaaatctatttatgtggcatttgcgcaactccaccaaataaagatattcataaaacagctttaggcgcaactgaatctgtggaatgggaatatgtagaagatactttagaattggttgaaaaattaaaaactgagaacgtaaaagtcttggcgattgaacaagcagaaaattcgaccaaattagatactttttatccagaaaaagatacaaagtatgcaattgtgatgggaaatgaagtaaaaggtgtgcagcaagaagtggtaaatgcaagtgatttttgtattgagattccacaattgggaaccaagcattccttgaatatttctgtaactacaggtgttgtagtctgggatttgtttgtgaagttgaggatttaa

SEQ ID NO: 22724 - protein, 176 aa, Unknown
  Obtained from environmental sample
  DOMAIN (24)...(168): SpoU rRNA Methylase family
  misc_feature (1)..(176): Xaa is any amino acid
MRKLKNNELGRISVDEFKSTKKTPLIIVLDNVRSLNNIGSVFRTSDAFLIEKIYLCGICATPPNKDIHKTALGATESVEWEYVEDTLELVEKLKTENVKVLAIEQAENSTKLDTFYPEKDTKYAIVMGNEVKGVQQEVVNASDFCIEIPQLGTKHSLNISVTTGVVVWDLFVKLRI

SEQ ID NO: 22725 - DNA, 849 bp, Unknown
  Obtained from environmental sample
  misc_feature (1)..(849): n is a, c, g, or t
atggaagatgcaatagatttacaacgcaatagagagcccattccagaagaagaaatagtagtaatttacaaatacaaaaacacaaaagactacactacaaacggtaaagtctatttgttttataacgaagcaaaatatggcgacgacaattttacaattacagatactagaacgtatcatggcgagattgctcaagataacgacaacctagtttacacctctaaaccagaaaacaaaacctattacgcttccgcagaaattcaaagcttgcgtaatacatttaaccctcaagattctactgaaagacaaaatttaccattaacacttgccgaagctaaaaccaactataaaaactcaagccaattaagctttagcaacatgcaaccaaatgaagagcgtaatatattttacaccttaaaaacaacaccagaaatgctaaaggatacaagtgcgataatttcggtaagaggtgtttatattccagataataattatgacgaccataatgtaaaagacatggaaatggaaattgtaacctctcacgatcctaacaaaatgtcctcaaactctacttttttaaactacagattagtacgttacaaaaaacctaaatttaaaattagatttcaaaataatggcgaaggtcctgcaaccacaattagactagaaacagacataccagatatgtttgacaaaaccactattgaagttttggacatgtacccaaaagtaaaaatttgtcctaaatccgaggtccaatatagttgccttgataacagctatacacaaaagcaagccatatttacttttaaaaacattacttaccaggaaggcagcaaaaaaacgtga

SEQ ID NO: 22726 - protein, 282 aa, Unknown
  Obtained from environmental sample
  misc_feature (1)..(282): Xaa is any amino acid
MEDAIDLQRNREPIPEEEIVVIYKYKNTKDYTTNGKVYLFYNEAKYGDDNFTITDTRTYHGEIAQDNDNLVYTSKPENKTYYASAEIQSLRNTFNPQDSTERQNLPLTLAEAKTNYKNSSQLSFSNMQPNEERNIFYTLKTTPEMLKDTSAIISVRGVYIPDNNYDDHNVKDMEMEIVTSHDPNKMSSNSTFLNYRLVRYKKPKFKIRFQNNGEGPATTIRLETDIPDMFDKTTIEVLDMYPKVKICPKSEVQYSCLDNSYTQKQAIFTFKNITYQEGSKKT

SEQ ID NO: 22727 - DNA, 849 bp, Unknown
  Obtained from environmental sample
  misc_feature (1)..(849): n is a, c, g, or t
atgaaattagaaattgttcatgaatttggagggagtaatcgagaaatttggaaccatttatctaaacgagatctaaaacgcatagaagatgaattagcggttctagtaaaacctcagaaaggagactctgatttagctaggtattatgataaattattatatacattaattactaaaagattagaaacgccaaataaagaagaatatgtaaatagttttctaataccaatttctaaagtagcaacaacgtctaaaaaactacttaaaaaaaccactattcccgcagttaagtcaaaagaacctttaattaaattaccattagaggaagagttttggaaaatagatggaattacacatctagaaaaattaagaaaaggagttcgtgaattggtgaaatatatagatcctgtagaccaacgttatgtaaccacagactttgaagaccatattcttgaaggtgaaataaaagaaggaggttttacaaatgaagcagatttagattatgatgttccttcaccatttcaaaacaatgtccatcgtttagagcaattgatacgagaaaatgagcatcatattacaatatcaagaattagaaaaggagaaacgataaccaaagaagaattaaaagttttagaagatattctttttaaaggaggcatagataaaaaaaagattgaaaaagaattgggttctcaatttagtttagtcaaatttattatttcattaatgggcttgaatcctgaaatggtagatgcctcattttctaaatttataaatgactatcagttaaactcaatacaaatacagtttttagataccattaaaaaattcttaacaaccaagtggtaa

SEQ ID NO: 22728 - protein, 282 aa, Unknown
  Obtained from environmental sample
  misc_feature (1)..(282): Xaa is any amino acid
MKLEIVHEFGGSNREIWNHLSKRDLKRIEDELAVLVKPQKGDSDLARYYDKLLYTLITKRLETPNKEEYVNSFLIPISKVATTSKKLLKKTTIPAVKSKEPLIKLPLEEEFWKIDGITHLEKLRKGVRELVKYIDPVDQRYVTTDFEDHILEGEIKEGGFTNEADLDYDVPSPFQNNVHRLEQLIRENEHHITISRIRKGETITKEELKVLEDILFKGGIDKKKIEKELGSQFSLVKFIISLMGLNPEMVDASFSKFINDYQLNSIQIQFLDTIKKFLTTKW

SEQ ID NO: 22729 - DNA, 939 bp, Unknown
  Obtained from environmental sample
  misc_feature (1)..(939): n is a, c, g, or t
atgtcgaaaccccattgttctaccgagcagattaaaaaaatggcatttatcccaaatgtcgaaaacaaattactcgaggaaacacgcgctagttttttaaaatatattgctcaaaaaacggtggtttacaccaaaaatattgatttacttttttctagaatcgatgatttttttggtaaagctgaaaccgctttcgaaaatttatcctctgaaattaaacatgccccacctatcgagctgttttgtaattcgacccttttaaaaaagcaattattagagttcactttagtggaatttggcactgattcttggttaaattcgtccacggttattacttataacacgacaccacagcccgcgtttaataagcagtttaatttattaatcgataatttaaacagcaatcataataatggatttaccaattatattgcgtgtattagcgagcaacaagccaaacgttttcacgacatttttaacgatgtcgaacaagaggttagctataagaccatcaccttatctttatttcaagggtttgtagaccacgataacaaaattgtgtgttataccgatcatcaaatttttgaacgttaccataagtttcatcttaaaaacggctacgcaaaaaagcaggcgattaccttaaaagaattaaccaatttggatattggagattatgttacgcacatagatcatggtattgggcgttttggcggattgaaaaaaattgatgtagaaggcaacaaacaagaagctattaaattagtgtacggtgagcgcgatattttatatttaagtattcattcgttacataaaatcaccaaatttaatggtaaggatggtaagcctcccaaagtttataaattaggaagtaaagcgtggaaaacacttaaagagaaaacaaaatctcgtgtaaagcactcgcctcctgagccataa

SEQ ID NO: 22730 - protein, 312 aa, Unknown
  Obtained from environmental sample
  DOMAIN (220)...(307): CarD-like/TRCF domain
  misc_feature (1)..(312): Xaa is any amino acid
MSKPHCSTEQIKKMAFIPNVENKLLEETRASFLKYIAQKTVVYTKNIDLLFSRIDDFFGKAETAFENLSSEIKHAPPIELFCNSTLLKKQLLEFTLVEFGTDSWLNSSTVITYNTTPQPAFNKQFNLLIDNLNSNHNNGFTNYIACISEQQAKRFHDIFNDVEQEVSYKTITLSLFQGFVDHDNKIVCYTDHQIFERYHKFHLKNGYAKKQAITLKELTNLDIGDYVTHIDHGIGRFGGLKKIDVEGNKQEAIKLVYGERDILYLSIHSLHKITKFNGKDGKPPKVYKLGSKAWKTLKEKTKSRVKHSPPEP

SEQ ID NO: 22731 - DNA, 918 bp, Unknown
  Obtained from environmental sample
  misc_feature (1)..(918): n is a, c, g, or t
ttgtttaattctgaaaaagtaaaattttacagacctcaacctaagcctaattttttagttgaagaagtaaaaaattatatagagcaaataaaggctaaccaaatattagttataggatcagaaggttttaaaaacgatattttatcaattcctaatattctattccattgtgatgataccgaaaataaaaacctatataagttaaataaatcaaaggttgaggaaatagaaggaagcagtgtatcttgggaaaagcaagtgttgttaaattatatagattttaatgcttctaacgatttaccaacttattggggacaaatacctaaaagtgtttctattaaattagagagtaatgttagtaatatattagacttattttattctaatagggatttagaatggtctactcaaaaagttatttttttaacaattcctgagttattattgtatcaagaacaattgttggaattgaaagatattgaggttgttacagttcataatgatttgttgtcaatagaaaataaaaaagttttaaaagaagttagtttagattttttgatgagtgaaatcaaaaatgaggatcatatttggttaaatttttctggtggtcaaagttttacacaacttacaaaaaagcaatgtgaagatttagaggttgatattcctcaactatttgataatatatggattgaaaaagtaactctcaataagtttaaaatttgggggaattttaattgggagaatttattgcttgattttgatgttactaatattatcgatgttaaaccgaggattgctgtatttgagaaagagcaagttataatagctcaggtaagtgctgttgaaacttttaaaaataaggtcattcggttcaatccagatctttgtatcngtctagatattgggtatttcaaaaac

SEQ ID NO: 22732 - protein, 306 aa, Unknown
  Obtained from environmental sample
  misc_feature (1)..(306): Xaa is any amino acid
MFNSEKVKFYRPQPKPNFLVEEVKNYIEQIKANQILVIGSEGFKNDILSIPNILFHCDDTENKNLYKLNKSKVEEIEGSSVSWEKQVLLNYIDFNASNDLPTYWGQIPKSVSIKLESNVSNILDLFYSNRDLEWSTQKVIFLTIPELLLYQEQLLELKDIEVVTVHNDLLSIENKKVLKEVSLDFLMSEIKNEDHIWLNFSGGQSFTQLTKKQCEDLEVDIPQLFDNIWIEKVTLNKFKIWGNFNWENLLLDFDVTNIIDVKPRIAVFEKEQVIIAQVSAVETFKNKVIRFNPDLCIXLDIGYFKN

SEQ ID NO: 22733 - DNA, 606 bp, Unknown
  Obtained from environmental sample
  misc_feature (1)..(606): n is a, c, g, or t
atgagtctatttagaaaactatttcgttctaaatctgataaagaaaaggaagaagtaacagcttcacaaggggggaaatatatgccgcctgttaaattaccaatcgacgaaagttttatgataaactttaaagagaatggtgggaagttcttgtattgtgatacgatgaacgaggtttacgataatttagctttaattattgaagaaaataattggcaaaataaatctgcttatttttacgatcaaaatttaaaacaacgcttcgaagatttgtacctaaatccaggcactttatctgatgcagcatacttcgtttctacgtgtgagaatttaatttcagatgacggctctattttactatcttctaatcagttagctgaaaataaattatcagaattccctagtaacattataatttttgcaactacgagtcagattgtaacaaatattggtgaaggtttacgagagattaaaacaaaaaacaccaataaaataccgactaatatttctacaataaaactttttaagcctgtagccgaaaaagattttttaacctacggtagtccctcaaaaaacctatatttgctgcttttagaagacttataa

SEQ ID NO: 22734 - protein, 201 aa, Unknown
  Obtained from environmental sample
  misc_feature (1)..(201): Xaa is any amino acid
MSLFRKLFRSKSDKEKEEVTASQGGKYMPPVKLPIDESFMINFKENGGKFLYCDTMNEVYDNLALIIEENNWQNKSAYFYDQNLKQRFEDLYLNPGTLSDAAYFVSTCENLISDDGSILLSSNQLAENKLSEFPSNIIIFATTSQIVTNIGEGLREIKTKNTNKIPTNISTIKLFKPVAEKDFLTYGSPSKNLYLLLLEDL

SEQ ID NO: 22735 - DNA, 606 bp, Unknown
  Obtained from environmental sample
  misc_feature (1)..(606): n is a, c, g, or t
ttgataatttccatgccattaaaaaatcaaaatccaacgaaaaccaatgcttggaataaactccaaaaagattatcaagatttaaagaacgttgagatgaaatcaatattccttggcgatccagatagaagggaaaaatacaccttactattcaatgacctcacgcttgatttttcgaagaacagaataaatgatagagcatttcagaatttgattgagttggctaatgaagttgatttaaaagacggaatcgacaaaatgttttcaggggatgtcataaacacaacagaaaatagagcagttttgcatacggctttacggaataagtcaaaaaaagcagtattggttgaaggcagaaacgtaatgcctgaagtagaagcctcactaaaaaaaatggaagacttttcgaggaatgttatttcaggagaattcaagggttttaccggcaaagcaattactgatgttgttaaatatggtattggcggttctgacttggggccaaaaatggtagtagatgcattgcagtattataaaaatcatttaaaaacccatttccatttcaatattgatggtgaccatgttactgaaacatttaaaaaaatttga

SEQ ID NO: 22736 - protein, 201 aa, Unknown
  Obtained from environmental sample
  misc_feature (1)..(201): Xaa is any amino acid
MIISMPLKNQNPTKTNAWNKLQKDYQDLKNVEMKSIFLGDPDRREKYTLLFNDLTLDFSKNRINDRAFQNLIELANEVDLKDGIDKMFSGDVINTTENRAVLHTALRNKSKKAVLVEGRNVMPEVEASLKKMEDFSRNVISGEFKGFTGKAITDVVKYGIGGSDLGPKMVVDALQYYKNHLKTHFHFNIDGDHVTETFKKI

SEQ ID NO: 22737 - DNA, 933 bp, Unknown
  Obtained from environmental sample
  misc_feature (1)..(933): n is a, c, g, or t
atggctgaggcgggccttattttttgggacagacagcaccattattctacatcatcagtatatcctgaatttaaaaatagttctaccaacccgtgttctgaaattgctatgcaaggtggtgacagttgccgattgatcgctattaatttattcagttttgtcgaagatccttttactaagaaagcagcctttaattttaaaaagttttatgaagttgtctacgaatctcaacggctaatggatgatttagtggatctcgaacttgaagctgcagatagaattcttaccaagattgaagcagatcctgaaccggatcatgttaaacgtacagaaaaagaaatctgggaattattacaagaaaccggcaaaaaaggaaggcgaacaggattaggatttactgccttggccgatacggttgccgcattaggaattaaattcgatactgataaggctataaaatcagtggatgaaataatgaaaaccaaattaaaagctgaatttgatagcagtattgatatggcaatcaccagagggcaatttgaagtttttaaccggaatatagaagacacttcagagtttgttcaaatgatggaaaaggaatttccggatatttatcaccgaatgatggaatacggacgtagaaatattagtataagtacggtggcaccaacgggatcattaagtatgctggctcaagtttcatctggcattgaacctgtctttttattgtcctataagcgtcgaagaaaagtaaataccagtgatgaaaatgcaaaaattgattttgtggatgatcttggcgatgcatttcaagaatttactgtttatcataaaaaacttgagagctggatgaaacgcacgggtaaaactaacctaaaagaaagcccttattcgggggcaactgcatccgaaatagactggaaaaaacgtatt

SEQ ID NO: 22738 - protein, 311 aa, Unknown
  Obtained from environmental sample
  misc_feature (1)..(311): Xaa is any amino acid
MAEAGLIFWDRQHHYSTSSVYPEFKNSSTNPCSEIAMQGGDSCRLIAINLFSFVEDPFTKKAAFNFKKFYEVVYESQRLMDDLVDLELEAADRILTKIEADPEPDHVKRTEKEIWELLQETGKKGRRTGLGFTALADTVAALGIKFDTDKAIKSVDEIMKTKLKAEFDSSIDMAITRGQFEVFNRNIEDTSEFVQMMEKEFPDIYHRMMEYGRRNISISTVAPTGSLSMLAQVSSGIEPVFLLSYKRRRKVNTSDENAKIDFVDDLGDAFQEFTVYHKKLESWMKRTGKTNLKESPYSGATASEIDWKKRI

SEQ ID NO: 22739 - DNA, 543 bp, Unknown
  Obtained from environmental sample
  misc_feature (1)..(543): n is a, c, g, or t
gtgactaaacgtcctcgaaaaattgaagctgagattattcgttttcacaatgaatctgaaaaatggctagccgtaattggattaattgatgggagaccttatgaaatatttacagggaaaatgaaagatgcttttaatctgccgcaatgggtagataaaggttgggtactgaaaagtaggaatgaaaagggaatttccagatatgattttcaatatattgacagtgatggatataaaacaaccattgagggcttatcaagatcattcgatgaggaattttggaattatgccaaactgatttcaggggtattacgtcatggaatgccaatgccttatgtggtggatctgattcaaaatttaaacttatatgacgagcatatcaatacttggaaaaatggggttgccagagctttaaaacgatttatacaagaaggggcagtagcggcagataaaaagtgccctgaatgtaaagaccctgaagggttaatttataaagaaggttgcctgatttgcaaaagttgtggacattctaagtgcggataa

SEQ ID NO: 22740 - protein, 180 aa, Unknown
  Obtained from environmental sample
  misc_feature (1)..(180): Xaa is any amino acid
MTKRPRKIEAEIIRFHNESEKWLAVIGLIDGRPYEIFTGKMKDAFNLPQWVDKGWVLKSRNEKGISRYDFQYIDSDGYKTTIEGLSRSFDEEFWNYAKLISGVLRHGMPMPYVVDLIQNLNLYDEHINTWKNGVARALKRFIQEGAVAADKKCPECKDPEGLIYKEGCLICKSCGHSKCG

SEQ ID NO: 22741 - DNA, 801 bp, Unknown
  Obtained from environmental sample
  misc_feature (1)..(801): n is a, c, g, or t
ttggatgagtcattaaaaaaaggacgtaaaaaggcgtttcgttatttagataaaaatttctcaatatcaaaccacccacttaattttaatgattctgagcagcttgaaacaactattgctattttatcaagatataaacatcgatcagagttttcttggttagaagaattaattccaagaatggaacaatcatttaagctggtagaaagcggtgataatggtattattagttatcaagagaatttagatttaaaaggaagagagcatattggtacgctgtttaatctaatattaaaacggaaaaaaattaaaattaattatgagccttacgggaaaccgcaatttaatgtgaaaatttctccgtatcatgtcaaacaatataataatcgttggtttttattttgttttaatgaggattataaaacaatttctaattaccctttggatagaataaatagtattgaagagttaagtaatagttttattccaagtactataaattggttagattattttgatgatattataggagtgacaaaaccagaaggaggtaaaatagaaaagattcatttgaaattttcagaaaatcgaattaattatgttttgacaaaacctttgcatggttctcagaaattagataagacagataaggaaggtagaatggttactattgaagtggttccaaataatgaattgtatcaattgttgttttcttttggagcagatttggaggttataaaacctatggaaataaganaagaaattttagaaagagttaaaaatatgattaataattattaa

SEQ ID NO: 22742 - protein, 266 aa, Unknown
  Obtained from environmental sample
  misc_feature (1)..(266): Xaa is any amino acid
MDESLKKGRKKAFRYLDKNFSISNHPLNFNDSEQLETTIAILSRYKHRSEFSWLEELIPRMEQSFKLVESGDNGIISYQENLDLKGREHIGTLFNLILKRKKIKINYEPYGKPQFNVKISPYHVKQYNNRWFLFCFNEDYKTISNYPLDRINSIEELSNSFIPSTINWLDYFDDIIGVTKPEGGKIEKIHLKFSENRINYVLTKPLHGSQKLDKTDKEGRMVTIEVVPNNELYQLLFSFGADLEVIKPMEIRXEILERVKNMINNY

SEQ ID NO: 22743 - DNA, 639 bp, Unknown
  Obtained from environmental sample
  misc_feature (1)..(639): n is a, c, g, or t
atggatcagaattcggctgaggtagataactcataccaatataggccaaaacctattataaagaaaaatatctactttataagaaacggaggagaatctccaaagtcaattttttctttaatctaccagcaagataataaattgcaaaattttgaaaatgttgaaatacaaaatcaaattttagaagctgtattaaaactagagttaaacaaacggttaagagaagaaatgggtgttgtttatggcgtttctgtttctattagtgctacaaaacacccaataccattaagtagacaaaccatcgctttagtttgcaaaccatcggatgtagaaattatcagtgcagaaattcagtctatacttaatggaattgcttctggagaaattgattttaatcaagatttaaaaaaggtaaaaataaacctaatcaaaaattttaatattaataaacaagagaattctttctggacaaaaagcatacgtaatttttattttaatcaacttaaaaactgggattcagtttcagattatgagaatgttgtcaataaaatttcagaaaaagatttaagaaaaaagacaaaaaaatatttcattaaaaaccccaaaataaaggcggtattacacccaaaagagaattaa

SEQ ID NO: 22744 - protein, 212 aa, Unknown
  Obtained from environmental sample
  misc_feature (1)..(212): Xaa is any amino acid
MDQNSAEVDNSYQYRPKPIIKKNIYFIRNGGESPKSIFSLIYQQDNKLQNFENVEIQNQILEAVLKLELNKRLREEMGVVYGVSVSISATKHPIPLSRQTIALVCKPSDVEIISAEIQSILNGIASGEIDFNQDLKKVKINLIKNFNINKQENSFWTKSIRNFYFNQLKNWDSVSDYENVVNKISEKDLRKKTKKYFIKNPKIKAVLHPKEN

SEQ ID NO: 22745 - DNA, 759 bp, Unknown
  Obtained from environmental sample
  misc_feature (1)..(759): n is a, c, g, or t
atgaaaaatattgttgttggttttttaatgtcttatgactacgagaaattaaaattatctattcctccagtttatgaacaagcggataaaatatatctagctttagaccataaacaacgtacctggaaaggtgaaacttttgatgttgaccctactttttttgaatggctttcaaattttgataagcacaataaaattgaaatttataaagacaatttttttgtgccagagctaaatgctatccaaaacgataccagagaacgtcacatgttgtccattaaaatgggtattggtaattggttagtgcaagtagacagtgacgagatttttattgacttcactcagtttgttaaaacattacgtcaacacgatcattttttggataatcctaagaaaaacccagttcaaatagctggttttttaattaatatttataagtatttagaagacggaatgctttacgttgatgagcctacaaaagtaatgttggcgactaattacccaaattataaatatgccagaaatagtaaagagcgtgtaatatataccaataatgtattgctacacgagtgtttgtctagagatgaagcgtctctaaaatttaaactagataattggggacactcccatgagcttaacgatcagttttttccaaaatggcaaaaagcagataaaaacaattacaaagaattaaaaaacctgttttatttagatccagaaatctggaaaagtttaggctattttccaacacatgattaa

SEQ ID NO: 22746 - protein, 252 aa, Unknown
  Obtained from environmental sample
  misc_feature (1)..(252): Xaa is any amino acid
MKNIVVGFLMSYDYEKLKLSIPPVYEQADKIYLALDHKQRTWKGETFDVDPTFFEWLSNFDKHNKIEIYKDNFFVPELNAIQNDTRERHMLSIKMGIGNWLVQVDSDEIFIDFTQFVKTLRQHDHFLDNPKKNPVQIAGFLINIYKYLEDGMLYVDEPTKVMLATNYPNYKYARNSKERVIYTNNVLLHECLSRDEASLKFKLDNWGHSHELNDQFFPKWQKADKNNYKELKNLFYLDPEIWKSLGYFPTHD

SEQ ID NO: 22747 - DNA, 456 bp, Unknown
  Obtained from environmental sample
  misc_feature (1)..(456): n is a, c, g, or t
atggaagtgatgaatagagtagagttggaggctcgttatgaaattgatattgaggaatatacaaagcgtttgcaaattgaaagtagagttttaggcgatattgcaagaaatcatattgtgccaacagcaatcaattatcaaaacacgttgttagaaaataccaagaatttaaaagaggtatttggagacgattttaaaaacattgcaaaagagcaaatcgagttgattatgacaatttctaaccacatcacagaaattaattcattaaccttaaaaatgattgacgaacgcagaaaagcaaacaaattagaaagcttaaaatctgcagaagcctatagtaaaaaggtaaaaccgtttttcgaagaaattcgttatcactgtgataaactagaaaccatggtcgatgataatttgtggccattaacaaaatacagagaattattattcacgagataa

SEQ ID NO: 22748 - protein, 151 aa, Unknown
  Obtained from environmental sample
  misc_feature (1)..(151): Xaa is any amino acid
MEVMNRVELEARYEIDIEEYTKRLQIESRVLGDIARNHIVPTAINYQNTLLENTKNLKEVFGDDFKNIAKEQIELIMTISNHITEINSLTLKMIDERRKANKLESLKSAEAYSKKVKPFFEEIRYHCDKLETMVDDNLWPLTKYRELLFTR

SEQ ID NO: 22749 - DNA, 528 bp, Unknown
  Obtained from environmental sample
  misc_feature (1)..(528): n is a, c, g, or t
atgcctaaagaagagctacctattgacgaaagttttactataaactttaaagaaaatggtggtaaattcctgtattgtgactctttagacgaagtttacgacaacttaaataatataatactagaaaataactgggaagatcattctgcttatttttatgacaataacttgaaagataaatttaaatcttctcaacttaaaatcagtgacaaactatcagaatgcacttattttataaccacttgcgaaaacctaatagctaatgatggctctttattggttagctctaaccagctagctgaaaaaaaacttaacgaattccctaataacgttatagtgtttgcaactacaagtcaaataatatcaaacataggcgaaggattaagagaaataaagcataagaatagtgtaaaaatacctactaacatcacaactattaaacattttaagctacaagaggaaaaagactttttatcttacggaagcagtacaaaaaacttatatttgctgcttttagaagacctttag

SEQ ID NO: 22750 - protein, 175 aa, Unknown
  Obtained from environmental sample
  misc_feature (1)..(175): Xaa is any amino acid
MPKEELPIDESFTINFKENGGKFLYCDSLDEVYDNLNNIILENNWEDHSAYFYDNNLKDKFKSSQLKISDKLSECTYFITTCENLIANDGSLLVSSNQLAEKKLNEFPNNVIVFATTSQIISNIGEGLREIKHKNSVKIPTNITTIKHFKLQEEKDFLSYGSSTKNLYLLLLEDL

SEQ ID NO: 22751 - DNA, 666 bp, Unknown
  Obtained from environmental sample
  misc_feature (1)..(666): n is a, c, g, or t
gtgtctttaaataaaaccttagaagagttacaccattcgattttttcgactagtaaacattccgaatctatggggattgagtttgacgcattaaataaacgtattaaaactaaaattaataatcttaatgagcaaaccaagagtaccacctcaatttcatcgttaagaaaattagttgatcatgaattaaagtccctcggtgaagattttattgccaaagaagaacttgaacgcaaagatcgcaaagtacttataaccagctttgatgaaataaataatcgtattggcagcttagaaaataaactcactaaatataaaaagcgccttaacgatcaacgttttaaaagcctgctcgatagcctaactaaactgccaaatagagccgccttcgatgagcgctataatcacgaaatgcacttatttaatgtgcaagcatccgatgttactctagcggtaatagacgtagattattttaagtcaataaacgacaggtttggtcatacggctggagatattacgctacaagttattgctaaagccttgcaaaaatcgatagaaaaaacagactttatagcgcgttatggcggcgaagaatttgtactcttaatgccaggcacctctttagagcatgccattccacaactcgaaaaacttaaaaagatataa

SEQ ID NO: 22752 - protein, 221 aa, Unknown
  Obtained from environmental sample
  DOMAIN (112)...(221): GGDEF domain
  misc_feature (1)..(221): Xaa is any amino acid
MSLNKTLEELHHSIFSTSKHSESMGIEFDALNKRIKTKINNLNEQTKSTTSISSLRKLVDHELKSLGEDFIAKEELERKDRKVLITSFDEINNRIGSLENKLTKYKKRLNDQRFKSLLDSLTKLPNRAAFDERYNHEMHLFNVQASDVTLAVIDVDYFKSINDRFGHTAGDITLQVIAKALQKSIEKTDFIARYGGEEFVLLMPGTSLEHAIPQLEKLKKI

SEQ ID NO: 22753 - DNA, 777 bp, Unknown
  Obtained from environmental sample
  misc_feature (1)..(777): n is a, c, g, or t
atggcagatcaaatgaaaaggaagggaatttctttagatataactaaattaaagcaagagttaaaatctgaggtattattgatcagtgcccgtaagaatttaggaatagtagaacttaaaacggcaattttaaattataaagaagtcgatactacaactattgcgaatattgcaaatcgcgtagattcagagttttttaaaaaagtaaaaagtgagtttaaggaaatgtcgctttacaaagcttggctattaataactcagcaacataattttcccaatattgacccggaattaaaaaagcgtattgatatatttagagatgatattgaaaagttacagaaaatgcagaataaagaaaccattttgcgttatcagtacattaatgatatcctcaaaaaaacgtataccttcgataatgaaaaagcaacaggattacgttttaaacttgacaaaatattaacacatagaatttttggatatgtaatatttgcaggaatcttactgttaatatttcaatcaatttttgactggacacgtgtgcctatggattttattgatgctgcatttgcacaattgagtgaatttgcaaaaaatcaattaccccctggtgtttttacaaatttaattgccgaaggtatcatacccggaattggaggaatcgcaatttttatacctcanatagctattctttttttattgatatctattttagaagaaaccggctatatgagcagagtggtttttttaatggataaaattatgcggcgatttgggatg

SEQ ID NO: 22754 - protein, 259 aa, Unknown
  Obtained from environmental sample
  DOMAIN (1)...(216): Ferrous iron transport protein B
  misc_feature (1)..(259): Xaa is any amino acid
MADQMKRKGISLDITKLKQELKSEVLLISARKNLGIVELKTAILNYKEVDTTTIANIANRVDSEFFKKVKSEFKEMSLYKAWLLITQQHNFPNIDPELKKRIDIFRDDIEKLQKMQNKETILRYQYINDILKKTYTFDNEKATGLRFKLDKILTHRIFGYVIFAGILLLIFQSIFDWTRVPMDFIDAAFAQLSEFAKNQLPPGVFTNLIAEGIIPGIGGIAIFIPXIAILFLLISILEETGYMSRVVFLMDKIMRRFGM

SEQ ID NO: 22755 - DNA, 582 bp, Unknown
  Obtained from environmental sample
  misc_feature (1)..(582): n is a, c, g, or t
ttgtttttaaagtttcctgttgtacatttgcacgaaattatgagagacaaaattatacataaatctgccgagttgtttttaccacttggttttaaaagcgttacaatggatgacattgctagtgctttaggtatttctaaaaaaacaatttatcagcattttgctaataaaacaaaattagtagaagcgactacatcgcatatgtttgaaaacatttgtgatggcattgattgcatttcaaataaatcacttaatcctattgaggaactatacgacattaaaatgtttgtaatgacctttttaaaaaacgaaaaagcatcacctcaatatcaattaaaaaaatactaccctcagatatacagtattttacaccttaaacaatttgaaaaaatgtacgtgtcggtaaaacaaagtatggaaaaaggtgtacaaacaggtttgtttagaaaaaacattgatgtcgattttatttcaagaatgtattttaacggtatgtctggaattaaagacgagaacatttttcctaccaaactatttactatggaatatttaatggaaagctatgttggaatatcaccttag

SEQ ID NO: 22756 - protein, 193 aa, Unknown
  Obtained from environmental sample
  DOMAIN (18)...(64): Bacterial regulatory proteins, tetR family
  misc_feature (1)..(193): Xaa is any amino acid
MFLKFPVVHLHEIMRDKIIHKSAELFLPLGFKSVTMDDIASALGISKKTIYQHFANKTKLVEATTSHMFENICDGIDCISNKSLNPIEELYDIKMFVMTFLKNEKASPQYQLKKYYPQIYSILHLKQFEKMYVSVKQSMEKGVQTGLFRKNIDVDFISRMYFNGMSGIKDENIFPTKLFTMEYLMESYVGISP

SEQ ID NO: 22757 - DNA, 492 bp, Unknown
  Obtained from environmental sample
  misc_feature (1)..(492): n is a, c, g, or t
atgtcaaaattaaatttaattattgtagtattaggttttgtgttaataagctgtggtggcaatgagaaaaaagctaaagacaattttagctataagcgtccaccttcgtctaaagtagaatcaaatcctgaacaaaacacagcatcaagcactgtagacctaactaacaaaggaataggcccaataaaagcactaaccttacctgatcaaatagatactaaaatggtttctctaggcaaagaagtctacgataaaatgtgcacagcatgtcatagatctgataaaaaatttattggtccagcaccaaaagacattttaaaaagacgtacgccagaatgggttatgaatatgattttaaatcctgaagagatgctaaaaaacgatccaattgctaaagatttattaaaagaatataataatacgcctatgattaatcaaggacttacagaagctgacgcacgcgctgttttggaatactttagaacactttaa

SEQ ID NO: 22758 - protein, 163 aa, Unknown
  Obtained from environmental sample
  misc_feature (1)..(163): Xaa is any amino acid
MSKLNLIIVVLGFVLISCGGNEKKAKDNFSYKRPPSSKVESNPEQNTASSTVDLTNKGIGPIKALTLPDQIDTKMVSLGKEVYDKMCTACHRSDKKFIGPAPKDILKRRTPEWVMNMILNPEEMLKNDPIAKDLLKEYNNTPMINQGLTEADARAVLEYFRTL

SEQ ID NO: 22759 - DNA, 582 bp, Unknown
  Obtained from environmental sample
  misc_feature (1)..(582): n is a, c, g, or t
atggcggagtatgtggtggctcacgattgtaaaattattttcttttcttccgcaaatgtgtttgatgcgtatagcaaatatccaagttatgaagacgacaaaactttgagtgatagcatttatgggcatttcaagataaagattgaaaatatgtttttacgtttgccaaaaaagaaagtggccattgtcagactccctatgatttttggaacacattcccctcgtctcaaggaaatcaagcaacatattgcagaaaaaacgcctattgaggtgtttccaaacttgatcatgaatgtcacaaccgattttaagttgacgcaacaaatccactacattatcaaccgagataaatatggcgtgttccatttgggaagttcagatttagtacaccatgacgattttatcacggaaatggtggctttaattactttagaaaacgttcttttcaagcaagtttacaccactaatgaagaccgttatttggccgtgatgcccaaattgaatgccttgcccaagcatcttcaaatcagcagcacagaactacttgaagaattggacaattacatcaattataactcttag

SEQ ID NO: 22760 - protein, 193 aa, Unknown
  Obtained from environmental sample
  misc_feature (1)..(193): Xaa is any amino acid
MAEYVVAHDCKIIFFSSANVFDAYSKYPSYEDDKTLSDSIYGHFKIKIENMFLRLPKKKVAIVRLPMIFGTHSPRLKEIKQHIAEKTPIEVFPNLIMNVTTDFKLTQQIHYIINRDKYGVFHLGSSDLVHHDDFITEMVALITLENVLFKQVYTTNEDRYLAVMPKLNALPKHLQISSTELLEELDNYINYNS

SEQ ID NO: 22761 - DNA, 375 bp, Unknown
  Obtained from environmental sample
  misc_feature (1)..(375): n is a, c, g, or t
atggaagtttcaggaaaaattaaaaaaatagacgaagccaaaacgtacggtacgggaggattcagaaaacgtgaattggtggtaactacagatgagcaatatcctcaaatgttgtcaatagaatttacacaagacaaatgtgaattactcgataattacaatgttggagaagatgtaaaagtgaatatcaatttgcgcggaagagaatggataaaccctgaaggtgaagccaaatattttaactcaattcaaggttggagaattgaaaaattagaatctggtacaccgaatgaaatacctccaattgaagctgttgatgcctttgaacctgcagataaaattactgatgaagatcctgatgatttacctttttaa

SEQ ID NO: 22762 - protein, 124 aa, Unknown
  Obtained from environmental sample
  misc_feature (1)..(124): Xaa is any amino acid
MEVSGKIKKIDEAKTYGTGGFRKRELVVTTDEQYPQMLSIEFTQDKCELLDNYNVGEDVKVNINLRGREWINPEGEAKYFNSIQGWRIEKLESGTPNEIPPIEAVDAFEPADKITDEDPDDLPF

SEQ ID NO: 22763 - DNA, 459 bp, Unknown
  Obtained from environmental sample
  misc_feature (1)..(459): n is a, c, g, or t
ttggaatgtaaagtgagggatgttatcgagttagggaaagaaggtggagcaggtaatttaattatttgtgaagtactgagaatgcatattagccatgatgtgttagataaaaatgaccaaatagttcaagagaaattagatttggtggccaggggaggcggtagttactattccagggcaaaagatggattttttacagtgccgaaaccattatctactttaggcattggagtcgatcaaattcctgaaaacattagaaatagtaatatacttaccggtaataatttaggaatgcttggtaatgtagaagttttaccgacacaaagcgatgttgataactttggaaaggaaaattcaaaatacatagggttaaaaactcaagaaaaacataaatttgcacaacaatttttagaaaataatgatgtagagagtgcttggaaagtacttttaataaaataa

SEQ ID NO: 22764 - protein, 152 aa, Unknown
  Obtained from environmental sample
  misc_feature (1)..(152): Xaa is any amino acid
MECKVRDVIELGKEGGAGNLIICEVLRMHISHDVLDKNDQIVQEKLDLVARGGGSYYSRAKDGFFTVPKPLSTLGIGVDQIPENIRNSNILTGNNLGMLGNVEVLPTQSDVDNFGKENSKYIGLKTQEKHKFAQQFLENNDVESAWKVLLIK

SEQ ID NO: 22765 - DNA, 555 bp, Unknown
  Obtained from environmental sample
  misc_feature (1)..(555): n is a, c, g, or t
gtgccaaggttgggaggcaaagcgtttgaacaaggggctggatttttaagaataaaaaatgccaaaaacccattagatgattcagcggttcatccggaaagttatggcatcataactaagatggcaaaagatgaaaacaaaagcgtctctgatctaatcggcaataaggacattttacataaaatagagctaaaaaagtactgtacatctgcggttgggttgcctacccttactgatattattaatgaattagaaaaaccaggattagatcccagagaaactgctaagatttttacttttaatcaaaatattagatccattaatgatctgaaagaaggacaattgctccctggaattgtaaataatattacgaattttggatgttttgtagatattggcattaaagaaagcggtttagtgcatgtgtcgaatttagccgataagtacgtaagtgatgtcaacgaaattgtgaatttacatcaacatgtgatcgtaaaagtgttggaagtggatattgcaagaaaacgaattcagttatctttgaattataaataa

SEQ ID NO: 22766 - protein, 184 aa, Unknown
  Obtained from environmental sample
  DOMAIN (109)...(182): S1 RNA binding domain
  misc_feature (1)..(184): Xaa is any amino acid
MPRLGGKAFEQGAGFLRIKNAKNPLDDSAVHPESYGIITKMAKDENKSVSDLIGNKDILHKIELKKYCTSAVGLPTLTDIINELEKPGLDPRETAKIFTFNQNIRSINDLKEGQLLPGIVNNITNFGCFVDIGIKESGLVHVSNLADKYVSDVNEIVNLHQHVIVKVLEVDIARKRIQLSLNYK

SEQ ID NO: 22767 - DNA, 681 bp, Unknown
  Obtained from environmental sample
  misc_feature (1)..(681): n is a, c, g, or t
atgagattaatactattatttaccttgtgcctagctatggcttgtgccaataagaacaaaccaaaagaaaaacaaaatcccatagcgataaccgaagatttaatagcggttttagatactatctggagtactgaacaaaccccaataacattgcgggattctttgatccaaaaatatggtgcagactccaaaggggcacaggtgcagcaagaaatctatgagaagaaccatggaatcaatgaaaaaaggataaaggagatccttgataaaaatgggtggccagacaagaatatcattggggagcaaggtaattggacgatttgcaacgtcattcaacattcggacaatgaaatacggatcaaatatctccccatgatgcggcaagccgtaaaagataaaaaattggaagcgcgttttttggttagggctgaagatagaattgcaaccgaaagaggtgatccgcagatttatggcggacagatgaaatattatcctgaaaccaaaagctttaatgtttggccagtatatgatccagtaaacattgataaaagaagagcagaaataggtttggggccaattgcggagcacttaagagataggtttgattttgagtggaaccttgaagaacaaataaaaagaacagcggaatttgaagccgcaatgaataaaaaggaagaatga

SEQ ID NO: 22768 - protein, 226 aa, Unknown
  Obtained from environmental sample
  SIGNAL (1)...(14)
  misc_feature (1)..(226): Xaa is any amino acid
MRLILLFTLCLAMACANKNKPKEKQNPIAITEDLIAVLDTIWSTEQTPITLRDSLIQKYGADSKGAQVQQEIYEKNHGINEKRIKEILDKNGWPDKNIIGEQGNWTICNVIQHSDNEIRIKYLPMMRQAVKDKKLEARFLVRAEDRIATERGDPQIYGGQMKYYPETKSFNVWPVYDPVNIDKRRAEIGLGPIAEHLRDRFDFEWNLEEQIKRTAEFEAAMNKKEE

SEQ ID NO: 22769 - DNA, 414 bp, Unknown
  Obtained from environmental sample
  misc_feature (1)..(414): n is a, c, g, or t
ttgggcatttttaaactatctataaaatttatatttcttatttttttcttcggatgttttgcaaactgtaaaaaacagcaaaaaaacatggaaataaaagaggaagtttcaattcaaaaaaaagatacaattcctaatttccctgaatatttgaccaaagaatatgttttagggaaattcgattatacaaaaaatgatgattttatattggttccagaaaatttatcaaacaaaaaaatatatgttcggaaagaagttttagatgattttctaaaaatggaaatggctgctaagttagaaaacatcaaccttactattatttctggaacgcgaaatttcgaacatcaaaaaagaatttggaattacaaatggaacgaaaaatataaaaatattccaacgcaaaaaagagcttaa

SEQ ID NO: 22770 - protein, 137 aa, Unknown
  Obtained from environmental sample
  misc_feature (1)..(137): Xaa is any amino acid
MGIFKLSIKFIFLIFFFGCFANCKKQQKNMEIKEEVSIQKKDTIPNFPEYLTKEYVLGKFDYTKNDDFILVPENLSNKKIYVRKEVLDDFLKMEMAAKLENINLTIISGTRNFEHQKRIWNYKWNEKYKNIPTQKRA

SEQ ID NO: 22771 - DNA, 339 bp, Unknown
  Obtained from environmental sample
  misc_feature (1)..(339): n is a, c, g, or t
atggttgctatttctatgatttttatttcgaagcatattgttccaaaaggttttaatggtattaccctatttccttttatatttttgattgataaaaatttaaagaacgattatattttaattcatcatgaaaaaattcatttacagcaacaaaaagaaatgtttctcctcttcttttatcttttttatggattagaatggttcattaaattactaaaatataaatctaaacatagtgcttatcttaacataagttttgagcgagaagcgtatcaaaatgaaaataatttaaactacttaaaaacaagaaaactttgggcatttttaaactatctataa

SEQ ID NO: 22772 - protein, 112 aa, Unknown
  Obtained from environmental sample
  misc_feature (1)..(112): Xaa is any amino acid
MVAISMIFISKHIVPKGFNGITLFPFIFLIDKNLKNDYILIHHEKIHLQQQKEMFLLFFYLFYGLEWFIKLLKYKSKHSAYLNISFEREAYQNENNLNYLKTRKLWAFLNYL

SEQ ID NO: 22773 - DNA, 540 bp, Unknown
  Obtained from environmental sample
  misc_feature (1)..(540): n is a, c, g, or t
atgagcgaaaataacaacgggaaatcattagttccaaacgaattaatagcaagtagaatattactaattagaggtcaaaaagtaatgatagatagtgatattgcacaactntacggagtaactacaacaaggctaaatgaacaagtaaaaagaaataaaactcgttttccaaataattttatgtttgaattaacaaaagaggaaaagaaagaggttatcgcaaattgcgaccaccttaaaaatttaaaattctcaccagttttaccaaaggtttttacagaacacggaataatgatggttgctaatgttttaacaagtgaaagagcaatacaggtaagcatccaaataatagaagtgtttataaaaatgcgtgaaatcttaacagataatttaagtttgaaacttgatattgaagaaatcaaaaagaagttatctaatcatagcaagaatatagaattggtttttaactatttggatgaattgattgataaaaaagagaaaccacgaactcaaataggctacaaaaaagatagaaagtaa

SEQ ID NO: 22774 - protein, 179 aa, Unknown
  Obtained from environmental sample
  misc_feature (1)..(179): Xaa is any amino acid
MSENNNGKSLVPNELIASRILLIRGQKVMIDSDIAQLYGVTTTRLNEQVKRNKTRFPNNFMFELTKEEKKEVIANCDHLKNLKFSPVLPKVFTEHGIMMVANVLTSERAIQVSIQIIEVFIKMREILTDNLSLKLDIEEIKKKLSNHSKNIELVFNYLDELIDKKEKPRTQIGYKKDRK

SEQ ID NO: 22775 - DNA, 666 bp, Unknown
  Obtained from environmental sample
  misc_feature (1)..(666): n is a, c, g, or t
gtggttggttatagtgtttcttctgctgataaatctctaacaaccattcaaaaatctggcataaaagtaatttataatggagattggctagaagaaactcctctaggaagagctgaatggattaagttttttggagttttgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgaaacaggtggcgcaatttactatgaattagcaggaacaagaccagatttggttttaaaagatttgattaaaattacaaatcctgaagtattaccaaattatgagtttaccttttttgaaaaaatgaaataa

SEQ ID NO: 22776 - protein, 221 aa, Unknown
  Obtained from environmental sample
  misc_feature (1)..(221): Xaa is any amino acid
MVGYSVSSADKSLTTIQKSGIKVIYNGDWLEETPLGRAEWIKFFGVLFDKEKQADSIFKVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGETGGAIYYELAGTRPDLVLKDLIKITNPEVLPNYEFTFFEKMK

SEQ ID NO: 22777 - DNA, 663 bp, Unknown
  Obtained from environmental sample
  misc_feature (1)..(663): n is a, c, g, or t
atgaggcacccaatgcaatcaaacttagaaaaaaagcaccaagatgagaagctagaagctctaaaagaagggaaaacacaaaagactaaagatacacttgataaattgaacttaattttatctaattattttgagcaaggaaatgttgatttttcaataacaaatatcggaatgataagttataaaaatagcggtcccagttacgaaacgcttcgtgcaacaaaaaatgtgcactatagaaagctaattagttattgggctgaattaatcaaaagtcaatcggttgacaataaagtggtattaccagctacggataatgagcttttaaatacgatacccgatattgcggctcgcgcatactttgcaagaattttagctgaaagaaagaaatttaaaaccgagctgaatatcttaaaaagtcaatcggaaatagtaatcgataagcgtaatcaatatacccaaactacagactttattcctaacttaaaactaactaataatgagttatcagcgcttacttatgctgtatcggatgagtgtattaagctcaatggttggctaanaactgaattaggccaaataaaaggaagtgaatatcanaatgaaatattcccaagaggctttatancagctttgaataaagtaattaagtctaatgagtaa

SEQ ID NO: 22778 - protein, 220 aa, Unknown
  Obtained from environmental sample
  misc_feature (1)..(220): Xaa is any amino acid
MRHPMQSNLEKKHQDEKLEALKEGKTQKTKDTLDKLNLILSNYFEQGNVDFSITNIGMISYKNSGPSYETLRATKNVHYRKLISYWAELIKSQSVDNKVVLPATDNELLNTIPDIAARAYFARILAERKKFKTELNILKSQSEIVIDKRNQYTQTTDFIPNLKLTNNELSALTYAVSDECIKLNGWLXTELGQIKGSEYXNEIFPRGFIXALNKVIKSNE

SEQ ID NO: 22779 - DNA, 711 bp, Unknown
  Obtained from environmental sample
  misc_feature (1)..(711): n is a, c, g, or t
atgaagaatattttagttccaaccgatttttcagataattcatggaacgccatacaatatgctttagatttttttaaaaacacatcttgcaatttttactttttgcatgtaacatccatttcgaattatgccggcggagaatctcctataataccaaccgcagatgttattgaaaaaaccttattaaagaaagcgaaagttgaactacaaaaattacttgtcaatataaaaaaattgtttcctaatacgaatcacaattttattacgctgtcgagttatgattactttatagatgcagtaagaaaccatattgatgaaaagaatgtagattatatcgttatgggaactaaaggtgcaaacggcgttaaaagagcgatcattggaaccaatacaggtgatcttattactaaaatcaagtgcccggtgttggtagttcctgaaaaagctgtattcagtcttccgaaagaaatagccttccctacggactataacattttttatcaaacaaaaattttaagcaccatttctgatttggcaaanatgtttgattctacaataagaatactacacgtcgtgaaaaaagatgaacaactcacgagttatcaaatagagaatcaggaatatttgaatgacttctttatggatgaaaaacacagttttcatagggttactaataaaaaaattgaagctggcgttccatgttttttgtga

SEQ ID NO: 22780 - protein, 236 aa, Unknown
  Obtained from environmental sample
  DOMAIN (1)...(146): Universal stress protein family
  misc_feature (1)..(236): Xaa is any amino acid
MKNILVPTDFSDNSWNAIQYALDFFKNTSCNFYFLHVTSISNYAGGESPIIPTADVIEKTLLKKAKVELQKLLVNIKKLFPNTNHNFITLSSYDYFIDAVRNHIDEKNVDYIVMGTKGANGVKRAIIGTNTGDLITKIKCPVLVVPEKAVFSLPKEIAFPTDYNIFYQTKILSTISDLAXMFDSTIRILHVVKKDEQLTSYQIENQEYLNDFFMDEKHSFHRVTNKKIEAGVPCFL

SEQ ID NO: 22781 - DNA, 801 bp, Unknown
  Obtained from environmental sample
  misc_feature (1)..(801): n is a, c, g, or t
gtgacagatcggctcgggatccttgaactgggtattatggtaaatttaagtggtcgttccggtgcagaattacagaaatcagtaaaaaatataacagaccattacccgaaccggtttgtagtatttgccaatataaactttaatggtgttggtgaagatggttgggcgaaaaaaacggcggaccagcttgctgaagatgtgaaaaatggtgcccggggattaaaaatatacaagagtttgggcatgcgaaacaccgacagcgatggtaaacggattcctattgatgatgcgcggttaaaccctatttgggctaaatgtggggagcttagaatacctgtattgatacatgccgcagatccaaaatccttttgggacgagtttgatggagacaatgaaaggtggttagaattgaaaacacatccgcgtaggaaacgtaatgccaagaatcctgttccgtgggagcaaattattactgaacagcacaatatgttcaaaaagcaccccaacactcagtttatcaatgcacatatgggttggtatgccaataaccttggcaagttaggtcaactaatggatgaaatgcctaatatgaatgtagaaattggtgccattatagctgaactaggccgtcaacctagatttgccaaagccttttttgataaatatcaggataggatcttattcggaaaagatagttggaagcctgaagaatttcccacctatttcagaatattagaaacagccgatgaatatttttcataccataaaaatatcatgctttttggggcatgtatggtttag

SEQ ID NO: 22782 - protein, 266 aa, Unknown
  Obtained from environmental sample
  misc_feature (1)..(266): Xaa is any amino acid
MTDRLGILELGIMVNLSGRSGAELQKSVKNITDHYPNRFVVFANINFNGVGEDGWAKKTADQLAEDVKNGARGLKIYKSLGMRNTDSDGKRIPIDDARLNPIWAKCGELRIPVLIHAADPKSFWDEFDGDNERWLELKTHPRRKRNAKNPVPWEQIITEQHNMFKKHPNTQFINAHMGWYANNLGKLGQLMDEMPNMNVEIGAIIAELGRQPRFAKAFFDKYQDRILFGKDSWKPEEFPTYFRILETADEYFSYHKNIMLFGACMV

SEQ ID NO: 22783 - DNA, 489 bp, Unknown
  Obtained from environmental sample
  misc_feature (1)..(489): n is a, c, g, or t
ttgaaaaaaaataggttttttttatgtttcatgttatttgtgatgtttcaaatgatacacgctcagactgttgagctaaatgggacaatcactgctgaagacgatattgaaagtattcatatattaaataaaacctctttaactaatgcaacatcaagcaaagacggaagctttgttatcaaggctaaattaaacgataccattatattttctgcagtacaatatacattgctaaccaaagtggttaatcaagaggatataacttcaaaaacaatagcagtcactttaaaattacaaaccaatcaattagatgaagtgtttttaaaaaggtctttgtcaggagatctagaagatgatttattgcttttagaggctaaaccagtaatcaatttttatgacgtaggcctacctggatacccaggaaacaaaaatcatctgccgaaagagtcttacatgaagcaacaacgggaggagggtttataccattaa

SEQ ID NO: 22784 - protein, 162 aa, Unknown
  Obtained from environmental sample
  misc_feature (1)..(162): Xaa is any amino acid
MKKNRFFLCFMLFVMFQMIHAQTVELNGTITAEDDIESIHILNKTSLTNATSSKDGSFVIKAKLNDTIIFSAVQYTLLTKVVNQEDITSKTIAVTLKLQTNQLDEVFLKRSLSGDLEDDLLLLEAKPVINFYDVGLPGYPGNKNHLPKESYMKQQREEGLYH

SEQ ID NO: 22785 - DNA, 414 bp, Unknown
  Obtained from environmental sample
  misc_feature (1)..(414): n is a, c, g, or t
atggtcgtattcgttttcagcgttcgaaaacagggtaaattatatgacatcaaaatcaccgagaaattacaggagattatatctatatatacaggaaataaagaaaaacatgagtatatttttccaattgtaaaaagggacaagctcgaattacaacataaagatattgactgggaacggcatagatataataaagggttaaaaagaattggcgcgctttgtggtattcaagataatctcacatcgtatgtttctaggcatagttttgcgactcaagccatgttacaagatgttccattattagctatttcggcaatgttagggcatagtaaattaaatacaactcaaatatatttaaagtcattacctaacaatatactcgatacctataatgagcaaataacgtcattttaa

SEQ ID NO: 22786 - protein, 137 aa, Unknown
  Obtained from environmental sample
  misc_feature (1)..(137): Xaa is any amino acid
MVVFVFSVRKQGKLYDIKITEKLQEIISIYTGNKEKHEYIFPIVKRDKLELQHKDIDWERHRYNKGLKRIGALCGIQDNLTSYVSRHSFATQAMLQDVPLLAISAMLGHSKLNTTQIYLKSLPNNILDTYNEQITSF

SEQ ID NO: 22787 - DNA, 363 bp, Unknown
  Obtained from environmental sample
  misc_feature (1)..(363): n is a, c, g, or t
gtgaacatcaaaaactacatattaaaacataaaaagaaaacaattttccttgttattctgttgattttctatgcgttttgtttaccaagagaattatttacaaagccaacatccacagtaattaccagtaaaaatgatgaattattaggtgcattaattgcaaaagatggtcagtggagatttcctcataatgatagtgttccagaaaagtttaaaacctgtttaattcagtttgaagatgaatatttttatagtcatccaggatttaatccgatttcgatttttaatgcattacaacaaaatttaaaaagcaggaagtgtaaaaagaggaggaagcacaatcacgncacaagttatcagatt

SEQ ID NO: 22788 - protein, 121 aa, Unknown
  Obtained from environmental sample
  DOMAIN (39)...(116): Transglycosylase
  misc_feature (1)..(121): Xaa is any amino acid
MNIKNYILKHKKKTIFLVILLIFYAFCLPRELFTKPTSTVITSKNDELLGALIAKDGQWRFPHNDSVPEKFKTCLIQFEDEYFYSHPGFNPISIFNALQQNLKSRKCKKRRKHNHXTSYQI

SEQ ID NO: 22789 - DNA, 336 bp, Unknown
  Obtained from environmental sample
  misc_feature (1)..(336): n is a, c, g, or t
atggctgtattaaagaaaataaaggcatctacattgatggagactttagtggcaacagtgatgattgttatagtctttatgatcgccagtatgatcttgaataatttgttttcaaataccattaaaagcaatacaagagctattgatgcccacttaaacgaagtgcaatatctttatcttaatgacaagataaaaacaccttatttcgatgaatttaaagattggcaaatttcagttactttgtttaaaagcgaaggtgctaatcttgtccaaatagagggtaaaaatccaaatactaaccaaacggtgacaaaagaacttcttgaaactgaataa

SEQ ID NO: 22790 - protein, 111 aa, Unknown
  Obtained from environmental sample
  misc_feature (1)..(111): Xaa is any amino acid
MAVLKKIKASTLMETLVATVMIVIVFMIASMILNNLFSNTIKSNTRAIDAHLNEVQYLYLNDKIKTPYFDEFKDWQISVTLFKSEGANLVQIEGKNPNTNQTVTKELLETE

SEQ ID NO: 22791 - DNA, 876 bp, Unknown
  Obtained from environmental sample
  misc_feature (1)..(876): n is a, c, g, or t
ttgccagccaatagtcagcaaaatacgtttattccttttgatgtaaaagtcgaatatggtttgccaacctacagagaaaaagatgctattttttcgtatcacttttttaggttgatgcaaagagcaaagaacgtttttattttgtacaatacagaacatgatatttttggaagtggagaaaaaagtagatttgttacgcaattagaaatgatgagaacagatattgttcagaaaattatttcgccaaaagtggtcgctcaaaatgccgaattaaaaaccatcgaaaaaaatgagttggtttttaatcgactaaaagaattagcaaaagctggtttttcgccttcgtctttaactaattatttatacaatcctgttgctttttacaaacaaaaaatattacgaatcaaggaatttgatgatgttgaagaaactgttgcttacaatacattaggaactgttgtacacgaaactttagatgaattgtacaaaccttttatgggtaaatttttaaaggttgatgatctttcatccatggaaaaaattgccaaagatttggttttaaaacattttaaaatccacttcaaaaatggcgatatttctacaggacaaaatcgattaatttttgaagttgccaacaggtttgtaacgaactttttatccaaagaaaaagaattggtaaaaaatgagaaaaatcaactaaagataattgctacagaagaaaatttatctgcagaaatagttattgaagggtttgaatttcctgtaaaaattcatggaaatgtagatagagttgatgaattaaatggcgaaattagaattatcgattacaaatctggaatggtacaagctgctgaaataaaagtgctagattttgaa

SEQ ID NO: 22792 - protein, 292 aa, Unknown
  Obtained from environmental sample
  misc_feature (1)..(292): Xaa is any amino acid
MPANSQQNTFIPFDVKVEYGLPTYREKDAIFSYHFFRLMQRAKNVFILYNTEHDIFGSGEKSRFVTQLEMMRTDIVQKIISPKVVAQNAELKTIEKNELVFNRLKELAKAGFSPSSLTNYLYNPVAFYKQKILRIKEFDDVEETVAYNTLGTVVHETLDELYKPFMGKFLKVDDLSSMEKIAKDLVLKHFKIHFKNGDISTGQNRLIFEVANRFVTNFLSKEKELVKNEKNQLKIIATEENLSAEIVIEGFEFPVKIHGNVDRVDELNGEIRIIDYKSGMVQAAEIKVLDFE

SEQ ID NO: 22793 - DNA, 303 bp, Unknown
  Obtained from environmental sample
  misc_feature (1)..(303): n is a, c, g, or t
atggatcagatcggctcgagatgcgatcttattatttgcttgtcacatttgggatacaattacagcaaaacgcctgataaaataagcgatttaagcttagctaaagcgactaaagatattgacttgattattggtggacacacacatacttttttacctaagccaaccgttgctcaaaatctagaaggtaaaaacgtattagttaaccaagtaggttgttatggtataaatttaggtaaaatagacttttactttgatgcagatagtactaaaaaagcagaaggaacttctattattgtataa

SEQ ID NO: 22794 - protein, 100 aa, Unknown
  Obtained from environmental sample
  misc_feature (1)..(100): Xaa is any amino acid
MDQIGSRCDLIICLSHLGYNYSKTPDKISDLSLAKATKDIDLIIGGHTHTFLPKPTVAQNLEGKNVLVNQVGCYGINLGKIDFYFDADSTKKAEGTSIIV

SEQ ID NO: 22795 - DNA, 486 bp, Unknown
  Obtained from environmental sample
  misc_feature (1)..(486): n is a, c, g, or t
atgaaaattctattagtgtcaataaaatccattcattttaaacgttggactgaacaattggaacattcaggacatgaggtgttttattttgatattagtggtaaagttggaacttataataatatgccatggctaagtcaaaagaaaagttggaaatacagatgggattttcctggacgctattatttaaaagaatattttcccaaaacatataagctgattaagcctcttaatgaaagacatgtggacaaagtttttgaggcatacttaaaagagataaatcctgacgtggtgcaaagttttgtcttatatctatcttggactcccatactaagtattatgtgtaaatacaaaaacattgcttggatatactctgcatggggaaatgatttgttttattataaaaatattgactcttataaaagagacatcctgagagtgttacctgaaattgactatatgtttgctgattgtcaacgtgatatt

SEQ ID NO: 22796 - protein, 162 aa, Unknown
  Obtained from environmental sample
  misc_feature (1)..(162): Xaa is any amino acid
MKILLVSIKSIHFKRWTEQLEHSGHEVFYFDISGKVGTYNNMPWLSQKKSWKYRWDFPGRYYLKEYFPKTYKLIKPLNERHVDKVFEAYLKEINPDVVQSFVLYLSWTPILSIMCKYKNIAWIYSAWGNDLFYYKNIDSYKRDILRVLPEIDYMFADCQRDI

SEQ ID NO: 22797 - DNA, 591 bp, Unknown
  Obtained from environmental sample
  misc_feature (1)..(591): n is a, c, g, or t
atgtataacggggctctctccgatttgaaactctctctggattttatgcctgatataaaaaaaattggactggcgaattggttagatctcttcacaataagaacaagagttcctttcaacgccggagcaacacaagaatattctgatgaatttgtatttcattatatgccattcatacagccttcttttttgaatatgatattcaatcttaatgaaaatgaacgaaaaaatgcccagttctttcgaactatcattaagaaatacactcctcatctagctaaaatagatttagtgaaaggaagtgaatgttaccctttttggatgaaagatctaactgctttagggtggatcaaattcaaaaataagctctctaaaaaacccactcgcctaaatcccgaagtagaactacttttaaaaatcaaggaatttataagagatagtttttcatcaggttttttaagtaatcatacagattacgatactgcaaaagtcactactcttttagatcttttttacaataaaaaaaactaccacttatcttctcagataggttggctgatctgttttgaaagcttccgaaaacagatataa

SEQ ID NO: 22798 - protein, 196 aa, Unknown
  Obtained from environmental sample
  misc_feature (1)..(196): Xaa is any amino acid
MYNGALSDLKLSLDFMPDIKKIGLANWLDLFTIRTRVPFNAGATQEYSDEFVFHYMPFIQPSFLNMIFNLNENERKNAQFFRTIIKKYTPHLAKIDLVKGSECYPFWMKDLTALGWIKFKNKLSKKPTRLNPEVELLLKIKEFIRDSFSSGFLSNHTDYDTAKVTTLLDLFYNKKNYHLSSQIGWLICFESFRKQI

SEQ ID NO: 22799 - DNA, 426 bp, Unknown
  Obtained from environmental sample
  misc_feature (1)..(426): n is a, c, g, or t
gtgcaaaaggcgatgtataatattattgctttggcgcaaaatgctaatgctattatttataacgaaattgatgaagaccttaatgtgagagcaattccggcttatctcgatagtattgtgcttaattttcttaccaacgccataaagtataaatctgatgaaagagttccaattattgaattatcttctgaagttcagggtgattttgtagtttttaaggtaaaagataacggcttaggtattgatatggagaaatttggagataagatatttcaaatgtataaaacctttcattacaatgaagatgctattggtattggtctttttataactaaaaatcatatcgaatcactagggggcaaagtagaggtaaagagcgaagttggtataggaaccgagtttgtaatctatctcaaaaaagcataa

SEQ ID NO: 22800 - protein, 141 aa, Unknown
  Obtained from environmental sample
  DOMAIN (31)...(141): Histidine kinase-, DNA gyrase B-, and HSP90-like ATPase
  misc_feature (1)..(141): Xaa is any amino acid
MQKAMYNIIALAQNANAIIYNEIDEDLNVRAIPAYLDSIVLNFLTNAIKYKSDERVPIIELSSEVQGDFVVFKVKDNGLGIDMEKFGDKIFQMYKTFHYNEDAIGIGLFITKNHIESLGGKVEVKSEVGIGTEFVIYLKKA

SEQ ID NO: 22801 - DNA, 456 bp, Unknown
  Obtained from environmental sample
  misc_feature (1)..(456): n is a, c, g, or t
ttggtttcaggtttaatcctaaaaaagattgaaaaccgttaccgcaaatttataattatgactacagatccaatcgcggattatttaacacgaattagaaatgctgtgagtgcaaaccacagagtagtagaaatacctgcttctaatttaaagaaagaaatcactaaaatattattcgatcaaggatatattttaagttacaagtttgaagattcagctgtacaaggaactattaaaatagcccttaaatacaacaaggaaacgaaagaacctgtaattaagaagattcaaagaataagtaaaccaggtttacgtaagtacgcaagttcaaaagagcttcctagaattcttaatggtcttggtattgctattgtttctacatcacatggtgtaatgacaggcaaacaagcacaaagagataatgtaggaggtgaagtactttgttacgtttactaa

SEQ ID NO: 22802 - protein, 151 aa, Unknown
  Obtained from environmental sample
  DOMAIN (23)...(151): Ribosomal protein S8
  misc_feature (1)..(151): Xaa is any amino acid
MVSGLILKKIENRYRKFIIMTTDPIADYLTRIRNAVSANHRVVEIPASNLKKEITKILFDQGYILSYKFEDSAVQGTIKIALKYNKETKEPVIKKIQRISKPGLRKYASSKELPRILNGLGIAIVSTSHGVMTGKQAQRDNVGGEVLCYVY

SEQ ID NO: 22803 - DNA, 306 bp, Unknown
  Obtained from environmental sample
  misc_feature (1)..(306): n is a, c, g, or t
atgaaaaaaactacaatcttaatcgcaatatttcttctaatcggacttaaaatcaatgcgcaggaattgacttgttcggattttaaaatcggaactttctacattccaacgagtgatgaaatggaaaaatataaaattacttcaaatgacagtataagtgaaattacagccgaaagagatgttaatgttaatcgttatgttgttatccgagaaaaaaactctcaaaccgaatggaaaaacggaatcggaaacggaaacccaacttatgaaattcttgaatggattgatgattgtactatcgcttga

SEQ ID NO: 22804 - protein, 101 aa, Unknown
  Obtained from environmental sample
  SIGNAL (1)...(19)
  misc_feature (1)..(101): Xaa is any amino acid
MKKTTILIAIFLLIGLKINAQELTCSDFKIGTFYIPTSDEMEKYKITSNDSISEITAERDVNVNRYVVIREKNSQTEWKNGIGNGNPTYEILEWIDDCTIA

SEQ ID NO: 22805 - DNA, 915 bp, Unknown
  Obtained from environmental sample
  misc_feature (1)..(915): n is a, c, g, or t
gtgactaccaaccccaacgaaaacatcttttcgcaagacattatacaagttacagacattgcttttgtagaatatgacgagaatgaatataaaacacttcagtttattaatagaaataatggtgaacccattaccaatgctgaagtgataatctatgataaaaataaaaaagattctgaaattaaaactacagatccttatggtaaaataagagtaaaaaataataaacagcgttatattaattacaacattgaagtttctaattacggagatacagcctattttgataacttaagcataagtggatattatcaaggaaatactccacaaaaaacaacttataagtcgtttttatttacagatcgcagtatttacagacccggacagaccgtttattttaaagggattgttattaatagtgagcgtaacaaatcggaagtggttagcgattacaacgttacagccacgttatttgatgttaacggtaaagaagtaagtaatttaaatttaaaaacgaatacctacggctcggtggctggcgaattcatacttccaaatactggattaacggggtcgttttatatccatttacaatcagactccgaaaaatacactattaatagtcaaacgaattttagtgttgaagaatataagcgtcctaagtttaaaacaacatttaaacccattattgaaaccctaaaagtaaatgatagcgttgccgtaaaaggtgaagccttagctttttcaggatctacaattaccgatgccaaagtactctatcacgtanagcgaaacgtacaatacccaccgtggttttactactcgcgttacgcaccgcaacaacctgagcaaagaatagcgcacggcgaaaccactacaaataataaaggagatattccattctttttaggctat

SEQ ID NO: 22806 - protein, 305 aa, Unknown
  Obtained from environmental sample
  DOMAIN (14)...(281): Alpha-2-macroglobulin family N-terminal region
  misc_feature (1)..(305): Xaa is any amino acid
MTTNPNENIFSQDIIQVTDIAFVEYDENEYKTLQFINRNNGEPITNAEVIIYDKNKKDSEIKTTDPYGKIRVKNNKQRYINYNIEVSNYGDTAYFDNLSISGYYQGNTPQKTTYKSFLFTDRSIYRPGQTVYFKGIVINSERNKSEVVSDYNVTATLFDVNGKEVSNLNLKTNTYGSVAGEFILPNTGLTGSFYIHLQSDSEKYTINSQTNFSVEEYKRPKFKTTFKPIIETLKVNDSVAVKGEALAFSGSTITDAKVLYHVXRNVQYPPWFYYSRYAPQQPEQRIAHGETTTNNKGDIPFFLGY

SEQ ID NO: 22807 - DNA, 792 bp, Unknown
  Obtained from environmental sample
  misc_feature (1)..(792): n is a, c, g, or t
gtggctggcgaattcatacttccaaatactggattaacggggtcgttttatatccatttacaatcagactccgaaaaatacactattaatagtcaaacgaattttagtgttgaagaatataagcgtcctaagtttaaaacaacatttaaacccattattgaaaccctaaaagtaaatgatagcgttgccgtaaaaggtgaagccttagctttttcaggatctacaattaccgatgccaaagtactctatcacgtaaagcgaaacgtacaatacccaccgtggttttactactcgcgttacgcaccgcaacaacctgagcaagaaatagcgcacggcgaaaccactacaaataataaaggagaatattccattccttttaaggctattccagacgcgagtgtcgataaaaaaggacaacctgtttttatctatgaaatcacagctgatgtaaccgatattaacggtgaaacccaaagcgcaaccacttttataaaagtgggatatcacactataaccgcttcgctctctattgccgaacagcttgaaaaatcgaataaaaaacatacgcttcaattagcgactaaaaacttaaatgatgaatttgtttcgacaaccggaagcttaaaaatatacaaactacaagcgccagattatgtattaagacaacgaccttggaaagctccagattatcaaaatttttcaaaagaaaattttaaatcccttttcccatacgaagcgtataccaatgaaaacgatactggaaattggaaaaaagggagcacttgtatttaa

SEQ ID NO: 22808 - protein, 263 aa, Unknown
  Obtained from environmental sample
  misc_feature (1)..(263): Xaa is any amino acid
MAGEFILPNTGLTGSFYIHLQSDSEKYTINSQTNFSVEEYKRPKFKTTFKPIIETLKVNDSVAVKGEALAFSGSTITDAKVLYHVKRNVQYPPWFYYSRYAPQQPEQEIAHGETTTNNKGEYSIPFKAIPDASVDKKGQPVFIYEITADVTDINGETQSATTFIKVGYHTITASLSIAEQLEKSNKKHTLQLATKNLNDEFVSTTGSLKIYKLQAPDYVLRQRPWKAPDYQNFSKENFKSLFPYEAYTNENDTGNWKKGSTCI

SEQ ID NO: 22809 - DNA, 654 bp, Unknown
  Obtained from environmental sample
  misc_feature (1)..(654): n is a, c, g, or t
atgaacttatttgatttaagattaaataataggcttttagatgaatccaaaaaagagttattagagcgtaatgctgatttaagcaaatttgctagtcacgtgtctcacgatttaaaatctccactagcaaacattatatctttaactgcctttttaaaggaagaagaaggtaatgtttttactgaagaatctattgattacattaattatattgaagaatctgcagattctcttaaaaattatattgacggaattttaatacattataaagctaacgagttattaaatgaagataaacaaaccattgccttaaatgcgctttttgaagaagttaaacgcatacacctgttagacgatttacaatttaaaacaaatacaaaaaaccaaaacatatttattaataaagctgctgttactcaaattttaataaatttagtggacaacgctttaaaatataataacaaaccaaatcctgaggttattttaaactattctgaaaataagaattttcatattttctctgtgacagataatggaattggtattgcgcaagagcaacaaaacgaagtatttaaattatttaataacaataatcaaacagacgcaaaaggtaataaagggactggaattggattngttactgtaaaaacttag

SEQ ID NO: 22810 - protein, 217 aa, Unknown
  Obtained from environmental sample
  DOMAIN (133)...(216): Histidine kinase-, DNA gyrase B-, and HSP90-like ATPase
  misc_feature (1)..(217): Xaa is any amino acid
MNLFDLRLNNRLLDESKKELLERNADLSKFASHVSHDLKSPLANIISLTAFLKEEEGNVFTEESIDYINYIEESADSLKNYIDGILIHYKANELLNEDKQTIALNALFEEVKRIHLLDDLQFKTNTKNQNIFINKAAVTQILINLVDNALKYNNKPNPEVILNYSENKNFHIFSVTDNGIGIAQEQQNEVFKLFNNNNQTDAKGNKGTGIGXVTVKT

SEQ ID NO: 22811 - DNA, 540 bp, Unknown
  Obtained from environmental sample
  misc_feature (1)..(540): n is a, c, g, or t
atgagagtgtttcaaataagccccaaagaaattatagatttgaacgacttggaatctgccctgaacgccaacgtcatgatcaagcgggcgcaagtgtacatcaacgttgacggtagtttgacggctgaaatagaacaaaagaaaccaattgcaagggtaagtactaatgcgtcctattacattgatgatgaaggttcttacatgccgttatcaacaaattacacctcaagagtgcctttggttacgggttatgtaaccaaaaatgagttgtataatgtgtttcaagttgctaaaaaagtgcaaagtgacgactttttaaaaaaacacgtcacagagattcatcagaatgaaaacaaaagcattgatctaaaatttagattgaatgattttaaagtgcagttagggtcattggaccaattagacaaaaagataaataacctgaaggctttttatcaaaaagcgatgaaggatggttctctggatagttacagtgctgtcaatttaagatttgataaacaggtcatatgtaccaaaaagtaa

SEQ ID NO: 22812 - protein, 179 aa, Unknown
  Obtained from environmental sample
  misc_feature (1)..(179): Xaa is any amino acid
MRVFQISPKEIIDLNDLESALNANVMIKRAQVYINVDGSLTAEIEQKKPIARVSTNASYYIDDEGSYMPLSTNYTSRVPLVTGYVTKNELYNVFQVAKKVQSDDFLKKHVTEIHQNENKSIDLKFRLNDFKVQLGSLDQLDKKINNLKAFYQKAMKDGSLDSYSAVNLRFDKQVICTKK

SEQ ID NO: 22813 - DNA, 714 bp, Unknown
  Obtained from environmental sample
  misc_feature (1)..(714): n is a, c, g, or t
gtgtttacaaaacaacaccgtattctcagtatgaaactgattgtaacttgtgaacacggtggaaatacaatacctagcgattatcaagactattttaaaaatagtgatgaaatactacagtcgcatcgcggtttagacttaggagctttagacgtttttaatactttaaaaccattagctgaatattctaattacagcacaacaagcagattattaattgaattaaatcgatcgttatatcacaaaaacctgttttctgaattcactaaaaatttaactgactctgaaaaagagacaattataaaacacttttatttgccgtatcgcaacactgttgagacagaaattagaagattaattactaataataaaactgtaatacatatatctattcattcttttacgcctattctaaatactgtaaaacgtacttgtgatattgggattttatatgattcttctatacaaggtgaaaaactatgggctgcacgattaaaagcctctattaaaaaagaagataacaatttaaacgtgagatacaactatccgtatttaggaaaagctgatggcttcacaacctatttaaggcaacaatgtcccagcaactatctcggtatagaactggaaattaatcagaagttttcacgacaaaacgaaatgcctttaactttaaaaaacacgctatttcaagccataaaaaaaaccttaaattaa

SEQ ID NO: 22814 - protein, 237 aa, Unknown
  Obtained from environmental sample
  DOMAIN (10)...(217): N-formylglutamate amidohydrolase
  misc_feature (1)..(237): Xaa is any amino acid
MFTKQHRILSMKLIVTCEHGGNTIPSDYQDYFKNSDEILQSHRGLDLGALDVFNTLKPLAEYSNYSTTSRLLIELNRSLYHKNLFSEFTKNLTDSEKETIIKHFYLPYRNTVETEIRRLITNNKTVIHISIHSFTPILNTVKRTCDIGILYDSSIQGEKLWAARLKASIKKEDNNLNVRYNYPYLGKADGFTTYLRQQCPSNYLGIELEINQKFSRQNEMPLTLKNTLFQAIKKTLN

SEQ ID NO: 22815 - DNA, 459 bp, Unknown
  Obtained from environmental sample
  misc_feature (1)..(459): n is a, c, g, or t
gtggttagcagttatattaccaagcgacaattaccttattttattaaaaaaattaatgattcatttgctagtagtgattttgataatcacttaaaggttacatttaaaaactggaaagttctacctataaaaaatgtaaaaattattgactcaaatgccattaatactttggatcaactaaagtatacaatgctagaagctgaagataattataacgctaataatgctgctgtcaatttaaaagtctaccaagatgctttgtataagtataattcaatagcggatcaatatacttaccataatttatcagttcctttatttaatagtgatttcacatatgctatattaatgtccaaaactattataaatggttataacgacacaagtagagcgctttttgaatttaagaagataaacaatacttgggttataatagacagtgattttaaccaaaattag

SEQ ID NO: 22816 - protein, 152 aa, Unknown
  Obtained from environmental sample
  misc_feature (1)..(152): Xaa is any amino acid
MVSSYITKRQLPYFIKKINDSFASSDFDNHLKVTFKNWKVLPIKNVKIIDSNAINTLDQLKYTMLEAEDNYNANNAAVNLKVYQDALYKYNSIADQYTYHNLSVPLFNSDFTYAILMSKTIINGYNDTSRALFEFKKINNTWVIIDSDFNQN

SEQ ID NO: 22817 - DNA, 333 bp, Unknown
  Obtained from environmental sample
  misc_feature (1)..(333): n is a, c, g, or t
atgaaaaaatcaatcattatttcggcaattgtattagggttctctttagtttccgttaatgcaaaatcaatcgtacctgttgtaaatcaaaacaacatagagactgtttttaacgtaaattctttttgcatctctattgtaaaaggagacatagaaaccgtaaagaaattattaattagaggagaagacatcaatcaaaaatcgaatggaatgaccccaataatgtacgctgctaaatataatagagttgagattttaaaacttttaattgaaaaagggcgcaacattaaaaacaaaatcaagcaaaggatattctgctttagactatgctga

SEQ ID NO: 22818 - protein, 110 aa, Unknown
  Obtained from environmental sample
  SIGNAL (1)...(18)
  DOMAIN (69)...(101): Ankyrin repeat
  misc_feature (1)..(110): Xaa is any amino acid
MKKSIIISAIVLGFSLVSVNAKSIVPVVNQNNIETVFNVNSFCISIVKGDIETVKKLLIRGEDINQKSNGMTPIMYAAKYNRVEILKLLIEKGRNIKNKIKQRIFCFRLC

SEQ ID NO: 22819 - DNA, 879 bp, Unknown
  Obtained from environmental sample
  misc_feature (1)..(879): n is a, c, g, or t
atgggcatgtatcataagcaagatttagaaaaactagaaaaatttgcgccaaataatgaggtttgtaaaagagctgtaattgttggtggtggtttaataggaattgaattggcagaaatgctaagaagtagaaaaattcctgttacttttttaatacgtgaaaatagtttttggaatggagttttgccagctcaagaatctgaaatgattaacaaacacatcaaagagcatcacatagatttgcgtttatcaaccaatttaaaagaaattaaaagtgatgaaaatggcaatgtaaaatcaataattattgaagaaactggagaggaaatattttgtaacgtagttggtttaacagctggagttactccaaatatcgactttttaaaagattctggtatcgaaacaaaaagaggtgttttagtcaatcgttttttagaaaccaatatcaaagatatttatgcaattggcgattgtgcagagcaacataaagcgattggacaacgtagaaatattgaagctgtttggtatacaggaagaatgatgggcgaagttttagcacaaacaatttgcggcaataaaatggcatacaatcctggacattggtttaattctgctaaatttttagatatagaataccaaacgtatggctgggtttttagtgaacgaaacaaacaagaagatgaagaatattttcaatggcaacatcctacaaaaaatatttgcattaccatttcttatgataaaaacacccataaatttttagggataaatacattcggaattagaatgcgtcatgaaatctttgatcgatggttgacagaaaacaaatcaatagaatacgttttagaatatctaaaaaatgccaattttgatccctga

SEQ ID NO: 22820 - protein, 292 aa, Unknown
  Obtained from environmental sample
  DOMAIN (1)...(167): Pyridine nucleotide-disulphide oxidoreductase
  misc_feature (1)..(292): Xaa is any amino acid
MGMYHKQDLEKLEKFAPNNEVCKRAVIVGGGLIGIELAEMLRSRKIPVTFLIRENSFWNGVLPAQESEMINKHIKEHHIDLRLSTNLKEIKSDENGNVKSIIIEETGEEIFCNVVGLTAGVTPNIDFLKDSGIETKRGVLVNRFLETNIKDIYAIGDCAEQHKAIGQRRNIEAVWYTGRMMGEVLAQTICGNKMAYNPGHWFNSAKFLDIEYQTYGWVFSERNKQEDEEYFQWQHPTKNICITISYDKNTHKFLGINTFGIRMRHEIFDRWLTENKSIEYVLEYLKNANFDP

SEQ ID NO: 22821 - DNA, 573 bp, Unknown
  Obtained from environmental sample
  misc_feature (1)..(573): n is a, c, g, or t
atgccaaacacaatattagcttacaaacactttaaaagaactgccgacgtattgagtgctgtattattattaacacttttttggtggtgtattgtaatattaattatgatagcgagtatagacacaaaatcttatggtgtttttaaacaaacccgaatagggcgttataaaataagattcacgattttcaagattaaaacaattaatagtgttggcaaaatctctaaaataggtgcgtttttaagacgttcgaaattagatgagcttcctcaattattaaatgtgctttttgggaatatgagttgtgtaggcccaagaccagatattcctggttttgcagatgaactaaaaggtaaagaagaaataatccttagcgtacggccgggtattactggacccgcgacattattttttagaaatgaagaattgcttttagcaacacaacaagatccaaagcagtataacgcgacagtaatttggcctaaaaaattagagttaaatgtgaaatatgttgaggaactcagttttaaaaaagatatatattaccttgttaatacgtttttaaaactatga

SEQ ID NO: 22822 - protein, 190 aa, Unknown
  Obtained from environmental sample
  DOMAIN (12)...(189): Bacterial sugar transferase
  misc_feature (1)..(190): Xaa is any amino acid
MPNTILAYKHFKRTADVLSAVLLLTLFWWCIVILIMIASIDTKSYGVFKQTRIGRYKIRFTIFKIKTINSVGKISKIGAFLRRSKLDELPQLLNVLFGNMSCVGPRPDIPGFADELKGKEEIILSVRPGITGPATLFFRNEELLLATQQDPKQYNATVIWPKKLELNVKYVEELSFKKDIYYLVNTFLKL

SEQ ID NO: 22823 - DNA, 705 bp, Unknown
  Obtained from environmental sample
  misc_feature (1)..(705): n is a, c, g, or t
atggcccnaggattaatggttttttatagcattaaggaagcgatgaaaaaaaacccagagttaaaagtctttacaggtaataaagaagatcgttttgccatggctgaacagcgtatagctgataaacttcagtgtgaacttgtttgtataccccatggtttagagtatgcatttaaattccctactggtcttgctggaaatatattctattctacaagccaaaatagttgcgaagtcctaagtagactgtacgaaaatacaaagtttattttcgatcataaattaaataaagttctttattcttttgaaagaaaagtggaacctaatacctgtaggcaagtttattttttttctgagtcgcgtgatattaatgtaaacaaaaatattattactcttttgaaggacgcgaggattgattttaaagtgaagctacatcccgccgatagtgaagataactataaagatttaaatgttgactttgaaagtgattatgtaaaagcgttgacgaactctatatgtatagcaagaaagtctacagttttgctggaagcattatataatgaatctatttcgattgcctttcttatagatactaaagatgactattacgcttcttttgtattcccatcattgagcgacagtaatataaaaaaattattaacaattaaagagcttcaactttatttagcaaaggataaaaaatag

SEQ ID NO: 22824 - protein, 234 aa, Unknown
  Obtained from environmental sample
  misc_feature (1)..(234): Xaa is any amino acid
MAXGLMVFYSIKEAMKKNPELKVFTGNKEDRFAMAEQRIADKLQCELVCIPHGLEYAFKFPTGLAGNIFYSTSQNSCEVLSRLYENTKFIFDHKLNKVLYSFERKVEPNTCRQVYFFSESRDINVNKNIITLLKDARIDFKVKLHPADSEDNYKDLNVDFESDYVKALTNSICIARKSTVLLEALYNESISIAFLIDTKDDYYASFVFPSLSDSNIKKLLTIKELQLYLAKDKK

SEQ ID NO: 22825 - DNA, 876 bp, Unknown
  Obtained from environmental sample
  misc_feature (1)..(876): n is a, c, g, or t
atggctgaggattatgctgaaatgttcgttgatagtaaaaacttcagttccttacaagacagtgctttagtctggaaaggagaagcctatgtggcagatattaaaaatgtcctcattaagtttttgggagaggagcgttcccaacgtgccttgaatctattttttttgaaatataaactaccacaaaacactcaaatggcggatgcaagattgataaatttttcagaaaaattattgacaggaagcatcggaaatgcatcagctaaaatattgatctcaagtgtagtaaaggaagaagaaattagtcttcttgaagtgttaaaaattttagaagaatcgaaagatgcgttggcaaggaataaactacttcatgaaaagtctacagaattaactaatcttagtaataaactaaaagatgctaatgaagaactcattgtcaaagataaacaaaaggatgattttttagatacggtggcacatgagcttaaaacacccattactggtataagagcggccacagagctattaatggatgaagatgatgaaatgccaggtgaaatgaaagcgcaattcttaaagaatattctgcaagattctgataggttatcaaggttaatacataatattttagattttgaaaaactttctacgggaaggcaacaattagtattaaatcagaacagtattaaaaaaactgttgcaaaggcaataaatagtattcaacaaatcgcttctaataaaaaaatacgaatcattcataatcataaggttgattttgaattacattatgatgaggataggattttgcaagtgttaccaattttatatctaacgcaatcaaattttgtgaacaaaaaagggtgtcattacagttag

SEQ ID NO: 22826 - protein, 291 aa, Unknown
  Obtained from environmental sample
  DOMAIN (150)...(218): His Kinase A (phosphoacceptor) domain
  misc_feature (1)..(291): Xaa is any amino acid
MAEDYAEMFVDSKNFSSLQDSALVWKGEAYVADIKNVLIKFLGEERSQRALNLFFLKYKLPQNTQMADARLINFSEKLLTGSIGNASAKILISSVVKEEEISLLEVLKILEESKDALARNKLLHEKSTELTNLSNKLKDANEELIVKDKQKDDFLDTVAHELKTPITGIRAATELLMDEDDEMPGEMKAQFLKNILQDSDRLSRLIHNILDFEKLSTGRQQLVLNQNSIKKTVAKAINSIQQIASNKKIRIIHNHKVDFELHYDEDRILQVLPILYLTQSNFVNKKGCHYS

SEQ ID NO: 22827 - DNA, 549 bp, Unknown
  Obtained from environmental sample
  misc_feature (1)..(549): n is a, c, g, or t
gtggcagatccttcaggcaaagattatattgcattggatgttatgaacacacttttgggcggttcgtttggatcgcgaataaccagtaatattcgtgaggacaaagggtatacctattctcctagcagtgctttggtagcgaattataaaagcggactttggtttgaaagcgccgatgtaactaccgaatttacaggcgcctcgatagatgaaattaaaaaggaaattgtgcgattgcaaaccgaagcaccaagcaaagcagaattggacggaatgaaaagttataaatctgggatttacgttttgcaaaactcaactcctaatggaataattgggcagttgaatttcttagatgtacacaatttggatgaatctttcttggtaaaccaagtgaaaaacataaatgccgtaaccccgcaacaagtgcaagaaatggcaaaaaaatatatcactccagaaactatgacgctgatagttgtgggcgataaggaaaagattaaagatcaagtaaaggaaaccatcgcgcagccagcgaaaaaagaacaataa

SEQ ID NO: 22828 - protein, 182 aa, Unknown
  Obtained from environmental sample
  DOMAIN (2)...(96): Peptidase M16 inactive domain
  misc_feature (1)..(182): Xaa is any amino acid
MADPSGKDYIALDVMNTLLGGSFGSRITSNIREDKGYTYSPSSALVANYKSGLWFESADVTTEFTGASIDEIKKEIVRLQTEAPSKAELDGMKSYKSGIYVLQNSTPNGIIGQLNFLDVHNLDESFLVNQVKNINAVTPQQVQEMAKKYITPETMTLIVVGDKEKIKDQVKETIAQPAKKEQ

SEQ ID NO: 22829 - DNA, 552 bp, Unknown
  Obtained from environmental sample
  misc_feature (1)..(552): n is a, c, g, or t
atgcgcgtggcctattttaatgagcttgatacttacgctcaaacctttggacttgaaaccaaacaaattatagaaggtattgggttagacccgcgtattggtgatcattataacaatccatcatttggctatggtggctactgcttacctaaagataccaaacagctattggcgaactatgacgaggtgccaagtaacctgataaaagccattgtcgactccaacagaactcgtaaagatttcatcgctgataaaattattgaaagaaaaccaaaaattgtaggtatacaccgattggttatgaaaagcggatcagacaactttagagcttctgcgatacaaggcatcatgaaacgtattaaggcaaaaggtatcgaagtcgttgtttacgaaccagtattgaaagaaagtacctttttcaactcacaagttattcaagacctagaagcgtttaaatcaatgagtgatgtcattgtggcaaaccgtttatctgctgaaatcgaagatgtggcggacaaggtctttacgcgtgatttatttgggagcgactga

SEQ ID NO: 22830 - protein, 183 aa, Unknown
  Obtained from environmental sample
  DOMAIN (95)...(182): UDP-glucose/GDP-mannose dehydrogenase family, UDP binding domain
  misc_feature (1)..(183): Xaa is any amino acid
MRVAYFNELDTYAQTFGLETKQIIEGIGLDPRIGDHYNNPSFGYGGYCLPKDTKQLLANYDEVPSNLIKAIVDSNRTRKDFIADKIIERKPKIVGIHRLVMKSGSDNFRASAIQGIMKRIKAKGIEVVVYEPVLKESTFFNSQVIQDLEAFKSMSDVIVANRLSAEIEDVADKVFTRDLFGSD

SEQ ID NO: 22831 - DNA, 879 bp, Unknown
  Obtained from environmental sample
  misc_feature (1)..(879): n is a, c, g, or t
gtggcatctgacgcaataactgacacgcgtttcgccagtgacgatgagatatattataatattgcttctatcatcaaatatgtgcctttttgtcgtcatatatacattgtcacagatcaacaaaagccagcgttcatcgatgagtttgccaagcaaggtatttgttcagcagataaaatacgcatcgttgatcataaagacatatttttaggttatgagcaatttttgcctacgtttaatacccgatcgattgagtcgatgatatggaatattgaggggctatctgattacttcatctatatgaatgatgatttcttttttaaccaaccagtaaaaatagatgactttttggacggtaaaaagctaaacattcacggccactggcgtaaaagtgcggcattaaatgctaagcttaatttccgaaaatcgcgctttaaactgtttggaacaccgattcaaccaaggcatactatcgcccaaatgctaagcgccaaaataattggtatggatcaattctttgaaattcatcactatcctcatatcgtcgataggaacatattgaaagattatttgctaaatcatcctcagctgctgacagagcagattagatataaatttagagatgtggcgcaggtgaacccaataaccctgatgaatcatcttaaaattcaaaaaaatgaagcaaatctaaaacccgatacctctgtcaactatctaaaaaatgaaagtagtgtcgatgattttattactgctttagaagataaatctatcaagtacggttgtatccaaagcctagatcttcttgaaccagatttacacaaaaaaatcaaccaagctatgaagcataaatttttagcgtatctccccgtttctgggaca

SEQ ID NO: 22832 - protein, 293 aa, Unknown
  Obtained from environmental sample
  misc_feature (1)..(293): Xaa is any amino acid
MASDAITDTRFASDDEIYYNIASIIKYVPFCRHIYIVTDQQKPAFIDEFAKQGICSADKIRIVDHKDIFLGYEQFLPTFNTRSIESMIWNIEGLSDYFIYMNDDFFFNQPVKIDDFLDGKKLNIHGHWRKSAALNAKLNFRKSRFKLFGTPIQPRHTIAQMLSAKIIGMDQFFEIHHYPHIVDRNILKDYLLNHPQLLTEQIRYKFRDVAQVNPITLMNHLKIQKNEANLKPDTSVNYLKNESSVDDFITALEDKSIKYGCIQSLDLLEPDLHKKINQAMKHKFLAYLPVSGT

SEQ ID NO: 22833 - DNA, 378 bp, Unknown
  Obtained from environmental sample
  misc_feature (1)..(378): n is a, c, g, or t
atggatgaattaattaatgaactaaatatagctattaaaaataagatgtacataacatctataaatacagcgttaatcattccagatatttgttctgcactacaatcatctaatggtcgaacaaatggctctaaatattctaattggtttaatgagtttatatctgaaaaatataaaggaaacttattagggtctgatctctataaattaagatgtgcttcattacatcaaggcaagttcaattacgactttgaacattttgacaaaatattgtttcaaccaaccacaaactcaatagttcataactgtgtaagtcaaaacaacggaggtatagaagaaaaagcacttattaaaaatgaaagaaaatccattttatga

SEQ ID NO: 22834 - protein, 125 aa, Unknown
  Obtained from environmental sample
  misc_feature (1)..(125): Xaa is any amino acid
MDELINELNIAIKNKMYITSINTALIIPDICSALQSSNGRTNGSKYSNWFNEFISEKYKGNLLGSDLYKLRCASLHQGKFNYDFEHFDKILFQPTTNSIVHNCVSQNNGGIEEKALIKNERKSIL

SEQ ID NO: 22835 - DNA, 846 bp, Unknown
  Obtained from environmental sample
  misc_feature (1)..(846): n is a, c, g, or t
gtggctaaaaagtttattattgcttccgttattagtggtttactctttagcttcagtagtaccaaaattatcgaaaagtcaagtagtgaaaacgtatcttctacaaaacaaagtcttacaagctctggaaacgcaatcaattccgaagataataatacagcaaaacaaaaccaggaaatattgttaactataaatggaatcgcttgtgaagaatgtgtttttcatttttcaaaaaaagctatcaagaagctcattgtcggtacctctacaggtgaaaaaataacgagttttaatgtgaaattttctggtaaacctacagaaactattaggggagcaaaaacattaaatgctacaacaaaaaaatatttagaagaggcaacggttggagatattgtacaacttttcgatattaaaatttacgagaagaaatttccgcctgtacttttatatgtggtagataaaaacgacccgaagtacagcaatgctctaaaagttaaaaagggagaacactcgactattcctgcacctcctgccccaccagctccgcctataacacgaactcaaacctctcaaattacacctacaccgccgccaacaccacaccaaactggttttataactattaatggttctgaacacttttttgtaactattaatgaaaagacaaaatattacaatcgttggggagtagaagttgatgctaaaggcagagaagtaaatggttctcttcgggtttctggggatcaagttgttccaggacaacacttaaccaaagtgtataaagacgataaagtggtaagtgaatttagaaaaacngtggcgcgacagccgtatgagttttcctga

SEQ ID NO: 22836 - protein, 281 aa, Unknown
  Obtained from environmental sample
  misc_feature (1)..(281): Xaa is any amino acid
MAKKFIIASVISGLLFSFSSTKIIEKSSSENVSSTKQSLTSSGNAINSEDNNTAKQNQEILLTINGIACEECVFHFSKKAIKKLIVGTSTGEKITSFNVKFSGKPTETIRGAKTLNATTKKYLEEATVGDIVQLFDIKIYEKKFPPVLLYVVDKNDPKYSNALKVKKGEHSTIPAPPAPPAPPITRTQTSQITPTPPPTPHQTGFITINGSEHFFVTINEKTKYYNRWGVEVDAKGREVNGSLRVSGDQVVPGQHLTKVYKDDKVVSEFRKTVARQPYEFS

SEQ ID NO: 22837 - DNA, 456 bp, Unknown
  Obtained from environmental sample
  misc_feature (1)..(456): n is a, c, g, or t
ttgccgttaagaaaactaagtaaggaattagcagcaaaaactattgttttaaataacggtgaaattcaagaaacaaaaaactttacggttgaagcggtaccaatgtacaatctaagagaggaagctctacaatttcatccaaaaggacgtggtaacggttatattttaacgctaggagatcaacgcatttatatttctggtgatactgaagatattccagaaatgagagcattaaaaaatattgataaagcatttatttgtatgaatttaccatacacaatgacggttaaaagtgctgcagacgcggttgtagcattcgctccaaaagaagtttacccttaccattacagaggaactgaaggtttaagcgatgttaaattgtttagggaattggtattagagaaaaataataatattgaagtgagtcaatgggattggtataaaactaaagaataa

SEQ ID NO: 22838 - protein, 151 aa, Unknown
  Obtained from environmental sample
  misc_feature (1)..(151): Xaa is any amino acid
MPLRKLSKELAAKTIVLNNGEIQETKNFTVEAVPMYNLREEALQFHPKGRGNGYILTLGDQRIYISGDTEDIPEMRALKNIDKAFICMNLPYTMTVKSAADAVVAFAPKEVYPYHYRGTEGLSDVKLFRELVLEKNNNIEVSQWDWYKTKE

SEQ ID NO: 22839 - DNA, 840 bp, Unknown
  Obtained from environmental sample
  misc_feature (1)..(840): n is a, c, g, or t
atgacgatttgctcgctttcaggggctgtagttttgtatgataaagatgatgtagatacgctttgggtacgcgtgtatttcaacgaatttgaacggcaggaaatagatttaagtttaaaaaaagtctataccatattgcattctgatggtaatgaacgcactattccatttttaaatgtggatgctattgattactgcacttttggtaattcaaaaccattccgaatcaaagtcagaaatatcctgaatgataattacacctatttttatataaaaaaagccgatgcttcccgcatttatggcttagaattggagcatatgctctcaccctataatcttaattttttggtgtttgagaataccttgatagaagagcatattgctggtgtacctggagatgaatttatcaaaaacatgttgcctaaatgtactccttcagaaagatcgcagattgccaaagagtttgtaaagtttaatgagcgttgtatgatccgtcttttgggagatatgcgttcgtataattatgtcattgtgcctacgcacgactttgatcatgtagtttataaaattagacccatagattttgatcagcaaagttatgaaggcaaatttaatgtgtaccgaccacaattttttaaggagaatttagcgatggtagaattggttcaggaaaaatttcagcaggaatccattgaccaatataaattggaagagcgctctattgttgccaaacgtttaatcagttatcatgaacgaattaaggaacttctggactgtatgattaatgataccctgtccacgccagagcacattaagctcctaaagatgaaaatcttttga

SEQ ID NO: 22840 - protein, 279 aa, Unknown
  Obtained from environmental sample
  misc_feature (1)..(279): Xaa is any amino acid
MTICSLSGAVVLYDKDDVDTLWVRVYFNEFERQEIDLSLKKVYTILHSDGNERTIPFLNVDAIDYCTFGNSKPFRIKVRNILNDNYTYFYIKKADASRIYGLELEHMLSPYNLNFLVFENTLIEEHIAGVPGDEFIKNMLPKCTPSERSQIAKEFVKFNERCMIRLLGDMRSYNYVIVPTHDFDHVVYKIRPIDFDQQSYEGKFNVYRPQFFKENLAMVELVQEKFQQESIDQYKLEERSIVAKRLISYHERIKELLDCMINDTLSTPEHIKLLKMKIF

SEQ ID NO: 22841 - DNA, 300 bp, Unknown
  Obtained from environmental sample
  misc_feature (1)..(300): n is a, c, g, or t
atgtctaaaggcactttcaaatggaccaaatacctgaggatgtgcaattacttggatgttagttggatcgatggatacatttgcgtaaaaatagataaccagggtggcaattatagtgatcgcaattatgctgctaaaataatatctaaattcttcattttttcgatatttggtaaaatcaccttttactgcataataactaagaacaaaattggttcccgcaacaaacatgaaaaagataataatgtattgaatcatgggttggtcattccaataggcaatactgtcatttttggttga

SEQ ID NO: 22842 - protein, 99 aa, Unknown
  Obtained from environmental sample
  misc_feature (1)..(99): Xaa is any amino acid
MSKGTFKWTKYLRMCNYLDVSWIDGYICVKIDNQGGNYSDRNYAAKIISKFFIFSIFGKITFYCIITKNKIGSRNKHEKDNNVLNHGLVIPIGNTVIFG

SEQ ID NO: 22843 - DNA, 648 bp, Unknown
  Obtained from environmental sample
  misc_feature (1)..(648): n is a, c, g, or t
atgattgacaaggagttattagaacatttagaaagttatttaacaccacatcggttggagcgttttaattacgttatcaatcagcgcaccaaacattttacagtggctaccgaagatgtgtatcaattacataatacgagtgctgttattcgtagctgtgatgtgtttggtattcaagaagtgaatattgtagaggaaataaattctaagcgcatagaccgcgaaattgctatgggagctcagaaatgggtagatttaaatcgctaccattctataaaagattgtattgccgatgtgaaaagtaaaggctaccaaattgtagcaacgacaccgcataccgacgactgtgaactacacgattttgacgtgacaaaaaagtcttgttttttcttcggaagagaaacagaagggttgtcgcaagaagttttagatgaagcagatgtgtttttaaaaatcccgatgtctggatttaccgagagtttaaatatttcggtttctgcagccattattttacaacacgttaccacaaaattgaaaaaaacaactctagagtggggcttaaccgaagatgaaaaacttcaaaaacgattggattggtgtaccaaaacaataaaaagtcacgaagaaattatagctcgatttatataa

SEQ ID NO: 22844 - protein, 215 aa, Unknown
  Obtained from environmental sample
  DOMAIN (32)...(172): SpoU rRNA Methylase family
  misc_feature (1)..(215): Xaa is any amino acid
MIDKELLEHLESYLTPHRLERFNYVINQRTKHFTVATEDVYQLHNTSAVIRSCDVFGIQEVNIVEEINSKRIDREIAMGAQKWVDLNRYHSIKDCIADVKSKGYQIVATTPHTDDCELHDFDVTKKSCFFFGRETEGLSQEVLDEADVFLKIPMSGFTESLNISVSAAIILQHVTTKLKKTTLEWGLTEDEKLQKRLDWCTKTIKSHEEIIARFI

SEQ ID NO: 22845 - DNA, 798 bp, Unknown
  Obtained from environmental sample
  misc_feature (1)..(798): n is a, c, g, or t
ttgatcgcagttgagaagccatttttaatttttaactgcgcatatacacacaactatataatgaaagaaaaaggacttcatccaaaaaataagtttgataaaggatataattntgatgaacttgttaaagtaaatccgaagttaaaaccatttgtaactacaaataaatatgattcagttacaattgatttttctaatcctgaagctgtaaaagaactcaataaagccttgttatttacgtttgataaaatttcgacttgggattttcctgacgctaatttatgtccgccaattcctggaaggttagattatattcatcatttaaatgatttaatttcatccgaagaaaacataaaagttttagatattggtactggagcaacgtgtatttatccgcttttaggagttgcagcatacaattgggattttgtagcaacagacatcgatttagattctttagatactgctcaagatataatttacgacaataaattagattcgaaaatagaattacgtcagcaattagatgaacaacaaattttaaaaggaattttaaaagatgaagattcattttcggcgactatgtgtaatccgcctttttacaaatctgcagaagaagcacaaggagcaaacaaacgtaaaaacagaaatttaggaaataacgctgtaagaaatttctctggtaacaataacgaactttggtatgttggaggagagaaagcttttttacacaattatttgtatgaaagttctttatttaaagagaaaagtaaatggtttacaagcnttggtatctaa

SEQ ID NO: 22846 - protein, 265 aa, Unknown
  Obtained from environmental sample
  DOMAIN (21)...(262): Protein of unknown function (DUF890)
  misc_feature (1)..(265): Xaa is any amino acid
MIAVEKPFLIFNCAYTHNYIMKEKGLHPKNKFDKGYNXDELVKVNPKLKPFVTTNKYDSVTIDFSNPEAVKELNKALLFTFDKISTWDFPDANLCPPIPGRLDYIHHLNDLISSEENIKVLDIGTGATCIYPLLGVAAYNWDFVATDIDLDSLDTAQDIIYDNKLDSKIELRQQLDEQQILKGILKDEDSFSATMCNPPFYKSAEEAQGANKRKNRNLGNNAVRNFSGNNNELWYVGGEKAFLHNYLYESSLFKEKSKWFTSXGI

SEQ ID NO: 22847 - DNA, 483 bp, Unknown
  Obtained from environmental sample
  misc_feature (1)..(483): n is a, c, g, or t
ttggaatttgagaaagtaacatattataaaacacctattggtactgcaagaattgtaggtgatgatgatggtgtatcgtcaataactgttttggatagtgagaaagaaagctcaacaaagataccagaatgtttaaaagattgtgttaatcaattaaaggagtattttcagggaaagagaacttcatttaacttaaacttaaatcctcaaggcacttcttttcaaaaggaagtgtggagtgcattgcagcaaataccttatggtacaacgaaatcttatttaaaaatgagtaaagaaatgggaaacgttaaagcaatcagggctgttgcttccgcaaatggtaaaaatccgctttggatcgttatcccttgtcaccgtgttatcggtagtgacgggtcacttactggatatgcaggtggtttatggcgtaaacgctggttattagaacacgaaaatccaccaattcaacaatcacttttttaa

SEQ ID NO: 22848 - protein, 160 aa, Unknown
  Obtained from environmental sample
  DOMAIN (71)...(156): 6-O-methylguanine DNA methyltransferase, DNA binding domain
  misc_feature (1)..(160): Xaa is any amino acid
MEFEKVTYYKTPIGTARIVGDDDGVSSITVLDSEKESSTKIPECLKDCVNQLKEYFQGKRTSFNLNLNPQGTSFQKEVWSALQQIPYGTTKSYLKMSKEMGNVKAIRAVASANGKNPLWIVIPCHRVIGSDGSLTGYAGGLWRKRWLLEHENPPIQQSLF

SEQ ID NO: 22849 - DNA, 897 bp, Unknown
  Obtained from environmental sample
  misc_feature (1)..(897): n is a, c, g, or t
atggaaaagcttatgaatcgtcaagcagagcttcaagatcaaattgatgcgtctaatgcttgggaattagacacaaagttagaaattgctatggatgcgttacgtacgcctgatggtgataaaaaaattggtgtattgtctggaggggaaagacgtcgtgtagcgttgtgtcgtttattattacaagaaccagacgttttattattagatgagcctactaaccacttggatgcagagtctgtacattggttagagcaccatttagcacaatataaaggaactgtaattgctgtaacgcacgatagatactttttagataacgtagcaggatggattttagaattagatagaggtgaaggtatcccatggaaaggaaactactcttcttggttagatcaaaaatctaagcgtatggctcaagaaagcaaaacagcatctaagcgacaaaaaactttagagcgtgagctagaatgggttaaacaaggtgctaaaggtcgtcaaacaaagcaaaaagcacgtttaaaaaattatgacaagttaatgagtcaagatcaaaaacaacttgacgaaaagcttgaaatttacataccaaatggtccacgtttaggtactaacgtgattgatgcaattggtgtaagtaaagcgtatgacgataaattattatacgaagatttaaagtttaatttaccacaagcaggaattgttggtgtaattggtccaaacggagcaggtaaaaccacaatttttagaatgataatgggtgaagaaacgcctgataaaggtgagtttaaagtaggagaaactgcaaaaattgcctacgtagatcaaaagcactctaatattgatccagaaaaaactatttggcaaaactttagtgatgagcaagaattaatcttt

SEQ ID NO: 22850 - protein, 299 aa, Unknown
  Obtained from environmental sample
  DOMAIN (3)...(118): ABC transporter
  misc_feature (1)..(299): Xaa is any amino acid
MEKLMNRQAELQDQIDASNAWELDTKLEIAMDALRTPDGDKKIGVLSGGERRRVALCRLLLQEPDVLLLDEPTNHLDAESVHWLEHHLAQYKGTVIAVTHDRYFLDNVAGWILELDRGEGIPWKGNYSSWLDQKSKRMAQESKTASKRQKTLERELEWVKQGAKGRQTKQKARLKNYDKLMSQDQKQLDEKLEIYIPNGPRLGTNVIDAIGVSKAYDDKLLYEDLKFNLPQAGIVGVIGPNGAGKTTIFRMIMGEETPDKGEFKVGETAKIAYVDQKHSNIDPEKTIWQNFSDEQELIF

SEQ ID NO: 22851 - DNA, 405 bp, Unknown
  Obtained from environmental sample
  misc_feature (1)..(405): n is a, c, g, or t
atggtatttacggaacacaagattttagaaccggaacctgggcaaggttatcaagacaaagacttaatagcaactgttgatttaggtagcgtgaagcaagtaaatctggtaacattaaattttttacaagaacaacgatcatggatattttatccaacccaagtgagctgttttggctcgacagatggaattaattttaacccaattgataccactaaatctgttaatagcacacaaccatctgaggacacagaaatcaaaaaggtgttttttaaacaagtatcaaaaccatatcgctacataaaaatcatagcaaaaaaactaggcaaacttccagaatggcatttaggttacaagcatgatggtagaagttggctttttgtggacgaaatcactatcaaataa

SEQ ID NO: 22852 - protein, 134 aa, Unknown
  Obtained from environmental sample
  misc_feature (1)..(134): Xaa is any amino acid
MVFTEHKILEPEPGQGYQDKDLIATVDLGSVKQVNLVTLNFLQEQRSWIFYPTQVSCFGSTDGINFNPIDTTKSVNSTQPSEDTEIKKVFFKQVSKPYRYIKIIAKKLGKLPEWHLGYKHDGRSWLFVDEITIK

SEQ ID NO: 22853 - DNA, 750 bp, Unknown
  Obtained from environmental sample
  misc_feature (1)..(750): n is a, c, g, or t
atgaatcttctaaagaagcctcttttaaaccaagctagatcaaacggagtagaaagcctaatcgtaacgtcaacttgcaatcgtacagaaatttacggttttgcagaacacccatatcaattaattcaactattgtgcgataacacaaaaggaactgttgaagagttccaaaaatttgcatatatctataaaggcaaagaagctatttcgcatttatttagagttggttctggattagacagccaaattttaggagattttgaaataattggacagcttaaaaaaagtactatcgaatctaaaaaacatggcttactaaacccttttattgagcgtttagtaaactctgtaattcaagcaagcaaacgcattaaaaccgaaaccgaaatttcttctggtgcaacaagcgtatcttttgcttctgttcaatacattttaaatactattgaagacgtaaccaacaaaaacatactattgtttggtactggtaaaattggacgtaacacctgcgaaaatttagttaagcatactaaaaacgagcaaatcacattaataaatcgtaccaaaggaaaagcagaagctgttgctggtaaatttaatttagtggttaaggattatgccaacctacaagaagaaataaatgaagctgacattttaattgtagctactggagcacaaaacccaacggttgataaacaactaattcaatctaaaaaagacttattaattttagatttatctattccctaa

SEQ ID NO: 22854 - protein, 249 aa, Unknown
  Obtained from environmental sample
  DOMAIN (133)...(249): Glutamyl-tRNAGlu reductase, NAD(P) binding domain
  misc_feature (1)..(249): Xaa is any amino acid
MNLLKKPLLNQARSNGVESLIVTSTCNRTEIYGFAEHPYQLIQLLCDNTKGTVEEFQKFAYIYKGKEAISHLFRVGSGLDSQILGDFEIIGQLKKSTIESKKHGLLNPFIERLVNSVIQASKRIKTETEISSGATSVSFASVQYILNTIEDVTNKNILLFGTGKIGRNTCENLVKHTKNEQITLINRTKGKAEAVAGKFNLVVKDYANLQEEINEADILIVATGAQNPTVDKQLIQSKKDLLILDLSIP

SEQ ID NO: 22855 - DNA, 498 bp, Unknown
  Obtained from environmental sample
  misc_feature (1)..(498): n is a, c, g, or t
atggtgcaaactggggtaattttaaaaacgaactcatcaataaataataaattaaaaggagttatttttaaactgaatattatactaactattcttaccatattttccctatatgtttggcaaattgtaaaccctaattcattaggcaatttttctgataagccttatttgttagtatttccaatgatttattttataggtttaattgggttgttttttatcaaaaaaattaagaaggatatgcatgcttttatattatcaactttggtaattcttggaggaattacatcctcattagcatctttgtttcctgtaattttaccatcaacaaatacaaaacatgaatctttaacaatttataatactgcaacatcagaatatggtttgtcagttgctttaatttggggaattattggctttattctactttttgtttatatgataattcaaaaaaaattaatgggtggtaaaattgataaaatggattatggtcattag

SEQ ID NO: 22856 - protein, 165 aa, Unknown
  Obtained from environmental sample
  misc_feature (1)..(165): Xaa is any amino acid
MVQTGVILKTNSSINNKLKGVIFKLNIILTILTIFSLYVWQIVNPNSLGNFSDKPYLLVFPMIYFIGLIGLFFIKKIKKDMHAFILSTLVILGGITSSLASLFPVILPSTNTKHESLTIYNTATSEYGLSVALIWGIIGFILLFVYMIIQKKLMGGKIDKMDYGH

SEQ ID NO: 22857 - DNA, 636 bp, Unknown
  Obtained from environmental sample
  misc_feature (1)..(636): n is a, c, g, or t
ttgagttcgaaaattcatcaatattttataaaacaatttaccgaatgttgggtgccagattctgaaaccgaaccgtatttaagtggtaagttaggacatcctaaatcggcagctctacaaatgaaatatattgacccgcagagcaggttaaaaaagcaaatactaccaaaacactacgcagttatgattgtattgtcaggccccgaaccacaacgacactatttagaagttgaattatttgaagcgtttaaacattttaaaggccgtgttttaatggtaaaaggtgtaattgaacggcaacaaacggtaacccaaaatgggccgtttactatctataactttatgcaaacggaggctttagaaaaagccataaatagtagcgaaattatagtgtcgcgttcggggtatacgacgcttatggatttagccaaattgaataaaaaagcattttttatcccaactccgggacaatttgaacaagaatatttagccgaaagactccacgaattacaaatcgcaccctattgtaaccaaggtaagtttaacatagaattactagagtgtttgaaggactatagtggatttaaaactccaataaccaacaccgattacgagtctttatttcgccttttctaa

SEQ ID NO: 22858 - protein, 211 aa, Unknown
  Obtained from environmental sample
  misc_feature (1)..(211): Xaa is any amino acid
MSSKIHQYFIKQFTECWVPDSETEPYLSGKLGHPKSAALQMKYIDPQSRLKKQILPKHYAVMIVLSGPEPQRHYLEVELFEAFKHFKGRVLMVKGVIERQQTVTQNGPFTIYNFMQTEALEKAINSSEIIVSRSGYTTLMDLAKLNKKAFFIPTPGQFEQEYLAERLHELQIAPYCNQGKFNIELLECLKDYSGFKTPITNTDYESLFRLF

SEQ ID NO: 22859 - DNA, 438 bp, Unknown
  Obtained from environmental sample
  misc_feature (1)..(438): n is a, c, g, or t
ttgaaaagtcttaaaatgaaattaaaatcaacgactgtaaacgcagtatctattatagaaatacctaaaatcactgatgaagaaggacgtggtaatttgtcagttatagaaaaagattgcgttccatttgatatcaaacgcgtgtattatttatacgatgtacctagtgatgcttatagaggaggtcatgctcataaagctttatttcagtttttgatacccttaagtggtagttttgatgtgattttaaaagatggtaaaaacactaaaacagtcagtttaaataagcctaataaagggttgatgattgtaccaggtatttggagagaacttgaaaatttttcttcaggagcagtatgtttagttttagcatcagaggtttacaatgaagaggattatgttagagattatagcgaatttgaattacttaaaagctga

SEQ ID NO: 22860 - protein, 145 aa, Unknown
  Obtained from environmental sample
  DOMAIN (14)...(145): WxcM-like, C-terminal
  misc_feature (1)..(145): Xaa is any amino acid
MKSLKMKLKSTTVNAVSIIEIPKITDEEGRGNLSVIEKDCVPFDIKRVYYLYDVPSDAYRGGHAHKALFQFLIPLSGSFDVILKDGKNTKTVSLNKPNKGLMIVPGIWRELENFSSGAVCLVLASEVYNEEDYVRDYSEFELLKS

SEQ ID NO: 22861 - DNA, 300 bp, Unknown
  Obtained from environmental sample
  misc_feature (1)..(300): n is a, c, g, or t
atgaaaactaaaggttttaaatttccgcatgaattgtctggaggagagcaacaacgtattgcaattgcacgtgcgttgctaaatgatcctgaattaattttagcagatgagcctactggtaatcttgacccacaaactagtattgaggtcatggaagtattacaagacattaataaaaatggtaatacaatcttaatggctactcatgattatgctttacttttaaaatatccaagtaaaacattaaaatgtgacgataacagaatttttgaagtggtacagcgtaagactactgtataa

SEQ ID NO: 22862 - protein, 99 aa, Unknown
  Obtained from environmental sample
  DOMAIN (1)...(87): ABC transporter
  misc_feature (1)..(99): Xaa is any amino acid
MKTKGFKFPHELSGGEQQRIAIARALLNDPELILADEPTGNLDPQTSIEVMEVLQDINKNGNTILMATHDYALLLKYPSKTLKCDDNRIFEVVQRKTTV

SEQ ID NO: 22863 - DNA, 531 bp, Unknown
  Obtained from environmental sample
  misc_feature (1)..(531): n is a, c, g, or t
atgggattaaccattcctttgatctctaaatatgatttaaaacaacatagtcttgcattagtacacaaactatccaaaactattaaatatgtcagagattattttaaaaacggtactttagtaactagtgatactcatggatttattacaactaatttagttgaaaatagtactaaagatttagatggttttgccaaacgggttactataaaccatgaagatggattgttagattttactcaaaacaccaaaaggatccaagaaattatcaagcaatgtcagtctagagatattaacgtgtatttagtaagtttgccagttaattatagatatgtaaatttagtaaattctaaaaaagtagctaaaatttacgatacagcaaatgctttagcattaggtaatagtaatacaacgtatatcaacttgtttgaagataaccgatttgatgattcagatttttttgatgctaatcaccttaatgttaaaggtgctaaaaaatgtacagtaattttaaaccaaattatacagtag

SEQ ID NO: 22864 - protein, 176 aa, Unknown
  Obtained from environmental sample
  misc_feature (1)..(176): Xaa is any amino acid
MGLTIPLISKYDLKQHSLALVHKLSKTIKYVRDYFKNGTLVTSDTHGFITTNLVENSTKDLDGFAKRVTINHEDGLLDFTQNTKRIQEIIKQCQSRDINVYLVSLPVNYRYVNLVNSKKVAKIYDTANALALGNSNTTYINLFEDNRFDDSDFFDANHLNVKGAKKCTVILNQIIQ

SEQ ID NO: 22865 - DNA, 807 bp, Unknown
  Obtained from environmental sample
  misc_feature (1)..(807): n is a, c, g, or t
atggctaaagttaaacacaatattttcttggatacggttgatgaagtaatcaccaatgcaaccaatgctggggtaatccatctccatgcagagggcaatgaattaaacgggcggcgtataaccattaacgggaaaccttcctatcacttcggaaccacgggttacttaggacttgaacaagataaaaggttaaaaagagcagcaatagatgctattgaaaaatacggaacccagtttccactatccaaaacatatatttcgcacccgctctatgctccgctggaagaaaaaatatttgaaatgtaccagcaccccatactcattactaaaaatagtacacttgggcatttagcagtcattcccacagctataagggatggtgatgcggtgatcttggatcaccaggtacattggagtgttcaaagtgccacggaggttttaaaatcaaaaggagtaacagtaaggatgatcaggcatagcaatatggatatgctggaacattatatcaaagacttaagaaataaggccaataaaatttggtatatggcagacggggtttattccatgtacggggattttgcccctttacaggacttaatggagttgtccaaaaagtacccgcaattacacctctatatagatgatgtgcacggaatgagttggaaaggaaagcacggttcgggttatgttatgtctgtattgaaagagcttccccagaatctactcttaatcggcacgttgagtaaaacttttggggctagtggtgcagtgctagtatgtcctgataaaaaatgcataaaaaaataa

SEQ ID NO: 22866 - protein, 268 aa, Unknown
  Obtained from environmental sample
  misc_feature (1)..(268): Xaa is any amino acid
MAKVKHNIFLDTVDEVITNATNAGVIHLHAEGNELNGRRITINGKPSYHFGTTGYLGLEQDKRLKRAAIDAIEKYGTQFPLSKTYISHPLYAPLEEKIFEMYQHPILITKNSTLGHLAVIPTAIRDGDAVILDHQVHWSVQSATEVLKSKGVTVRMIRHSNMDMLEHYIKDLRNKANKIWYMADGVYSMYGDFAPLQDLMELSKKYPQLHLYIDDVHGMSWKGKHGSGYVMSVLKELPQNLLLIGTLSKTFGASGAVLVCPDKKCIKK

SEQ ID NO: 22867 - DNA, 690 bp, Unknown
  Obtained from environmental sample
  misc_feature (1)..(690): n is a, c, g, or t
ttgttaaatgaagcggttaacgtggttaatttatttgtaccaaaagagcaattggtagtaagtacaaagtctaaagtaaaaaaatataaccgaacgtattatacccaaaacgaccctatagataccgaaattcctttggtggttttaattaacggtacaagtgcttcagcaagtgaaattgttgcaggaacacttcaagatattgatcgtgcggttattgtgggctctagaagttttggtaaaggtttagttcagcgtccaaaaaaactaacttacggtacacaaatcaaattaactatttcgcgttattatacaccgtctggacgttgtattcaggctttagattattggaataaagacgataatggaaatgcggtgcgtgttaaacaaaaagactacaatgcttttaaaactaaaaatggacgaaaagtttacgatggtggcggtgtctttcctgatgaaattttagaacattctaaaaactctgccattaccaatgctattttaagcacacaaagtattttcgattttgcaacactttattattacagtcatcctctcgaagatatttcagattttaaattaacagatgccgatttcaaaagctttaaaaattacttaaaagaaactaacttttccttcgaaaccgaaaccgaaaaatcgtttgccaaagcccttcgaaatatctaa

SEQ ID NO: 22868 - protein, 229 aa, Unknown
  Obtained from environmental sample
  DOMAIN (2)...(118): Peptidase family S41
  misc_feature (1)..(229): Xaa is any amino acid
MLNEAVNVVNLFVPKEQLVVSTKSKVKKYNRTYYTQNDPIDTEIPLVVLINGTSASASEIVAGTLQDIDRAVIVGSRSFGKGLVQRPKKLTYGTQIKLTISRYYTPSGRCIQALDYWNKDDNGNAVRVKQKDYNAFKTKNGRKVYDGGGVFPDEILEHSKNSAITNAILSTQSIFDFATLYYYSHPLEDISDFKLTDADFKSFKNYLKETNFSFETETEKSFAKALRNI

SEQ ID NO: 22869 - DNA, 801 bp, Unknown
  Obtained from environmental sample
  misc_feature (1)..(801): n is a, c, g, or t
gtgtatttcgatacggataaatataatgtgcctttaaccgaagaaaacagacttttattatttatttccgaattagattcggtagacataggtaaagtgtctatttatggttttaccgacgatagaggcacgagcgaatacaatttagaactctctcaaaaccgtgccgatgctattaaagaaatgttttctggctatggaatagatcctaatttaattaccaatgtcgatggtaaaggtattatacttttaaaggttttaaatgaaaatgaaattaacaaaattcgaggtttaaaccgaaaagtagaaattagtgttacccctaaactacccgaaaaaaaagggagtaaaaaacaacttactaaagctgaagaaaagtcggaaaataccttagaaaaaaccattgaggatctcaataaaggcacagttaaaaaaggtgataaaatacgtttagacaagatttattttaaaaccaattatagttatatcacagccgaatcgcgtaaaaccttagagaatattgcaaaaattctagtagaacacgataacatctattttactattcaagggcacgtatgttgtacacaaatgagtcgagatgctattgataaaagaacaaaaaaacgaaatttatcagtcgctagagcgcagtatatttacgattatttagaaagaaaaggcgttgataaaagacgaatgaaatatgtgggtttacgacgtaaatttccgttgggaggcgatccaaaattcgatcgtcgggtagagattttagtcacttatgttgggaaaactaccaactaa

SEQ ID NO: 22870 - protein, 266 aa, Unknown
  Obtained from environmental sample
  DOMAIN (2)...(100): OmpA family
  misc_feature (1)..(266): Xaa is any amino acid
MYFDTDKYNVPLTEENRLLLFISELDSVDIGKVSIYGFTDDRGTSEYNLELSQNRADAIKEMFSGYGIDPNLITNVDGKGIILLKVLNENEINKIRGLNRKVEISVTPKLPEKKGSKKQLTKAEEKSENTLEKTIEDLNKGTVKKGDKIRLDKIYFKTNYSYITAESRKTLENIAKILVEHDNIYFTIQGHVCCTQMSRDAIDKRTKKRNLSVARAQYIYDYLERKGVDKRRMKYVGLRRKFPLGGDPKFDRRVEILVTYVGKTTN

SEQ ID NO: 22871 - DNA, 462 bp, Unknown
  Obtained from environmental sample
  misc_feature (1)..(462): n is a, c, g, or t
atgcacaacaaaataaaagacttttacgaaaaccaaaagttcgcacgaattacaagaaaagttgcggaagattgggacgaaataagtcgtggttatattgtcgatttttcaactgaatttattgttttgcaagaatgcgatgattttgaactgaaaggatataatattctgccaattaaagattttaccgaaatccgatttaataacaacgacaaatattatgacaaaataatgttgttggaaaatgaaaaagaaaatatcggaattaaaactaaattggatttaactgattggaaaacaatcttcaaatctttacggaaaaataaacggaatgttgcgattgaatgtgaaaatccagaatttgacacatttactattggaccgataaaaagaattacggacaaaagcgtttttattcagtattttaatgcaatcggaattcttgatgaaaagccgcactaa

SEQ ID NO: 22872 - protein, 153 aa, Unknown
  Obtained from environmental sample
  misc_feature (1)..(153): Xaa is any amino acid
MHNKIKDFYENQKFARITRKVAEDWDEISRGYIVDFSTEFIVLQECDDFELKGYNILPIKDFTEIRFNNNDKYYDKIMLLENEKENIGIKTKLDLTDWKTIFKSLRKNKRNVAIECENPEFDTFTIGPIKRITDKSVFIQYFNAIGILDEKPH

SEQ ID NO: 22873 - DNA, 864 bp, Unknown
  Obtained from environmental sample
  misc_feature (1)..(864): n is a, c, g, or t
ttgatcagatcggctcnagtaccgccaaaatacattaccaaatacattgtagataatactgttcgcaaactttgtgaggaaaagaaaattgaacttgacatacaagaagctgaatacgaaaaagaacgtaaaggaagaaagaaagcaacactaaaaaaattaactcaaaaattagaagattatagaaaatggctattacaaattaccatttgcgacccagcttgtggtagtggagcttttctaaatcaagctttggagtttttaattgcagaacatcaatatattgacgaattacaagccaaactctttggagacgcaatggttttaagtgaagttgaaaatgcaattttagaaaataatatttatggtgttgacatcaatgatgaaagtgtagaaattgcaaaactatcactttggttaagaacagcacaaaaagacagaaaactaacttcattaaacaataatattaaatgtggtaacagtttaattgatgaccctacttttgctagagaaaaagcttttaattggaataacgaatttccagaagtttttgcaaatggaggttttgatgttattattggaaatccaccttatgttagacacgagataattaaagagtttaaaccttcatttcaaaaggattatgaaacatatttaagtacagcagatttatatgtgtatttcattgaattgggcatcaaagctttgaaaacaaacggattattaggttttattaatccaaacaaatttatcaaagcatcttatggaaaaaatttaaagcaatttttaagtaaattacaaattgaacaattaattgattttggagaattaatgtttttcaagatgctgttacttcacctctga

SEQ ID NO: 22874 - protein, 287 aa, Unknown
  Obtained from environmental sample
  misc_feature (1)..(287): Xaa is any amino acid
MIRSAXVPPKYITKYIVDNTVRKLCEEKKIELDIQEAEYEKERKGRKKATLKKLTQKLEDYRKWLLQITICDPACGSGAFLNQALEFLIAEHQYIDELQAKLFGDAMVLSEVENAILENNIYGVDINDESVEIAKLSLWLRTAQKDRKLTSLNNNIKCGNSLIDDPTFAREKAFNWNNEFPEVFANGGFDVIIGNPPYVRHEIIKEFKPSFQKDYETYLSTADLYVYFIELGIKALKTNGLLGFINPNKFIKASYGKNLKQFLSKLQIEQLIDFGELMFFKMLLLHL

SEQ ID NO: 22875 - DNA, 399 bp, Unknown
  Obtained from environmental sample
  misc_feature (1)..(399): n is a, c, g, or t
ttgttttttgtacatttaaatcaaaagcaagattcgaaagaaggtattgcaaaatttagagaaagtggaactaattttgataaagaaattaaaagaatatcagaaatttctgatgaatttttaaaattaaaatccatagaagaatttgataaattaattgttgaacacgaattaattatcagcaatattatcaaactaaaaccagtaaaagagaaattatttccagattattttggagaaataaaaagtttaggagcttggggaggagattttgtattagctacaggaaatgaaaaaactccaaactattttaagaataaaggatttaaaacagtcatttcttattcagagatgataaagcccaccttaatcctcccaaagggaggaaactcaaattaa

SEQ ID NO: 22876 - protein, 132 aa, Unknown
  Obtained from environmental sample
  misc_feature (1)..(132): Xaa is any amino acid
MFFVHLNQKQDSKEGIAKFRESGTNFDKEIKRISEISDEFLKLKSIEEFDKLIVEHELIISNIIKLKPVKEKLFPDYFGEIKSLGAWGGDFVLATGNEKTPNYFKNKGFKTVISYSEMIKPTLILPKGGNSN

SEQ ID NO: 22877 - DNA, 438 bp, Unknown
  Obtained from environmental sample
  misc_feature (1)..(438): n is a, c, g, or t
atgtcgtttataaaagtttatattcattttgtttggagtaccaaaaacagaattccgtttctggaaacaaaagaattgaggcagaaagtttggcaacatattaaggaaaatgctaaagaaaaaggaatttttattgattttataaatggctattcagatcattgtcattgtttaatatcacttggagtagatcaaaatattcaaaagattatgcagttgataaaaggagaatcagctttttggattaataaacaaggattaacaaaagaaaagtttcaatggcaaagtgaatattttgcagtttctgtatccgaatctattgttgagaaagttagagattatataaggaatcaagaaaagcatcatttaaaaaaatcttttaaggaggaatttgaagaaattatgcagaaatatgattttaaaaatattaaggattaa

SEQ ID NO: 22878 - protein, 145 aa, Unknown
  Obtained from environmental sample
  DOMAIN (11)...(111): Transposase IS200 like
  misc_feature (1)..(145): Xaa is any amino acid
MSFIKVYIHFVWSTKNRIPFLETKELRQKVWQHIKENAKEKGIFIDFINGYSDHCHCLISLGVDQNIQKIMQLIKGESAFWINKQGLTKEKFQWQSEYFAVSVSESIVEKVRDYIRNQEKHHLKKSFKEEFEEIMQKYDFKNIKD

SEQ ID NO: 22879 - DNA, 357 bp, Unknown
  Obtained from environmental sample
  misc_feature (1)..(357): n is a, c, g, or t
atgtatggtcattatggggaagatagaaattacgccactagagtattgttccataattttagaattgttattgtaaataacgctaaaatttgtcacgatagaattattaaacgcaattttaaaaaagattctattcagtcaaaatataaaatattgacagaggttttaaatgttaacaactccttattttttagttatcgaaatggatttttaaatgtttttgggttaccgaagtatttttacaagtattattctctttcttcagtaataagtctttttttaaaattactatggtattactcaggtttaatattaaactttactaaaattttaaaaaaacggttaagctataaataa

SEQ ID NO: 22880 - protein, 118 aa, Unknown
  Obtained from environmental sample
  misc_feature (1)..(118): Xaa is any amino acid
MYGHYGEDRNYATRVLFHNFRIVIVNNAKICHDRIIKRNFKKDSIQSKYKILTEVLNVNNSLFFSYRNGFLNVFGLPKYFYKYYSLSSVISLFLKLLWYYSGLILNFTKILKKRLSYK

SEQ ID NO: 22881 - DNA, 891 bp, Unknown
  Obtained from environmental sample
  misc_feature (1)..(891): n is a, c, g, or t
atgatggaagatatttcttctttaaatattaacacttgtaattacaatcaatcaaaatatttgattggaaaaaattgtgaagaatgtattcaagtaattaaacttaatatttataggaagcttttctatattgataaagcatcaggaaattatgatgaagcatttgaaaatttgataaacctgcaaaaaataattgaagcacttccggataagaatcaatactattacaaaaataaaatagaaacaaatcaaagtttagctttattaaatataaaactaggatataacgaaaaaggattagaaattttaaagaaagcaaataaagatataaatagaataaagattaaaagagataatatatggtatgaaaattttattttgcaaaaagcaaatattttaaactctattggtgatttatatatgaatatatatgaagagaaagagaaaattaatttatcattacttgactctgtaagtatttattataaaaaatcctacgataccgtaaatttattacaagatcaaaatttggataatagagctatttaccaactgagaatgatagacttattcatagagaaaaaagattataatttagctttatttcatattaataggtttgattcagttttcaaaaaaaataattataaaaataacctgttactttataaatctgagatttatagatatcaaaaaaaattcgattcttcaatcgtatcttcaaaaatgtttataaaccatagtgacaaagaaaatctaaacaccaaaaatttaatttctgtttataataatcttactaatagttatttggcgcaaaaaaataatgatagcgcaataaagtattccaacttaacattaacaaaaattaatgaactgaataaaaaagaaatt

SEQ ID NO: 22882 - protein, 297 aa, Unknown
  Obtained from environmental sample
  misc_feature (1)..(297): Xaa is any amino acid
MMEDISSLNINTCNYNQSKYLIGKNCEECIQVIKLNIYRKLFYIDKASGNYDEAFENLINLQKIIEALPDKNQYYYKNKIETNQSLALLNIKLGYNEKGLEILKKANKDINRIKIKRDNIWYENFILQKANILNSIGDLYMNIYEEKEKINLSLLDSVSIYYKKSYDTVNLLQDQNLDNRAIYQLRMIDLFIEKKDYNLALFHINRFDSVFKKNNYKNNLLLYKSEIYRYQKKFDSSIVSSKMFINHSDKENLNTKNLISVYNNLTNSYLAQKNNDSAIKYSNLTLTKINELNKKEI

SEQ ID NO: 22883 - DNA, 612 bp, Unknown
  Obtained from environmental sample
  misc_feature (1)..(612): n is a, c, g, or t
ttgtttaaaaaaatatttaatgtaagtgatactggattttttatttattcttatagttggatagtcagtaaatgggacaaacttactgccgatgaaatacaatttattattgatgttttatcatcagacaggattgatttaaggtggattaaggcaggtgcattagccgtaagttttgaacctcctaaagaggttcaaaaagcaatttttaatgatgaattgtattttagtcaaaatatacctgatttagtaagtaaaatggattcggatttatttttggattcattaaaaatttacacaggtgatgcgcatattattgattggtacggtttaagtcatggcagtgaagtctggaaaaaagtttgtatccatattctagaaaacaatcataaaaatggttttgaaatggccttacgtcatttcttgaatgattttattaatggagcttgggatgaaggatggggaagtatgaaagatttatggaaaaagttgttttataatcacgatgaccaagaattcatagtaaatcttttgatagaggaagtatctgaatgcacttgcagtctagaaaacgtgaaatatgcctttaaaataataattaaatggtantag

SEQ ID NO: 22884 - protein, 203 aa, Unknown
  Obtained from environmental sample
  misc_feature (1)..(203): Xaa is any amino acid
MFKKIFNVSDTGFFIYSYSWIVSKWDKLTADEIQFIIDVLSSDRIDLRWIKAGALAVSFEPPKEVQKAIFNDELYFSQNIPDLVSKMDSDLFLDSLKIYTGDAHIIDWYGLSHGSEVWKKVCIHILENNHKNGFEMALRHFLNDFINGAWDEGWGSMKDLWKKLFYNHDDQEFIVNLLIEEVSECTCSLENVKYAFKIIIKWX

SEQ ID NO: 22885 - DNA, 780 bp, Unknown
  Obtained from environmental sample
  misc_feature (1)..(780): n is a, c, g, or t
atgccaaaggatattcctcaaattgtttttaattctcaaaaaccatataatagcggaattgaaattttatctattgaaaaccttgccaatagaaaagaccaagttgtaagtcatcatccggaaaaagcacaccaaatagcttttaatatgattgtgttatatacttcaggagaaagtaaacaattggtagattttgtatggcacacggttaaaaaaaacactattatacatatatctaaaggtcaaattaatgcctttaagtttactaaaaatcttaaaggttacatcttattgtttactgaagattatcttttaaaacaaattaatgcgttaccaaaaaatgaattaattagattatttaatgcgcatttgttttctccaattattcaagtaccaaaagactctaatgtggttcattatattgaattattatttgaagaatataacagtcagaaagaagattataatcaagaaaacacatataaatccttacattctataattttttcaaaattagaacgcttaaaacaatatcaaacaattcatttaaaacaatctaaacagcttattacttttttagattttaaatctcttttagaccttcattttaaaactagtagaaatgcagatttttacgcagaaaagcttaatattacctacaaacacttaaacactatatgtaaagctacaatagctattactgcaaagcattttatagatcaatttgtggtggtagaagctaaacgatttactataaactctgaaataaaagtacagatt

SEQ ID NO: 22886 - protein, 260 aa, Unknown
  Obtained from environmental sample
  misc_feature (1)..(260): Xaa is any amino acid
MPKDIPQIVFNSQKPYNSGIEILSIENLANRKDQVVSHHPEKAHQIAFNMIVLYTSGESKQLVDFVWHTVKKNTIIHISKGQINAFKFTKNLKGYILLFTEDYLLKQINALPKNELIRLFNAHLFSPIIQVPKDSNVVHYIELLFEEYNSQKEDYNQENTYKSLHSIIFSKLERLKQYQTIHLKQSKQLITFLDFKSLLDLHFKTSRNADFYAEKLNITYKHLNTICKATIAITAKHFIDQFVVVEAKRFTINSEIKVQI

SEQ ID NO: 22887 - DNA, 483 bp, Unknown
  Obtained from environmental sample
  misc_feature (1)..(483): n is a, c, g, or t
gtgagggaaataactggcagcaatgttgagaaaattgtccgaaaggccaatgccccgattattgtggtcaaagaagaggaagtaacatttccctttaaggacattctattcgtatcagattttgaagaagatgtgagtcatccgtttcaagaagtactttcgatagctgaaaaatgtgatgcaaaaattcatttgttacgcataaatacagaaacagactttaacagtatagaagttggattaaaccctgttaaggaattccttgaaaaatttcccgacctaaaaaaattttctatgagtgttcataacgaatcttcagtagaggcaggtattaatacatttttaaaacatcagccatcagatttaattgcgatgagtacccacggaaagacaggatttttgagcttattttcaaaaagtattgccgaaggtgtaaccaatcattcagaacttcctgtaatgaccatacatattaaaaaatga

SEQ ID NO: 22888 - protein, 160 aa, Unknown
  Obtained from environmental sample
  DOMAIN (31)...(157): Universal stress protein family
  misc_feature (1)..(160): Xaa is any amino acid
MREITGSNVEKIVRKANAPIIVVKEEEVTFPFKDILFVSDFEEDVSHPFQEVLSIAEKCDAKIHLLRINTETDFNSIEVGLNPVKEFLEKFPDLKKFSMSVHNESSVEAGINTFLKHQPSDLIAMSTHGKTGFLSLFSKSIAEGVTNHSELPVMTIHIKK

SEQ ID NO: 22889 - DNA, 510 bp, Unknown
  Obtained from environmental sample
  misc_feature (1)..(510): n is a, c, g, or t
ttgatagaaaaactgagttcagattatgaaaaggtaaacagccatttcttggacaaaaatatataccacggaccagcgatggatttcgcaatcaaagaattggtacattccgaactcaccttttttctggatagtgatactgaaacaaaacaatctggatttttggaagagatggaagaactatgtttttctgatgagcaaatttatggtgttggtgagatcactaaatctaataaaagagggtataaggcggagaacggagaacagatattattaactccatatatgctgataagaaatgatatctatcgttctttaaaaccttttattcatcatgggcaaccaacattgcataattttatagatgcaaaagagaaaggatatagcctaaaagaattccatgtatcggaatttataaatcatttatggcgaggtactgccagtaaatttggttacggtctaggagcaagaggaaagatcgattatatacttaataaaataggtatttga

SEQ ID NO: 22890 - protein, 169 aa, Unknown
  Obtained from environmental sample
  misc_feature (1)..(169): Xaa is any amino acid
MIEKLSSDYEKVNSHFLDKNIYHGPAMDFAIKELVHSELTFFLDSDTETKQSGFLEEMEELCFSDEQIYGVGEITKSNKRGYKAENGEQILLTPYMLIRNDIYRSLKPFIHHGQPTLHNFIDAKEKGYSLKEFHVSEFINHLWRGTASKFGYGLGARGKIDYILNKIGI

SEQ ID NO: 22891 - DNA, 696 bp, Unknown
  Obtained from environmental sample
  misc_feature (1)..(696): n is a, c, g, or t
gtgggatacgaatttatgaaatacgtcactcaagaatttgatttaatgcctgtaactacagttgaagaaaatattggtaaacatttatcgcgtttttatcctgaagagaagcaaagacgaacagatgaacttattaaggttgtagaacttgaagcctttgctaaaaccaaagttaaatttttaagtggaggtcaaaaacaacgtgtcgctattgccagagcattagcaaagcaaccagaaattttattgttagatgaaccctttagccatattgataattttaaaaaacaatcgctgaggcgaagcgtttttaaatatctaaaagacaataatattgcctgtgtggttgctacacacgataaaaatgatgtccttggttttgcagaccaactattggtaattcacgattctaaaatcatagaaaaagacactccaaaacgcatttgtaataatccaaaaacacctctaatagcctcgttttttggtgaatttaatgttatagagccttatggtattgtgtatgctcatcagcttcaaattgtggcgcaatctcatctaaaagccacagtaaataaatcttattttaacggtaattcgtggctgattgaagcaaattatagatcagaaactatatttatagaacatcatgatgaattaaaggaagatcaagaaattcattttttaatatctttatag

SEQ ID NO: 22892 - protein, 231 aa, Unknown
  Obtained from environmental sample
  DOMAIN (2)...(137): ABC transporter
  misc_feature (1)..(231): Xaa is any amino acid
MGYEFMKYVTQEFDLMPVTTVEENIGKHLSRFYPEEKQRRTDELIKVVELEAFAKTKVKFLSGGQKQRVAIARALAKQPEILLLDEPFSHIDNFKKQSLRRSVFKYLKDNNIACVVATHDKNDVLGFADQLLVIHDSKIIEKDTPKRICNNPKTPLIASFFGEFNVIEPYGIVYAHQLQIVAQSHLKATVNKSYFNGNSWLIEANYRSETIFIEHHDELKEDQEIHFLISL

SEQ ID NO: 22893 - DNA, 657 bp, Unknown
  Obtained from environmental sample
  misc_feature (1)..(657): n is a, c, g, or t
ttggaagttgacacccactcacatcctgctgtcgaatttataaaagctaaaaagggaacgttttctatagagacctattttggcaagcaaagcaatctgacttttgcaatcattgatgccaatttaaatcataaaatgacttccgaacaaaatgaaatcgaatttttattgattgaatgtaataaccttaagttgaaagaatttttatttacccgagatattaaacttaaaaatggtgttttcacttctacagacttaatgcataccgatgatatcatcgacgatgtactcaatcattcaaccaaacaaaatttaaaaaagaccaatgataaaagggttgataattgtattgagataatagaaaccgagaatttacaatacaaagaactgataactactttatcctcaaaaatattcctctccgaaagtagattgtcacatttgttcaaagaaaatgttggaatctctattaagaaataccatgtttggaataagttaaaatacgcattaaaatttctcttgactgaagaaactaacttaaaagaagcgtcatttgaagccggcttctctgatcaagcacacctaagtaatagttttaaaaattttttaggcacaaatccatccaaagtttttaatagcagtaccttacaactttaa

SEQ ID NO: 22894 - protein, 218 aa, Unknown
  Obtained from environmental sample
  DOMAIN (168)...(212): Bacterial regulatory helix-turn-helix proteins, AraC family
  misc_feature (1)..(218): Xaa is any amino acid
MEVDTHSHPAVEFIKAKKGTFSIETYFGKQSNLTFAIIDANLNHKMTSEQNEIEFLLIECNNLKLKEFLFTRDIKLKNGVFTSTDLMHTDDIIDDVLNHSTKQNLKKTNDKRVDNCIEIIETENLQYKELITTLSSKIFLSESRLSHLFKENVGISIKKYHVWNKLKYALKFLLTEETNLKEASFEAGFSDQAHLSNSFKNFLGTNPSKVFNSSTLQL

SEQ ID NO: 22895 - DNA, 531 bp, Unknown
  Obtained from environmental sample
  misc_feature (1)..(531): n is a, c, g, or t
atgaaagaaatacatattactgctaaggacacggaagatagtattaagcagattcaaaaagtaattggagggactattacaagtcgctggggagagaacgcactaactgtagacaatgccgttgcgaaaggctctattcgttttattatttttgaatggggcggtagctttttatactataatattactttttttgaagacattattttaaaaaaagacacctcactttataacccgatttcttttatttattgtttgaatggccattttaaacaccgtttcgaccacgaagatagttaccagactttagagcaatttcagtcggtgattatgaccagtaaagatggggggtttaataatgagtatttccctaaagacgtaaaactagaagtaaatattattcaaattaatagaattaaatttattagtaaacgattgaatgatgcctctttattaaacaaaaaactttacgaggtcttccacgacacagattacaaaaatgtatttgcttattttgggtcttataattaa

SEQ ID NO: 22896 - protein, 176 aa, Unknown
  Obtained from environmental sample
  misc_feature (1)..(176): Xaa is any amino acid
MKEIHITAKDTEDSIKQIQKVIGGTITSRWGENALTVDNAVAKGSIRFIIFEWGGSFLYYNITFFEDIILKKDTSLYNPISFIYCLNGHFKHRFDHEDSYQTLEQFQSVIMTSKDGGFNNEYFPKDVKLEVNIIQINRIKFISKRLNDASLLNKKLYEVFHDTDYKNVFAYFGSYN

SEQ ID NO: 22897 - DNA, 423 bp, Unknown
  Obtained from environmental sample
  misc_feature (1)..(423): n is a, c, g, or t
ttggtttttataatgaataaagcagaggaaatattaaacatcaaaactgtaaaacctacagcaataagattaattgttttaagacacctattagaacaaaaaaaagcccaatccctaaaagatattgaagataaattaattcatacagatagaagttcaatttttagaacacttaaaacatttttagaaaataaattaattcatagtattgaggatggttctggtatggttaaatatgcagtatgtgctgatgggtgtaactgcgacccaatagacctgcattatcatttttattgttcaaaatgcggcctaacttattgcttgttagaaatacctataccaagtattcagttacctaataattttaaaatgcaacaagccaatatgggtaataaaagactttgtgacaattgtaaccactaa

SEQ ID NO: 22898 - protein, 140 aa, Unknown
  Obtained from environmental sample
  misc_feature (1)..(140): Xaa is any amino acid
MVFIMNKAEEILNIKTVKPTAIRLIVLRHLLEQKKAQSLKDIEDKLIHTDRSSIFRTLKTFLENKLIHSIEDGSGMVKYAVCADGCNCDPIDLHYHFYCSKCGLTYCLLEIPIPSIQLPNNFKMQQANMGNKRLCDNCNH

SEQ ID NO: 22899 - DNA, 639 bp, Unknown
  Obtained from environmental sample
  misc_feature (1)..(639): n is a, c, g, or t
ttgaaaaataatacgatgatgaaactaaaattctgtggtatgaaatacaccaacaacatcactgatgttgcgagcttaaatccccattatttaggtttcattttctatgaaaaatctacgcgtttctttgaaaattcaattcctgaaatttcagaacacatcaaaaaaacaggtgtatttgtaaacgcaacattagcatttattacacaacaagtacaaacttatggtttaaaagcagtacaattacacggtaatgaaactccagaattctgcaaaaatttacgcactttacaggtagaaattattaaagtattttcaataaaagatgactttaatttttcggtattgcaatcttttgaaaccgtttgcgattattatttatttgataccaaaggtaaacttcctggaggaaatggctacacttttaactggaataccttaacaaaatatccatcaacaaaaccttactttttaagcggaggtattggtgtaaacgaaataaaacagctagaagatttccttaaaacagaagcttcaacctactgttatgctattgatgtaaacagtaaatttgaaatagaaccaggcttaaaaaatatacaatcattacaagaatttaccaacacgttttacgactaa

SEQ ID NO: 22900 - protein, 212 aa, Unknown
  Obtained from environmental sample
  DOMAIN (9)...(209): N-(5'phosphoribosyl)anthranilate (PRA) isomerase
  misc_feature (1)..(212): Xaa is any amino acid
MKNNTMMKLKFCGMKYTNNITDVASLNPHYLGFIFYEKSTRFFENSIPEISEHIKKTGVFVNATLAFITQQVQTYGLKAVQLHGNETPEFCKNLRTLQVEIIKVFSIKDDFNFSVLQSFETVCDYYLFDTKGKLPGGNGYTFNWNTLTKYPSTKPYFLSGGIGVNEIKQLEDFLKTEASTYCYAIDVNSKFEIEPGLKNIQSLQEFTNTFYD

SEQ ID NO: 22901 - DNA, 510 bp, Unknown
  Obtained from environmental sample
  misc_feature (1)..(510): n is a, c, g, or t
ttgagtattctcgaaaagaaacgcatttcggttgaacacgaaatttcgttattaaaaaattatttagatatagaaaagcttcgttttgaagacgattttgactttcaattaaatatagataaagcattggatacacaagatttatttttgcctccaatgattttacaacctattgtagaaaacgccattaaccatggtctctttcataaaaaaggaaaaggagaagttgttattgactttgtaagtatcaatgattatagttttaaagttgaaattacagatgacggaataggtattaataagtctaaacttatgaatgccaaaaagaaacaatcgcatacagaacattctagttttgtgttagaagaacgtttggctttattaaaagtaagtaaacattgggatgtcgcgtttacaattgaggatcgtgcagatacatccgataaaacaggaaccaaagtcaccttgatttttaaggaaggcttaaatgaagacgattatgaccattaa

SEQ ID NO: 22902 - protein, 169 aa, Unknown
  Obtained from environmental sample
  misc_feature (1)..(169): Xaa is any amino acid
MSILEKKRISVEHEISLLKNYLDIEKLRFEDDFDFQLNIDKALDTQDLFLPPMILQPIVENAINHGLFHKKGKGEVVIDFVSINDYSFKVEITDDGIGINKSKLMNAKKKQSHTEHSSFVLEERLALLKVSKHWDVAFTIEDRADTSDKTGTKVTLIFKEGLNEDDYDH

SEQ ID NO: 22903 - DNA, 594 bp, Unknown
  Obtained from environmental sample
  misc_feature (1)..(594): n is a, c, g, or t
atgaaaaaactttttacactactaataatgtctcttgttttatcgtcatgtacagatgcaaataatggtttgactaaagcattagctttacaaaatattaaagcttgcgatgcagaaaatccagtggaatttataaaaggaatttatgttggtaaaatgacctatcaaaatgcaggaacaagtctagtagagttaggatacattaaaaaattagcaaaatctgggattgtagtcttggattcattatcctctagcaatcaacaaatgtcagatcatatcaggataaataccgtttataatgtttccattaaaccagaatataaaaagcatattaccaaacagaaggacaatattgcttatgttagattagtctctagagaagtacaagaagtaacatctattacattaaaaaacgatgttagagcagatgtgatggcaacttttaaaaagataaaaacaccattttatgacattcaatttgatcaatcaaccaggttaaaaacaagacaagatgtgtttacagaagtcattggttttaataagtcaaataaagatggttggacaagttgctttttaaaagaaaacaaacagtaa

SEQ ID NO: 22904 - protein, 197 aa, Unknown
  Obtained from environmental sample
  SIGNAL (1)...(20)
  misc_feature (1)..(197): Xaa is any amino acid
MKKLFTLLIMSLVLSSCTDANNGLTKALALQNIKACDAENPVEFIKGIYVGKMTYQNAGTSLVELGYIKKLAKSGIVVLDSLSSSNQQMSDHIRINTVYNVSIKPEYKKHITKQKDNIAYVRLVSREVQEVTSITLKNDVRADVMATFKKIKTPFYDIQFDQSTRLKTRQDVFTEVIGFNKSNKDGWTSCFLKENKQ

SEQ ID NO: 22905 - DNA, 393 bp, Unknown
  Obtained from environmental sample
  misc_feature (1)..(393): n is a, c, g, or t
atgattcaaatgaaaaattatacaggtgaaggtgcttatattgttatttcattattaaatcctaaaggtgagtatgcagaaactttgtatgttcaaggtgatgatgatgagtggtattttgatattacagaatggtggaattttcaaggaaaaaaacgtgctaatatagatgcaattacaggtgcaactattagtggtggagaacgttctataagcgttattcaaattccagaagataaagtaaaccaaggttataaagttcgttttgaaacagctgtagaagatcaaggttatcataaagatgatgttgaatttgagctaacatcagaaaacttaaaatctaaaattgaaggtaaaggatttattcgttacataagaatgatacctcaataa

SEQ ID NO: 22906 - protein, 130 aa, Unknown
  Obtained from environmental sample
  misc_feature (1)..(130): Xaa is any amino acid
MIQMKNYTGEGAYIVISLLNPKGEYAETLYVQGDDDEWYFDITEWWNFQGKKRANIDAITGATISGGERSISVIQIPEDKVNQGYKVRFETAVEDQGYHKDDVEFELTSENLKSKIEGKGFIRYIRMIPQ

SEQ ID NO: 22907 - DNA, 705 bp, Unknown
  Obtained from environmental sample
  misc_feature (1)..(705): n is a, c, g, or t
ttgcaaattcatgaaaattttattcctacacttcctgtttttaaaattgataaccaatcttttgattcttttaaaatttggcttaaacaatggaatttcaacaatcagttagtcttaaatattcatcaggaagatattgtaaagtcatctaaagaagatattaattttaaggttctagaaaaaacaaatctaaatattgatgatacttttttacttaaaataaagcccactaaaaaagtaaaatttgtttctggagatttactttccatcaacctaaaagatgatcatagaaaccgattatattctgttgcaaaagttgataaaactattttattaagcattaaaaaacacgagtttggagtttgctcaacgtatttaaatgatcttaatttaaaagaaaaattaagtgcgcatattcaggaaaacaaacaatttcattttcctaaaaaagcaagtgaaggtattttaattgcaaacggaacaggagttgcgccttttttaggaatgattcaaaaaaataagaaaaagaagattcatttattttggggaggaaaaacaaaagaatctttaaatatttacaatgagtttatcagcaaggctttaaaaaacaaatcgcttgcatcttttaaatctgttttttctcaagaacagcaagagaaaatatattacagatatctcagccatctgatcttggcnnnnntttaa

SEQ ID NO: 22908 - protein, 234 aa, Unknown
  Obtained from environmental sample
  misc_feature (1)..(234): Xaa is any amino acid
MQIHENFIPTLPVFKIDNQSFDSFKIWLKQWNFNNQLVLNIHQEDIVKSSKEDINFKVLEKTNLNIDDTFLLKIKPTKKVKFVSGDLLSINLKDDHRNRLYSVAKVDKTILLSIKKHEFGVCSTYLNDLNLKEKLSAHIQENKQFHFPKKASEGILIANGTGVAPFLGMIQKNKKKKIHLFWGGKTKESLNIYNEFISKALKNKSLASFKSVFSQEQQEKIYYRYLSHLILAXX

SEQ ID NO: 22909 - DNA, 690 bp, Unknown
  Obtained from environmental sample
  misc_feature (1)..(690): n is a, c, g, or t
ttgctggaattgataattataagggcagcatactttcagcacaacggagaagatttttatgcattggaattcgaaacagatacagttaaaggggttaaagattattttaccgaagacgcaaaaaacttaagacgtgcctttttaaaagcacctgttgagtataaacgtatttcttccagatataatttaaaccgtagaattgctttgtatggtaatcgcgtaagaccacacaaagggacggattttgcagctaatattggtacaccaattagagcaaccgcaaatgggactgtaattgaatctgcaaaacgtggcggaaatggtaactatgtaaaaattaaacacaactcaacctacagcacgcaatacttgcacatgagtaagcgtaaagctaaagtaggcgattttgttaaacaaggagatgttattggttatgtaggtatgacaggtaatacatctggaccacatgtctgttatcgtttttggaaaaacggaaaacaagtagatccatttaaacaaaaattaccagaagccgaagcgatttcggatagcttaaaagctaaatatttaaaatttgtaaaaccacttaaaacacaattagatgggattgaatttatccttccaattgacgaaaatcaaattttagatatccaagaaacgtctaaaaactcaataacttatactaagtaa

SEQ ID NO: 22910 - protein, 229 aa, Unknown
  Obtained from environmental sample
  DOMAIN (75)...(170): Peptidase family M23
  misc_feature (1)..(229): Xaa is any amino acid
MLELIIIRAAYFQHNGEDFYALEFETDTVKGVKDYFTEDAKNLRRAFLKAPVEYKRISSRYNLNRRIALYGNRVRPHKGTDFAANIGTPIRATANGTVIESAKRGGNGNYVKIKHNSTYSTQYLHMSKRKAKVGDFVKQGDVIGYVGMTGNTSGPHVCYRFWKNGKQVDPFKQKLPEAEAISDSLKAKYLKFVKPLKTQLDGIEFILPIDENQILDIQETSKNSITYTK

SEQ ID NO: 22911 - DNA, 501 bp, Unknown
  Obtained from environmental sample
  misc_feature (1)..(501): n is a, c, g, or t
atgaacgattttggtgctaatcttggttttattgtttctaaagtagggtttcaatcaggaagttatgaagctgttgaaaaaactaacatcaaactggttactttagaagaacttgaaatggtttactatcgaaaatggttaaaatcaatgccagaaaaatatatggaattagctgataagttgtttccatattgggatcctactggaggaaaaatgccgacaaatagagaaaaatttaattgggaaaacaacagattagttcatgacgcatacaagccaatttgctcaataggcccttgggatcttgaaggaaaaaactatatggaacgtaaatttcctatgacaattccaattattgatgatgaattaaatcaaataggtacggaggaaataactacgtacaggcaatactttaatattgtagaaagagataaggaaaaagctttaaagcattttaaaattttatatggagaaaataactctacacaacactatatttag

SEQ ID NO: 22912 - protein, 166 aa, Unknown
  Obtained from environmental sample
  misc_feature (1)..(166): Xaa is any amino acid
MNDFGANLGFIVSKVGFQSGSYEAVEKTNIKLVTLEELEMVYYRKWLKSMPEKYMELADKLFPYWDPTGGKMPTNREKFNWENNRLVHDAYKPICSIGPWDLEGKNYMERKFPMTIPIIDDELNQIGTEEITTYRQYFNIVERDKEKALKHFKILYGENNSTQHYI

SEQ ID NO: 22913 - DNA, 453 bp, Unknown
  Obtained from environmental sample
  misc_feature (1)..(453): n is a, c, g, or t
atgaactcgaagcaaacaccgaatacatttcagtttccaaaggaagtacagaagaaatttcatcaattgatgaacagcagagaaagctttttgaagaatctgtcgtctgccgaacagcaaaaattaatgaactcgtacgcagtattaataaatgtttacaatcagaatcgcacaaacgaactgaacaactctttgagtcagagttatcaagagttgcgaaaaatagagaaagagaaaaacaaagattgggaaatttggaagaatcaaatagtagaaaggcacttgaaagaaatagatttgaagaagaaactattaattcaaaactcgaaaaagagaacagaaaatactcagatttggaaagtagatatagaaaccaagatagagagcttggaacatcttttgaagcccactacaacaatcaagggattagaaatacagttgaataccgattaa

SEQ ID NO: 22914 - protein, 150 aa, Unknown
  Obtained from environmental sample
  misc_feature (1)..(150): Xaa is any amino acid
MNSKQTPNTFQFPKEVQKKFHQLMNSRESFLKNLSSAEQQKLMNSYAVLINVYNQNRTNELNNSLSQSYQELRKIEKEKNKDWEIWKNQIVERHLKEIDLKKKLLIQNSKKRTENTQIWKVDIETKIESLEHLLKPTTTIKGLEIQLNTD

SEQ ID NO: 22915 - DNA, 720 bp, Unknown
  Obtained from environmental sample
  misc_feature (1)..(720): n is a, c, g, or t
ttgaaaaccaataaagacataagtgtaaaacaagccattaccaaagggcaaatcatggtcaacgttcccgtgtttttatgcttaattggcacacctttatttactttattcctagcaaaacaaggtgtgtttccagagtgggtagcagtaattggtatgtttataggttttgtttttgcttggataacgtggagtgttttaataacaaaatggcgcatttgggcatttaccaatgttagaaatgtacacgcattaaaaaaagaagccatacgcagcatgcttatttgggaagacggaacctcttttgaaaaaacagaatatcgatccaaaaaagacaaaataattctagatacacttgataaaaaatttattcagaaagacttggtctatgaagatccaaaagtacctcaagaaacaaaaatttacttttcaattactaccgctttttttattgttttatttttatcaataggtgtaacctctggagcttatttgatgtttgaagaaaagaacaaagatttcctgataggcttatttatgtttataatctgcttatttattttaacacaagcttttaaaaaattaataaatagagaacctcaattaattttaaaccataaaggaattacattatctgacaacacttttgtaagttggtctgagatatacgaattagaaataataagagaaggtttggaaactcgccctcgagccatctga

SEQ ID NO: 22916 - protein, 239 aa, Unknown
  Obtained from environmental sample
  misc_feature (1)..(239): Xaa is any amino acid
MKTNKDISVKQAITKGQIMVNVPVFLCLIGTPLFTLFLAKQGVFPEWVAVIGMFIGFVFAWITWSVLITKWRIWAFTNVRNVHALKKEAIRSMLIWEDGTSFEKTEYRSKKDKIILDTLDKKFIQKDLVYEDPKVPQETKIYFSITTAFFIVLFLSIGVTSGAYLMFEEKNKDFLIGLFMFIICLFILTQAFKKLINREPQLILNHKGITLSDNTFVSWSEIYELEIIREGLETRPRAI

SEQ ID NO: 22917 - DNA, 807 bp, Unknown
  Obtained from environmental sample
  misc_feature (1)..(807): n is a, c, g, or t
atgtataatttatatttaatgacactatccctaatgatagaggtcagtaaaaaatctaaaacgcagttagaaactattcaaaaaaagcatttagctacagcagaagaaaaaaatcccaacaaaaaatttataaacaatcaggttctagaactactgtctaataacgtagctttaaaaacagcttttgaagtcaacaatataaaaaattggcaactagataatgagtatgtagatattatctataaagaaataattgctagtgatttatataaagaatacatgcaaactaaatcgtctacctttaaggaagatagaaactttatagtagatgtatttaaagaaataatagctcctaacgagaaactttacgattatattgaagataaaaaccttacttggttagatgatcttccaacagtaaatacagctattttaaaattacttagaaaaattaaagaaacatcagacgagcgtttccttacccctaagttatacaaagatatcgaggataaacaatacgcaattaacttgtttaaaaaaacaatgttaaaccaatccaaattaagcgaagaaatagctaataaaactaaaaattgggatacagaacgtatcgcaactatagacatggttttattaaaaatggctatttgcgagttaactagttttccatcaattccgactaaagtaacaattaatgaatacctagaaattgctaaagaatactcaacgcctaanagcagtatttttattaacggaattcttgacaaattgttaaaagaatatccagaaggaggggaaattaaataa

SEQ ID NO: 22918 - protein, 268 aa, Unknown
  Obtained from environmental sample
  DOMAIN (138)...(261): NusB family
  misc_feature (1)..(268): Xaa is any amino acid
MYNLYLMTLSLMIEVSKKSKTQLETIQKKHLATAEEKNPNKKFINNQVLELLSNNVALKTAFEVNNIKNWQLDNEYVDIIYKEIIASDLYKEYMQTKSSTFKEDRNFIVDVFKEIIAPNEKLYDYIEDKNLTWLDDLPTVNTAILKLLRKIKETSDERFLTPKLYKDIEDKQYAINLFKKTMLNQSKLSEEIANKTKNWDTERIATIDMVLLKMAICELTSFPSIPTKVTINEYLEIAKEYSTPXSSIFINGILDKLLKEYPEGGEIK

SEQ ID NO: 22919 - DNA, 471 bp, Unknown
  Obtained from environmental sample
  misc_feature (1)..(471): n is a, c, g, or t
atgattgaaggaaaaaatgtgattggtttaggtgcttttaaacatcattattgcttatggttttttaatggcagcttattgactgacaaacaaaatatattacataatgcgcaagaaggaaaaactaaagctttgcgacaactacgttttaatgatacaagtgatttatccgaaacgttactaatgtcttacatagaggaagctataataaatcaaaaaaatggtaagaacattaaacctattaaaactacagtaaaagatattgtgatacctgatgaattacaaagtgtttttaaagaagataacatacttttaaaggcgtttaaagctttaacaccatctaaacagcgtgaatactgtaactatataagtgaagccaaaagagagactacaaaactatctagaatagataaaataacacctatgattattgaaaataagggtttacatgataagtataaaaattgctaa

SEQ ID NO: 22920 - protein, 156 aa, Unknown
  Obtained from environmental sample
  misc_feature (1)..(156): Xaa is any amino acid
MIEGKNVIGLGAFKHHYCLWFFNGSLLTDKQNILHNAQEGKTKALRQLRFNDTSDLSETLLMSYIEEAIINQKNGKNIKPIKTTVKDIVIPDELQSVFKEDNILLKAFKALTPSKQREYCNYISEAKRETTKLSRIDKITPMIIENKGLHDKYKNC

SEQ ID NO: 22921 - DNA, 957 bp, Unknown
  Obtained from environmental sample
  misc_feature (1)..(957): n is a, c, g, or t
atgatggctcggatgacatttaagtttgatcacttaaattttgatactccaaaagtaacttattaccacaacccattggctgatacagatcaaggcanngtgcgtctggtttttaaaaacataaaaaaaacaatttacattaaaaatcttagcgttaataaggcttcagttgaggtttttaatgtcaaaaatgattccgttttattaagcacaaacaatcttgattttacaatgtcacagattattgttgataataatttagcgtcttcaaagcttttcgattttaaatctagcacattaagcactaataatttaaaatatcagataagcagatttgaaaacttaagtgttgataaattaaaaatagataatactagaatgactttatctggatttagtttaaaaacaaaatatgataaggtggcattatcagacgtgatcaccacagagcgtgatcactttgaattagcaactccagaaatacgtattgataattatgattttaagtttgataataccatattatcgagatttagcacagataaaattacctttacaaaacctgatttgacaatttacagagataagttagttgcggacgacttaacacaaaaagacctatatagtacaatgttaaggtcgcttaatgttaaattagatattaaacatataaatattgtggaaggtaaaattgtttaccaagaaaaagttaatcaagataaaacagcaggtcagctttcttttagtgactttaatgcaagcttagaccacataagtaacactaaattaaatcctaaaaaaacagaaattaaaatagattgtaactttatgcaaagcacaccacttagggtggattggtcgtttgatgttaatgatcctaatgatggctttgtttttaaagcaaatttaggagacttacaagcagaccatttaaaccattttatgcaacctaattta

SEQ ID NO: 22922 - protein, 319 aa, Unknown
  Obtained from environmental sample
  misc_feature (1)..(319): Xaa is any amino acid
MMARMTFKFDHLNFDTPKVTYYHNPLADTDQGXVRLVFKNIKKTIYIKNLSVNKASVEVFNVKNDSVLLSTNNLDFTMSQIIVDNNLASSKLFDFKSSTLSTNNLKYQISRFENLSVDKLKIDNTRMTLSGFSLKTKYDKVALSDVITTERDHFELATPEIRIDNYDFKFDNTILSRFSTDKITFTKPDLTIYRDKLVADDLTQKDLYSTMLRSLNVKLDIKHINIVEGKIVYQEKVNQDKTAGQLSFSDFNASLDHISNTKLNPKKTEIKIDCNFMQSTPLRVDWSFDVNDPNDGFVFKANLGDLQADHLNHFMQPNL

SEQ ID NO: 22923 - DNA, 540 bp, Unknown
  Obtained from environmental sample
  misc_feature (1)..(540): n is a, c, g, or t
atggaagaaaatctaaaacgtatcaataaatttttaagtgaagttgggtattgctcacgtcgtgaagcggacagactcattgaggcaggacgtgttaccattaacgggaaagttcctgaaatgggtacgaaaatttcagaaaatgacgttgttcacgttgatggtaaagctataaaagacaccaaagaaggatttgtctatttagcatttaacaaacctataggcattgtttgtacaacagatactcgagttgaaaaggacaatattattgattacataaaatatccaaaacgcatcttccctattggccgtttagacaaacccagtgagggcttaattttaatgactgatgatggcgatattgtcaataaaattctaagagccagcaataaccacgaaaaggaatatattgtaacggttgataaaccgatctcccaaacgtttattgagcgcatgtctaatggggtacctattttggatacggtgagcaaaaagtgtaaagttgagaaattgagcacttatgaattcagaattatttga

SEQ ID NO: 22924 - protein, 179 aa, Unknown
  Obtained from environmental sample
  DOMAIN (66)...(179): RNA pseudouridylate synthase
  misc_feature (1)..(179): Xaa is any amino acid
MEENLKRINKFLSEVGYCSRREADRLIEAGRVTINGKVPEMGTKISENDVVHVDGKAIKDTKEGFVYLAFNKPIGIVCTTDTRVEKDNIIDYIKYPKRIFPIGRLDKPSEGLILMTDDGDIVNKILRASNNHEKEYIVTVDKPISQTFIERMSNGVPILDTVSKKCKVEKLSTYEFRII

SEQ ID NO: 22925 - DNA, 810 bp, Unknown
  Obtained from environmental sample
  misc_feature (1)..(810): n is a, c, g, or t
gtgaatatgaaactggtgtcaaaggcactgaaagatgaagataattatgatctgcttatttcaattgcggtacctcatactatacattggggagttgctaaagcacgaaaaatcaatccccatttaactaaaatatgggtagcagactgtggcgatccttatctcaaagtacaaagcgatacctttcaaaaaatgccatattttaagtatgtagaactgtggtggggaaaaaaagcagattttttaagtgtacctatacaggatgccataaaagcatatcatcccgcaattagatctaaaataaaaattatcccgcaaggatttaaattttctgatttaaagcccataaaaatacataaaaataagataccaacttttgcctatggagggggctttatacctaataaaagagatccaagaaattttttggaatacctgattgagctcgatcaggattatttattttatatttttacatctagcaaggaaatggtgcgttcctatgcagaaagatccaataataaaataattgtaaaagacccgattccaagaaatgaatttcttggatttttaagttcaatggattttgtgataaattttgaaaattcaggcacccagcaactcccaagtaaattaattgattatgcaattattgccaagcctatactctccctggatggtagcaacatcgaccaagaaaaagtaggcgagtttctggaaggaaattatgataggagtttaaaaattgctgatatagaacaatatagaattgaaaatgtggtaaatgaatttttaatattgcagaattag

SEQ ID NO: 22926 - protein, 269 aa, Unknown
  Obtained from environmental sample
  misc_feature (1)..(269): Xaa is any amino acid
MNMKLVSKALKDEDNYDLLISIAVPHTIHWGVAKARKINPHLTKIWVADCGDPYLKVQSDTFQKMPYFKYVELWWGKKADFLSVPIQDAIKAYHPAIRSKIKIIPQGFKFSDLKPIKIHKNKIPTFAYGGGFIPNKRDPRNFLEYLIELDQDYLFYIFTSSKEMVRSYAERSNNKIIVKDPIPRNEFLGFLSSMDFVINFENSGTQQLPSKLIDYAIIAKPILSLDGSNIDQEKVGEFLEGNYDRSLKIADIEQYRIENVVNEFLILQN

SEQ ID NO: 22927 - DNA, 510 bp, Unknown
  Obtained from environmental sample
  misc_feature (1)..(510): n is a, c, g, or t
gtgaatatattaagaaagtttaaatataatttatcgcatatacctggttggcatataaatcggaaaattgttattattgaatctgatgattgggggagtattagaatgccttcaaaaaaaatatttactaaactacaaaaggaagggtttcaacccgaaaaagatccctatttgcgatatgatagtttagccagtgaagatgatttacaagctttatttgatgtgttaacctctgtaaaagataaaaagggggcttatgccaaaattacagctaattgtgttgttgccaaccctgattttaaaagaatagaagcatcaaattttaaggagtatcattacgagtcttttgttgaaacattaaaaaaatatccaaaacatggtaattcttttaagttgtggcaagaggggatgagtaatgatatatttcaccctcaatttcatggcagggagcatttaaacgtttataattggctatttgatcttcaaaacggtgatanaaaatttgcataa

SEQ ID NO: 22928 - protein, 169 aa, Unknown
  Obtained from environmental sample
  misc_feature (1)..(169): Xaa is any amino acid
MNILRKFKYNLSHIPGWHINRKIVIIESDDWGSIRMPSKKIFTKLQKEGFQPEKDPYLRYDSLASEDDLQALFDVLTSVKDKKGAYAKITANCVVANPDFKRIEASNFKEYHYESFVETLKKYPKHGNSFKLWQEGMSNDIFHPQFHGREHLNVYNWLFDLQNGDXKFA

SEQ ID NO: 22929 - DNA, 495 bp, Unknown
  Obtained from environmental sample
  misc_feature (1)..(495): n is a, c, g, or t
atgggtggaattattttaaaaaaaatgaatatgaaaaacaatttaatatttacgtctataaatcaaacaaaaagagttttcgtaattattttaattagctgttttatacagatatcctgtcaagatgcgaataacaagaaagtagaaccagaaaaattagaatctaaagaaatggaaaagcagagtgaagccctattaagacatctagtcatttttaaatttaatgatgatgcgagtgaagcagatgttcaaaaattaaatgatagttttaatgcattgccagatcacatttcagcgataaaagattttgaatggggtttaaatgatagtcctgaaaattttcaccaagatttcactcattgttatttaataacctttaattcagaaaaagatagagatagtatttataccccacatccaaaacatcaagagttcgtagcgagtttgcaaccttttgtagaaaaagtattcgttgtagactactgggcaaaataa

SEQ ID NO: 22930 - protein, 164 aa, Unknown
  Obtained from environmental sample
  misc_feature (1)..(164): Xaa is any amino acid
MGGIILKKMNMKNNLIFTSINQTKRVFVIILISCFIQISCQDANNKKVEPEKLESKEMEKQSEALLRHLVIFKFNDDASEADVQKLNDSFNALPDHISAIKDFEWGLNDSPENFHQDFTHCYLITFNSEKDRDSIYTPHPKHQEFVASLQPFVEKVFVVDYWAK

SEQ ID NO: 22931 - DNA, 447 bp, Unknown
  Obtained from environmental sample
  misc_feature (1)..(447): n is a, c, g, or t
ttgcgtgcaattggttcaaacgacctacatgtaaacgccaagatcaaagtgcgtgttactgagacgcaaattgacgaagaaggtaacgagactaaagaaatcattatcaaagatacggttgctggtcgtctacttatctggaacatcatgcctaaaggtatgacgtttgatgagtgtaaccaggagatgacgaagaaaaacatctctcgtttgatcaactcttgctaccgtaaagttggcgtaaaagaaagtgttatgtttgctgaccaattgatgtatcttggttttgctcaagcaacattatctggcgtgtctatcggtatcgacgacatggtcattccaccacttaaaaagcaaatcatcgaagtggcagaaggcgaagttcgcgaaatcgaagatcagttcgagcaaggtttcgtaactgctggtgagcgctataacaaataa

SEQ ID NO: 22932 - protein, 148 aa, Unknown
  Obtained from environmental sample
  DOMAIN (1)...(111): RNA polymerase Rpb1, domain 3
  misc_feature (1)..(148): Xaa is any amino acid
MRAIGSNDLHVNAKIKVRVTETQIDEEGNETKEIIIKDTVAGRLLIWNIMPKGMTFDECNQEMTKKNISRLINSCYRKVGVKESVMFADQLMYLGFAQATLSGVSIGIDDMVIPPLKKQIIEVAEGEVREIEDQFEQGFVTAGERYNK

SEQ ID NO: 22933 - DNA, 549 bp, Unknown
  Obtained from environmental sample
  misc_feature (1)..(549): n is a, c, g, or t
ttgatgaaaaaaaatattgccataattatgggcggctattcgtctgaagttaacatttctttaaaaagcggaaatgttgtgtttaaccatttagataaagagaaatacactccttttagagtgcatattttaaaagaaaaatgggtggttttagatgatgaaaacacagaatatcaaattgataaaaatgatttttcttttgttttaggtaatcaaaaaatcacttttgattgtgtttttaatgcaattcacggaaatcctggcgaaaatggaatgattttaagctatttggagttgctaaatattccacatacttctgcgcctttttatcaaatggcattaacatttaataaaagagataccttaagtgttgtaaaagaatatggcattaaaacagcaatttctgtgtatttaaacaaaggagatgttattaatgctgatgaaattattgccaaagttggtttgccatgttttataaaaccaaacaatgcaggttctagttacggaatctctaaagcttataacaaagaagaggtttacaaggaatga

SEQ ID NO: 22934 - protein, 182 aa, Unknown
  Obtained from environmental sample
  DOMAIN (4)...(116): D-ala D-ala ligase N-terminus
  misc_feature (1)..(182): Xaa is any amino acid
MMKKNIAIIMGGYSSEVNISLKSGNVVFNHLDKEKYTPFRVHILKEKWVVLDDENTEYQIDKNDFSFVLGNQKITFDCVFNAIHGNPGENGMILSYLELLNIPHTSAPFYQMALTFNKRDTLSVVKEYGIKTAISVYLNKGDVINADEIIAKVGLPCFIKPNNAGSSYGISKAYNKEEVYKE

SEQ ID NO: 22935 - DNA, 612 bp, Unknown
  Obtained from environmental sample
  misc_feature (1)..(612): n is a, c, g, or t
atgaaaaaacatttttttaaacttacgttttttgttgtatcaattttgatgatttcgtgtactaataatgatgacgaaatggaaataaatgattttaaaggtttctataaaattaagtcaatttcgagcagtatagagattgatttgaataatgatgggttgaaatctaatgattatctgcaagaaattaaatcaaactatatttcttacaatggagaaattataaactatagatataacaacgaattaagaccaaactttgctgaagcgaggccaacaaaataccaatctaataatgctcaatttctagacattcgatttccaattcaacgaatagactcaatttaccaaggaaatgatgattttgttaaaatgaatatggaatatcaaaaaatgtacacagggtttatttataagctaacaaataataacattgaaatagaatctgacccgtttaaccaatttaagttttacgaaatcaataattttgaaataagtagaagaaacaaaactgaatttgaagtaattttcgattttaaagtttatgactttacagaaaataaatggactgaaactaaccttaaagcaaagtataaaaaagtagaagaataa

SEQ ID NO: 22936 - protein, 203 aa, Unknown
  Obtained from environmental sample
  misc_feature (1)..(203): Xaa is any amino acid
MKKHFFKLTFFVVSILMISCTNNDDEMEINDFKGFYKIKSISSSIEIDLNNDGLKSNDYLQEIKSNYISYNGEIINYRYNNELRPNFAEARPTKYQSNNAQFLDIRFPIQRIDSIYQGNDDFVKMNMEYQKMYTGFIYKLTNNNIEIESDPFNQFKFYEINNFEISRRNKTEFEVIFDFKVYDFTENKWTETNLKAKYKKVEE

SEQ ID NO: 22937 - DNA, 825 bp, Unknown
  Obtained from environmental sample
  misc_feature (1)..(825): n is a, c, g, or t
atggctgagtttctatcggaattttttatgtacttttacgctgcacgccaaccgatcttagatcgcgataaaaagcttattggctatgaattactatttcgtgatggtgtaaataacgtgtttcccgatatagatggagatgaggcaacaacacgcctaatagaaggcagccagtttaattttggccttgaggatttaactgacaataaaccagcatatatcaattttactctagaaactttactaaaaggctaccctactttactgagtaaagacgctgtggtggtagagatactcgaaacggtgcaacctggtaagcgtttacttgctattgttaaagacttaaaagaaaaaggttatacattagccttagacgactacattcatcaacctgtgtggcgccacttttatccatttattgatattataaaaattgactttttaacctgtaatatagaaacaattaaaacaattattgatgatttaaaaccttatccacatctaaaattacttgctgaaaaagttgaaacccatgaggtgtataaccaagcattggaacttggctttgattattttcaagggtttttcttttcaaaaccagagatgatccaaagtaaagcgcttcccccctctggtatgacattagccgaactactttatgagacctcaacgcttgatatggatctaaaaaagatcaccgatatatttgagcgagatgtaaatctatcttataagttactgcgttattcaaactctgcagcatttgctagacgtgcaaaaataagcacaataaaacaagcgcttatcacccttggtgcccaatga

SEQ ID NO: 22938 - protein, 274 aa, Unknown
  Obtained from environmental sample
  DOMAIN (1)...(200): EAL domain
  misc_feature (1)..(274): Xaa is any amino acid
MAEFLSEFFMYFYAARQPILDRDKKLIGYELLFRDGVNNVFPDIDGDEATTRLIEGSQFNFGLEDLTDNKPAYINFTLETLLKGYPTLLSKDAVVVEILETVQPGKRLLAIVKDLKEKGYTLALDDYIHQPVWRHFYPFIDIIKIDFLTCNIETIKTIIDDLKPYPHLKLLAEKVETHEVYNQALELGFDYFQGFFFSKPEMIQSKALPPSGMTLAELLYETSTLDMDLKKITDIFERDVNLSYKLLRYSNSAAFARRAKISTIKQALITLGAQ

SEQ ID NO: 22939 - DNA, 525 bp, Unknown
  Obtained from environmental sample
  misc_feature (1)..(525): n is a, c, g, or t
ttgggaataaagaaaacttttgaaaagattgaggctgctcaggttgttatctatctttttgatgctgaaaaatttcaggtttcaggctccaagtttcaggttgaaattgaaactataaaaaataagtatcccttaaaaaatcttgtaattgtagccaataaggttgataaactttcagaagaagaaatcaaaaatctgcaatctgcaatcagcaatcttcaattattatcagccaaaaccaatcagggcgtggaagaacttcaaaataaattactcgaattcgtaaataccggtgcgctccgaaacaatgaaaccatcgttaccaacagccgccattatgatgcgatgctgaaagctttggaggaaacaatcaaagtacaggaaggtattgacaacaatcttagcggcgatttgttggctattgatatccgtcaagcactgtattattttggtgaaattactggtgaaatatccaacgacgaattgctgggtaacatttttgctaatttctgtatcggaaagtaa

SEQ ID NO: 22940 - protein, 174 aa, Unknown
  Obtained from environmental sample
  misc_feature (1)..(174): Xaa is any amino acid
MGIKKTFEKIEAAQVVIYLFDAEKFQVSGSKFQVEIETIKNKYPLKNLVIVANKVDKLSEEEIKNLQSAISNLQLLSAKTNQGVEELQNKLLEFVNTGALRNNETIVTNSRHYDAMLKALEETIKVQEGIDNNLSGDLLAIDIRQALYYFGEITGEISNDELLGNIFANFCIGK

SEQ ID NO: 22941 - DNA, 528 bp, Unknown
  Obtained from environmental sample
  misc_feature (1)..(528): n is a, c, g, or t
gtggtggccatagaccatgcagaggaggaaagggtattggaattttccccctttaaggaaaccaaatggggcaaaggggatggcaaaaagtatcttaagttcttggtggaaaccctaaaaccccatatcgataaaaattttaggaccataaaagaaagggaacatacgggagttggagggagctctatgggggggcttataagtatttatgccggtttaaggtatccttcagtgtttggaaaattgatgattttttctccttcgctctggataacccctaagatttatttcgatgctatcgcatttcatcaaccttatcctacagatatctatttatatgccggcggggccgaaagtgtaaatatggtggggaatgtgaaaagattgaaacaagttcttgaggataagaacaaagacgacgccatggtgaacattgaattacatattgatccccagggaaaacatgaggaatggttttggagtcaagaattcccggcagcaatggaatttctttattttaggaattaa

SEQ ID NO: 22942 - protein, 175 aa, Unknown
  Obtained from environmental sample
  misc_feature (1)..(175): Xaa is any amino acid
MVAIDHAEEERVLEFSPFKETKWGKGDGKKYLKFLVETLKPHIDKNFRTIKEREHTGVGGSSMGGLISIYAGLRYPSVFGKLMIFSPSLWITPKIYFDAIAFHQPYPTDIYLYAGGAESVNMVGNVKRLKQVLEDKNKDDAMVNIELHIDPQGKHEEWFWSQEFPAAMEFLYFRN

SEQ ID NO: 22943 - DNA, 444 bp, Unknown
  Obtained from environmental sample
  misc_feature (1)..(444): n is a, c, g, or t
atgatcgatttaaacgacaatataaatttacctttttcgttacaaataagttttaataaacttattgagcgctataatgacttggctaaaagtgaagattcctttatcgcagccaaagcaaatcgcatattagaaataggacaggctaatcctgtattaaaagagggatttagtaagatttctgtattgaaaaaatatgagaaagaaatcgcaatattattggaagattcgtttagcgaggttttaagtctaaatgaaattaaaacagcaagtgtaccctatcataattttatttttaatgcttcaaaacgttttgaaaatataataaaatcagctggtcccgattttgaattggtaattaaaaatatgccagaaaatgattggtatattcttagttgtacaattataatgagtttttgttataactatgacactaatttttaa

SEQ ID NO: 22944 - protein, 147 aa, Unknown
  Obtained from environmental sample
  misc_feature (1)..(147): Xaa is any amino acid
MIDLNDNINLPFSLQISFNKLIERYNDLAKSEDSFIAAKANRILEIGQANPVLKEGFSKISVLKKYEKEIAILLEDSFSEVLSLNEIKTASVPYHNFIFNASKRFENIIKSAGPDFELVIKNMPENDWYILSCTIIMSFCYNYDTNF

SEQ ID NO: 22945 - DNA, 561 bp, Unknown
  Obtained from environmental sample
  misc_feature (1)..(561): n is a, c, g, or t
atgcttgataaaaagaaaaataaaggcaatccaaagccatatttaagaaatcaaaatgttcagtggtttaatataaatacagatgatcttcttgaaatgcgttttgaggatagtgagtatgaaagatatgctattaaaaaaggagacttggtaatttgtgagggtggttatccagggcgtggagctatttgggagcaagatgaagatatctttttccaaaaagccttgcatagaatacgttgtcataatccactctataatcgctgggttttatactatttatatctgagcgattgtaatggcactctaaaaaacagttttactggggctggtatccaacattttacagggaagtctctaaagcaattagccttgccgattccaccggttgaattaaccgagaagtttgtgcgcaattttgatgagttatttaatcacgtaataagcttggaacatgtatatcataataaattgaactcgatagacgaactcaaaaaatccatcttacaaaaagccttttccggcgagttgaccaaagaaaaagaaggagcggtggcctaa

SEQ ID NO: 22946 - protein, 186 aa, Unknown
  Obtained from environmental sample
  DOMAIN (1)...(145): Type I restriction modification DNA specificity domain
  misc_feature (1)..(186): Xaa is any amino acid
MLDKKKNKGNPKPYLRNQNVQWFNINTDDLLEMRFEDSEYERYAIKKGDLVICEGGYPGRGAIWEQDEDIFFQKALHRIRCHNPLYNRWVLYYLYLSDCNGTLKNSFTGAGIQHFTGKSLKQLALPIPPVELTEKFVRNFDELFNHVISLEHVYHNKLNSIDELKKSILQKAFSGELTKEKEGAVA

SEQ ID NO: 22947 - DNA, 675 bp, Unknown
  Obtained from environmental sample
  misc_feature (1)..(675): n is a, c, g, or t
gtgttctggtttaatccgtttatttggtggtataaaaaagaaattcaacaaaatctagaatacattgcagaccaccaaacacaacaaaaaataaagtgtccaaaaagctatcaaacagttttgttaaaagccaacttaaatcaaaatcaattagcttttactactaatttttatcaatcattaatcaaaaaacgaattattatgctacaaaaatcaaaatcaaaaaacagtaatttattaaaactcactatcgtgttaccttttttagcgctatttctaatgagttttaatacaaaaaaagtatatatcgctaatgcggaaatacaacaaaatccaactattaacgaaacatttataatcacctacaagtctactgaccaacagcttgaaaatattaaaaataagttagaagaccagttagacggaataaaaattaaattttcagacattaaaagaaaccaaaataatgagatcatagctttaacaatagccacaaaaaatataaatcaaatagattttacaaaacatatcacttttaataaattagacagtacacccataaataacactactttacaaattgtaaataaccagctattagtaagtgatgacaaaaatggatctgtagttgctatatcaaaaattggaccacaacatcaacaacgactccattaa

SEQ ID NO: 22948 - protein, 224 aa, Unknown
  Obtained from environmental sample
  misc_feature (1)..(224): Xaa is any amino acid
MFWFNPFIWWYKKEIQQNLEYIADHQTQQKIKCPKSYQTVLLKANLNQNQLAFTTNFYQSLIKKRIIMLQKSKSKNSNLLKLTIVLPFLALFLMSFNTKKVYIANAEIQQNPTINETFIITYKSTDQQLENIKNKLEDQLDGIKIKFSDIKRNQNNEIIALTIATKNINQIDFTKHITFNKLDSTPINNTTLQIVNNQLLVSDDKNGSVVAISKIGPQHQQRLH

SEQ ID NO: 22949 - DNA, 498 bp, Unknown
  Obtained from environmental sample
  misc_feature (1)..(498): n is a, c, g, or t
ttgatgatggctcggattataaagataaactttacaaagcaattagtgcctttatcatttaatcaaaaacaggtgcaagaagcttctcatttatttgtgttttgcattgattcaaaaatggatacaccttttgttttagattattttaatagagttaaagaaattagaaacactcctaatgagattttggatccatttaaaaattttttagttcaggattttgatgctaaaactcaaattgataaagaaacttgggccactaaacaagcttatttagctttaggaaatttaatgacggtttgtgcgttattaaatatagatgcttgtcctatggaagggttttcgactaaagattatgatgctattttaaagttagaaaagttaaatttaaaatctgtccttattatgccaataggatatagggctgaagatgattttatgtctaaacttaaaaaagttagaaaacctattgaagaaagtgtaattatttggaaatag

SEQ ID NO: 22950 - protein, 165 aa, Unknown
  Obtained from environmental sample
  DOMAIN (48)...(140): Nitroreductase family
  misc_feature (1)..(165): Xaa is any amino acid
MMMARIIKINFTKQLVPLSFNQKQVQEASHLFVFCIDSKMDTPFVLDYFNRVKEIRNTPNEILDPFKNFLVQDFDAKTQIDKETWATKQAYLALGNLMTVCALLNIDACPMEGFSTKDYDAILKLEKLNLKSVLIMPIGYRAEDDFMSKLKKVRKPIEESVIIWK

SEQ ID NO: 22951 - DNA, 411 bp, Unknown
  Obtained from environmental sample
  misc_feature (1)..(411): n is a, c, g, or t
ttgcaacaagaattatgtttagtaacttcagcgtttttaagtgatttgccaaaagatattaaccacccatttttaaaaagaaatacaaattcatttagggtaacggattcatggtcagttcttttaaacaaatcgggatttcataaaaatcattatcattcagaaggctggatgagttcgccttattatataaaaataccttcagttatagattgctttactaaaaaagaaggttggttaaagctgggtgagccggggttcaatatgtataaaaaaataccggttaaaaaaattatcaaaccagaggaaggcaaattaatacaattcccatcatacatgtggcatggcactactgctcttaaaagcgatgtagagcgtttaactatagcgtatgacattactccgaaataa

SEQ ID NO: 22952 - protein, 136 aa, Unknown
  Obtained from environmental sample
  misc_feature (1)..(136): Xaa is any amino acid
MQQELCLVTSAFLSDLPKDINHPFLKRNTNSFRVTDSWSVLLNKSGFHKNHYHSEGWMSSPYYIKIPSVIDCFTKKEGWLKLGEPGFNMYKKIPVKKIIKPEEGKLIQFPSYMWHGTTALKSDVERLTIAYDITPK

SEQ ID NO: 22953 - DNA, 453 bp, Unknown
  Obtained from environmental sample
  misc_feature (1)..(453): n is a, c, g, or t
atgactaaaatactaatggtttgcctcggaaatatctgtcgctcaccactagctcaaggtatcttagaatctaaattagatgctaattatagtgtagattctgctgcgactagtaattaccatattgatagtaaaccagacccaagatctatagccattgcaaaagaatttggtttggatatttctaaacaacgcggaaggcaatttaaagtggaggattttgacactttcgattatatttacgcaatggataattctaattacgaaaacattataaaatgggctcgtaatcctaaagacatttcaaaagtaaaacttattttaaatgaaagtcatcccaatcaaaatttagaggttccagacccttattttggcggcgattcaggctttttagatgtttataaattattggacgatgcctgtataagtattgctgaaaaattaaaatcatag

SEQ ID NO: 22954 - protein, 150 aa, Unknown
  Obtained from environmental sample
  SIGNAL (1)...(18)
  DOMAIN (2)...(147): Low molecular weight phosphotyrosine protein phosphatase
  misc_feature (1)..(150): Xaa is any amino acid
MTKILMVCLGNICRSPLAQGILESKLDANYSVDSAATSNYHIDSKPDPRSIAIAKEFGLDISKQRGRQFKVEDFDTFDYIYAMDNSNYENIIKWARNPKDISKVKLILNESHPNQNLEVPDPYFGGDSGFLDVYKLLDDACISIAEKLKS

SEQ ID NO: 22955 - DNA, 879 bp, Unknown
  Obtained from environmental sample
  misc_feature (1)..(879): n is a, c, g, or t
gtgcatattagttttgacttttctcaaaccacacccaataaccagagatcttatactaataacgaagctttagattaccggttattagaaaggcttacctatcagggattgtcttatcgctatcaagattcggatgaggttatttattcacgaattaaaaaagaactccatattgttaaagaaagaggttttgtgtcctattttttgatcaattggaagattttgaaatatgcacgcagtaaaggctatttttatgttgggcggggtagtggggccaatagtattgttgcctatttattgcgcattacggatgttgaccctgtagaactggacctgtattttgagcgttttatcaatttgtatcgcaaaaacccacctgattttgatattgatttttcatggaccgaccgtgatgatattacacaattcatttttaagaggtttaaaaacacggcattgattgcagtgtataatacttttaaattcagggcttctgttcgtgaattaggaaaagtttttggtttacctaaatcagaaatggatctattgaccagaaagaaatataattttaatgaattagacagactatcacaattagtattgaagtatagtaagtatattcagggttttccgaattatttaggaatccatgccggaggtattctgatctctgaaaaacccattcattattacaccgccacttttctaccacctaaagggttttcaaccacacaatttgatatggtggtggctgaagatataggtttgtataagtttgatattttaagtcaacgggggttaggtaagattaaagaaacagttgagataattaaatataattatctaaataataataatatagatatacgtgacatntaa

SEQ ID NO: 22956 - protein, 292 aa, Unknown
  Obtained from environmental sample
  misc_feature (1)..(292): Xaa is any amino acid
MHISFDFSQTTPNNQRSYTNNEALDYRLLERLTYQGLSYRYQDSDEVIYSRIKKELHIVKERGFVSYFLINWKILKYARSKGYFYVGRGSGANSIVAYLLRITDVDPVELDLYFERFINLYRKNPPDFDIDFSWTDRDDITQFIFKRFKNTALIAVYNTFKFRASVRELGKVFGLPKSEMDLLTRKKYNFNELDRLSQLVLKYSKYIQGFPNYLGIHAGGILISEKPIHYYTATFLPPKGFSTTQFDMVVAEDIGLYKFDILSQRGLGKIKETVEIIKYNYLNNNNIDIRDX

SEQ ID NO: 22957 - DNA, 651 bp, Unknown
  Obtained from environmental sample
  misc_feature (1)..(651): n is a, c, g, or t
atggttaagcctaggtttattaaagaaattagaacgcaagatcgtgttgttgagaggtttgataaagaggtgataaatcctaagatctgctcacaatcaactattaataaagtaagagaaataatgaaaaatgtggtaaaaaggggaacagccacaaacatttataataaaaattatgaattagccggtaaaacaggtacttgtcagacagaatattggacaggtaaaactcaatatatttcatcatttgtggggtattttcctgctgataacccgcaatattcctgtatagtagtcattcataaaccaaataagaaaataggctattatggcgctgatgtagcagggcctgtttttaagcaaattgcgcataaaatctatacagaaactccattgttagatgaagtcaatggattgcatcaaaaccctgcaagcatcaattcagattttgattcttattacgatatcactaggaaacaaacccaaaagatgcctaatgttaagaatatgacaggaatggacgccgtggctctattggaaaatctaggtttgaaagtgaaatttaaaggtacaggtaaggtcatgtctcaatcagtaaaagcaggtgaagtattaaataaaaatgtaatagtacaattaaccttatcgtga

SEQ ID NO: 22958 - protein, 216 aa, Unknown
  Obtained from environmental sample
  DOMAIN (160)...(216): PASTA domain
  misc_feature (1)..(216): Xaa is any amino acid
MVKPRFIKEIRTQDRVVERFDKEVINPKICSQSTINKVREIMKNVVKRGTATNIYNKNYELAGKTGTCQTEYWTGKTQYISSFVGYFPADNPQYSCIVVIHKPNKKIGYYGADVAGPVFKQIAHKIYTETPLLDEVNGLHQNPASINSDFDSYYDITRKQTQKMPNVKNMTGMDAVALLENLGLKVKFKGTGKVMSQSVKAGEVLNKNVIVQLTLS

SEQ ID NO: 22959 - DNA, 681 bp, Unknown
  Obtained from environmental sample
  misc_feature (1)..(681): n is a, c, g, or t
ttgatagtccaaaacgcaaaacaaaacgcaaacctaacaagagtagggccaaacgcccaggacagccgagaccagctgctgatcaaaataaacctcaggagaagtctcaagagaaaaaccaacaaaaacctgctcaaaaaacagggcaaaagaaacgaagaaaaccaaatccaaaaaaatccaatcctaacgatgccaaataaattttcttggatagttttaacaattgtgcttttggggttcagttgtgattccaatcaaatttttgacgagtataagtcggtgccaaatcaatggcacaaggattcccttatttcctttaccgtcacaccgcctgattctacaaagctctataatttgtttatcaatatccggaacactaatgattacaaattcagcaatttatttttgattgctgaaattgattttcctcatggtaaaactgtcaaggatactttagaatatcaaatggcaaaaccggacggcaccttattaggagaagggtttacagatgttaaagagaataaattgtggtataaagaagcggtgaagtttgatgaaattggaccttacaccataacaattcagcatgtcatgcgtaataatggtgaggttgagggcgttgataacttagaaggtattacagatgtgggctttagaatagaacctgcaactaattag

SEQ ID NO: 22960 - protein, 226 aa, Unknown
  Obtained from environmental sample
  misc_feature (1)..(226): Xaa is any amino acid
MIVQNAKQNANLTRVGPNAQDSRDQLLIKINLRRSLKRKTNKNLLKKQGKRNEENQIQKNPILTMPNKFSWIVLTIVLLGFSCDSNQIFDEYKSVPNQWHKDSLISFTVTPPDSTKLYNLFINIRNTNDYKFSNLFLIAEIDFPHGKTVKDTLEYQMAKPDGTLLGEGFTDVKENKLWYKEAVKFDEIGPYTITIQHVMRNNGEVEGVDNLEGITDVGFRIEPATN

SEQ ID NO: 22961 - DNA, 678 bp, Unknown
  Obtained from environmental sample
  misc_feature (1)..(678): n is a, c, g, or t
atgtatattaattgtcattcatattattctttgcgttttggtacgttttcggaagttgatttactaaaattagctcaagaaaataatgttaccactttagccttaaccgatattaataatacctcagcgtgtttaaattttattcgcaaagcaaaagattttaatattaaacccgtggtgggtattgactttagagtaggtgcacaacaaaattttattggaattgctaaaaataatgcaggatttaaagagcttaatagttttttatctcatcattctgaacgcaaattaaaacttcccgaaactgcacccgcgtttaaagacagttatattatatatccgtttgagaaagtccttaaattaaataaaacaacatttttagattgtgaatttattggcgtttctgttgaagaattacgaaaattacgcttttctaaactgaatacttacaccgataagttagtcgtattacagtcagtaaccgtgcgttctcaaaaagattttaatgcccatcgcttattacgcgccatcgataataatgcacttttaagtaaattatgtcccactgaagaatgcaaaatcacagataaaatgctttccgctgaagcgttagaagttgcttttaaagagtttcctcatattattaaaaatacccaccggtttattagaagattgtaa

SEQ ID NO: 22962 - protein, 225 aa, Unknown
  Obtained from environmental sample
  DOMAIN (5)...(66): PHP domain N-terminal region
  misc_feature (1)..(225): Xaa is any amino acid
MYINCHSYYSLRFGTFSEVDLLKLAQENNVTTLALTDINNTSACLNFIRKAKDFNIKPVVGIDFRVGAQQNFIGIAKNNAGFKELNSFLSHHSERKLKLPETAPAFKDSYIIYPFEKVLKLNKTTFLDCEFIGVSVEELRKLRFSKLNTYTDKLVVLQSVTVRSQKDFNAHRLLRAIDNNALLSKLCPTEECKITDKMLSAEALEVAFKEFPHIIKNTHRFIRRL

SEQ ID NO: 22963 - DNA, 318 bp, Unknown
  Obtained from environmental sample
  misc_feature (1)..(318): n is a, c, g, or t
atgatttcaattccaaaacataaacagcttattttatttgatggggtttgcaatctctgcaattcttctattcaatatataattcgtcgcgataaaaaaaatgtttttttatttgctgcgttacaaagtgatgtgggaaaagaaattataaaggaatataatattgatccttcaacaacagattccattctactttacagtcccgaatgcggattatacacaaaatctacggcagcattaaaaattgccaaacatttagaattccctataaatttattacgcgcttttttaattttaccggcttttattcgaacctag

SEQ ID NO: 22964 - protein, 105 aa, Unknown
  Obtained from environmental sample
  DOMAIN (4)...(105): Protein of unknown function, DUF393
  misc_feature (1)..(105): Xaa is any amino acid
MISIPKHKQLILFDGVCNLCNSSIQYIIRRDKKNVFLFAALQSDVGKEIIKEYNIDPSTTDSILLYSPECGLYTKSTAALKIAKHLEFPINLLRAFLILPAFIRT

SEQ ID NO: 22965 - DNA, 396 bp, Unknown
  Obtained from environmental sample
  misc_feature (1)..(396): n is a, c, g, or t
ttgcttttaaaaattaagaataatcttattaaaaacgaacatattatctcaaaatataagaatgaacttattaataagccacatataaaaataaaaaaatctcaagacgaaatttttctagaaaatttaaatacaattgttaataattgtttgagtaactctcaatttaaagttgatgagttggcagataaattaaatatgagtcattctagtttgtatagaaaatgttctgcattaacaggtttaagccttgtagattatataagacaattacgtcttaaaaaagctgcaatcttattagtcaaatatggttataatatttctgaagtagcttatatggtaagtttttataatccaaaatacttttctaaaagtttaaaaatcaatttaatataa

SEQ ID NO: 22966 - protein, 131 aa, Unknown
  Obtained from environmental sample
  DOMAIN (46)...(89): Bacterial regulatory helix-turn-helix proteins, AraC family
  misc_feature (1)..(131): Xaa is any amino acid
MLLKIKNNLIKNEHIISKYKNELINKPHIKIKKSQDEIFLENLNTIVNNCLSNSQFKVDELADKLNMSHSSLYRKCSALTGLSLVDYIRQLRLKKAAILLVKYGYNISEVAYMVSFYNPKYFSKSLKINLI

SEQ ID NO: 22967 - DNA, 813 bp, Unknown
  Obtained from environmental sample
  misc_feature (1)..(813): n is a, c, g, or t
atgatttctgctcctggacaaggtgcaataatgattactgctttagaaaaaaatgattttgtnttagatgcttgtgaacaattaaaccatcatgaaacaaaagtttgtgtgggtgttgagcgtgagtttttgagattgttagaaggtggttgtacagctccaattggtgctttagcttatgtaaactcaaaaactgaagaggttaattttaaaggagttttattaagtaaagatggttctaagaaaattaaagtagaaaaaacggccaaacttggtaatcacaaatttttagcaaaagattgtgcagattatgtgattaatagaggaggaaaagaattgatgttagaagataatgaaaatcaatctaagatcgcttcaatttattctacaaagaaactttcagaacttcaaaaagaaactttatcagaggcaattggtatagaagatagcgattttattaaaatacgttttaatagaattcctgctaaagtgatgaaaactgaaattgaaaacgtaattattacgagtcaaaatggagtagaagcaattttaaattcatttactaaaaacgaattaaaattcaaaaatatctattgtgtaggtagaagaacaaaaaaattaatcgaaaatagaatagggaaagttaccaaggttgcaaaaaatgcaaaaacattagctgaatatttatcaaaagaactagaaaacaaagaggttacttacttctgtagtaacttaaggatggatattttaccagcgtatttaaaaacacacagtattgttgtgaatgaagttgaagcttacaaaacaatttaa

SEQ ID NO: 22968 - protein, 270 aa, Unknown
  Obtained from environmental sample
  DOMAIN (34)...(109): Porphobilinogen deaminase, C-terminal domain
  misc_feature (1)..(270): Xaa is any amino acid
MISAPGQGAIMITALEKNDFVLDACEQLNHHETKVCVGVEREFLRLLEGGCTAPIGALAYVNSKTEEVNFKGVLLSKDGSKKIKVEKTAKLGNHKFLAKDCADYVINRGGKELMLEDNENQSKIASIYSTKKLSELQKETLSEAIGIEDSDFIKIRFNRIPAKVMKTEIENVIITSQNGVEAILNSFTKNELKFKNIYCVGRRTKKLIENRIGKVTKVAKNAKTLAEYLSKELENKEVTYFCSNLRMDILPAYLKTHSIVVNEVEAYKTI

SEQ ID NO: 22969 - DNA, 885 bp, Unknown
  Obtained from environmental sample
  misc_feature (1)..(885): n is a, c, g, or t
ttgaaagttaatatcaaagaaggaaaagcgaagcctatcaaaacgaatggcgaaatgcttttaaaacaagcagatgaacgggagtacatttttgatcatagttggagacaagtaagagagaaattttatgttgttgaccttcagggtgtagattgggatttttattattctgaatacaaaaaatttctaccttttataaacaatagttatgatttcacagaaatgcttagcgaaatgcttggagagttaaatgcttcacacacgggcagtggatataggccaaaagttacaaatggtgataaaactgcatcgttaggaattttgtatgattatgcacatataaagactggtgtaaaagtggcagaagtgattaatggtggaccacttgacaaagctgtgtcaaaagtagaagctggtaatattattgaaaaaattgatggacaagctattactcaagctattgatttttataaattgttaaatagaaaagaaggaaaaaatattcttttatcaatatataacccgaacacgaatattcggtgggatgaagtggttaagccaatttctttgaataaagagaatcaattactttataaacgttgggtaaaaacgcgacgtgaagaagtaacacgcctttcaggtggtaagttgggttatgtacatgtaagaggtatgaatgacccaagtatgagagatgtttttgaagatgcgcttggtaaacatatctctgcgaatgccctaatcgtagacacacgttttaatgggggtggaaatctacatgacgtactttcagattttctcaacggaaaagaaatatatggatatcattcctcacggccaaaacataggctatcaacgtggaacaaatggataaaccttctatag

SEQ ID NO: 22970 - protein, 294 aa, Unknown
  Obtained from environmental sample
  misc_feature (1)..(294): Xaa is any amino acid
MKVNIKEGKAKPIKTNGEMLLKQADEREYIFDHSWRQVREKFYVVDLQGVDWDFYYSEYKKFLPFINNSYDFTEMLSEMLGELNASHTGSGYRPKVTNGDKTASLGILYDYAHIKTGVKVAEVINGGPLDKAVSKVEAGNIIEKIDGQAITQAIDFYKLLNRKEGKNILLSIYNPNTNIRWDEVVKPISLNKENQLLYKRWVKTRREEVTRLSGGKLGYVHVRGMNDPSMRDVFEDALGKHISANALIVDTRFNGGGNLHDVLSDFLNGKEIYGYHSSRPKHRLSTWNKWINLL

SEQ ID NO: 22971 - DNA, 456 bp, Unknown
  Obtained from environmental sample
  misc_feature (1)..(456): n is a, c, g, or t
atggaaaagaaactacaaaagatttttcagaaacacccggcggatgcagcgtctcttataaatatcctgcacgatatccagaatgaatacggatatctgccgtgtacagcactggaggcggtctcaacaacacttgacgtaccgttgagtaaaattttcagtgtttcaacattctacaatgcgttcagcctggataaaaaaggcgatctgataataaaaatctgtacaggcacagcctgtcatatcagaggctcgaaaatattgattgatgagctgataagaaaactgaatatggagaacgtcgggacaactgaagacgggaagtttactgtggaaacagtgaattgtctgggtgcatgcgcgatggctccccttgtggtaacaactgaaaaaaacacatccaaatatcataacaaggtttcaatctcctcattggatacaatgattaaacggtga

SEQ ID NO: 22972 - protein, 151 aa, Unknown
  Obtained from environmental sample
  DOMAIN (2)...(151): Respiratory-chain NADH dehydrogenase 24 Kd subunit
  misc_feature (1)..(151): Xaa is any amino acid
MEKKLQKIFQKHPADAASLINILHDIQNEYGYLPCTALEAVSTTLDVPLSKIFSVSTFYNAFSLDKKGDLIIKICTGTACHIRGSKILIDELIRKLNMENVGTTEDGKFTVETVNCLGACAMAPLVVTTEKNTSKYHNKVSISSLDTMIKR

SEQ ID NO: 22973 - DNA, 930 bp, Unknown
  Obtained from environmental sample
  misc_feature (1)..(930): n is a, c, g, or t
ttgtatgggccaaatgacaaaacatctttaataaacattaggcaatgtggtgttaaaggaattgtaactgcgttacatgaaattcctgttggtaatgtctgggaaattgaagacattaatgaaagaaaaaaactaattgaagataaaggcttagaatggaaagttgtagaaagtttacctgtacatgaagatataaaaaaacgtaccaaaaattacgagaaatatatagagaattataaaaaaagcattcaaaatttagcagagtgtggcatagaagtcataacctataactttatgcctgttttagattgggtaagaacacatacagattacctgaatcaagatggaacaaaatctttatattttcataaagatgcttttgtgtattttgatgtttttttgttgaaaagacccaatgcaaaagcagattacacaccagaacaaataagaaaagcactgttgtatggacaatcattatcaagaaaagaaaaaagtaagttatcaagaagtgtactattaggtttaccaggaagtacaaaaaactttacatcaacacaaattttaaaacttttagaagaatataaaaatattgatgaagctactttaagaaataatctaattttatttttaaaggaagtaacacctattgcagaaaaagcaagtattgcattggccattcatcctgacgaccctccatattcagttttaggtttaccacgtatagtaggtacaaaagccgatttacaacttattctaaaccaagttccaagtattgccaatggattatgctactgtacaggttctttaggtgcgcatcctgaaaacgaccttttggatattttagaaacgacatcagatagaatacattttttgcatttaagaaatgttataaaagatattgatggtaattttaaggaatctgaccattag

SEQ ID NO: 22974 - protein, 309 aa, Unknown
  Obtained from environmental sample
  DOMAIN (1)...(309): D-mannonate dehydratase (UxuA)
  misc_feature (1)..(309): Xaa is any amino acid
MYGPNDKTSLINIRQCGVKGIVTALHEIPVGNVWEIEDINERKKLIEDKGLEWKVVESLPVHEDIKKRTKNYEKYIENYKKSIQNLAECGIEVITYNFMPVLDWVRTHTDYLNQDGTKSLYFHKDAFVYFDVFLLKRPNAKADYTPEQIRKALLYGQSLSRKEKSKLSRSVLLGLPGSTKNFTSTQILKLLEEYKNIDEATLRNNLILFLKEVTPIAEKASIALAIHPDDPPYSVLGLPRIVGTKADLQLILNQVPSIANGLCYCTGSLGAHPENDLLDILETTSDRIHFLHLRNVIKDIDGNFKESDH

SEQ ID NO: 22975 - DNA, 666 bp, Unknown
  Obtained from environmental sample
  misc_feature (1)..(666): n is a, c, g, or t
atgactaaaattttatataaatttaaaggaaaatattccgctaaagcgctactaatgttacaaaacaaagcttttttattactattactttcatttttattatttctaaattgcaaggaagatccaggtattgacaggaaacttcctgctttaatacaagaggataatagtatcgcttacgctgaaggatttagtattacaaatcatagtaattttaaagtgttaaccgttaacaacccttggcctaaagcagaaaaagcctataagtacgttttaattagtaaagaagacgctgcaaaaacatcgtttatgaaagatgaatatgatggtattatcattactcctgtaacatctatagtagtaacttctacaactcatattcctgctttagaacttttaaatgaagaaaactcattaattggttttcctggcagtgattatatttcttcagaaaaaatcagacagcgtattgataatggacacgtaagagaattaggtaaaaacgaaggtttaaacaccgaagtgttattagagttaaatccaaatgttgtcgttggatttggtgttgatggcacaagtaaatctttaaaaacaataagtaatgctagaatacctgtaatttacaatggtgattgggtagaaaaaaaccttttagctaaagccgaa

SEQ ID NO: 22976 - protein, 222 aa, Unknown
  Obtained from environmental sample
  misc_feature (1)..(222): Xaa is any amino acid
MTKILYKFKGKYSAKALLMLQNKAFLLLLLSFLLFLNCKEDPGIDRKLPALIQEDNSIAYAEGFSITNHSNFKVLTVNNPWPKAEKAYKYVLISKEDAAKTSFMKDEYDGIIITPVTSIVVTSTTHIPALELLNEENSLIGFPGSDYISSEKIRQRIDNGHVRELGKNEGLNTEVLLELNPNVVVGFGVDGTSKSLKTISNARIPVIYNGDWVEKNLLAKAE

SEQ ID NO: 22977 - DNA, 504 bp, Unknown
  Obtained from environmental sample
  misc_feature (1)..(504): n is a, c, g, or t
atgttttctgagtcagcacaaacgagactaaaaaatattaaaaaatcaagctggtacaagtctagtattcataaggttcactgtcctccaatacaagccttacaagaaatacaagtcataataaataattatataaaaaaatacggaggcaaaagtaaagttagaactagagaagtaagtatattttctcattctggaactgatgggcctatcacttatgatacacctaacgaccctccgcttaatgacaaaaaaaagcaaatgcatatagatggctggtcaagtatagattttaactgggctacatacaaaggtgtaactacaactagatgtgttttctttggatgtagattgacccctgccgtcaaatccgtacagttaaacttgggagatttaattacgcagcttgacgataataatcaaaccacacctgtcttggcgatttatagcccaagctcttttgagttctcgtttggttgtaatatagttcaatatatccaatga

SEQ ID NO: 22978 - protein, 167 aa, Unknown
  Obtained from environmental sample
  misc_feature (1)..(167): Xaa is any amino acid
MFSESAQTRLKNIKKSSWYKSSIHKVHCPPIQALQEIQVIINNYIKKYGGKSKVRTREVSIFSHSGTDGPITYDTPNDPPLNDKKKQMHIDGWSSIDFNWATYKGVTTTRCVFFGCRLTPAVKSVQLNLGDLITQLDDNNQTTPVLAIYSPSSFEFSFGCNIVQYIQ

SEQ ID NO: 22979 - DNA, 357 bp, Unknown
  Obtained from environmental sample
  misc_feature (1)..(357): n is a, c, g, or t
atgtgcactaatatagaagctatttcaaaaacctcacaaggcgaattaaactactgtaaaggatgcaagcagtttcattttgagtttaataatatttattttgaatttacgccagaacaatttgagcaatttaaagcctacattttatttgttgaagcagattattgggaacataaatatgcttgtgctaatgttaagcgtaaaataccaatcccaaccttacaagacaatttagtgttaatgtttgataggcaagaaattaaagagcttaaagtactggttagccaaaaaaacaaggctgtttttgatactttacttaatgtagacgatatagattacacttatattgttaactag

SEQ ID NO: 22980 - protein, 118 aa, Unknown
  Obtained from environmental sample
  misc_feature (1)..(118): Xaa is any amino acid
MCTNIEAISKTSQGELNYCKGCKQFHFEFNNIYFEFTPEQFEQFKAYILFVEADYWEHKYACANVKRKIPIPTLQDNLVLMFDRQEIKELKVLVSQKNKAVFDTLLNVDDIDYTYIVN

SEQ ID NO: 22981 - DNA, 477 bp, Unknown
  Obtained from environmental sample
  misc_feature (1)..(477): n is a, c, g, or t
ttgatccacagttanaaagccgttataatcgtagttccgcacactagttggcacgatttctaccttggattatttacacgtagactgacaaagacccagattaattatattgctaaaaaagaattatttcgctggccttttggttggtactttcgctggacaggaggtgaaatgttagaccgaacgcccgggcagaacaaggtagaagcaattgctgaaatttttaagaataaagaagagttccgcttggcattggcgcccgaaggtacccgacggaaagtaactaattggaaaacaggtttctattatatcgccttagcggcaaatgttcctataatctgcgttccttttgattatagcaaaaagactataactataaacgaacccttttatccaactggtgatatcgatttggatattgaaaagcttcgcgtctattttgaaggcgtagttggaaaaaaagcagaattttcttaa

SEQ ID NO: 22982 - protein, 158 aa, Unknown
  Obtained from environmental sample
  misc_feature (1)..(158): Xaa is any amino acid
MIHSXKAVIIVVPHTSWHDFYLGLFTRRLTKTQINYIAKKELFRWPFGWYFRWTGGEMLDRTPGQNKVEAIAEIFKNKEEFRLALAPEGTRRKVTNWKTGFYYIALAANVPIICVPFDYSKKTITINEPFYPTGDIDLDIEKLRVYFEGVVGKKAEFS

SEQ ID NO: 22983 - DNA, 327 bp, Unknown
  Obtained from environmental sample
  misc_feature (1)..(327): n is a, c, g, or t
atgacttttgctcccgtatatccacattatgtaactaaagtagaaaaaaaaggacgttcaattgaggaattacatcaagtcatccagtggttgacaggctacaattttaaaacaattgaaaccttaattgacaaaaaagtatcatttaaaaccttttttgaagaggcgacacttaacccaaatgctaaccttattaaaggtgtaatttgtggttatcgtattgaggacataacgtttcctttaacacagcaagtaaggtacttagataaattggtcgatgaattggctagaggtcgtaaaatggataaaattttaagacagaattga

SEQ ID NO: 22984 - protein, 108 aa, Unknown
  Obtained from environmental sample
  misc_feature (1)..(108): Xaa is any amino acid
MTFAPVYPHYVTKVEKKGRSIEELHQVIQWLTGYNFKTIETLIDKKVSFKTFFEEATLNPNANLIKGVICGYRIEDITFPLTQQVRYLDKLVDELARGRKMDKILRQN

SEQ ID NO: 22985 - DNA, 822 bp, Unknown
  Obtained from environmental sample
  misc_feature (1)..(822): n is a, c, g, or t
gtgattaaaaatataaatgttgtttatgacgaggtacttgcggattttgatacagaagaagattttgttatcacaccatcacaagaacataatgaaatgncagaggaagaacctattcagaataaacaacaaattaccttaactttcgatatgcctttagcagaagagtctattgaagataaacaaccagaagctaaaactgaagatcgcataaaatacgcacaacaatcaagttacggaacacctgaggttagaaaaaaaacaacacctgcaccagaaaataaagcaccagaggtgaagcctatagtttacaatttagaaagtgaaataaaggaatttgaagttaaagagcctgtagagattattcctgttagtgaaaatacaagttctgggatgaaacgttatgccttggatgattatgaagaaattgattcttcagtgagcacatcaaaaaagaaggaatcagaaattgaaaaagatttcgatgctgaggttgtattcgagaaaaaagtagttcaagaaatcacatctaacgatgctgatgacgatgatttagatccaatgaacagttctatttctgatattttaaaagaaagagcagatgaaagaagacgtaagatgaagaacttcaattataagtttaatgcttcaaaaattgatgaaattgaaaaaactccagcttacaaacgccaaggtttagatttgcaagatgcgcaacattcatcagacattaacacgtcaagaacgagtttaggagtcgatgacaacgacgatatacaactaagaagtaataactcatttctacacgataacgtagactaa

SEQ ID NO: 22986 - protein, 273 aa, Unknown
  Obtained from environmental sample
  misc_feature (1)..(273): Xaa is any amino acid
MIKNINVVYDEVLADFDTEEDFVITPSQEHNEMXEEEPIQNKQQITLTFDMPLAEESIEDKQPEAKTEDRIKYAQQSSYGTPEVRKKTTPAPENKAPEVKPIVYNLESEIKEFEVKEPVEIIPVSENTSSGMKRYALDDYEEIDSSVSTSKKKESEIEKDFDAEVVFEKKVVQEITSNDADDDDLDPMNSSISDILKERADERRRKMKNFNYKFNASKIDEIEKTPAYKRQGLDLQDAQHSSDINTSRTSLGVDDNDDIQLRSNNSFLHDNVD

SEQ ID NO: 22987 - DNA, 363 bp, Unknown
  Obtained from environmental sample
  misc_feature (1)..(363): n is a, c, g, or t
ttgttcatatattcggaatcgctatctatcagattgctaagacctaaccataattatctgattacaaaaaggcctataagtatgaataatgcacagcaaaaaccatcactaaaaggacgtttatactgttctgtttttggacacaattttagcgtaagcaaaaaagtaacctatcatattaaagagtataagtgctgtcattgcaaaaaagaaatgactaaaaacagcaaaggacacttaaccgacttgacaccaaagtataaagaaataaactcggtgttagagcgtattcatcaaaacaaattaactagatatagcaacagtcaaattatacaatcacctgttttaaaaatgacatcttag

SEQ ID NO: 22988 - protein, 120 aa, Unknown
  Obtained from environmental sample
  misc_feature (1)..(120): Xaa is any amino acid
MFIYSESLSIRLLRPNHNYLITKRPISMNNAQQKPSLKGRLYCSVFGHNFSVSKKVTYHIKEYKCCHCKKEMTKNSKGHLTDLTPKYKEINSVLERIHQNKLTRYSNSQIIQSPVLKMTS

SEQ ID NO: 22989 - DNA, 432 bp, Unknown
  Obtained from environmental sample
  misc_feature (1)..(432): n is a, c, g, or t
ttgtttacaattacagcttttgttatttcaaaagaaatagccatgtattctatacttacttatattgtaactgctaaagtaactgatatggtaattgaaggttttgaagactttataggtgtatctattgtatctaaagattacgaaaagattaaagtcgcaattattaaagagcttggtgctggaatgaccatttacaaaggaaaaaaagggtttgtaaataaaaatgaaaacgaagaattagatattattcatacgattattaaccgtattgatatcaaaaaaatgtaccgcattatatctgatatagatgatgatgcttttattgtagagtttgatgtaaacaacgtaaaaggtggcgttttaagacgctatttagatcgaaaaaagggagaaaaactagcaaactttttgtcgcaaaatcctttttaa

SEQ ID NO: 22990 - protein, 143 aa, Unknown
  Obtained from environmental sample
  misc_feature (1)..(143): Xaa is any amino acid
MFTITAFVISKEIAMYSILTYIVTAKVTDMVIEGFEDFIGVSIVSKDYEKIKVAIIKELGAGMTIYKGKKGFVNKNENEELDIIHTIINRIDIKKMYRIISDIDDDAFIVEFDVNNVKGGVLRRYLDRKKGEKLANFLSQNPF

SEQ ID NO: 22991 - DNA, 510 bp, Unknown
  Obtained from environmental sample
  misc_feature (1)..(510): n is a, c, g, or t
atgagtaccgaaaaggagctatcttatcaaattactaatacctatagcgttttaaacgattttactaaaaaaacaaaaacggtatggctggtttgtcacgggattggttatttaagcaggtatttcttaaggcattttaatcatttaaatgcaacagaaaattatgtgattgctccgcaggctcagtctaaatattacctcaacaacgagtacaaacacgtaggcgcctcctggctcaccaaagaacgcactgaagctgaaacagaaaatgttctcaactatctggacgaagtttataaggctgaaaatataaaaaatgcttccagacttattattttaggatattctcaaggagtttcggtagcgacaaggtggatcgcgaaccgaagaattaagtgtgatgaattaatattgcattcagggaaagttccgggggaaattaagagtgaagattttcagtttttaaaaaatacaaactttcaccttttatttatggaacccaaagattga

SEQ ID NO: 22992 - protein, 169 aa, Unknown
  Obtained from environmental sample
  misc_feature (1)..(169): Xaa is any amino acid
MSTEKELSYQITNTYSVLNDFTKKTKTVWLVCHGIGYLSRYFLRHFNHLNATENYVIAPQAQSKYYLNNEYKHVGASWLTKERTEAETENVLNYLDEVYKAENIKNASRLIILGYSQGVSVATRWIANRRIKCDELILHSGKVPGEIKSEDFQFLKNTNFHLLFMEPKD

SEQ ID NO: 22993 - DNA, 408 bp, Unknown
  Obtained from environmental sample
  misc_feature (1)..(408): n is a, c, g, or t
atgaaaaatctagtgctatcattatttttaattgcaatttcgatctcggcttttagtcaagacgacctttcaaccacaactggtcatattaaatttttctcaagtactcctgctgaggatatcgaagctaataactataaggttataagcaaaattactctatctacaggtgacatcgttttttcagtacctatgcagagctacgaatttgaaaaggccttaatgcaaaagcattataattcaaaaaagtttttagacactaagacatatccaaaaagtaagtttaaaggaaaaatctctaatttaacagatatcgattttgctaaggatggttcttataaagctaatgtttccggacacctaactattcacggggtgactaaagaatttccggaagtattacgatag

SEQ ID NO: 22994 - protein, 135 aa, Unknown
  Obtained from environmental sample
  SIGNAL (1)...(19)
  misc_feature (1)..(135): Xaa is any amino acid
MKNLVLSLFLIAISISAFSQDDLSTTTGHIKFFSSTPAEDIEANNYKVISKITLSTGDIVFSVPMQSYEFEKALMQKHYNSKKFLDTKTYPKSKFKGKISNLTDIDFAKDGSYKANVSGHLTIHGVTKEFPEVLR

SEQ ID NO: 22995 - DNA, 372 bp, Unknown
  Obtained from environmental sample
  misc_feature (1)..(372): n is a, c, g, or t
atgcttttgaatttcatatttagtaactttgttatcgattataaaactacacatatcatgaaattcagaattgaaaaagacactatgggtaaggttgaagtacctgccgataaatattggggggcacaaacagaacgatctcgaaataactttaaaataggtccttcatcttccatgccgttggaaatagtctatggctttgcttaccttaaaaaagcagcggcacatgctaattgctatttaggtgttttaactaatgataaacgtgatttaatatctaaagtttgtgatgaaattctcgccggtaagctcgatgatcaattcccgttagttatttggcaaacaggctttcaggtacgcaaagtaacatga

SEQ ID NO: 22996 - protein, 123 aa, Unknown
  Obtained from environmental sample
  misc_feature (1)..(123): Xaa is any amino acid
MLLNFIFSNFVIDYKTTHIMKFRIEKDTMGKVEVPADKYWGAQTERSRNNFKIGPSSSMPLEIVYGFAYLKKAAAHANCYLGVLTNDKRDLISKVCDEILAGKLDDQFPLVIWQTGFQVRKVT

SEQ ID NO: 22997 - DNA, 429 bp, Unknown
  Obtained from environmental sample
  misc_feature (1)..(429): n is a, c, g, or t
atggagaatacagaaaaaagtagattcgggttggtggggaaaagtatttcctactctttttccaaaggatattttacccaaaaattcaaggaattagaattagatcaccattcctatgaaaattttgatttggctgcaattgaggattttcaagagctcatccagttgaacaaaaacctgaagggattgaatgtcactattccctacaaagaagtcgtaatcccatatttggacaagctaaatccaaaagcagaaaaaattggcgccgtcaacacgatcaagttcacaaaaaaaggtcttaaaggctttaatacggatatttatggttttaaaaaatcaataaaaccttttttaaaaaaacgccataagaaaaccttgatactaggaaccggtggggcctccaaagccagtggctttttgtatcagtga

SEQ ID NO: 22998 - protein, 142 aa, Unknown
  Obtained from environmental sample
  DOMAIN (27)...(142): Shikimate / quinate 5-dehydrogenase
  misc_feature (1)..(142): Xaa is any amino acid
MENTEKSRFGLVGKSISYSFSKGYFTQKFKELELDHHSYENFDLAAIEDFQELIQLNKNLKGLNVTIPYKEVVIPYLDKLNPKAEKIGAVNTIKFTKKGLKGFNTDIYGFKKSIKPFLKKRHKKTLILGTGGASKASGFLYQ

SEQ ID NO: 22999 - DNA, 558 bp, Unknown
  Obtained from environmental sample
  misc_feature (1)..(558): n is a, c, g, or t
atgaaaaagttattagagataaaaagatatagtcttgtttgtttacttcttatactttgtataggttgtaaaagcgaaattaaaaaggaaaacatcaaagtcgttgaaacgagcagaacggaacacctgccctattacaacgaggaatcatttactcccaattggttgactccgggttctcaggaagaaaagggttttcataagattccagattttaaattaattaatcaattaggcgatacggttacacagaagacttttgaaaataaaatctatgtcaccgatttcttctttaccatttgccccggaatttgtccacagttggccgaaagtatgattaagttacaagaagaatttaaaaatgattcagatgtacttctgctatcgcattcagtaatgccatcaacagattcggtacccgttttaaaagaatatgctgaaacccatggcgcgatagctaacaaatggcatctcgtaactggtgataaaaaagaaatttattcgctgggcagagatcaatattttgttgaaaatgatttgggagttcaaaaagtatag

SEQ ID NO: 23000 - protein, 185 aa, Unknown
  Obtained from environmental sample
  DOMAIN (32)...(185): SCO1/SenC
  misc_feature (1)..(185): Xaa is any amino acid
MKKLLEIKRYSLVCLLLILCIGCKSEIKKENIKVVETSRTEHLPYYNEESFTPNWLTPGSQEEKGFHKIPDFKLINQLGDTVTQKTFENKIYVTDFFFTICPGICPQLAESMIKLQEEFKNDSDVLLLSHSVMPSTDSVPVLKEYAETHGAIANKWHLVTGDKKEIYSLGRDQYFVENDLGVQKV

SEQ ID NO: 23001 - DNA, 453 bp, Unknown
  Obtained from environmental sample
  misc_feature (1)..(453): n is a, c, g, or t
ttgaagttaaaaaagacttacaagtttgcattaaaaacctcgtttttaataacaatcttcctaaccctttttatgggtttgtttttatatacgttttatattgtgaacgtaggacaattggtgctttttgctttcgcaacctttagcgtctcgtttttaataacacagtttagggtagaaaaatttatctataaacgtattaacaaaatttacaaagatcttacccttttagaagcagttagttttagtaaaaaaagcatcactacagacatggctacactgaccaaacagatagaccaatatgctaaaaacaaaaagctagaaattgaaacacttaaagtaagagaagaataccgtaaggagtttatgggtaatatttcccatgagcttaaaacacccattatttacagtacaaggctatctagaaacattgttagatggggcctatcatga

SEQ ID NO: 23002 - protein, 150 aa, Unknown
  Obtained from environmental sample
  misc_feature (1)..(150): Xaa is any amino acid
MKLKKTYKFALKTSFLITIFLTLFMGLFLYTFYIVNVGQLVLFAFATFSVSFLITQFRVEKFIYKRINKIYKDLTLLEAVSFSKKSITTDMATLTKQIDQYAKNKKLEIETLKVREEYRKEFMGNISHELKTPIIYSTRLSRNIVRWGLS

SEQ ID NO: 23003 - DNA, 717 bp, Unknown
  Obtained from environmental sample
  misc_feature (1)..(717): n is a, c, g, or t
atgacggaagaagattttaaaatagatagatttcacgaaacctgggaaagtggcgttccctattggttcattggagcttgcttactcaattataatttcaagtcctttaggcgctttttgatttatatttctcattatagctctgttatagatttaagggaaactccttctcaagacattaaaaacgaagaaataatagctggatttcagccactattcacagaacgtattcctaaaaaggtgctataccaaataactagactcaaatcaaaaactacttttaatgaacaatttaaaacctattttgtagcaaataatctaatagggagaaaaagtttcacgatgctggaagcttataagattttagagttttggcaaggtgaaggtaaatggggaagaatgcaggcagcgaaaaaagatatgttagctgatattattcacaatggaaattatgagcgaactgctgaagaatttagaggagctttgggtaaagaaggttacagaccaaaccttatatctcccaaaaaaatcaaacaactcattgaacatattgaccttacagaagaaaaccagattgaagaacttatgggttataaagaacttcaaactggcttattatggatgtttggaatagtgacagtatccataattttgtgtaaacaaaaattatacgggggtttaacttttttaaagttgaaacccttttttcaaatatag

SEQ ID NO: 23004 - protein, 238 aa, Unknown
  Obtained from environmental sample
  misc_feature (1)..(238): Xaa is any amino acid
MTEEDFKIDRFHETWESGVPYWFIGACLLNYNFKSFRRFLIYISHYSSVIDLRETPSQDIKNEEIIAGFQPLFTERIPKKVLYQITRLKSKTTFNEQFKTYFVANNLIGRKSFTMLEAYKILEFWQGEGKWGRMQAAKKDMLADIIHNGNYERTAEEFRGALGKEGYRPNLISPKKIKQLIEHIDLTEENQIEELMGYKELQTGLLWMFGIVTVSIILCKQKLYGGLTFLKLKPFFQI

SEQ ID NO: 23005 - DNA, 543 bp, Unknown
  Obtained from environmental sample
  misc_feature (1)..(543): n is a, c, g, or t
ttgattaattttataacacacagttttattatggatgatttaaagaatcaatttttacagagtggtctattaaaaggcctaaaaacagaagacgatctaagtaatctgttaaatgagttgcatagtgcagctttggaagccatgcttcaaggagagatggatgcccatttgggttaccccaaaaatggtaagcgtagcgatgataatgcgcgtaatggcactacttcaaaaaaagtaaagaatcgctttggtcaaagcgagattaaggttccccgtgatcgtaatagtgattttgaacctgttgtagttcctaagcataaaagcacctcactatctatagagaatattgtgatctctctttatgctaaagggatgagtgtttctgatattgaagatgagctttatgagatttatggatataagctctccacatcatcgatatctattatcaccgacagagtaaaccaagaagtacttgaatggcaaaataagcctttagaatcggtctattgtgtagtttggaatggatggcattgtatttaa

SEQ ID NO: 23006 - protein, 180 aa, Unknown
  Obtained from environmental sample
  DOMAIN (13)...(180): Transposase, Mutator family
  misc_feature (1)..(180): Xaa is any amino acid
MINFITHSFIMDDLKNQFLQSGLLKGLKTEDDLSNLLNELHSAALEAMLQGEMDAHLGYPKNGKRSDDNARNGTTSKKVKNRFGQSEIKVPRDRNSDFEPVVVPKHKSTSLSIENIVISLYAKGMSVSDIEDELYEIYGYKLSTSSISIITDRVNQEVLEWQNKPLESVYCVVWNGWHCI

SEQ ID NO: 23007 - DNA, 390 bp, Unknown
  Obtained from environmental sample
  misc_feature (1)..(390): n is a, c, g, or t
atgtctcctggtattaatgatcctggaacaactattatagcgatagattatcttgcagaactttttcaaagcagaatgtataaaaatgatataagtatcttgttggaagataataaaccagtagtaaaaattagctctgtgacatttaaagagttactatattttgtaatggctccaattaggacttacgcaaagcacgacgttattatagttaataaattaattaatctatttcagcatttagcatttaatatagattgcgataataaaggctatttaacagatattgataacgaagttaaacgcttatcaatagatgctaatagtgctataagtaatcaggaggatttaaaattaataaacgacaggttaaaatcttttaatctataa

SEQ ID NO: 23008 - protein, 129 aa, Unknown
  Obtained from environmental sample
  misc_feature (1)..(129): Xaa is any amino acid
MSPGINDPGTTIIAIDYLAELFQSRMYKNDISILLEDNKPVVKISSVTFKELLYFVMAPIRTYAKHDVIIVNKLINLFQHLAFNIDCDNKGYLTDIDNEVKRLSIDANSAISNQEDLKLINDRLKSFNL

SEQ ID NO: 23009 - DNA, 321 bp, Unknown
  Obtained from environmental sample
  misc_feature (1)..(321): n is a, c, g, or t
atggttattaaagtaccaaacaccattgggtctcacgtagcaacgtatgttacagactacaaactaaaaggaaaagatacacgtgtaacatctgccgacatcagtcctgatggctctaccattatactattaaatcatgatagaatttggaaacttacaaactttaaatccgatgctttttttgatggtaatgtagagagcatctcattaaatcatgatagtcaaaaagaaggtgtttgctttataaataacacgtctatttatattacagacgaagactctggtaaagaagataataatatttataagtttaaattatag

SEQ ID NO: 23010 - protein, 106 aa, Unknown
  Obtained from environmental sample
  misc_feature (1)..(106): Xaa is any amino acid
MVIKVPNTIGSHVATYVTDYKLKGKDTRVTSADISPDGSTIILLNHDRIWKLTNFKSDAFFDGNVESISLNHDSQKEGVCFINNTSIYITDEDSGKEDNNIYKFKL

SEQ ID NO: 23011 - DNA, 867 bp, Unknown
  Obtained from environmental sample
  misc_feature (1)..(867): n is a, c, g, or t
ttggaggataaaaagattgaactttttattaagagagaagatttaattcatccttttgtttctggtaataaatttagaaaattaaaatacaatcttaaagaagccaaaaagctaaaaaagagtgctttattaacgtttggaggtgcctactctaaccatattgtagctacagcagttgcaggaaatatttctggttttaaaacttttggagttattagaggagaagaattaggggtaaatcttgaaaaaactttagaagaaaattctactttaagagaagcgcataataatggcatgaaatttcagtttgtgtctagagaagattatcgacaaaaaacttctttcggttttattgagaagttaaaaaacaaatggggcgatttttatttaatccctgaaggaggaaccaaccttttagctgtggatggttgtgaggaaattctatcaaaagaagataaaaattttaattttatttgtgctgctttaggtactggaggtacagtttctggtttgataaattctattgggaaaaaacaaaaagtacttggttttccagcattaaaaggaaattttttatccgaagaaattaaaaaatatacggttaatagaaaaaattggagtttgcagaaaaaatatcactttggtggttatgcaaaatataacgaagaattaattcgttttataaatgattttaaagaaaaaaccgatgttttattagatcctatttatactggtaaaatggtttttggtgtgttagatttaattaaaaaagatttttttgctgaaagttctaaaattttagtaattcatacaggaggcattcaaggaattgagggcatcaacagaaaattaatgggcaaagaatga

SEQ ID NO: 23012 - protein, 288 aa, Unknown
  Obtained from environmental sample
  misc_feature (1)..(288): Xaa is any amino acid
MEDKKIELFIKREDLIHPFVSGNKFRKLKYNLKEAKKLKKSALLTFGGAYSNHIVATAVAGNISGFKTFGVIRGEELGVNLEKTLEENSTLREAHNNGMKFQFVSREDYRQKTSFGFIEKLKNKWGDFYLIPEGGTNLLAVDGCEEILSKEDKNFNFICAALGTGGTVSGLINSIGKKQKVLGFPALKGNFLSEEIKKYTVNRKNWSLQKKYHFGGYAKYNEELIRFINDFKEKTDVLLDPIYTGKMVFGVLDLIKKDFFAESSKILVIHTGGIQGIEGINRKLMGKE

SEQ ID NO: 23013 - DNA, 570 bp, Unknown
  Obtained from environmental sample
  misc_feature (1)..(570): n is a, c, g, or t
ttggatatcagcattaaagaacgctcagaaaaaggaaaaaagctaactcttgaatttttagaaaatcaattgaaaacagttttaaaatcgattggaattccagaaaaaaacctttccatttctgatgtgaatgcagtgttagcaaaaactggttggtggtctgaagaaatattgtcggttgcaaattacagtttaaaagtaaatggtgcagacaaactaaaattactattcgaaaatttcaagaaacttaaaatttctgatgtcaacattgcaaaagctacacattctgatcttatcaacattaaaaagaaaaacaggattaaagcaattaaagctgctaaagaaaaagcagattatttgctaactgctattggcgaacaaacaggaaaaccaattatcatcaacgaattggcaaataataatcaagattttgcaaacgtaaattacctgaacaaacgttctaatttttctaaagtagagcttactggttatgatgtaaaaaataaaaatgtagagtttaaaacaataaaaataacatctacaatctatgtgaaatttgagattaaataa

SEQ ID NO: 23014 - protein, 189 aa, Unknown
  Obtained from environmental sample
  misc_feature (1)..(189): Xaa is any amino acid
MDISIKERSEKGKKLTLEFLENQLKTVLKSIGIPEKNLSISDVNAVLAKTGWWSEEILSVANYSLKVNGADKLKLLFENFKKLKISDVNIAKATHSDLINIKKKNRIKAIKAAKEKADYLLTAIGEQTGKPIIINELANNNQDFANVNYLNKRSNFSKVELTGYDVKNKNVEFKTIKITSTIYVKFEIK

SEQ ID NO: 23015 - DNA, 432 bp, Unknown
  Obtained from environmental sample
  misc_feature (1)..(432): n is a, c, g, or t
atgtctagcttcgattttgcctctacaattgcggtgggttccgttttagcttcaattgtcttgaatagtaattactccttaactaaaggagctctagtgcttgtaactattattggttttcaaacgttattttcgtttttagtacggaaaattaaattttttaaagacctgtttactaataaaccccaagttattatgtggaaaggagagattctttacgaccgacttaaaagttgtaatattggtaaagacgatttactggctaaattaagagaagcaaacgttcataattttaatgaagtgagagcggtgatttttgagagtacaggagacgtttctgtaattcataacaatgagaataagagtttagattcacaattattgggtgacgttaatacaataaaaaccgatgaaaagttttataataaataa

SEQ ID NO: 23016 - protein, 143 aa, Unknown
  Obtained from environmental sample
  DOMAIN (54)...(141): Protein of unknown function (DUF421)
  misc_feature (1)..(143): Xaa is any amino acid
MSSFDFASTIAVGSVLASIVLNSNYSLTKGALVLVTIIGFQTLFSFLVRKIKFFKDLFTNKPQVIMWKGEILYDRLKSCNIGKDDLLAKLREANVHNFNEVRAVIFESTGDVSVIHNNENKSLDSQLLGDVNTIKTDEKFYNK

SEQ ID NO: 23017 - DNA, 891 bp, Unknown
  Obtained from environmental sample
  misc_feature (1)..(891): n is a, c, g, or t
ttggaagaaactctacccatagcatcttttaactctaaaatgcgaagcattttatttgaagcttccgctttagattggggaaaaatatcgcccgcaatttntggttcgttatttcaaagtgtaatgaatcccgaagaaagaagaaatttaggcgcacattatacttccgaaaaaaatatttttaaactaattaaaccgctctttcttgacgatttaagggcagaattcgaaaaagtaaaatcgaactcaaagaagctaaaagaatttcattataaactttctaccttaaaatttttagatcctgcttgtggtagtggtaattttttaattattacttacagagaattacgtttgttagaaattgacgttttgcgagaactttttaaaaaaggagaacaagttttagatgtttcttctattctttggttagatgtagaccaattttacggaattgagtatgacgaatttgcagcaaaaattgccgaagttgcaatgtggttgatagaccaccaaatgaatatgttagtatctgaagaatttgggcaatactttgcacgtttaccgttaaaaaaggcggctaaaattgtacacgctgatgcactcgaagttgattggaatgagctagttcctaaagaccaactatcttacataattggtaatccgcccttcataggttctaatataatgaagaaagaacagcgaaatcaaatagtaaaattatttgaaaataaatcaggtggaggaactttagattatgttgcaggatggtacatcttggcttcaagatatattttaaaaacaaatattaaagccgcttttgtttcaactaattctattgttcaaggagaacaaacaagtttactttggggcttatacaaaaagaaatgctga

SEQ ID NO: 23018 - protein, 296 aa, Unknown
  Obtained from environmental sample
  misc_feature (1)..(296): Xaa is any amino acid
MEETLPIASFNSKMRSILFEASALDWGKISPAIXGSLFQSVMNPEERRNLGAHYTSEKNIFKLIKPLFLDDLRAEFEKVKSNSKKLKEFHYKLSTLKFLDPACGSGNFLIITYRELRLLEIDVLRELFKKGEQVLDVSSILWLDVDQFYGIEYDEFAAKIAEVAMWLIDHQMNMLVSEEFGQYFARLPLKKAAKIVHADALEVDWNELVPKDQLSYIIGNPPFIGSNIMKKEQRNQIVKLFENKSGGGTLDYVAGWYILASRYILKTNIKAAFVSTNSIVQGEQTSLLWGLYKKKC

SEQ ID NO: 23019 - DNA, 570 bp, Unknown
  Obtained from environmental sample
  misc_feature (1)..(570): n is a, c, g, or t
atgaattttttacctgacgtgtatgtcgaatgtgaaacttgccaaggtaagcgttttaatcgcgaaacattagagattagatataaaggaaaaagcataagtgatgttttagacatgaccattaatgaaggggttgacttttttgaaaacattcctaaaattcataaaaaactaaaaacaattaaagatgttggattaggttacattaccttgggacaacaaagtacaacgctatctggtggagaagctcaacgtataaaattggctacagagttaagtaaacgcgacactggtaataccttttatatattagacgaaccaactacaggtcttcattttgaagatattagagtgttaatgattgtattaaacaaattagcagacaaaggaaacacagtgttaattatagaacataatttagatgtcattaaaaccgtagatcatattattgatattggatatgaaggcggaaaaggtggtggacaagttattgtagatggtactccagaagtagttgctaagcataaaaaaagctacacagctaaatttttaaagaaagaattaaaataa

SEQ ID NO: 23020 - protein, 189 aa, Unknown
  Obtained from environmental sample
  DOMAIN (16)...(153): ABC transporter
  misc_feature (1)..(189): Xaa is any amino acid
MNFLPDVYVECETCQGKRFNRETLEIRYKGKSISDVLDMTINEGVDFFENIPKIHKKLKTIKDVGLGYITLGQQSTTLSGGEAQRIKLATELSKRDTGNTFYILDEPTTGLHFEDIRVLMIVLNKLADKGNTVLIIEHNLDVIKTVDHIIDIGYEGGKGGGQVIVDGTPEVVAKHKKSYTAKFLKKELK

SEQ ID NO: 23021 - DNA, 729 bp, Unknown
  Obtained from environmental sample
  misc_feature (1)..(729): n is a, c, g, or t
atgagccatggctgtatcggtgctaactatgtaagtgcacaaggctcaaaccgtacagatgatatttggacaacaaatgcaatggacgaaataacgaaagaacaattttcgatacgttctaaagtaattataaacgccgcaggcccttttgttgatcctattaatattactaacagtcaaactacagcacatcaccatttattttcaaaaggtattcaccttattgttgataaaattactagcagtaataaagtacttacattttttgctgacgatggcagactattcttcgtgatccctatgggacctaaaacttgtattggtacaactgatacacaagttgaaagcccacattcgcatgttactgatgaagatagaaagtttgtgttagataatgcgaacaagttactagaactggataaacagctcacaaaagacgatataatagctgaacgatgtggtgtaaggccattagcaattaaaaaagatggtaatggtaaggctgactgggtgcaattatcgcgcaaacacgcaatcgacactaactatgagaaaaaatacctttctatatttggtgggaaattaactgattgtatcaatgtcggtgatgaagttgctgagttaatcaaaaagcttggtaataaccttccttacaaggattacaaattggtacggcgaagcctgacgatactgtcaaaaatgaattttatgcctccgtgcttaagctaa

SEQ ID NO: 23022 - protein, 242 aa, Unknown
  Obtained from environmental sample
  misc_feature (1)..(242): Xaa is any amino acid
MSHGCIGANYVSAQGSNRTDDIWTTNAMDEITKEQFSIRSKVIINAAGPFVDPINITNSQTTAHHHLFSKGIHLIVDKITSSNKVLTFFADDGRLFFVIPMGPKTCIGTTDTQVESPHSHVTDEDRKFVLDNANKLLELDKQLTKDDIIAERCGVRPLAIKKDGNGKADWVQLSRKHAIDTNYEKKYLSIFGGKLTDCINVGDEVAELIKKLGNNLPYKDYKLVRRSLTILSKMNFMPPCLS

SEQ ID NO: 23023 - DNA, 828 bp, Unknown
  Obtained from environmental sample
  misc_feature (1)..(828): n is a, c, g, or t
atgatcagatcggctcgagattctccatttaatgataaaaaagttatagaaggtcaagcaacggttggtttagagattatagatcaaacggagtttcatccaatagattacgtttttgtacctattggaggtggtggtttgtcttcaggattatcctctgtttttaagttgttatcgccacatacaaaaattataggtgtggagccaaaaggggcaccttcgatgttaacatcaataagaaataataaaaacaccgagttagaagagattgatagttttgtagatggtgctgcggttaaacgtgttggtgatttaaatttcgccatttgtaaagagaccttacatcgtgtggttactgtggatgaaggtaagatttgccaaaccattttagatttatacaataaagaagcgattgtagcagaacctgcaggggttttaagtttatctgctttagagtattttaaagaagaaattaaaggtaaaaatgtagtttgtgttataagcggaagtaataatgatattacgcgtactgcagaaattaaagaacgtgcgctattacatgccgatttaaagcactattttattgttaagtttccgcaacgctctggagcattaagagattttgttgttgatattttaggtgatacagatgatattactcattttgaatacaccaaaaaagcaaaccgtgaaaacgatgttgctgtggttggaattgagttaaaatctccaaatgacttagagcctttaattacaaaaatgaagcgtcacaatttttatggagattatctaaatgataagcctgatttatttcagtttttagtgtga

SEQ ID NO: 23024 - protein, 275 aa, Unknown
  Obtained from environmental sample
  DOMAIN (1)...(170): Pyridoxal-phosphate dependent enzyme
  misc_feature (1)..(275): Xaa is any amino acid
MIRSARDSPFNDKKVIEGQATVGLEIIDQTEFHPIDYVFVPIGGGGLSSGLSSVFKLLSPHTKIIGVEPKGAPSMLTSIRNNKNTELEEIDSFVDGAAVKRVGDLNFAICKETLHRVVTVDEGKICQTILDLYNKEAIVAEPAGVLSLSALEYFKEEIKGKNVVCVISGSNNDITRTAEIKERALLHADLKHYFIVKFPQRSGALRDFVVDILGDTDDITHFEYTKKANRENDVAVVGIELKSPNDLEPLITKMKRHNFYGDYLNDKPDLFQFLV

SEQ ID NO: 23025 - DNA, 972 bp, Unknown
  Obtained from environmental sample
  misc_feature (1)..(972): n is a, c, g, or t
ttgggctattattatgtatatgttcccgaaatagctcacgatggagaatttcccgaaagagaaaattataatgatgtagttttacataatcgtttaaaagaagcaattctgcaactcaatccatctattccagaagaggcaagagaagatgcttttaaacaagtattgcgaattagctcaccagacattttggtaaataatgaagcgtttcataaaatgcttaccgaaggtgtaaaagtatcttacagaaaagatggtatttctcgaggtgatttagtgtggttagtagattttgataatgcagaaaataatgagtttgtagttgctaatcaatttacaataaaagaggatgatcaaacaaaaagacctgatgttattttgtttattaatggtttacctttagttgttatagagttaaaaaatgcagtagatgaaaatgcaactgtaaaatcagctttcaaacaattgcaaacctataaagcaacaataccaagtctatttacttataatagtttgtgtgttatttcagatggtttagaagcaaaatcaggttcattgtcagcaggtttttcacgctttatgagttggaaaacaaaagatggtgaaacgttagcttcgcatttagattctgaaatagaagtgttagcacaaggacaattaaataaaaaaacattaatagatattattaggtatttcattgtatttgaaaaatctaaaaaagaagatttaaaaacaggaattacaacaattgatacagtaaaaaaggttgcagcatatcatcaatattatgcagttaataaagctgtagaaagtagtaaaatagctgctgcagaagatggagatagaaaaggtggtgtagtatggcatacacaaggttctggtaaatcgttgtcaatggttttctatacaggtaaaattgtacaagcacttaataatccaacggtattagtaattacagatagaaatgattag

SEQ ID NO: 23026 - protein, 323 aa, Unknown
  Obtained from environmental sample
  DOMAIN (18)...(192): Type I restriction enzyme R protein N terminus (HSDR_N)
  misc_feature (1)..(323): Xaa is any amino acid
MGYYYVYVPEIAHDGEFPERENYNDVVLHNRLKEAILQLNPSIPEEAREDAFKQVLRISSPDILVNNEAFHKMLTEGVKVSYRKDGISRGDLVWLVDFDNAENNEFVVANQFTIKEDDQTKRPDVILFINGLPLVVIELKNAVDENATVKSAFKQLQTYKATIPSLFTYNSLCVISDGLEAKSGSLSAGFSRFMSWKTKDGETLASHLDSEIEVLAQGQLNKKTLIDIIRYFIVFEKSKKEDLKTGITTIDTVKKVAAYHQYYAVNKAVESSKIAAAEDGDRKGGVVWHTQGSGKSLSMVFYTGKIVQALNNPTVLVITDRND

SEQ ID NO: 23027 - DNA, 807 bp, Unknown
  Obtained from environmental sample
  misc_feature (1)..(807): n is a, c, g, or t
atggcttttttaaacgcctcttttgataaagagttagcaactatagatgagtggattgcttattttaatagtggaaaaaagagaacgattgttttagaagatatcaaatatntttattttagaaaagtaggtggttttaatgtgttgcatcaactttctaatttaatatcatcaacaaaaaatagtgttttttggattattacttctgcaaaatatgcgtttcaatatttagataaatccattcaaatttctgagctttttgcgtttaacattcaaatgttagaaatggataaagaaaccatgaaagatgcactgataaaaagacataaaattagtggttataatttacattttgagcaaccacctgttgcttatttatcaagtaaatttttaaaatcgccagaagaagttcagcaagaaattttaagagaagaattttttagtgatatcaataaaattgcacagagtaactttagaatcgcttttatgtattggattcgttctactgtaaaagtttctggaagcaccatttatatgcgttctctaaaaacaatagatacatcatttttaaataaattagcgcctgtaaagttgttgtttttaaatagtattttattgcaagaaagattgtcgcttcaagatattgtagaactgtctagtttaaatgagcaacaaacaaaaaacattgtacatgcactttttgaaaacggattgttaactatggataatgaaaaattttatatgattaacatttttttatatcgtcaaataaccacgttgttaaaaagtaaaaatgtaattcattaa

SEQ ID NO: 23028 - protein, 268 aa, Unknown
  Obtained from environmental sample
  misc_feature (1)..(268): Xaa is any amino acid
MAFLNASFDKELATIDEWIAYFNSGKKRTIVLEDIKYXYFRKVGGFNVLHQLSNLISSTKNSVFWIITSAKYAFQYLDKSIQISELFAFNIQMLEMDKETMKDALIKRHKISGYNLHFEQPPVAYLSSKFLKSPEEVQQEILREEFFSDINKIAQSNFRIAFMYWIRSTVKVSGSTIYMRSLKTIDTSFLNKLAPVKLLFLNSILLQERLSLQDIVELSSLNEQQTKNIVHALFENGLLTMDNEKFYMINIFLYRQITTLLKSKNVIH

SEQ ID NO: 23029 - DNA, 870 bp, Unknown
  Obtained from environmental sample
  misc_feature (1)..(870): n is a, c, g, or t
ttggtatttttttcatttttaaatatctttttgattttcggtagcaatttattgatttatttaattaatatttgtgctttattagtttttaaagtaactttaatagatattatgcagtctttcttcgataaagaaaaattaacttcaagtttaaaaattccaaaaggagttcaatggttttttaaaactatccatattttttcaaatagcattagtatctattttgcagcaaaattatttacaactcctatcaaatttaaaacacctttaagagaattagctatggacgaagctgcacagaaaaaaacgctgcatgtttcatcgattaaaaaagatattcatattttatcttatgggtattcggataaaaaagtgttgttaactcatggttgggcaggaagacgaactcaattatttatgattgctaatttattgctagaaaaaggttttatggtgattgcttttgatgctccttcacatggaaaatcacctggaaaaacaactaatttactagaatatatatcaagtataaaagcaataaacgaagaatttggtccttttgaagctgcaattgggcattcttttggagctatggcaattatgaacacacaagctcaaacagcaatttttaaacgattaattacagttggttctggagatacagttgaagatatcttaattaattttgcacataatttatgtttaaccacgcattttggtcatcaacttaaaaaatattttgagaagaaatggaacatcaaactccttgattatgatacgaatgaagttgcaaaaaaaataaaagttcctgttttggtaattcatgatgttttagatggagatgttgctgtaagttctcgagcgatctga

SEQ ID NO: 23030 - protein, 289 aa, Unknown
  Obtained from environmental sample
  misc_feature (1)..(289): Xaa is any amino acid
MVFFSFLNIFLIFGSNLLIYLINICALLVFKVTLIDIMQSFFDKEKLTSSLKIPKGVQWFFKTIHIFSNSISIYFAAKLFTTPIKFKTPLRELAMDEAAQKKTLHVSSIKKDIHILSYGYSDKKVLLTHGWAGRRTQLFMIANLLLEKGFMVIAFDAPSHGKSPGKTTNLLEYISSIKAINEEFGPFEAAIGHSFGAMAIMNTQAQTAIFKRLITVGSGDTVEDILINFAHNLCLTTHFGHQLKKYFEKKWNIKLLDYDTNEVAKKIKVPVLVIHDVLDGDVAVSSRAI

SEQ ID NO: 23031 - DNA, 411 bp, Unknown
  Obtained from environmental sample
  misc_feature (1)..(411): n is a, c, g, or t
atgttaaacaaaccggtagagcttttagatgatgtagaattggttttagaagaactatcgaataaatacaagctaatagtggccacaaaaggcgatttattagatcaagaacgcaaattagaaaaatcaggattgctagattattttcatcatatagaagtattaagtgataaaaaagaggctaactattcgaaattattaaatcatttagacattaatccctcagagtttttaatgattggaaattcattaaaatctgatattttaccattagtcaatatcaaatcgaatgctattcatattccatttcacaccacttggattcatgaacaagtaaaagcgtctgaaaccaatggaaaagtctataaaacaattagtaaacttaaggagttgacagatttattagtttaa

SEQ ID NO: 23032 - protein, 136 aa, Unknown
  Obtained from environmental sample
  misc_feature (1)..(136): Xaa is any amino acid
MLNKPVELLDDVELVLEELSNKYKLIVATKGDLLDQERKLEKSGLLDYFHHIEVLSDKKEANYSKLLNHLDINPSEFLMIGNSLKSDILPLVNIKSNAIHIPFHTTWIHEQVKASETNGKVYKTISKLKELTDLLV

SEQ ID NO: 23033 - DNA, 627 bp, Unknown
  Obtained from environmental sample
  misc_feature (1)..(627): n is a, c, g, or t
atggtggatggacaattaactaggcttcctgacaaccagcactatccatttgatcaaggatcaatggagtatcataattctcaatacttgagaactatgtcagacttgtacataaaaagtataagatctgggactaagcgtattgaagattacttcaaagaattagataaaatgagtgttacggatgcaaaatccctactatatacgtataatattttacttaataaaagttgggaaaatataaattatgacaatgatgattataaaaacttattgatcaaagagcttaaaacctggagttcacccattgataaatttaatgagttattggatgttagagcaacgaaggttttaccaaaaagttatcttgactggtttaaaaatgatctacgatgctcactttttatcaccaatcttatctataatgtttttaaaaactcagcttttaaaggtaaggatgagctaataacagcaattacaagttttttgccatataacattatttattttaatagccatgtaaataacgaatttggttatttcaatagagtacagataatagatgattggaaagtttcgaatttactctcgataaaatccacctatttgaaaggccgtacaccctga

SEQ ID NO: 23034 - protein, 208 aa, Unknown
  Obtained from environmental sample
  misc_feature (1)..(208): Xaa is any amino acid
MVDGQLTRLPDNQHYPFDQGSMEYHNSQYLRTMSDLYIKSIRSGTKRIEDYFKELDKMSVTDAKSLLYTYNILLNKSWENINYDNDDYKNLLIKELKTWSSPIDKFNELLDVRATKVLPKSYLDWFKNDLRCSLFITNLIYNVFKNSAFKGKDELITAITSFLPYNIIYFNSHVNNEFGYFNRVQIIDDWKVSNLLSIKSTYLKGRTP

SEQ ID NO: 23035 - DNA, 618 bp, Unknown
  Obtained from environmental sample
  misc_feature (1)..(618): n is a, c, g, or t
atggacaaaaaacaaagcaatcacatgcgtaactatggattaattggtaaagatatctcctactctttctctcaaaactatttttcaataaaatttaaagacgaaaatattactgatgctaaataccaaaattttgacattcaaaatattgaaaattttaaatcaaacatattaacaaccaaaggattatctggtcttaatgttaccatcccttataaagaaagtattattccctttttagattcattagataaaaaagcaaaaaaaattggtgctgtaaatactattaaattcactaaaaaaggacgtcttaaaggctacaatacagatatttatggtttcaaaaaaagcatcaaaccacacataaaaaaacatcataaaaaagctttaattttaggtacaggtggagccagcaaagcaattgcttatgttttaaaacaactaaacattcaatttcattttgtatcaagacagcagtcaaaagcagttagttatacctatgacacgttaacggaagctattattaatgaccatcaaatcattataaattgcccgcccgttgggacgtttcctgatgtaaatgaagccaccaaatatcccctatggtggactttctaa

SEQ ID NO: 23036 - protein, 205 aa, Unknown
  Obtained from environmental sample
  DOMAIN (25)...(205): Shikimate / quinate 5-dehydrogenase
  misc_feature (1)..(205): Xaa is any amino acid
MDKKQSNHMRNYGLIGKDISYSFSQNYFSIKFKDENITDAKYQNFDIQNIENFKSNILTTKGLSGLNVTIPYKESIIPFLDSLDKKAKKIGAVNTIKFTKKGRLKGYNTDIYGFKKSIKPHIKKHHKKALILGTGGASKAIAYVLKQLNIQFHFVSRQQSKAVSYTYDTLTEAIINDHQIIINCPPVGTFPDVNEATKYPLWWTF

SEQ ID NO: 23037 - DNA, 828 bp, Unknown
  Obtained from environmental sample
  misc_feature (1)..(828): n is a, c, g, or t
gtgcttaatgttagatctgcttatcaagaactagaagaggaagtgaaaagagttttgcttcaattaccgaaagtaaaacctgcttcttacaatggccgacctattgccatgggatgtgggatacctataaccattccattagattctcaagaaattcctagagctattcagaaacaagatacttatcaagaagttagtgtccctaacacaattgcaaaaacaatagaaaaaagagacattactgaggcaattgcaatatcaaatttccctgaacataaaagcgatttaaatataccattaacgcatcaaacatataatgaattaagtttttattttgataaaaatgaaaatagccataccggttttaaaccttatcaatacagtgaagcaactaaatatgttgatctagatgcacagaaaaccgcgttgttaaaagataaaaaatcttgggctggaagaaaattctggaatgaacatctttttaaagttcaggaaaaagatttttggttcacagtgaatcctatttttgaccttcaaatagggaaagacaattctgataatattgactatacttataacaacacaagagcggttcaaatacaaggtggattaggtaaaaacctcaatttctcaacttctttttatgaaagccagggacgattttctaattacgtaacccaatttattagagaaaatattcctttaggggcatctggaacagttcctggtagaggaaaagggaaaggacttcaaaaaggtggatttgattaccctgtggcagaagcttatctttcatattctccaaataagttctttaatttcaattga

SEQ ID NO: 23038 - protein, 275 aa, Unknown
  Obtained from environmental sample
  misc_feature (1)..(275): Xaa is any amino acid
MLNVRSAYQELEEEVKRVLLQLPKVKPASYNGRPIAMGCGIPITIPLDSQEIPRAIQKQDTYQEVSVPNTIAKTIEKRDITEAIAISNFPEHKSDLNIPLTHQTYNELSFYFDKNENSHTGFKPYQYSEATKYVDLDAQKTALLKDKKSWAGRKFWNEHLFKVQEKDFWFTVNPIFDLQIGKDNSDNIDYTYNNTRAVQIQGGLGKNLNFSTSFYESQGRFSNYVTQFIRENIPLGASGTVPGRGKGKGLQKGGFDYPVAEAYLSYSPNKFFNFN

SEQ ID NO: 23039 - DNA, 921 bp, Unknown
  Obtained from environmental sample
  misc_feature (1)..(921): n is a, c, g, or t
atgccgtcgaaaagagattcgcctccgaccccaagggtggaaccaaagataatcgtaaacgtgattctaaccgaaaattccatcgaaattctggacaacggatgtggcttgagggaagcggagtttagggctttccttgctccaagtatttcatttaaatctggtggagatactcgtggaaacaagggtgttggggtgacctacattgcttacggtttcaacgatcttaccatccgaacaaaaaacgaatatttttcataccagggagttatgcgcagggggcgagaatggattgaagatcattctggaactgtatcccgcccactcattgagccagccaagaccgaaagcccaaatttcgacacgctagatcaaggcacgagcttcaagattaagttctccggaacacacgttcgaccaagcgatctgggctggtatcaggcaagaaccgcagaacagtggttatacattcttcttctgaagactccattgggaagcataaagttacctggctgcacggcttcgaacattaaatttgatctcaatgttacagacaagactggcgacgttacaaacgtcacggatcatgaggctaagtacaagtttcctcatcaagaaatcaaggcaagtcaacaccttggaaaagtcattgatgtgcagaggaaggctattgaggcggggaaagatccttccaaagcgatcatcaaatttcgcaactcaaacggagtctacgaagcgtatgcttacgaggacgtgttgaaaatttccggcttaacaacggatgaagttgatctggccaaaaagcataatgtaacagcttatggctatttcacctactccgtcgaagtctgggatcaattaaacgataataaggctaagctccggaagggtctccggattattcggggtggttgcaaatag

SEQ ID NO: 23040 - protein, 306 aa, Unknown
  Obtained from environmental sample
  misc_feature (1)..(306): Xaa is any amino acid
MPSKRDSPPTPRVEPKIIVNVILTENSIEILDNGCGLREAEFRAFLAPSISFKSGGDTRGNKGVGVTYIAYGFNDLTIRTKNEYFSYQGVMRRGREWIEDHSGTVSRPLIEPAKTESPNFDTLDQGTSFKIKFSGTHVRPSDLGWYQARTAEQWLYILLLKTPLGSIKLPGCTASNIKFDLNVTDKTGDVTNVTDHEAKYKFPHQEIKASQHLGKVIDVQRKAIEAGKDPSKAIIKFRNSNGVYEAYAYEDVLKISGLTTDEVDLAKKHNVTAYGYFTYSVEVWDQLNDNKAKLRKGLRIIRGGCK

SEQ ID NO: 23041 - DNA, 477 bp, Unknown
  Obtained from environmental sample
  misc_feature (1)..(477): n is a, c, g, or t
atgcggtctgttataaaacaagctagtcgtattggtatccaaaatgttgtaaaacagcaatttgaaattgcaaaagaggtaataaattcagggctaatgcctattattgagcctgaagttgatatttattgcgaagaaaagcaatctgcagaactcatgttgcatgatgtaattattgaagagctgaataaccttgaagatggacagcaagtaatattaaaactcacgttacctgaagtgcctaatttatataaagatcttgcaacacacccaaaagttttaaaattagttgctctatctggtggttactctattacacaagccaatgaaaagctaaaaagaaatactggtattattgctagtttttcaagagcattattgattggcctacatcatgacatgtctgataaaaagtttgatgaaaaattaaataattctatagaagccatttatgaagcttcaatatataaattataa

SEQ ID NO: 23042 - protein, 158 aa, Unknown
  Obtained from environmental sample
  misc_feature (1)..(158): Xaa is any amino acid
MRSVIKQASRIGIQNVVKQQFEIAKEVINSGLMPIIEPEVDIYCEEKQSAELMLHDVIIEELNNLEDGQQVILKLTLPEVPNLYKDLATHPKVLKLVALSGGYSITQANEKLKRNTGIIASFSRALLIGLHHDMSDKKFDEKLNNSIEAIYEASIYKL

SEQ ID NO: 23043 - DNA, 555 bp, Unknown
  Obtained from environmental sample
  misc_feature (1)..(555): n is a, c, g, or t
atgaaatttatagaccgttttttaaggaattggagaattaaaatggttaagccatatattagagctaatgatagtgttttagatattggctgctttgatgaaactctatttgagaaattgaaaacaaaaccaattttatcgagtattggtatagacccattattaactcaaactatagaaggtgaaaattatacattgttaccaggtaagtttccagataacctaaagaagaaacatacctttgatagtataactatgcttgctgttttagaacatattcctacggatgagcaaattcagctaagagataattgttgccaatacttaaataatgcaggtagaataattattacggttccttctccttttgtagatcatattctttgggttttgactaagttaaaacttatagatggtatgtctttagaggaacattatggctttaaggtggaagatgtcccaataatatttaatttagaacaactaagacttatcaaacataagaggttccaattaggcttaaataatttattcgtttttgaaaaaataggataa

SEQ ID NO: 23044 - protein, 184 aa, Unknown
  Obtained from environmental sample
  misc_feature (1)..(184): Xaa is any amino acid
MKFIDRFLRNWRIKMVKPYIRANDSVLDIGCFDETLFEKLKTKPILSSIGIDPLLTQTIEGENYTLLPGKFPDNLKKKHTFDSITMLAVLEHIPTDEQIQLRDNCCQYLNNAGRIIITVPSPFVDHILWVLTKLKLIDGMSLEEHYGFKVEDVPIIFNLEQLRLIKHKRFQLGLNNLFVFEKIG

SEQ ID NO: 23045 - DNA, 780 bp, Unknown
  Obtained from environmental sample
  misc_feature (1)..(780): n is a, c, g, or t
ttgggggaaatggggtcccttcgtcaaatatttcaaggtggcctttggaaaacagaaccggaagccattaagaaagatttagggcgcttttgtttcttcgtttacgtgggcaaagctcattttattcaaaagtttgaaatggaacataccatggaagaagcaagggtaaataaaggttatcataaattaaagaaaagcatttctgaaacctatcaaaaagcatggaaaaaagggcaaactggttttcctttgatagatgctagcatgcgttgtttgaatgaaactggatatttaaattttagaatgcgagctatgttagtttcgtttttcacacatattttatggcaaccttggcaagatgcaacacaccatttatcgcaacattttttagattttgaaccaggaattcattttcctcaattacaaatgcaagcctcagaaactggcacaaatactatcagaatttatagtccgttaaaaaatagtattgagcatgatacagatgcaaatttcataaaaaaatgggttccagaattggcgaaattatcaacaggttttattcatgaaccgtatttaatgacacctttagatcagcaatttgcaaattttgaattgggtgtaaattatccaaaaccaattgtagatattaaaatctcaagaaaaaaagctagcgatattttgtacaacatgcgtaaagacccagaggtaattatggaaactagaagaatcttaaaaaagcacacactttctgatagaaataaaatgttagaaaacgaataa

SEQ ID NO: 23046 - protein, 259 aa, Unknown
  Obtained from environmental sample
  DOMAIN (2)...(231): FAD binding domain of DNA photolyase
  misc_feature (1)..(259): Xaa is any amino acid
MGEMGSLRQIFQGGLWKTEPEAIKKDLGRFCFFVYVGKAHFIQKFEMEHTMEEARVNKGYHKLKKSISETYQKAWKKGQTGFPLIDASMRCLNETGYLNFRMRAMLVSFFTHILWQPWQDATHHLSQHFLDFEPGIHFPQLQMQASETGTNTIRIYSPLKNSIEHDTDANFIKKWVPELAKLSTGFIHEPYLMTPLDQQFANFELGVNYPKPIVDIKISRKKASDILYNMRKDPEVIMETRRILKKHTLSDRNKMLENE

SEQ ID NO: 23047 - DNA, 477 bp, Unknown
  Obtained from environmental sample
  misc_feature (1)..(477): n is a, c, g, or t
atgatggatttatcaaaaataaaattagtggtttctgatatggatggcactttactaaactcaaaaggtaaaatatccaaccaattttttgaactttttaaaaaactacaagaaaataacataactttttgtgctgcaagtggcagacaacacaatagcatagtctctaaattagatattataaaagatgatatttatgtaattgcagaaaatggaggtgttgcaaaaaaaggcgaaaatgttttactttctaacttcttaaaacctgagaaagtaattaatttaattccagctttaagaaatattcaagacgcaaatattgttttatgttgtgatggagctgcttttatagaaagtaaagatgaaattttcatgaatctatttcaagaatattacagtagttttcaacaagttgatgatttaatggaaattgcaaaatctattcctgtttttaaaattgcagtgtatccattttga

SEQ ID NO: 23048 - protein, 158 aa, Unknown
  Obtained from environmental sample
  misc_feature (1)..(158): Xaa is any amino acid
MMDLSKIKLVVSDMDGTLLNSKGKISNQFFELFKKLQENNITFCAASGRQHNSIVSKLDIIKDDIYVIAENGGVAKKGENVLLSNFLKPEKVINLIPALRNIQDANIVLCCDGAAFIESKDEIFMNLFQEYYSSFQQVDDLMEIAKSIPVFKIAVYPF

SEQ ID NO: 23049 - DNA, 639 bp, Unknown
  Obtained from environmental sample
  misc_feature (1)..(639): n is a, c, g, or t
gtggatgatagtcttgcgcatggtattggaacaccggcgattaatgggtttattccaaaaggattaccctcgtttaataattttaaaggttattcgtatcaacctgttaaagctatggagtatatcagtttatacaaaagcgaaacaggaaatttaaatcctgaaataacaattaccaccaatagtcagtatgtagatttatgcgaatatatacaacgtgaacttgaaaaaattggtttaattgttcatgtagatgttgtaccaccggctactttaagacaatcaaaggcaagtggtaaacttccaatatttagagcaagttgggtagctgattatcctgatgcagaaaattacctatcattattttatagtaaaaattttgtaccaaatggacctaattatatgcactataagaatgaggaatttgacaaattatatgaaaaagtatttgttactactgataatgatggaaggtataaattataccaacaaatggatagtttaattatcaatgatgccccgattgtaccgttgtattatgatcaatttgtacgatttagtcaaaaaaatataagaggattaagtaccaatccaattaatttattaaatctaaaaaaagtttctaaaattctagagtag

SEQ ID NO: 23050 - protein, 212 aa, Unknown
  Obtained from environmental sample
  misc_feature (1)..(212): Xaa is any amino acid
MDDSLAHGIGTPAINGFIPKGLPSFNNFKGYSYQPVKAMEYISLYKSETGNLNPEITITTNSQYVDLCEYIQRELEKIGLIVHVDVVPPATLRQSKASGKLPIFRASWVADYPDAENYLSLFYSKNFVPNGPNYMHYKNEEFDKLYEKVFVTTDNDGRYKLYQQMDSLIINDAPIVPLYYDQFVRFSQKNIRGLSTNPINLLNLKKVSKILE

SEQ ID NO: 23051 - DNA, 378 bp, Unknown
  Obtained from environmental sample
  misc_feature (1)..(378): n is a, c, g, or t
gtgggggtcccgaataaaaattttttgggacataaagattctgaaaggttgattaaaagactgcgaattctttttaaaaatcatcaaaaacagattgacacgctaaacgctcacatacagaattgtaaatataaaattattttggccggtgatttgaacaataccgcctactcctgggattataaaaatattaaaaataaattacaagatacttttttagaagttggtaaaggatttggaaagacatacgagtttaaaagattccctttgcggattgattatatttttgttgatgaaaatattagagtaattgatcataaaaacctaaagcaacagttttctgatcattatcctattgtagctactctagaattttag

SEQ ID NO: 23052 - protein, 125 aa, Unknown
  Obtained from environmental sample
  misc_feature (1)..(125): Xaa is any amino acid
MGVPNKNFLGHKDSERLIKRLRILFKNHQKQIDTLNAHIQNCKYKIILAGDLNNTAYSWDYKNIKNKLQDTFLEVGKGFGKTYEFKRFPLRIDYIFVDENIRVIDHKNLKQQFSDHYPIVATLEF

SEQ ID NO: 23053 - DNA, 780 bp, Unknown
  Obtained from environmental sample
  misc_feature (1)..(780): n is a, c, g, or t
ttgttactaatttatatcgtttttaaattcaccattcaaaaaggactacaaaccagcttattagaatctaaaattaaatataaagtagctcattggattcaagaagtagccagaacaataatcagttttaaactttctggcaaaactgatttggctatgactaaaaacgattatttggttgataaatatctgcaagcgagagaaaatcactttaaaatattaatcatgcaatttacgcaaatgattggttttaaagttattgttactgcaagtttacttttaattggtggtattttagtattgaatcaacaaatgaatattgggcaatttgttgctgcagaaattgtaatcttattagtaattacctctgtagaaaaattgattgttgggttagaatctttttatgatgtgttaacatccatcgaaaaaataggacaagttgtagataaagagttggaatctcaagaaggtgaaaaccctacttttaaagatggtttatctattgaattagaaaaagttacctataatgtaaatgaaaaacctacaccaatcatcaataatatttctttaaagatagaagataaaagtagaattttaattactggagaaagtggttctggaaaatcgagtttattacgttttattgcaggaattatagagcctacagaaggaaatatttatatcaataatttaccattaaaaagcttaaaatttaatcattatagatcccaattggttttatcttttacccgaagaaacaccattttgaagtacctttaa

SEQ ID NO: 23054 - protein, 259 aa, Unknown
  Obtained from environmental sample
  misc_feature (1)..(259): Xaa is any amino acid
MLLIYIVFKFTIQKGLQTSLLESKIKYKVAHWIQEVARTIISFKLSGKTDLAMTKNDYLVDKYLQARENHFKILIMQFTQMIGFKVIVTASLLLIGGILVLNQQMNIGQFVAAEIVILLVITSVEKLIVGLESFYDVLTSIEKIGQVVDKELESQEGENPTFKDGLSIELEKVTYNVNEKPTPIINNISLKIEDKSRILITGESGSGKSSLLRFIAGIIEPTEGNIYINNLPLKSLKFNHYRSQLVLSFTRRNTILKYL

SEQ ID NO: 23055 - DNA, 411 bp, Unknown
  Obtained from environmental sample
  misc_feature (1)..(411): n is a, c, g, or t
atgaaatcaataaaatttatattagtactatttataacggtatcaatttttagttgtaatagtcagcaaaaaaaaacgactgatgcaaatgcaatagttcaagttgtttctaccgaagtatttgaaaaggtatcggattcagttcagttaattgatattagaactcctgaagaatacaatgaaggctatattaaaaatgcgataaatatcaatttttttgatgatgattttatggagcaaatgtcgaagttaaacaaagatgaagcaatctatatttattgtcatagtggtggcagaagcggtagtgcttctgataaactagaagaggcaggatttacaaaagtgtatgatttgggtgtaggtatgaaaggttggaaaaaagcagaaaaggccgtaacacaggataaataa

SEQ ID NO: 23056 - protein, 136 aa, Unknown
  Obtained from environmental sample
  SIGNAL (1)...(18)
  DOMAIN (37)...(128): Rhodanese-like domain
  misc_feature (1)..(136): Xaa is any amino acid
MKSIKFILVLFITVSIFSCNSQQKKTTDANAIVQVVSTEVFEKVSDSVQLIDIRTPEEYNEGYIKNAININFFDDDFMEQMSKLNKDEAIYIYCHSGGRSGSASDKLEEAGFTKVYDLGVGMKGWKKAEKAVTQDK

SEQ ID NO: 23057 - DNA, 735 bp, Unknown
  Obtained from environmental sample
  misc_feature (1)..(735): n is a, c, g, or t
atgaatttaaccacgatcatcgtagaagacgaaaaaacaagtagagatattctcaaaaactatttggcaaaatattgccctaatgtgacggttgtaggtgaggctgaaaatattgaagaggcattggtattgattagaaacaatgacttagacttagtgtttttagatgtagaaatgccttatggtagtggatttgatttgttagataaattgagcaatatttcttttgaaactatttttgtaactgcttatgaccattatgcaatcgacgccttaaatcagcatgcatcttactatttgctgaaaccaatttctattgatgacctgattaaagccgtagattttatcgtagaaattaagaaaaaagaaaacgaattacagcacgcagttttaaaaccaaagattacagcagttgaagataaaattacgattccgacccaacaaggtttcgaagttttggagctgaaaaatattttgtatggcaaagccgatgataattatacccagttatttttagctgataacaagataaagttggtgagcaaaaccttaaagtattttgaaaatattttatcggagaatggttttgtcagaattcataagtcttatttagtcaatgtcaattttattaaaacatataaaaaaggtaaaggtggtacgattgaattgcaaaacggaaaagagctctcagttgctccgtcaaaaaaagcaaccttactgtcttattttagttga

SEQ ID NO: 23058 - protein, 244 aa, Unknown
  Obtained from environmental sample
  DOMAIN (148)...(244): LytTr DNA-binding domain
  misc_feature (1)..(244): Xaa is any amino acid
MNLTTIIVEDEKTSRDILKNYLAKYCPNVTVVGEAENIEEALVLIRNNDLDLVFLDVEMPYGSGFDLLDKLSNISFETIFVTAYDHYAIDALNQHASYYLLKPISIDDLIKAVDFIVEIKKKENELQHAVLKPKITAVEDKITIPTQQGFEVLELKNILYGKADDNYTQLFLADNKIKLVSKTLKYFENILSENGFVRIHKSYLVNVNFIKTYKKGKGGTIELQNGKELSVAPSKKATLLSYFS

SEQ ID NO: 23059 - DNA, 621 bp, Unknown
  Obtained from environmental sample
  misc_feature (1)..(621): n is a, c, g, or t
atgagtgatgcaacttcaagcctgacccattactgcgagttaaccatcatccctgaccctgatattgcgccctactttatctggagtaagctatttacccagctacacattgcgctagctgaaatgaagaataaacatgacatcgaatccatcggtgtcagcttccctgattatcattatgatgataaaaaggagaagtcatctaagctgggagtaaagcttcgcgtctttgcctctaaccaaaaagatttagaaacgctaaatcttgataactggctatcgcggcttactgactacgtgcatatcaaaggcatcaaagacgtgcctatagataaaataacgggctacgtgagtgtacaccgctatcgttttaaaccgatagaggtacaagtagaatctctagccaaaaaaatggagattagcaatgacgaggcaatggcgatagttgttaaacgcaaagctgaattaaagctgccttttatcagaatgtttagtgaaagcaataaagcccattatccattgcaaattttacaacaacctagtaaacaggacgtaactggtggttttaatgtatacggtatgaatggcatgcgccataacgttactgtgccgcagtggtag

SEQ ID NO: 23060 - protein, 206 aa, Unknown
  Obtained from environmental sample
  misc_feature (1)..(206): Xaa is any amino acid
MSDATSSLTHYCELTIIPDPDIAPYFIWSKLFTQLHIALAEMKNKHDIESIGVSFPDYHYDDKKEKSSKLGVKLRVFASNQKDLETLNLDNWLSRLTDYVHIKGIKDVPIDKITGYVSVHRYRFKPIEVQVESLAKKMEISNDEAMAIVVKRKAELKLPFIRMFSESNKAHYPLQILQQPSKQDVTGGFNVYGMNGMRHNVTVPQW

SEQ ID NO: 23061 - DNA, 621 bp, Unknown
  Obtained from environmental sample
  misc_feature (1)..(621): n is a, c, g, or t
ttggggtttgctagagcggttttaaagaagtctaattcaaattcgtcaatattgaatagcaagcgcagcagaaaattaatgcttttcacgctgaaaaaccttatgttacataaaaattacagacaaataatgcagttaagtgatatgaaaattggtttagtgttatctggtggaggcatgcggggtgctgcacatattggggtcatacgggcgctggaagaacatcagatttatcctacgcatattgccgggtctagtgctggtgcgattgtgggggcgttatatgcctatggatatcaatggaatgacatactggcgttttttaaagaagttcaattattgggtattacaaaatatgccattaacaaacccggatttctcgatgctgaaaaattttatgatgaattcaaggtctatttgaaggaagatgatttttcagttttgaaaaagaaattatacatcacagccaccaacatcttgaacggcaaactcaaaatattcgaaaagggcggattgattaaaccctgttttggcatctgctgcttttcctggtttggttgcaccagtaaaaatagaaggtccttattaatagatgggggaactcctaataatttcccttag

SEQ ID NO: 23062 - protein, 206 aa, Unknown
  Obtained from environmental sample
  DOMAIN (53)...(206): Patatin-like phospholipase
  misc_feature (1)..(206): Xaa is any amino acid
MGFARAVLKKSNSNSSILNSKRSRKLMLFTLKNLMLHKNYRQIMQLSDMKIGLVLSGGGMRGAAHIGVIRALEEHQIYPTHIAGSSAGAIVGALYAYGYQWNDILAFFKEVQLLGITKYAINKPGFLDAEKFYDEFKVYLKEDDFSVLKKKLYITATNILNGKLKIFEKGGLIKPCFGICCFSWFGCTSKNRRSLLIDGGTPNNFP

SEQ ID NO: 23063 - DNA, 924 bp, Unknown
  Obtained from environmental sample
  misc_feature (1)..(924): n is a, c, g, or t
ttggttgatggctcgagcagcaagaatacttcacgggcaaaaagatattttcatcaatctttggagtatatgttggctttatcctttaaagaaggattggctgctgtatacaacaatctcggagaggtttataaactggaaggaaatatatctaaagctattgagtttcatacgctttctcttgatctagaaaaagaatttgataacaagccggggataggtttaagctatcttaatattgcgtccttgtttaggattatagatcaacctaagatagccattgacaactatcttgaaagtataaactattttaaagccgtaaatgatctaggtggtttgcaaaaagcatacaatgacctagctactgcgtatgcagaaacggaagattttaaaaagtcgctcgaatattttcaattgcatgcagatataaaggatactctgatttcaatagaaacaaaccgccagatagctcagcttcaaacagagtatgaatcagaaaagcaaaaacaagaaatagagttactcaacgagacgtctgttttgcaattagcacagcttgagcaagaaaagaaaacacgacaattactttttgtcatcctttcactgctgataatcattgctataattcttcatatcagcgatcgctctaaaagaaaaaccaatcaaattcttattaataaaaataaagagatagaagaatcagcggcattaaaaattcagtttctatctgttatgagtcatgaaatacgaactcctatgaatgctgttgtgggaatgactaatcttttattaactgagaacccaagagaagatcaaaaaacatatctagacactctttctttttcttccaataatctactctcaattgtcaatgatgtgcttgattattctaaagcagaagccaataggataaactggaaataa

SEQ ID NO: 23064 - protein, 307 aa, Unknown
  Obtained from environmental sample
  DOMAIN (34)...(67): TPR Domain
  misc_feature (1)..(307): Xaa is any amino acid
MVDGSSSKNTSRAKRYFHQSLEYMLALSFKEGLAAVYNNLGEVYKLEGNISKAIEFHTLSLDLEKEFDNKPGIGLSYLNIASLFRIIDQPKIAIDNYLESINYFKAVNDLGGLQKAYNDLATAYAETEDFKKSLEYFQLHADIKDTLISIETNRQIAQLQTEYESEKQKQEIELLNETSVLQLAQLEQEKKTRQLLFVILSLLIIIAIILHISDRSKRKTNQILINKNKEIEESAALKIQFLSVMSHEIRTPMNAVVGMTNLLLTENPREDQKTYLDTLSFSSNNLLSIVNDVLDYSKAEANRINWK

SEQ ID NO: 23065 - DNA, 483 bp, Unknown
  Obtained from environmental sample
  misc_feature (1)..(483): n is a, c, g, or t
atggatcagatcggctcgagatataatgtgttggctcatttgggacacggtggtggttcgactgaaattaaaactatagctaacccaacaaatctgactttagcaaaaccaaatgaaattagaaaaacagtaaatggagaggctttaggttatgttgacaaatcgaatgcttacacgaaaaagattgatttttatggaattcaagtattctcatctttcaaataccaaaacaaagagttatttatagttcatctttctgacttaacttttcttgcggaaattaaaggcaacgaaattgagatagtgaaccctttatttcttagtgatttatacacacacgacccaattaccaaacaatatggaaattacattttaatgaatttagaccattatggaacagggctttatagagaaatttctgttttgataatagacggaaataaaataacaaaagtggactggaatgaaaatcacagccgctaa

SEQ ID NO: 23066 - protein, 160 aa, Unknown
  Obtained from environmental sample
  misc_feature (1)..(160): Xaa is any amino acid
MDQIGSRYNVLAHLGHGGGSTEIKTIANPTNLTLAKPNEIRKTVNGEALGYVDKSNAYTKKIDFYGIQVFSSFKYQNKELFIVHLSDLTFLAEIKGNEIEIVNPLFLSDLYTHDPITKQYGNYILMNLDHYGTGLYREISVLIIDGNKITKVDWNENHSR

SEQ ID NO: 23067 - DNA, 303 bp, Unknown
  Obtained from environmental sample
  misc_feature (1)..(303): n is a, c, g, or t
atgcataacttcaaaaaaataaaaatttggaatgaaagtatggaattagtttcagagtcttataaaataactcgaggttttccaaaatttgaaacttatggattaatgagtcaaatgaatagatgtgctgtttctattccttctaatatatctgaaggaagtagcaaaagttcaaataaacattttgcaaattatttagagcacagtttaggttcggcatttgaatgggaaacacaactgaatgtcgcttttaatgaaagttatatttcagaagaaaatttaaagaatttagaaacaaaataa

SEQ ID NO: 23068 - protein, 100 aa, Unknown
  Obtained from environmental sample
  DOMAIN (2)...(97): S23 ribosomal protein
  misc_feature (1)..(100): Xaa is any amino acid
MHNFKKIKIWNESMELVSESYKITRGFPKFETYGLMSQMNRCAVSIPSNISEGSSKSSNKHFANYLEHSLGSAFEWETQLNVAFNESYISEENLKNLETK

SEQ ID NO: 23069 - DNA, 576 bp, Unknown
  Obtained from environmental sample
  misc_feature (1)..(576): n is a, c, g, or t
ttggctgtttacggtgttggtacgtcacccatttttaaacagacgttacaagcacacaataaccgttttaaattagtgcaaaaagagtctggtgttggaccaagtgatcacactagtttttataattctgacatacctgttttacacttttttacaggtcagcatgaagattatcataaaccatcagacgatacagagcgtttacattttaatggtatgcaaatcatttcaaattatatttttgaaatcataacagatttagataacaacgggaaactaccctttagaaaaactaaaaacgaaagcgatgaagtgccacgttttaaagtaggacttggtgtaataccagattatttatttgacggaaaaggcatgcgaattgatggtataagcgaagataaaccagcacaaaaagcgaaccttaaaaaaggtgatattgttgttaaacttggcgatagtacagtttttgatatgatgagttacatgaaggtattagcaacttttaaagaaggtgataaaacaaatataacagtagacagacaaggcacaatggttgatgctgaaatacaattttaa

SEQ ID NO: 23070 - protein, 191 aa, Unknown
  Obtained from environmental sample
  misc_feature (1)..(191): Xaa is any amino acid
MAVYGVGTSPIFKQTLQAHNNRFKLVQKESGVGPSDHTSFYNSDIPVLHFFTGQHEDYHKPSDDTERLHFNGMQIISNYIFEIITDLDNNGKLPFRKTKNESDEVPRFKVGLGVIPDYLFDGKGMRIDGISEDKPAQKANLKKGDIVVKLGDSTVFDMMSYMKVLATFKEGDKTNITVDRQGTMVDAEIQF

SEQ ID NO: 23071 - DNA, 495 bp, Unknown
  Obtained from environmental sample
  misc_feature (1)..(495): n is a, c, g, or t
atgcaggtaaatgccagcacaactatatctcctaatataggtaaagatatatcaagtattattgattcagaggtcaatataggggatgatatttttttcaagggtgggatgtttaggtttcaagggtttggattcaaaatttgtgcgtcttggggagatcaagctggaggttgtaaaggtggaattatttttcaagatccagatttttctgtatcagttaatggtaaagagataaattcgttggatatagaagctttaggtattaaagaaaagtatagtcaggacactccaattgaagtagtttataatcctttaaaatcgaaagaaaaaataaaattgatgtcaacacctagaaaaattttgtttaaaaacaataaaacaggagaagttataacattagcttcagtaattgaaattaaaatgtcttgtggtgaaagtcagaaaactaaagcttcaacttattcaaaaaaagctatacagatgaagagaaactaa

SEQ ID NO: 23072 - protein, 164 aa, Unknown
  Obtained from environmental sample
  misc_feature (1)..(164): Xaa is any amino acid
MQVNASTTISPNIGKDISSIIDSEVNIGDDIFFKGGMFRFQGFGFKICASWGDQAGGCKGGIIFQDPDFSVSVNGKEINSLDIEALGIKEKYSQDTPIEVVYNPLKSKEKIKLMSTPRKILFKNNKTGEVITLASVIEIKMSCGESQKTKASTYSKKAIQMKRN

SEQ ID NO: 23073 - DNA, 762 bp, Unknown
  Obtained from environmental sample
  misc_feature (1)..(762): n is a, c, g, or t
ttgccccacgtaagcgtgagttgcggcgtgagcaatgtttcctttagtttcagggggaatgatcccgttcgtgaggcaatgcattccgtgtttttataccacgctattcaggcgggaatgaatatgggcattgtaaatcctgctatgttggagatttacgataatattccaaaagatttgctggaacgtgttgaagacgtaatgtttgaccgccgtgaagatgcaacggagcgattattggattttgcggaaaccgtaaaaggaactacaaaagaaagcaaaattgacctttcttggcgagaagaacctttgcaaaaccgtattactagagcgttggtaaagggaattgatgaatttattttggaggatattgaggaagcacgacaaaaagccgataaaccaattgaagtaatagaaggtaatttaatgattggaatgaacgtggttggcgacctctttggaagcggaaaaatgtttcttccacaagtggtgaaatcggctcgtgtgatgaaaaaagcggtcgcttatctacttccttatattgaagaagaaaagctaaaaaaccctcaaattggtgattccaaaaatgctggaaaaatattgatggcaactgtaaaaggtgacgttcacgatatcgggaaaaacattgtcggtgtggttttggcgtgcaataattatgaaataatcgatttgggagtaatggttcctccggaaaaaattattgcaaccgcaaaagaagaaaacgttgatgccattggttga

SEQ ID NO: 23074 - protein, 253 aa, Unknown
  Obtained from environmental sample
  DOMAIN (100)...(187): B12 binding domain
  misc_feature (1)..(253): Xaa is any amino acid
MPHVSVSCGVSNVSFSFRGNDPVREAMHSVFLYHAIQAGMNMGIVNPAMLEIYDNIPKDLLERVEDVMFDRREDATERLLDFAETVKGTTKESKIDLSWREEPLQNRITRALVKGIDEFILEDIEEARQKADKPIEVIEGNLMIGMNVVGDLFGSGKMFLPQVVKSARVMKKAVAYLLPYIEEEKLKNPQIGDSKNAGKILMATVKGDVHDIGKNIVGVVLACNNYEIIDLGVMVPPEKIIATAKEENVDAIG

SEQ ID NO: 23075 - DNA, 468 bp, Unknown
  Obtained from environmental sample
  misc_feature (1)..(468): n is a, c, g, or t
ttgaaaaaagatgttcaacataagaagatactttatgtttcaaaatatcttaataatagagaattcacttttccaaaaataaatggcagcatctattatgctcattttataggtgatttcgaatctttcagaaagcttaggtgctatgtggacaaagaaagtttttctttgaacgatgaagaacaaactgtaaaaatatacaatcaatatgaccaaaatattgccttggataaaatgcaatttgcgatcgcttttttgaatgacgccaagcagtttaaagagcttgtcccaattaaaatattgcccaggaataataaatcattaaccctaaaatcaaatgatacaacattttttacctttaagttaccaaaaccaaaaaaaataacgtcgccgggatattttaaaattgtaatttcagaaaacggattacggcacggactgaacagtgcaacgtttaaactaaactaa

SEQ ID NO: 23076 - protein, 155 aa, Unknown
  Obtained from environmental sample
  misc_feature (1)..(155): Xaa is any amino acid
MKKDVQHKKILYVSKYLNNREFTFPKINGSIYYAHFIGDFESFRKLRCYVDKESFSLNDEEQTVKIYNQYDQNIALDKMQFAIAFLNDAKQFKELVPIKILPRNNKSLTLKSNDTTFFTFKLPKPKKITSPGYFKIVISENGLRHGLNSATFKLN

SEQ ID NO: 23077 - DNA, 648 bp, Unknown
  Obtained from environmental sample
  misc_feature (1)..(648): n is a, c, g, or t
atgtcgagcagtttggtcattatccctacctacaatgagattgaaaacgttgatgcgatcataagggcagtctttgagttgcagaaagattttcatgtactagtcgtagatgataattcgcctgatgggactgccgatcatgttattacgatgcaaaaagaattccaggatcaattatttttagaggttcggaaaggcaaatccggattgggtacggcctatatacatggatttaaatgggcgattgcacgagaatacgactacatctttgagatggatgccgatttctcccataatccaacagacctattgcgcttgcgaaaggcttgcgaaaacggggcagatgtagtagtgggttcgcgttataaaaagggtgttaatgtcgtaaattggcccttgtatcgagttttactttcttacggggcatcattttacgtaaaaataattacagggatgcgggtacacgaccccactgctggttttgtttgttataaaagatatgtgctggaaaatataaaccttgattctataaggtttattggctatgcttttcaaattgaaatgaaatttagggcttatctaaaaaagtataagattgaggaaatttcgattattttccgagatagggtcaagggaaatccaaaatga

SEQ ID NO: 23078 - protein, 215 aa, Unknown
  Obtained from environmental sample
  DOMAIN (5)...(173): Glycosyl transferase
  misc_feature (1)..(215): Xaa is any amino acid
MSSSLVIIPTYNEIENVDAIIRAVFELQKDFHVLVVDDNSPDGTADHVITMQKEFQDQLFLEVRKGKSGLGTAYIHGFKWAIAREYDYIFEMDADFSHNPTDLLRLRKACENGADVVVGSRYKKGVNVVNWPLYRVLLSYGASFYVKIITGMRVHDPTAGFVCYKRYVLENINLDSIRFIGYAFQIEMKFRAYLKKYKIEEISIIFRDRVKGNPK

SEQ ID NO: 23079 - DNA, 621 bp, Unknown
  Obtained from environmental sample
  misc_feature (1)..(621): n is a, c, g, or t
ttgacatgcctctttaaaaccatccaagagattatagttgtggatggtggcagtactgataataccgtttcagttatccaagcattaggtttaaatattaaagttttgcattctgaaaaaggtcgtgctaagcaaatgaatcttggtgctaaagcttcaaaaggagatatactttattttttacacgcagattcttttccacctaacagatatgaccaattaattttagatgaaattaaaaaaggcaataatgctggttgttttagattacaatttgatagtaaccattggtggctacgttttactagttggttaactcagttttcttggcgagcaagtcgtggtggtgatcaaagtcaatttataaccaaagcgttattcaatgatattggtggttatgatgaaaattacattatctacgaagacaatatcttaataaatgagctttataaacgtaaagaatttgttgtgattaatcataagcttaaaacctcagctagactatatcaaaaacatggcgtttggacactacaatatcattatttagtcatacatataaaaaaatggtttggtgcttctgctgaagtactacacaagtactacaaaaaacatatttcttaa

SEQ ID NO: 23080 - protein, 206 aa, Unknown
  Obtained from environmental sample
  misc_feature (1)..(206): Xaa is any amino acid
MTCLFKTIQEIIVVDGGSTDNTVSVIQALGLNIKVLHSEKGRAKQMNLGAKASKGDILYFLHADSFPPNRYDQLILDEIKKGNNAGCFRLQFDSNHWWLRFTSWLTQFSWRASRGGDQSQFITKALFNDIGGYDENYIIYEDNILINELYKRKEFVVINHKLKTSARLYQKHGVWTLQYHYLVIHIKKWFGASAEVLHKYYKKHIS

SEQ ID NO: 23081 - DNA, 675 bp, Unknown
  Obtained from environmental sample
  misc_feature (1)..(675): n is a, c, g, or t
ttgttttttgaaaatagtacacgtactaaactttcttttgaattagctgaaaaaagactttcagcagatataataaatttttctgctagtcaatcatcagtcaaaaaaggagaaacattaattgatacagttaacaatatcttatcaatgaaagttgacattgttgttatgagacatccaaatgtgggtgcgggtatttttttatcaaaacatgtgaacgcaaagatagttaatgcaggtgatggggcccatgaacatccaacgcaggctctgttagattcatattcaattaaggaaaaattaggcacagttaaaggtaaaaaggttgtaattattggtgacgttttacactcgagggttgcactttctaatatttttgctcttcaacttcaaggagcaaccgtaaaaatttgcggaccaacaacgcttataccgaaatatattacgagtctgggtgtatctgtggaaacaaaccttaaaaaagctttagaatggtgtgatgttgccaatgttttaagagttcaacatgaacggatggacataaaatattttccatctgtaagagaatacactcaattatttggtataaataaagaagtgttaaattcagttggcaaggaaattgtaataatgcatccaggtcctataaatcgaggagtagaaattcaccagtga

SEQ ID NO: 23082 - protein, 224 aa, Unknown
  Obtained from environmental sample
  DOMAIN (104)...(223): Aspartate/ornithine carbamoyltransferase, Asp/Orn binding domain
  misc_feature (1)..(224): Xaa is any amino acid
MFFENSTRTKLSFELAEKRLSADIINFSASQSSVKKGETLIDTVNNILSMKVDIVVMRHPNVGAGIFLSKHVNAKIVNAGDGAHEHPTQALLDSYSIKEKLGTVKGKKVVIIGDVLHSRVALSNIFALQLQGATVKICGPTTLIPKYITSLGVSVETNLKKALEWCDVANVLRVQHERMDIKYFPSVREYTQLFGINKEVLNSVGKEIVIMHPGPINRGVEIHQ

SEQ ID NO: 23083 - DNA, 468 bp, Unknown
  Obtained from environmental sample
  misc_feature (1)..(468): n is a, c, g, or t
atgcgctctaaaattgttagtagagaacatttaaatgaactaggaaaagatttagatttaatacgttttataaatagtaatgtagacgaagccaatgttggcgataatattcatggtaatattttcgaagcgttagtaggtgctatttatttagataaagggtatagttattctcaaaaatttatatttgaaaatgtaattgatccttatgttgatatagaaaaactagaaggaaaaattacaagctataaaggtttgataatagaatggtgccaaaaacaaaagaaaaaatataagtttgatacttatgaagattctggtaacgaacctataaaacattttagtgttaaggtaagtatagatggtgagcaagttgcaaaaggcagagcaacctctaaaaaaaaggcagaagaacaagcctcaaaaagagtttattatgcgtttcaaagtcaaatttcagttggctaa

SEQ ID NO: 23084 - protein, 155 aa, Unknown
  Obtained from environmental sample
  DOMAIN (1)...(54): RNase3 domain
  misc_feature (1)..(155): Xaa is any amino acid
MRSKIVSREHLNELGKDLDLIRFINSNVDEANVGDNIHGNIFEALVGAIYLDKGYSYSQKFIFENVIDPYVDIEKLEGKITSYKGLIIEWCQKQKKKYKFDTYEDSGNEPIKHFSVKVSIDGEQVAKGRATSKKKAEEQASKRVYYAFQSQISVG

SEQ ID NO: 23085 - DNA, 519 bp, Unknown
  Obtained from environmental sample
  misc_feature (1)..(519): n is a, c, g, or t
ttgggtttcccggtgggcaaagtattaattaccccacccaaggtgagttattccgaaaaaattaatagaacctattttgacggtgattttactttgttaagcaattggctaggaacagagttgaactttgaaaaagtacagaatttgttactcggtcaagcattattgaatttaaaagatgataaatttagtcttgacttttataaaaacaagtaccagctaacacctaaaaaaggttatgatctattcagtatattgttcttaattaaccctgataattttaagatcgatagccaaaagattcatcaaaaagatgataataaatcactaacaataaattatagtgattatactcaagttgatgatgaagtatttcctaagggaattcatattgccgcttcagacacaaaaaatacttctaccatagatattaattacagatctgtaaattttaataaccatgttagctttccatttaaaataccctcaaattataaacaaattgttctgaaaaaatga

SEQ ID NO: 23086 - protein, 172 aa, Unknown
  Obtained from environmental sample
  misc_feature (1)..(172): Xaa is any amino acid
MGFPVGKVLITPPKVSYSEKINRTYFDGDFTLLSNWLGTELNFEKVQNLLLGQALLNLKDDKFSLDFYKNKYQLTPKKGYDLFSILFLINPDNFKIDSQKIHQKDDNKSLTINYSDYTQVDDEVFPKGIHIAASDTKNTSTIDINYRSVNFNNHVSFPFKIPSNYKQIVLKK

SEQ ID NO: 23087 - DNA, 705 bp, Unknown
  Obtained from environmental sample
  misc_feature (1)..(705): n is a, c, g, or t
gtggcttttgctgacaccttgtttaaagctgattttaagttagacgacaaggctgatggtgccatttgggtgaaacaagttgaaaacccaagtgcttatggggtaatcaaactaaaagatggttatattactgattttgtagaaaaaccggaaggttttgtttcagatctggccattattggtatttattattttaaaaagggagagttacttcgaaatgaaattcaatacttattagataataatatcacagaaaaaggagaatttcaattaaccaatgctttagaaaatatgaagcaaaaaggcttgaagttcgtacctggtcaagtagatgaatggatggattgcggtaataaggaaataacggttgaaaccaacgggagggtattacaatttgcacaccaagcgggtgaaaagttagtttcggaaactgtcgttttaaataattctgaaattatacaaccttgttatatcggtgaaaatgtaaagcttactaatgtgataattggtccaaatgtttcaattggcacaaattgtgtggtagaaaattcaaaaattagtaattctttaattcaaactaatacatctataaaaaatgctaatttagatggtgctatgataggcaacaatgcagaatttgatggtaattttacctcaattagtttagggagattattctcaactaaattaaaaaatggcaattaa

SEQ ID NO: 23088 - protein, 234 aa, Unknown
  Obtained from environmental sample
  misc_feature (1)..(234): Xaa is any amino acid
MAFADTLFKADFKLDDKADGAIWVKQVENPSAYGVIKLKDGYITDFVEKPEGFVSDLAIIGIYYFKKGELLRNEIQYLLDNNITEKGEFQLTNALENMKQKGLKFVPGQVDEWMDCGNKEITVETNGRVLQFAHQAGEKLVSETVVLNNSEIIQPCYIGENVKLTNVIIGPNVSIGTNCVVENSKISNSLIQTNTSIKNANLDGAMIGNNAEFDGNFTSISLGRLFSTKLKNGN

SEQ ID NO: 23089 - DNA, 816 bp, Unknown
  Obtained from environmental sample
  misc_feature (1)..(816): n is a, c, g, or t
atgtacacaaagcgtaattattctttaaagcagattctactttggacacggaaagatattttttatttcgtaatactttcaacagtacctgtaatactttataccgtttttcgttggtattggttacatttaccttggctacctattagtttaataggtactgcagtagctttcattattggttttaaaaataatgcttcttacgaccgtttatgggaagcacgaaaagtttggggaggcattgtaaatacttctcgatctttaactataatgcttaacgattatgtaaataatgaacatgcaaaaaaaatactttcagatcaagaattattcgaaattagaaagacatttatattgcgtcacatagcttggatgagttcgttacgtcacgctttacgcacaccaaagtcttgggaagcagaaccaagaaagaaaactggtatagactatagaaaacacttagaaattagagagcaaaaatattcacttgaagaagaactaaaaggctatttatctgaagaagaaaaggactatgttttaagtaaaaaaaataagcaagcagcctgtttaaatttacaatcaaaacatttaagtgcacttaaaactgaaggctatatttgggaatttgcccatttagagattgaaaagatgtttgttgaattatttactcttcaaggtaaagtagaacgtattaaaaatttcccttatcctcgtcagtttgccacattaaataagttttttgtttggatttttgttattctcctaccatttggtatgatgaatgaattgataaaattgggatatctcaagccataa

SEQ ID NO: 23090 - protein, 271 aa, Unknown
  Obtained from environmental sample
  DOMAIN (1)...(271): Uncharacterised protein family (UPF0187)
  misc_feature (1)..(271): Xaa is any amino acid
MYTKRNYSLKQILLWTRKDIFYFVILSTVPVILYTVFRWYWLHLPWLPISLIGTAVAFIIGFKNNASYDRLWEARKVWGGIVNTSRSLTIMLNDYVNNEHAKKILSDQELFEIRKTFILRHIAWMSSLRHALRTPKSWEAEPRKKTGIDYRKHLEIREQKYSLEEELKGYLSEEEKDYVLSKKNKQAACLNLQSKHLSALKTEGYIWEFAHLEIEKMFVELFTLQGKVERIKNFPYPRQFATLNKFFVWIFVILLPFGMMNELIKLGYLKP

SEQ ID NO: 23091 - DNA, 327 bp, Unknown
  Obtained from environmental sample
  misc_feature (1)..(327): n is a, c, g, or t
atgggtaaaatatatgcacccaaaataccaaaaaagaatattttttccagatttatggagcgaacaagaacaagaagattggggcaaaaatgtataattctagttatacttttattaagtttatatagttgtaaaaaagaagagcaacaaatagatactttagagacagcattaattgaagaaccagaagatgtttttgaattcggttttaatcttaatgagtttgtcgttaaaagagatacggtaaaacaaggtgacagttttggcgaaatattagagcgtaaccaagtagggtattctgagattttaaaatcgcagaactgctag

SEQ ID NO: 23092 - protein, 108 aa, Unknown
  Obtained from environmental sample
  misc_feature (1)..(108): Xaa is any amino acid
MGKIYAPKIPKKNIFSRFMERTRTRRLGQKCIILVILLLSLYSCKKEEQQIDTLETALIEEPEDVFEFGFNLNEFVVKRDTVKQGDSFGEILERNQVGYSEILKSQNC

SEQ ID NO: 23093 - DNA, 525 bp, Unknown
  Obtained from environmental sample
  misc_feature (1)..(525): n is a, c, g, or t
atgaatgatgtctacaaaaaactattttctttggataatatattaaatgaaccaagcgaaacaaacaactttttaaatacaattcaaaatgcaatagctattggatcatgggaagtaaacctaaaaagtatggagctctattggagcccgatgacgaagcaaattcatgaagtagaaccggattacatacctagtcttgacaatgcatttgacttctatcctaatttaaaagatagggagttattacaaaacgtctttaataacgctttcactgatggagaaaaatacgatatagaattacaattaaaaacggctaaaaagaataataaatgggtacgggctataggttatcctgtttttaaagatggtatctgtataaaaataatgggggtttttcaagatgttacttcaaaaacaaacattcttaatgaaaccgcgctcaaggaaaaacaaatcagcaccatcttagataattctcctaacgggatggctgtagtagatttaaatggcaatttaatatcgtaa

SEQ ID NO: 23094 - protein, 174 aa, Unknown
  Obtained from environmental sample
  misc_feature (1)..(174): Xaa is any amino acid
MNDVYKKLFSLDNILNEPSETNNFLNTIQNAIAIGSWEVNLKSMELYWSPMTKQIHEVEPDYIPSLDNAFDFYPNLKDRELLQNVFNNAFTDGEKYDIELQLKTAKKNNKWVRAIGYPVFKDGICIKIMGVFQDVTSKTNILNETALKEKQISTILDNSPNGMAVVDLNGNLIS

SEQ ID NO: 23095 - DNA, 414 bp, Unknown
  Obtained from environmental sample
  misc_feature (1)..(414): n is a, c, g, or t
gtgggtttgctccagggttttttatttttttaccaacacttttatatggaaaatcttttagtcgcagaaaatatctacaaacaatttggcaattttactgcactaaacaatgtctcaatagccattcctcatggtagtatttttggtcttttaggtcccaatggtgcagggaaaactactttactacgtattattaaccaaataaccatgccagataagggcaggatttatcttgatggcaaacctttacaccccaatgatattgcgcatattggttacctgccagaagaacgcggactttataaatctatgaaagtgggggagcaggcgctttatctcgcccgtttaaaaggactttctaaagctgaggctaaagagcgcctggaatattggtttaaaaaacntgcaaattga

SEQ ID NO: 23096 - protein, 137 aa, Unknown
  Obtained from environmental sample
  misc_feature (1)..(137): Xaa is any amino acid
MGLLQGFLFFYQHFYMENLLVAENIYKQFGNFTALNNVSIAIPHGSIFGLLGPNGAGKTTLLRIINQITMPDKGRIYLDGKPLHPNDIAHIGYLPEERGLYKSMKVGEQALYLARLKGLSKAEAKERLEYWFKKXAN

SEQ ID NO: 23097 - DNA, 822 bp, Unknown
  Obtained from environmental sample
  misc_feature (1)..(822): n is a, c, g, or t
atgaattttaaagcatggtttgaagatacttttaaaccagaagattttgactattttgagtcatttgaagaggaagttgagacaagaaagcagggggaatatttaaagtggtgtggagataacaggctttttataaatgatttaaatgacgtttgcgtatctgaaattgtctatcaagacattatgactctcccctctttttctcaacaaataaacttcgttttatcgatgcatgaagagcttatgtatcatggaaacttcgatgaattaaagaacgatttttgctatgcgcgttatctaattttttcggctagaaacatacctagtgaccatacacatttcttcaacaaaacatatcctcacgttgatgatatgtcacactccattaccaacctaaaagctagtcattataaaagcgcgttcagaacgctttactcgctatttgataaaattgcttactttatcaatcgcttttttgatctgaatgatatcaagtatgatcataaaatcagctttgacagtatttttagtgagctgaaaggaagtaagagctggaaaccacacagtaagcttaaagacagtcagaattgctttatccatgccttattctacatcctgaaagacattcgagatgtgaaagattcgacttctgtcagtcggtggcttgatcctgatgcanaggcgttttctgaaattagaaatgctatagagcatcgttctttaaagattgttgatgattttggttatacccctactcaatcaggtaaagcttttaagcaatcacagcttgaaaagcttaatggtgatataggtgacttttga

SEQ ID NO: 23098 - protein, 273 aa, Unknown
  Obtained from environmental sample
  misc_feature (1)..(273): Xaa is any amino acid
MNFKAWFEDTFKPEDFDYFESFEEEVETRKQGEYLKWCGDNRLFINDLNDVCVSEIVYQDIMTLPSFSQQINFVLSMHEELMYHGNFDELKNDFCYARYLIFSARNIPSDHTHFFNKTYPHVDDMSHSITNLKASHYKSAFRTLYSLFDKIAYFINRFFDLNDIKYDHKISFDSIFSELKGSKSWKPHSKLKDSQNCFIHALFYILKDIRDVKDSTSVSRWLDPDAXAFSEIRNAIEHRSLKIVDDFGYTPTQSGKAFKQSQLEKLNGDIGDF

SEQ ID NO: 23099 - DNA, 306 bp, Unknown
  Obtained from environmental sample
  misc_feature (1)..(306): n is a, c, g, or t
atgaataaacagccaaaaataaaacacgggcaaggcatttttgagcagcaaaaatcgagtggtttagccatcattcaattttgtcgtgataacaacattaacgcatcgactttctatgtttggcgtaaacgcctttctgacgaaacgataagggttaaaaagcaacaggtgatcccgtttgttattcatgagcaagcctttacacacccttcaatcattaaactcaccataccaaacggctatcaaatagacttcgagtcgacattagcgcaccaagcactcgccaaattattgagcgtactgtga

SEQ ID NO: 23100 - protein, 101 aa, Unknown
  Obtained from environmental sample
  misc_feature (1)..(101): Xaa is any amino acid
MNKQPKIKHGQGIFEQQKSSGLAIIQFCRDNNINASTFYVWRKRLSDETIRVKKQQVIPFVIHEQAFTHPSIIKLTIPNGYQIDFESTLAHQALAKLLSVL

SEQ ID NO: 23101 - DNA, 519 bp, Unknown
  Obtained from environmental sample
  misc_feature (1)..(519): n is a, c, g, or t
atgtatataaccattacaccccaaaaaatgggcgggaactattctaaaagtgcaacggatttcgtgggctatttggagaaagagaatcaaggtttggaacaggaagacatggaatgttttttcaatcagtttgacgatgaaatttcagcagaagaagtgattaaggaaatcgatggcaatactgcaaaattggaaaagatggagcctaggttctattcaataacagtcagtccctccaaatatgaattgggaaaattacaggacaacagtgaagatttaaaaaagtacggccgtgagctgatgaaggattatgtaacgtcgtttaatcgggaaatcaacggaaatccggttaccattgatgacataaaatactatgctaaaattgagcatcaacgcacatttaagggatcagacctgcaggtgcgggaaaaccaaccttttgccacgaaaatattacagcttaaaaccgacatccgcaaaattggaaacggtacgatggaaggaaatattaaattataa

SEQ ID NO: 23102 - protein, 172 aa, Unknown
  Obtained from environmental sample
  misc_feature (1)..(172): Xaa is any amino acid
MYITITPQKMGGNYSKSATDFVGYLEKENQGLEQEDMECFFNQFDDEISAEEVIKEIDGNTAKLEKMEPRFYSITVSPSKYELGKLQDNSEDLKKYGRELMKDYVTSFNREINGNPVTIDDIKYYAKIEHQRTFKGSDLQVRENQPFATKILQLKTDIRKIGNGTMEGNIKL

SEQ ID NO: 23103 - DNA, 747 bp, Unknown
  Obtained from environmental sample
  misc_feature (1)..(747): n is a, c, g, or t
atgaataatatagtaaatatagctattgacgaaaaaaaataccaagttcaagaaggtaagaatttagtggatgccgctaaagaaaatggaatttatattcctactntgtgccattttcacgaagtgaatcctcccttgggaacctgccgaatatgtactgttattgttaatggcaaaacaacaacaagttgtacaacaaaagtatatgaaggaatggaagtggaaattaacactccagaactaataaataccagaaaagcaatcattgaaatgctattttcggaaggaaaccatttttgcccttcttgtgaaaaaagtggtaattgtgacatgcaaaaccttggctatgacatgggaataaccgcttccagatttccacatgtttacagcaataaagttgtagattttaattccgaccgcatgatcatggaatcgaatagatgcatcttatgcaaacgttgtgtggaagaggtgaaaaccaaagatggtaaagatgtgttttcatttgtgaaccgaggtgttaaaactagagtacatattgattatgatgaagaagccaaattaacagatgccgaggctatgcacgccatgaacctgtgtcctgttggtgcaattctgattaaaggaatggtttatgaacaacctttcggagatagaaaatatgatatagtaggaaaagataaagaggcccctaaaagagatagtttcaaaaaaagaaatgacgagaataaattcatagtgctctga

SEQ ID NO: 23104 - protein, 248 aa, Unknown
  Obtained from environmental sample
  DOMAIN (5)...(70): 2Fe-2S iron-sulfur cluster binding domain
  misc_feature (1)..(248): Xaa is any amino acid
MNNIVNIAIDEKKYQVQEGKNLVDAAKENGIYIPTXCHFHEVNPPLGTCRICTVIVNGKTTTSCTTKVYEGMEVEINTPELINTRKAIIEMLFSEGNHFCPSCEKSGNCDMQNLGYDMGITASRFPHVYSNKVVDFNSDRMIMESNRCILCKRCVEEVKTKDGKDVFSFVNRGVKTRVHIDYDEEAKLTDAEAMHAMNLCPVGAILIKGMVYEQPFGDRKYDIVGKDKEAPKRDSFKKRNDENKFIVL

SEQ ID NO: 23105 - DNA, 738 bp, Unknown
  Obtained from environmental sample
  misc_feature (1)..(738): n is a, c, g, or t
ttgcaagtaactaattttcccatttatataaataaaaaaataaccggcgtttatggcatagcgaaggatgtaacccgacaggttgaaattgaacaaaaattaagggaagagcgcaacatgttccgggcaattatagattatattccagatcatatatttgtagtgaaccaaaaccacgaaactattttaaccaattatggtttttacaaaaattatttaggtgctgaaaatgaagaaaacagtttgggattaactcccaaagatttttttcctgaagaagaagctttagaaataatagacgataatacgcgggtgatgaattcgggggtcccgattataaatcgagaagatattattagaaattttaataatgaaatagatcacagccttttaaccaaagtgccctttaagtttggaaataataaaaaaggattggtggggatttccaggaatattactgaaataaagcaaaaagaagaagcattagaatcattaaaccaggaattaaaaacacacactgaagagctcgctttatctaatagagaactggagcaatttgcctatatcgcctcccacgatctccaggaacctctaaggatggtcactagttttcctactcagcttaagaaaaagtacattaatcaacttgatgaaaaggcacagcaatatatttattttgctcccgatgggtgctcccccaaatgccaacagaaaaatattagaatttaccttgaataa

SEQ ID NO: 23106 - protein, 245 aa, Unknown
  Obtained from environmental sample
  misc_feature (1)..(245): Xaa is any amino acid
MQVTNFPIYINKKITGVYGIAKDVTRQVEIEQKLREERNMFRAIIDYIPDHIFVVNQNHETILTNYGFYKNYLGAENEENSLGLTPKDFFPEEEALEIIDDNTRVMNSGVPIINREDIIRNFNNEIDHSLLTKVPFKFGNNKKGLVGISRNITEIKQKEEALESLNQELKTHTEELALSNRELEQFAYIASHDLQEPLRMVTSFPTQLKKKYINQLDEKAQQYIYFAPDGCSPKCQQKNIRIYLE

SEQ ID NO: 23107 - DNA, 612 bp, Unknown
  Obtained from environmental sample
  misc_feature (1)..(612): n is a, c, g, or t
atgaagaaattatttataacattcacgacattattacttttaatagcttgtaaaaatgaacccgtaattaaagattatgttactttatctggaaaaataacaaatcaagaagactctataatatctatcaatagcagatcttttaacaaactagttaaaataaacattgatggttcttttaatgacacacttgctgttgaagaaggattttttcaactatcaaacggaacattccgatcaatcattcaattaagaaatggatataatttagaaatttcattcgacgcagcagacttgcctaatactgttaagttttcgggtttgggtgctgatatgaataactatatgtctgataaaatcaatttcgagaaagaatacgaattgaacgacacacaacaattatttgaactggaaaaattagaatttgataagaagataaataatataaaggaccggatgagcaatatgctagataagtatgttgcattagattctgccttttaccgcaatgaaaatgttggtagcgagaggttcgttgaatatttaacctctaattatgacaagcttcatgcaatctatgcaccgattgtcaaaggcaaacccctcacctaa

SEQ ID NO: 23108 - protein, 203 aa, Unknown
  Obtained from environmental sample
  SIGNAL (1)...(18)
  misc_feature (1)..(203): Xaa is any amino acid
MKKLFITFTTLLLLIACKNEPVIKDYVTLSGKITNQEDSIISINSRSFNKLVKINIDGSFNDTLAVEEGFFQLSNGTFRSIIQLRNGYNLEISFDAADLPNTVKFSGLGADMNNYMSDKINFEKEYELNDTQQLFELEKLEFDKKINNIKDRMSNMLDKYVALDSAFYRNENVGSERFVEYLTSNYDKLHAIYAPIVKGKPLT

SEQ ID NO: 23109 - DNA, 711 bp, Unknown
  Obtained from environmental sample
  misc_feature (1)..(711): n is a, c, g, or t
gtgctctccatagattttccatcgggattatttgctgataaggccgtttcagataaagattctgttattaaagcataccataccttaacttttcagacccctaaattagcttttttattacctgataatcaaatatttgtcggatactgggacgtaattgatattggtttagataccgagtatttaaatacggcagaaactaatgtttatctaacttatcaacaggatgtgcaacttttgtataagtttagagacaaattttcacataagggtaattatgggcattcattaataattggtggaagttttggtaaaataggggctgtttcattggcatctagagccgctttaacaattggcagtggtttagtaacagcttacctacctaagtgtgggtatcaaattatacagaccgcattacctgaagtaatggcggaagtggatgccgaaaatgaattgcagtattttaattctaaaataaaagctacggtcattggtattggaatgggaatgggtatgcattccaaaacggcagatggatttaaacagtttcttcaaaaaaataaattacccttaattgttgatgcagatgcaattaatattttgtcaaaaaataagagtttattgaaatcattgcctgaaaattctgttttgacaccccctccaaaagaatttgagcgaataataggtaaatgggaagatggattttaa

SEQ ID NO: 23110 - protein, 236 aa, Unknown
  Obtained from environmental sample
  misc_feature (1)..(236): Xaa is any amino acid
MLSIDFPSGLFADKAVSDKDSVIKAYHTLTFQTPKLAFLLPDNQIFVGYWDVIDIGLDTEYLNTAETNVYLTYQQDVQLLYKFRDKFSHKGNYGHSLIIGGSFGKIGAVSLASRAALTIGSGLVTAYLPKCGYQIIQTALPEVMAEVDAENELQYFNSKIKATVIGIGMGMGMHSKTADGFKQFLQKNKLPLIVDADAINILSKNKSLLKSLPENSVLTPPPKEFERIIGKWEDGF

SEQ ID NO: 23111 - DNA, 366 bp, Unknown
  Obtained from environmental sample
  misc_feature (1)..(366): n is a, c, g, or t
atggcggaatttataagaatatatgaagagaacccgaatgccaaggaaataaaaaaggtaattaaggtacttcaagctggcggacttattatttatccaacggacaccgtttacggtttgggctgtgatattaataatgtgaaagctttggagcgcgtagcacaaattaagggtgttaaattagataaggctaatttttcgtttatatgtagtgatttgagcaacttaagcgattatgtcaagcaaattgactcgaccacatttaagatattaaaacgagccttacctggaccgtatacctttattcttcctggagcaaaaacactgccacatccttttaaaaaagaagaagaccgtggggattag

SEQ ID NO: 23112 - protein, 121 aa, Unknown
  Obtained from environmental sample
  DOMAIN (21)...(120): yrdC domain
  misc_feature (1)..(121): Xaa is any amino acid
MAEFIRIYEENPNAKEIKKVIKVLQAGGLIIYPTDTVYGLGCDINNVKALERVAQIKGVKLDKANFSFICSDLSNLSDYVKQIDSTTFKILKRALPGPYTFILPGAKTLPHPFKKEEDRGD

SEQ ID NO: 23113 - DNA, 645 bp, Unknown
  Obtained from environmental sample
  misc_feature (1)..(645): n is a, c, g, or t
gtggtcgctaacgacatggagaggattagactttactatgaatctttaggttatctaagagtaaaagtggacactactattgttgagttcaaaactgataaagtagaagtctcgtttatcgttattgaaggaacaccatcaaaaatagaaaccattgcttacaaaggggttccattttttgcggaccctcaaaaaagaatagattttttacgaaatagcccacttactaaagatcgtattaatgactccacttatgctgtaaacagacaatacagtactcaagaactcggtactgagcagcaacggattatagattttcttaaaaataatggctacgcatctatccaaaaagactcggtaattgcgcttgttaaaactcagaaacaagaccctacaaaaatcgatgttcaattcagagtgaatgctggaaaggtatatcgttttggagatgtatttgtagatattgcagacggaacgcctccagataattacacacaattagacactctatctaatgaaaaagctactgttgattcattaaagatatacatgaaaaaagaaccgggcacacagaccaagttttccttgctatcagatcaggttctttataaacccggaagttataccaccacgaattatacttaa

SEQ ID NO: 23114 - protein, 214 aa, Unknown
  Obtained from environmental sample
  misc_feature (1)..(214): Xaa is any amino acid
MVANDMERIRLYYESLGYLRVKVDTTIVEFKTDKVEVSFIVIEGTPSKIETIAYKGVPFFADPQKRIDFLRNSPLTKDRINDSTYAVNRQYSTQELGTEQQRIIDFLKNNGYASIQKDSVIALVKTQKQDPTKIDVQFRVNAGKVYRFGDVFVDIADGTPPDNYTQLDTLSNEKATVDSLKIYMKKEPGTQTKFSLLSDQVLYKPGSYTTTNYT

SEQ ID NO: 23115 - DNA, 345 bp, Unknown
  Obtained from environmental sample
  misc_feature (1)..(345): n is a, c, g, or t
ttgaaggttctgtttcaaattgttattgatgataatagtggccctgataatagggttgctttcgatgatttatcttggacatgttatacgaatttaagcacggacgattttacgatttcgaatattaatatgtaccctaaccctgtaaaaaacagtttaaacattaacttaaattacccgaaccaaacgcaaatagacatttacaatgtacttggtaaaaaggtaatctctaaagttatctacaaatcggacataattaataccgaacagttaagtagtggtatgtacattgtgcggattaaacaaaatgaaactacaataagcaaaaagctcattaaaaaataa

SEQ ID NO: 23116 - protein, 114 aa, Unknown
  Obtained from environmental sample
  misc_feature (1)..(114): Xaa is any amino acid
MKVLFQIVIDDNSGPDNRVAFDDLSWTCYTNLSTDDFTISNINMYPNPVKNSLNINLNYPNQTQIDIYNVLGKKVISKVIYKSDIINTEQLSSGMYIVRIKQNETTISKKLIKK

SEQ ID NO: 23117 - DNA, 681 bp, Unknown
  Obtained from environmental sample
  misc_feature (1)..(681): n is a, c, g, or t
ttggaaatattacggcggcgcagtatttttagagaaggtagcataagtatgcctaaagcttttaaaagtgatattaccgatgtgaattctaaaacggtttttgaaatcgagaaacactctcaaaatactattggttatactttagacggagttttcgattttatgaaaaaacgaaaggattacaatccgcaatacaaagtatttaaagagtattttgtagtgtgttgggctgcagaagaaaaacaaacagcaaacgaaatgtatctgtctcgggtggatattgaacttattaacgagcaagtacgcctgttttattccaatttagacaaagtatctattataatgaccgagcatagcttcaaaattatagaatacgtaaatttaggacttcaggacaactttaaacattatccgttagaagaaaccctaatacaatttaacgataacctcagctactctatagattcagctctagtttttgaagccccacaatacgacaagaaaattcttcatcatatttataatattaataatacattaattgagcgcttaaaacgcaatacaatactcacaaaagaagaagagaaagatttgctaaatctgcccgccacttatttaatttgttatttaaatttatttcacgaagccatagataaattggaagacgctaaaccttattaa

SEQ ID NO: 23118 - protein, 226 aa, Unknown
  Obtained from environmental sample
  misc_feature (1)..(226): Xaa is any amino acid
MEILRRRSIFREGSISMPKAFKSDITDVNSKTVFEIEKHSQNTIGYTLDGVFDFMKKRKDYNPQYKVFKEYFVVCWAAEEKQTANEMYLSRVDIELINEQVRLFYSNLDKVSIIMTEHSFKIIEYVNLGLQDNFKHYPLEETLIQFNDNLSYSIDSALVFEAPQYDKKILHHIYNINNTLIERLKRNTILTKEEEKDLLNLPATYLICYLNLFHEAIDKLEDAKPY

SEQ ID NO: 23119 - DNA, 789 bp, Unknown
  Obtained from environmental sample
  misc_feature (1)..(789): n is a, c, g, or t
ttgaataatgaaaaaaaggttttagaacaaattgcgaggtttaataataatgcacatataactttaccaccaaatgaaaaagtaagttttccattttataaaggaattattggtgatgtagcaagaactggtaaatctgaaattgtaaatgataccagtaaagataaaaggtatatgttagatgctgattttagattctctgaaataacagtacccataattagtgatggagaagtaattgctataatagatgctgaatatgagcataaaaactattttacaacagaacatataaaaacacttgaaaacgtagcaagcttagtggctgttcagctaaagagtgctataaatttaagagaaattaaaaaagtacaatcaaaaaataaagagcttttaacaaaattagctaaaagtaatgaagagctaaatgaatacgctcacatagtttctcacgatttaaaatcgcctttaagaagtattgcagctttaacatcttggattaaaacagacaatcaagataaatttgacgccataagtttacaaaattttgatgccatagaatttacgttagaaacgatggaaagtttaatctcagatattttaagatactcaagtttagactcagtttcagaagatattaaaaaagtaaacttagataccttggttaaagatttaactcaaattttatttataccagagaatattacccttaatatttttaaaaaatttaccagttgtaccagggagataaaattaaatatccaccaagtattttcaaaacttaattag

SEQ ID NO: 23120 - protein, 262 aa, Unknown
  Obtained from environmental sample
  DOMAIN (5)...(112): GAF domain
  misc_feature (1)..(262): Xaa is any amino acid
MNNEKKVLEQIARFNNNAHITLPPNEKVSFPFYKGIIGDVARTGKSEIVNDTSKDKRYMLDADFRFSEITVPIISDGEVIAIIDAEYEHKNYFTTEHIKTLENVASLVAVQLKSAINLREIKKVQSKNKELLTKLAKSNEELNEYAHIVSHDLKSPLRSIAALTSWIKTDNQDKFDAISLQNFDAIEFTLETMESLISDILRYSSLDSVSEDIKKVNLDTLVKDLTQILFIPENITLNIFKKFTSCTREIKLNIHQVFSKLN

SEQ ID NO: 23121 - DNA, 558 bp, Unknown
  Obtained from environmental sample
  misc_feature (1)..(558): n is a, c, g, or t
atgccggaatcgggtaaaaaaaaacccatggacgataaaagttacaaagaatacctacaccaaatcactacctttatttttgacgtagatggtgttttaactaacggaatgattactatcacgacatcaggcgaaatgattagacatatgaatgttaaggatggttatgccatgaagcaggcgttaaaccatggctataatgtctgtattatttctggtggtactaacgaaggtgtacgtactcgattaaatcatttaggtataaaagatgtctatttaggtgcacatcaaaaaatagtgcaatttgaagcctatttaaacgacaaccaaataaaagcagaaaacgtgctatatatgggagatgacattccggatgtacctgttttaaaattagtaggtatgcctagttgtccacaagatgctgtcccagaagttaaacgcgtatcaaaatatatctctcataaattaggaggtgaaggttgtgtacgtgacgtgattgagcaagttatgaaagtacaaaacaaatgggatagtgattttgacgcacaaaccttttaa

SEQ ID NO: 23122 - protein, 185 aa, Unknown
  Obtained from environmental sample
  misc_feature (1)..(185): Xaa is any amino acid
MPESGKKKPMDDKSYKEYLHQITTFIFDVDGVLTNGMITITTSGEMIRHMNVKDGYAMKQALNHGYNVCIISGGTNEGVRTRLNHLGIKDVYLGAHQKIVQFEAYLNDNQIKAENVLYMGDDIPDVPVLKLVGMPSCPQDAVPEVKRVSKYISHKLGGEGCVRDVIEQVMKVQNKWDSDFDAQTF

SEQ ID NO: 23123 - DNA, 306 bp, Unknown
  Obtained from environmental sample
  misc_feature (1)..(306): n is a, c, g, or t
atgacttactccctagattttcgcaaacaagtcttaaaaagcttagatgagggcatgacctttgctgaagctgctgttttctatgatatcagtccaacgactatccagaagtggaaaaagcgtcttcatagtaaaaccactcgatatattaagccctacaaaatagaggatgaagccttagctcaagatgtcaaagaccaccctgacgattatcactatgagcgagcacagcgttttgattgtagcccaacaggcatcagtaaagccttaaagcgtattggtgttagcaaaaaaaaagacacttga

SEQ ID NO: 23124 - protein, 101 aa, Unknown
  Obtained from environmental sample
  DOMAIN (1)...(101): Transposase
  misc_feature (1)..(101): Xaa is any amino acid
MTYSLDFRKQVLKSLDEGMTFAEAAVFYDISPTTIQKWKKRLHSKTTRYIKPYKIEDEALAQDVKDHPDDYHYERAQRFDCSPTGISKALKRIGVSKKKDT

SEQ ID NO: 23125 - DNA, 561 bp, Unknown
  Obtained from environmental sample
  misc_feature (1)..(561): n is a, c, g, or t
atgccaaaggatattcctcaaattgtttttaattctcaaaaaccaaataatagcggaattgaaattatatctattgaaaaccttgccaatagaaaagatcaagttttaagtcatcatccggaaaaagcacaccaagtagcttttaatatgattgtgttatatacttcaggagaaagtaaacaattggtagattttgtatggcacacggttaaaaaaaacacaataatacatatatctaaaggtcaaattaatgcctttcagtttactaaaaatcttaaaggttacatcttattgtttactgaagattatcttttaaaacaaattaatgcgttaccaaaaaatgaattaattagattatttaatgcgcatttgttttctccaattattcaagtaccaaaagactctaatgtggttcattatattgaattattatttaaagaatataacagtcagaaagaagattataatcaagaaaacacatataaatccttacattctataattttttccaaaatagaacgcttaaaaccatatcaaacaattcatttaanaacaatctaa

SEQ ID NO: 23126 - protein, 186 aa, Unknown
  Obtained from environmental sample
  misc_feature (1)..(186): Xaa is any amino acid
MPKDIPQIVFNSQKPNNSGIEIISIENLANRKDQVLSHHPEKAHQVAFNMIVLYTSGESKQLVDFVWHTVKKNTIIHISKGQINAFQFTKNLKGYILLFTEDYLLKQINALPKNELIRLFNAHLFSPIIQVPKDSNVVHYIELLFKEYNSQKEDYNQENTYKSLHSIIFSKIERLKPYQTIHLXTI

SEQ ID NO: 23127 - DNA, 549 bp, Unknown
  Obtained from environmental sample
  misc_feature (1)..(549): n is a, c, g, or t
gtgaaaacacgtttagcaaaaacagttggcaacgaagcagcatttaaagtctatgaaacacttgttgatgtaacagaaaatgccacttcaaatattcaaattgataaaagaatctatttttctgatgcagttatagcatctaaatggccaggtgcttttaaaacaatacagacaggaatcgatttaggtgaacgtatgaaaaatgcttttcgagaaggatttaatgatggctatgaaagtattgtgctattaggttccgatttgcccaatatttcatcaacaatcattaccaaaggattagatgctttagataaaactgaaattgtatttggccctgctgaagatggcggctactatttaattggaatgaataaacctcatccctttatatttgaaaataaaccatggagcgacacaaaactattagaaactactttaaatgaactcaaaagtaaaaatattgatgtttcattgctagaaaccttgaatgatattgatacttttgatgacttaaaacaatatcctgaattcttaaaacttatatcctaa

SEQ ID NO: 23128 - protein, 182 aa, Unknown
  Obtained from environmental sample
  misc_feature (1)..(182): Xaa is any amino acid
MKTRLAKTVGNEAAFKVYETLVDVTENATSNIQIDKRIYFSDAVIASKWPGAFKTIQTGIDLGERMKNAFREGFNDGYESIVLLGSDLPNISSTIITKGLDALDKTEIVFGPAEDGGYYLIGMNKPHPFIFENKPWSDTKLLETTLNELKSKNIDVSLLETLNDIDTFDDLKQYPEFLKLIS

SEQ ID NO: 23129 - DNA, 786 bp, Unknown
  Obtained from environmental sample
  misc_feature (1)..(786): n is a, c, g, or t
aagggctataatgatgctttaccctttgttaaagaggatattttttgcttattaaatagcgatattgaagttacgcctaattggttagtccctattttaaaaacatttaaagagcaacctgaaacagccattatacaccctaaaattttagattacaaaagcaaagaaaagtttgaatacgctggagctgctggaggttatatagataaatatggctatccatattgtagaggtcgtatttttaatacaattgaagttgataccaatcagtaccaaaacgaaaccattttttgggcatcaggtgcttgcttatttattagacaatctacatttaaggctttacaaggatttgacgaatcctattttgcccatatggaagaaattgatttatgttggagagcgtttaacaagggttatttaaccaaatacattaataatagtactgtgtatcacgttggtggagcaaccttaaacgcaagtagtccaaaaaaaacctatctaaattttagaaacagtttgtttactttaactaaaaatgccaaaggatatattgcattattaatttttgtaagattagtacttgatggtattgctgccttaaaatttttaatagaatttaagcctaaccatttaatagcaattttaaaagcacatgtatctttttacaaacatttacctaagctactaaaaaaacgaaaagcaatctcgcaaaaaactggctattaccagacaaaatcaatagtttacaactattttgttttaaataaaaaaacctttatcaagtaa

SEQ ID NO: 23130 - protein, 261 aa, Unknown
  Obtained from environmental sample
  misc_feature (1)..(261): Xaa is any amino acid
MGYNDALPFVKEDIFCLLNSDIEVTPNWLVPILKTFKEQPETAIIHPKILDYKSKEKFEYAGAAGGYIDKYGYPYCRGRIFNTIEVDTNQYQNETIFWASGACLFIRQSTFKALQGFDESYFAHMEEIDLCWRAFNKGYLTKYINNSTVYHVGGATLNASSPKKTYLNFRNSLFTLTKNAKGYIALLIFVRLVLDGIAALKFLIEFKPNHLIAILKAHVSFYKHLPKLLKKRKAISQKTGYYQTKSIVYNYFVLNKKTFIK

SEQ ID NO: 23131 - DNA, 483 bp, Unknown
  Obtained from environmental sample
  misc_feature (1)..(483): n is a, c, g, or t
ttgagtaaattaagtaatgagttaaataaactacaaatagtcttcccaagagacacacagattactcctgatcatatcgaagaaaatataggtattagtaaagactatataaactttgagttacgtaaagctattggagcaaaaaacactgctcaggcttttaaaattgtccattattttgcagaaaacccaaaggataatccaatggtgttaactgtatctttattgtttagctttttttctcaattattgcatttacatggaatgtctgataaaaaccctcgaagtgtagcctctgcattgcgggttaatccatattttgtaaacgaatatatagaggcttcacgcaattatccaatgcgaaaagttagtcaagttattgctattttacgcgagtttgatggtaaaagtaaaggtgttgatagtaatgctgtgccacaaggtgatttgcttaaagagatgttagttaagattatgtactaa

SEQ ID NO: 23132 - protein, 160 aa, Unknown
  Obtained from environmental sample
  misc_feature (1)..(160): Xaa is any amino acid
MSKLSNELNKLQIVFPRDTQITPDHIEENIGISKDYINFELRKAIGAKNTAQAFKIVHYFAENPKDNPMVLTVSLLFSFFSQLLHLHGMSDKNPRSVASALRVNPYFVNEYIEASRNYPMRKVSQVIAILREFDGKSKGVDSNAVPQGDLLKEMLVKIMY

SEQ ID NO: 23133 - DNA, 546 bp, Unknown
  Obtained from environmental sample
  misc_feature (1)..(546): n is a, c, g, or t
atgaaggttacagaaacaaaattaaaaggatgttttatcattgaacctgcgatttttggggatgaaagaggctatttttttgaaagttttaacaaacaaaaattcaatgaattaacaggagcagaaattgattttgttcaagacaatgaatcttattctactaaaggtgtattaagaggattgcattttcaaaaacgagattttgcccaagcaaaattagtgcgtgtttcgcacggaaacgtgctagatgttgctgttgatattagaaaacattctttaacctttggacaacatatttcaatagagttgtcatcagaaaataaaaagcagttatttgttccaagaggttttgctcacggatttattgtgttgagcgataccgttacttttctttataagtgcgataatttatataatcaagcatctgagggaggaattatttacaatgaccaagaattaaatattaattggaaactaccagaaaaagattttattatttctccaaaagacactgttttaccaactttagctgaggccaagttatga

SEQ ID NO: 23134 - protein, 181 aa, Unknown
  Obtained from environmental sample
  DOMAIN (3)...(179): dTDP-4-dehydrorhamnose 3,5-epimerase
  misc_feature (1)..(181): Xaa is any amino acid
MKVTETKLKGCFIIEPAIFGDERGYFFESFNKQKFNELTGAEIDFVQDNESYSTKGVLRGLHFQKRDFAQAKLVRVSHGNVLDVAVDIRKHSLTFGQHISIELSSENKKQLFVPRGFAHGFIVLSDTVTFLYKCDNLYNQASEGGIIYNDQELNINWKLPEKDFIISPKDTVLPTLAEAKL

SEQ ID NO: 23135 - DNA, 345 bp, Unknown
  Obtained from environmental sample
  misc_feature (1)..(345): n is a, c, g, or t
ttgttgttcagtgggcaagctgctagaattaaagcttctaaaattgccaaagaacgggcggtaacagagtctattgattataaaattcagataaagtcgaagcaagaaatcttactcgaagaaatttcacagattcaaaattcgctgaattattatgaaaatgaaggcactgagctatccgatgaaattttaaaaaccgctcaaataagctttaaaaatggtgaaattgatttctatcaatatatacagagtttagaaagcgcctatgatattaaattgggctatctagataaattgaaagagtacaataaaaccgctacaagcattaatttcttaaccttataa

SEQ ID NO: 23136 - protein, 114 aa, Unknown
  Obtained from environmental sample
  misc_feature (1)..(114): Xaa is any amino acid
MLFSGQAARIKASKIAKERAVTESIDYKIQIKSKQEILLEEISQIQNSLNYYENEGTELSDEILKTAQISFKNGEIDFYQYIQSLESAYDIKLGYLDKLKEYNKTATSINFLTL

SEQ ID NO: 23137 - DNA, 900 bp, Unknown
  Obtained from environmental sample
  misc_feature (1)..(900): n is a, c, g, or t
ttgnnttgggtttatcgctcantcttcacatattacaaaatcaaccaattattaccaaatgcagcagaggtgcaaattgttggaaaaattgtaaaatttgaagagattgcccagaaaagaggcaagcgattagtagccacttttaaggacgaaactggcactatggaattggtctggtttagaggtcaaaaatggattaaagaaggtttaaaattaaatgcaacttacgtcatttttggaaaaacaaacctgtttgcaaacaagtataatatgcctcatcctgacatagaattattgtcggaacacgaagccaatttacgaagtgcaatgcaagctatttacccttcaactgagaagttagcaaaccgaggaattagcaatcgcgtgatgacaaaaatcatgcaaaatttgttccttgaaaccaagggtagatttgttgaaactttgtccgaaaaactgctctcagaaaacaaattaatttctaaatctgaagcccttttaaatgttcattttccgaaggatcaaaacgcactttctaaagccgaatttagactaaaatttgaagagttattttacatacaattacaattaattctcaaaaatttaattcataaaactaaaataaaagggtttccatttacaaccgtcggaacacactttaatacgtttttcaaaaaccatttaccgtttgaattaaccaatgcacaaaaacgagtacttaaagaaattaggtcagatttaggtagcaatgcccaaatgaatcgtcttttacaaggtgatgttggctctgggaaaacaatagttgcgctaatgtcaatgttaatagcacttgacaacggttttcaagcttgcttaatggcacctactgaaattttgtcagtacagcactataatgaataa

SEQ ID NO: 23138 - protein, 299 aa, Unknown
  Obtained from environmental sample
  DOMAIN (24)...(99): OB-fold nucleic acid binding domain
  misc_feature (1)..(299): Xaa is any amino acid
MXWVYRSXFTYYKINQLLPNAAEVQIVGKIVKFEEIAQKRGKRLVATFKDETGTMELVWFRGQKWIKEGLKLNATYVIFGKTNLFANKYNMPHPDIELLSEHEANLRSAMQAIYPSTEKLANRGISNRVMTKIMQNLFLETKGRFVETLSEKLLSENKLISKSEALLNVHFPKDQNALSKAEFRLKFEELFYIQLQLILKNLIHKTKIKGFPFTTVGTHFNTFFKNHLPFELTNAQKRVLKEIRSDLGSNAQMNRLLQGDVGSGKTIVALMSMLIALDNGFQACLMAPTEILSVQHYNE

SEQ ID NO: 23139 - DNA, 339 bp, Unknown
  Obtained from environmental sample
  misc_feature (1)..(339): n is a, c, g, or t
ttgcccgatcctaaagaaattggaaatagcggaagtttttttaaaaaccctattatttcaacggatgattttaaaaacttacaaaaaacataccctgatgcacctcattatgttgtttcaaagaaagaagttaaggttcctgcaggttggctcgttgaacaatgtggatttaaaggtaaacgttttggtgatgccggcattcataaaaaacaagccttggttttagtgaattatgataatgccaccggtgaagatatattaaatttagctaaaaaaatccaaaagacagttttcgaaaaattcaaaatacacctcgaagcagaagtgaatattatatga

SEQ ID NO: 23140 - protein, 112 aa, Unknown
  Obtained from environmental sample
  DOMAIN (1)...(112): UDP-N-acetylenolpyruvoylglucosamine reductase, C-terminal domain
  misc_feature (1)..(112): Xaa is any amino acid
MPDPKEIGNSGSFFKNPIISTDDFKNLQKTYPDAPHYVVSKKEVKVPAGWLVEQCGFKGKRFGDAGIHKKQALVLVNYDNATGEDILNLAKKIQKTVFEKFKIHLEAEVNII

SEQ ID NO: 23141 - DNA, 798 bp, Unknown
  Obtained from environmental sample
  misc_feature (1)..(798): n is a, c, g, or t
ttgcaagaaatagctagaactaataatgttattctagatatatttgctaagccatacgccttattagatttaagtacagtaacaaatatagaaagcgttattgtgagttatcaaaatagtaaaatagctcaagaaaaatcggctcaattaatatttggagctattcctgcaaaaggaaacttaccagtttctgcgggtgagttttttaacgttggtgatggtaagcaagccaattctttagagcgtttggggtattcaataccagagcgagttggcatgtctagttatgcacttaaaaaaattgactcgattgccaactatgcagtcaatggtaaaatgacaccaggaatacaattagttattgctagaaaaggtaaagtgatttataataaaacctttggtaaacatacttatgaaggttcgactaaagtagaatctgatgatatttatgacattgcgtctttaactaaaattgtagctacattaccattattaatggagttagaagagcaaggtattgtgtctttagatactaaactttcagagattataccgtcttataaaaattcanataaaaaaaatgtgactttaaaaaagatgttgtcacattacgcccaattaaaaccatggattcctttttattataaaactttagatccagaaactagcaaaccttcggctaaatattatagaaaaactagaagtaagggatttacagtaaaggttgctcccgaacttttcatgagagatgactataaagattcctttaatactattattaagaaccagagctattat

SEQ ID NO: 23142 - protein, 266 aa, Unknown
  Obtained from environmental sample
  misc_feature (1)..(266): Xaa is any amino acid
MQEIARTNNVILDIFAKPYALLDLSTVTNIESVIVSYQNSKIAQEKSAQLIFGAIPAKGNLPVSAGEFFNVGDGKQANSLERLGYSIPERVGMSSYALKKIDSIANYAVNGKMTPGIQLVIARKGKVIYNKTFGKHTYEGSTKVESDDIYDIASLTKIVATLPLLMELEEQGIVSLDTKLSEIIPSYKNSXKKNVTLKKMLSHYAQLKPWIPFYYKTLDPETSKPSAKYYRKTRSKGFTVKVAPELFMRDDYKDSFNTIIKNQSYY

SEQ ID NO: 23143 - DNA, 708 bp, Unknown
  Obtained from environmental sample
  misc_feature (1)..(708): n is a, c, g, or t
atgaaatcaaggagttacatacaattattggttttggttttctttactgtatttatttctgcacctatgttgtctcagaacagcatgtctataaaaaccgacaccgcaaaaatagaaaacctcttttttgatggtcaaaaagtgataaaaccaatagacttgaatttgatcgatccttttcaaggcaattcaattttaaattttaaatccaatcagtttttaatcggttttaaaccaaaagccaaagattattttaaccctttaaattgtcataaaaagccaagcaattttatgtctgatccagaaaaaattgattctgacgttcttgtcaaaaaacatttcaacggaaaagacatgagcaatgttaaactaaccagtgattatagtcttggaaccctttacagtacttcaaaatcgatgcgaattgaagttcgtgatcatagtttagtggatggagacagaataaaagtttatataaatgagcagatgattagttcaaacattatgttgagtggcctttcaagaatcattaatattaatttaattaaaggatataaccggattgatattgaagccataaatgaaggatattcagggccaaatacagccgaattaaaggtctttgatgaagatggttatttaatttcttcgcaagaatggaatattttaaccgggcaaagagcaacacttggggtcgtaagaaattaa

SEQ ID NO: 23144 - protein, 235 aa, Unknown
  Obtained from environmental sample
  misc_feature (1)..(235): Xaa is any amino acid
MKSRSYIQLLVLVFFTVFISAPMLSQNSMSIKTDTAKIENLFFDGQKVIKPIDLNLIDPFQGNSILNFKSNQFLIGFKPKAKDYFNPLNCHKKPSNFMSDPEKIDSDVLVKKHFNGKDMSNVKLTSDYSLGTLYSTSKSMRIEVRDHSLVDGDRIKVYINEQMISSNIMLSGLSRIININLIKGYNRIDIEAINEGYSGPNTAELKVFDEDGYLISSQEWNILTGQRATLGVVRN

SEQ ID NO: 23145 - DNA, 423 bp, Unknown
  Obtained from environmental sample
  misc_feature (1)..(423): n is a, c, g, or t
gtgtacaggtcgctaaagtggcttaacataccaacttcttttagcgctcctaccagtaataatacacctacaaaaaacaacaaggtgtcgtattctatttcacgaatgaaatctatcatgtctttgtttatgtcttttttgcgcattaaaaattgcgctactaaaaacatcatagacaaaccaaacaaaaaggtaagcaatggcggtacactgtataaaacactcagtgttaaggtagcaataaccgtagataagaagataactgcaattgtaatatcggttttttcaatgcgtttttgcttcgttttagtaaagtcgagctggccatttaagccaattgacaacagtgcggctaacagcatcacacttacaaatgctggcccaattaacataacaaatgctaatagttactttgccatctaa

SEQ ID NO: 23146 - protein, 140 aa, Unknown
  Obtained from environmental sample
  misc_feature (1)..(140): Xaa is any amino acid
MYRSLKWLNIPTSFSAPTSNNTPTKNNKVSYSISRMKSIMSLFMSFLRIKNCATKNIIDKPNKKVSNGGTLYKTLSVKVAITVDKKITAIVISVFSMRFCFVLVKSSWPFKPIDNSAANSITLTNAGPINITNANSYFAI

SEQ ID NO: 23147 - DNA, 414 bp, Unknown
  Obtained from environmental sample
  misc_feature (1)..(414): n is a, c, g, or t
atgaatttcaccgataaacttattatagccgtcgattttgatggaactattgtagaagatgcctatccaaaaattggaaagcctaaactatttgcttttgaaacacttgaacgcttgcaaaaagaaggtcacagaataattttatggacatatagaagcgatattcgtttagcagaagctgttgcgttttgtaaagaaaatggcttggaattttatgctgtaaataaaagttttcctgaagagcaattcgattatacgaaaagccgaaaaatccatgcggacatttttgtagatgacagaaatataggcggtcttttgggttggggtgaaatttatcaattgcttgccaacccaaagtaccatcctcataaacttgctaaaaagaaaggattattttccttttttagaagataa

SEQ ID NO: 23148 - protein, 137 aa, Unknown
  Obtained from environmental sample
  misc_feature (1)..(137): Xaa is any amino acid
MNFTDKLIIAVDFDGTIVEDAYPKIGKPKLFAFETLERLQKEGHRIILWTYRSDIRLAEAVAFCKENGLEFYAVNKSFPEEQFDYTKSRKIHADIFVDDRNIGGLLGWGEIYQLLANPKYHPHKLAKKKGLFSFFRR

SEQ ID NO: 23149 - DNA, 879 bp, Unknown
  Obtained from environmental sample
  misc_feature (1)..(879): n is a, c, g, or t
ttgtatgaacaatctaaacataaaactagagtagttattggcggaagtcatggtaaaaccacaataacatccatgattttacacgtcatgcattaccatgatcgtgatgtggattacatggttggtgcacaattagaagggtttgatgttatggtaaaactaacagacgataacgactttattgtgttggaaggtgatgagtatttaagtagcccaattgataggagaccaaaatttcatttatacaaaccaaatattgctttgttaagcggaattgcatgggaccatattaacgtgtttcctacctatgaaaattatgtagagcagtttagcatttttgtagatagtattgtaaaaggaggaagcataaattataacgaagaagacacagaggttaaacgtgtagttgaagcatctgcaaatccaatacgtaagattgcataccacacaccagaatatacagtggaagatggcgaaacgttattagaaactcctgaaggtccaatgccaattgaaatttttggaaaacataacttgaataatttagcaggtgctaagtggatttgtcaacatatgggaattgatgaagacgatttttacgaagccatttctacttttaaaggcgcaagtaaacgtttagagaaaattgccgaaagtaaaactagcgttgcttttaaagattttgcgcactcacncagtaaagtaaaggcgactactaacgctgttaaagagcaatatcaaaaccgtacgttagtggcttgtttagagttacctacttatagtagtttaaatgccgaatttttaaaaaaatataaaggaacattagatgctgcagatgtaccagtagtgttttatagtccacatgccggtaaaaattaa

SEQ ID NO: 23150 - protein, 292 aa, Unknown
  Obtained from environmental sample
  DOMAIN (1)...(200): Mur ligase family, catalytic domain
  misc_feature (1)..(292): Xaa is any amino acid
MYEQSKHKTRVVIGGSHGKTTITSMILHVMHYHDRDVDYMVGAQLEGFDVMVKLTDDNDFIVLEGDEYLSSPIDRRPKFHLYKPNIALLSGIAWDHINVFPTYENYVEQFSIFVDSIVKGGSINYNEEDTEVKRVVEASANPIRKIAYHTPEYTVEDGETLLETPEGPMPIEIFGKHNLNNLAGAKWICQHMGIDEDDFYEAISTFKGASKRLEKIAESKTSVAFKDFAHSXSKVKATTNAVKEQYQNRTLVACLELPTYSSLNAEFLKKYKGTLDAADVPVVFYSPHAGKN

SEQ ID NO: 23151 - DNA, 513 bp, Unknown
  Obtained from environmental sample
  misc_feature (1)..(513): n is a, c, g, or t
ttggaaaggcagacagatcggctcagagattttaaacttacccttgaaaacacatcaggtagcataacgatagatggtatagacaaaacaatactccgtgctttaatggaagatgcgcgtacccctattttagaaattgcacgacaagtcggaatttctggagctgccattcatcagcggttacgaaaacttgaaaaatcaggattaattgcaggttctaagtttgttattaatcctaaaatattagggtatactacaatggcttttgttggtatttatttggacaaggcaatgagcaacccagaagcggtaaagcaactaaaaaaaatacctgaagttatagagtgtcactacaccacaggaaactggagtattcttattaaaatattatgtaaggataacgagcatttaatgcatttattaaataaagacatccaaaccataaatggcgtatcgcggacagaaacttttatttctttagaccaacaaatacagcgtcaaattaacatataa

SEQ ID NO: 23152 - protein, 170 aa, Unknown
  Obtained from environmental sample
  DOMAIN (48)...(149): AsnC family
  misc_feature (1)..(170): Xaa is any amino acid
MERQTDRLRDFKLTLENTSGSITIDGIDKTILRALMEDARTPILEIARQVGISGAAIHQRLRKLEKSGLIAGSKFVINPKILGYTTMAFVGIYLDKAMSNPEAVKQLKKIPEVIECHYTTGNWSILIKILCKDNEHLMHLLNKDIQTINGVSRTETFISLDQQIQRQINI

SEQ ID NO: 23153 - DNA, 534 bp, Unknown
  Obtained from environmental sample
  misc_feature (1)..(534): n is a, c, g, or t
atggctggaattaagttcaaaggtgcaactttcgatttgaatacgcgtcattgtaaagttacattgccaaacacagttgcctttggaaacgtaaaatatggcacttttaatgctcataatttaaatggtggggaattaacaattgatttttctcctgtaactatcaacgatttaaacgcttgtactttatttttaaacaatgtaactgatgctaaaattgcatcagttaccaatacaaccatgagtaataattcttctggagttaaaatttataaaatcaatgaaaatgtaacgatttctgataaatttggagagttaagaattgatagttttaacccaaattttggtgattttttgttaaatttaagtcaatctaatgccactattattttaggtgatgtgccaagtaaatttaaatatcaagtaaataaagtgaatttagaaaataaacgagctggaaaatcgaaagcaaattcatcaacagaaaacttaattacttttaaaggtgattatagtagtgtattgattgaataa

SEQ ID NO: 23154 - protein, 177 aa, Unknown
  Obtained from environmental sample
  misc_feature (1)..(177): Xaa is any amino acid
MAGIKFKGATFDLNTRHCKVTLPNTVAFGNVKYGTFNAHNLNGGELTIDFSPVTINDLNACTLFLNNVTDAKIASVTNTTMSNNSSGVKIYKINENVTISDKFGELRIDSFNPNFGDFLLNLSQSNATIILGDVPSKFKYQVNKVNLENKRAGKSKANSSTENLITFKGDYSSVLIE

SEQ ID NO: 23155 - DNA, 462 bp, Unknown
  Obtained from environmental sample
  misc_feature (1)..(462): n is a, c, g, or t
atgaaaatattcaaaaaatttacagcgatagtagcaattacatcatttttacttgtttcttgtaacacaaaagagaaagaatacaacttaactttaaatgatggcacagaggttttctacatttcaaatgatgaaagtgccatttctataaatggttggagtgaatttaatgctattaataaaaacttactaaacttaaaagacaaggattataatattacaattcaaagtttagaagatttgaatggttcaattactaatttggcaaatacaattccagcttctttaaaaacagaagaagttttagaagatattagagatgtacaggaagaatatacaaaactaatcaacgaaaaaaatgcaccacttaaaaatgtgaaacaaaacattgaagaattggtagagaaatttgatgatttaagagaagaattaaacgaaactgtagaagattacatcaaataa

SEQ ID NO: 23156 - protein, 153 aa, Unknown
  Obtained from environmental sample
  misc_feature (1)..(153): Xaa is any amino acid
MKIFKKFTAIVAITSFLLVSCNTKEKEYNLTLNDGTEVFYISNDESAISINGWSEFNAINKNLLNLKDKDYNITIQSLEDLNGSITNLANTIPASLKTEEVLEDIRDVQEEYTKLINEKNAPLKNVKQNIEELVEKFDDLREELNETVEDYIK

SEQ ID NO: 23157 - DNA, 441 bp, Unknown
  Obtained from environmental sample
  misc_feature (1)..(441): n is a, c, g, or t
gtgggtcgccgtacaaaacgcgaaattgaaaagcgcattggcaaagtgaagcactcagaaaataatgcaaaaaaattagcagaatatttaatagaatacattgatggtaccgaagtaacttacttctgtagcgatgtaagattagacgagcttccaacaatccttagtgaaaacaatattaaagtaaacgaagtggaagcttaccaaacaaagctagatcctttaaaattaaaagacagtatagaaggtgttatgttttatagcccgtctaccgtgcaaagttttaaacaagaaaacaaccctacagacacaacggttgcttattgtataggagataccactgcaaaagaagcatctagacattttaaagatgttcgcgttgcaaaattaccaactgtagaaagtgttatcgcattggtgaatgaaaattattcatcataa

SEQ ID NO: 23158 - protein, 146 aa, Unknown
  Obtained from environmental sample
  misc_feature (1)..(146): Xaa is any amino acid
MGRRTKREIEKRIGKVKHSENNAKKLAEYLIEYIDGTEVTYFCSDVRLDELPTILSENNIKVNEVEAYQTKLDPLKLKDSIEGVMFYSPSTVQSFKQENNPTDTTVAYCIGDTTAKEASRHFKDVRVAKLPTVESVIALVNENYSS

SEQ ID NO: 23159 - DNA, 726 bp, Unknown
  Obtained from environmental sample
  misc_feature (1)..(726): n is a, c, g, or t
ttgtcattaacaaaacccgaagtctgtttacacgaaaacatgcaacaaaaaaacacatacttctatgctattggcttaagttataaaaaagctgatgcagagattagagggcattttagcttggatgatactggtaaaactaaagtattggaacaagctaaagacaatggaattgaaagtttaattgtaacttctacctgtaacagaaccgaaatttttggttttgcagaacatccttttcagcttatccaattactttgtgataacaccaaaggtaccgttgaagaatttagaaaagtcgcttatatttacaaaaacaacgaagctgtatcccatatgtttcgcgttggctctggtttagacagtcagattttaggcgatttcgaaattattagtcagttaaaaaagagtgctattctttctaaacagtatcacttattaaacccgtttatcgagcgtttaataaactctgtcattcaggctagtaagcgtattaaaaatgaaactgaaatttcttcaggcgctacatcggtttcctatgcctctgtgcattatataatgaaacagtttgaaaatgttgccaatcaaaacattttattattcgggacaggtaaaataggtagaaacacctgtgaaaacctagtaaaacataccaaaaacgaacacataactttaaattatagaacccaagaccaagcagaagctattgctggaaagttaaattaa

SEQ ID NO: 23160 - protein, 241 aa, Unknown
  Obtained from environmental sample
  DOMAIN (24)...(170): Glutamyl-tRNAGlu reductase, N-terminal domain
  misc_feature (1)..(241): Xaa is any amino acid
MSLTKPEVCLHENMQQKNTYFYAIGLSYKKADAEIRGHFSLDDTGKTKVLEQAKDNGIESLIVTSTCNRTEIFGFAEHPFQLIQLLCDNTKGTVEEFRKVAYIYKNNEAVSHMFRVGSGLDSQILGDFEIISQLKKSAILSKQYHLLNPFIERLINSVIQASKRIKNETEISSGATSVSYASVHYIMKQFENVANQNILLFGTGKIGRNTCENLVKHTKNEHITLNYRTQDQAEAIAGKLN

SEQ ID NO: 23161 - DNA, 624 bp, Unknown
  Obtained from environmental sample
  misc_feature (1)..(624): n is a, c, g, or t
ttggatagtccaacgttaaagtttgcacagtcttgtggtatgcaatttaaatttataagtcgtgaagcatttagactaaaaggaacacagtccttttacgaaaaaattaaaaaagaatttggtgacttttatttaattcctgaaggcggaaccaatgatttggctgttaaaggatgtgaagaaattttgacggaaacagaccgtaaatttaattacatatgtgcttccgtaggaacaggaggtaccttatcaggcttgattaataattcaaacacagcacaaaaagttttaggtttttcagctttaaaaggtgactttttaaaagaagatattagtaaatttgcaaaacaagataattggcaattaatgacagattaccattttggtggttatgctaaaataaatgcagaattagtaacgtttattaatagctttaaaaagcaaaataatattgcattagaccctgtttataccggaaaaatgatgtttggtatttacgatttaattaaacgtgattattttaagccaaattctgaaatattagtgattcatactggaggtttgcaaggtattgtaggtatgaataaaagattaaaacaaaaacaacaacagttaattttataa

SEQ ID NO: 23162 - protein, 207 aa, Unknown
  Obtained from environmental sample
  misc_feature (1)..(207): Xaa is any amino acid
MDSPTLKFAQSCGMQFKFISREAFRLKGTQSFYEKIKKEFGDFYLIPEGGTNDLAVKGCEEILTETDRKFNYICASVGTGGTLSGLINNSNTAQKVLGFSALKGDFLKEDISKFAKQDNWQLMTDYHFGGYAKINAELVTFINSFKKQNNIALDPVYTGKMMFGIYDLIKRDYFKPNSEILVIHTGGLQGIVGMNKRLKQKQQQLIL

SEQ ID NO: 23163 - DNA, 903 bp, Unknown
  Obtained from environmental sample
  misc_feature (1)..(903): n is a, c, g, or t
gtggggattgaacgttgggtatttccagatgattattttgaaaaccacaacgatcccgatataaaaaatttaaaagggttggatcgttttatcgacgaggttggaatcatggatggaggtatagcagataaccaaggtattgggagtatgatgcttattaatgatcgtattaaagatgggttggatctaattattgttaatgatgtaggaagttataaaatgacaccatggcagcaggatacgactaccattgggaaaagttctacgattaaacgcactatgaataagatactgcaatactttacaataaagcctttgtattggattgcatttttactaggcttaataatcgtcctattaaatagcatgttggtctttggaccaattgcttatactggactctatattattggcagtgctattatgggaatggggtttcttttgagcgtatttgggatagcagctttttttataaagtctgggatactatctagattgaaaacactctttaaaaagaacgtccctgaagccttattggatgatgttttaacttttcagaaactagatattagtttaatacagcgtatgttgactgagcgttttacttcggccatggtaatgattaacgatgtttttttgaaacaaatacgacgtttaaattacgatttgttctactctaaagttgaattaaaaaataaacgcattaccacgaccgtctataagttaaatggtgaaaagacaccatacagtgctacaaattataacaaagcgatacaaccagcaccaagtaagagcttgaagagtgttagtttgacggcttctgaaacacctacaacattatggtgggacaaaacgcgatgttgccaaaaacaggatggaaactttaatctcgagccgatctga

SEQ ID NO: 23164 - protein, 300 aa, Unknown
  Obtained from environmental sample
  misc_feature (1)..(300): Xaa is any amino acid
MGIERWVFPDDYFENHNDPDIKNLKGLDRFIDEVGIMDGGIADNQGIGSMMLINDRIKDGLDLIIVNDVGSYKMTPWQQDTTTIGKSSTIKRTMNKILQYFTIKPLYWIAFLLGLIIVLLNSMLVFGPIAYTGLYIIGSAIMGMGFLLSVFGIAAFFIKSGILSRLKTLFKKNVPEALLDDVLTFQKLDISLIQRMLTERFTSAMVMINDVFLKQIRRLNYDLFYSKVELKNKRITTTVYKLNGEKTPYSATNYNKAIQPAPSKSLKSVSLTASETPTTLWWDKTRCCQKQDGNFNLEPI

SEQ ID NO: 23165 - DNA, 468 bp, Unknown
  Obtained from environmental sample
  misc_feature (1)..(468): n is a, c, g, or t
ttgaataaaggaattgcgttatttggtccgagtattaaatctgatgacgcgactaaaaaaataagtagttacgattggactttgcaaagtatagacggtgaagcattcgattttaacagtactaaaaacaaagtcgttttggtaaacttgtgggcaacgtggtgcccgccgtgtatagccgaaatgccatctattcaagcgttacacgatgattataaagataaaattaaatttgttttagtgtcgaatgaagacaaagtagttattacaaattttttaaggactaaagactatacatttcctgtattttctgcaactagcgaaagcccagaaacgtttaatgtacgtagtattccgcaaacctttttaatagataaagaaggacgtattattattgaagaatctggtgccgccaattggaatagtgataaagtacgtgctaaaatagatgcgcttttgaaactataa

SEQ ID NO: 23166 - protein, 155 aa, Unknown
  Obtained from environmental sample
  DOMAIN (27)...(154): Thioredoxin
  misc_feature (1)..(155): Xaa is any amino acid
MNKGIALFGPSIKSDDATKKISSYDWTLQSIDGEAFDFNSTKNKVVLVNLWATWCPPCIAEMPSIQALHDDYKDKIKFVLVSNEDKVVITNFLRTKDYTFPVFSATSESPETFNVRSIPQTFLIDKEGRIIIEESGAANWNSDKVRAKIDALLKL

SEQ ID NO: 23167 - DNA, 429 bp, Unknown
  Obtained from environmental sample
  misc_feature (1)..(429): n is a, c, g, or t
atgaaaaaatttttattgatagtatgtataggtttattgatgttttcatttacaaaaaaagaagagaattatactcaaattgatcaagactcaaaacttataaaaagtattaaaagagggaaggaagtctatgtagatatgtgtatgtcatgtcatttagcaaatggagaaggtatacccaaagtgtatcctcctttagcaaaatcagattatttaatggagaagagagaggctagtattagtgccataaaatacggtttgcgaggtaagattgttgtaaatggaataacatacaaaaatatgatgtctagattaggtttgttagatgatgaagttgcagacgtaatgaattatattaccaattcatggggaaataaaaactcggaaatgattacaattgaagaagtaaaagctgtttctaaaaaatag

SEQ ID NO: 23168 - protein, 142 aa, Unknown
  Obtained from environmental sample
  SIGNAL (1)...(18)
  DOMAIN (38)...(123): Cytochrome c
  misc_feature (1)..(142): Xaa is any amino acid
MKKFLLIVCIGLLMFSFTKKEENYTQIDQDSKLIKSIKRGKEVYVDMCMSCHLANGEGIPKVYPPLAKSDYLMEKREASISAIKYGLRGKIVVNGITYKNMMSRLGLLDDEVADVMNYITNSWGNKNSEMITIEEVKAVSKK

SEQ ID NO: 23169 - DNA, 876 bp, Unknown
  Obtained from environmental sample
  misc_feature (1)..(876): n is a, c, g, or t
gtgggtagaaatagtaaaggccattttattaattttaatgggactgctggggtttggagaaaaacctgtattctcgatgctggaaattgggagggcgacactttaaccgaagatttagatttaagttacagagctcaacttaaaaattggaaatttaagtatttggaagatgtcgaaacccctgccgaattaccagtagtgattagtgccgcaagatcacagcaatttcgatggaataaaggcggtgccgagaattttagaaaaatgatgtggaaagttttaaaaagcaaaaacatatctaaaaaaacgaagcttcacggattacttcatttattaaatagcacgatgttcttaaatgtacttattgttgctgttttaagcatcccaatgctatatattaaaaacgaatactcgcacctaaaaccttatttttatgtgatgagcttttttgtaatcagtactctcatcttttttatctgctattgggttatgtataagaattcctatggtaaaggtgtgaagaattttatacaatatacggctttatttttcacatttttctctatagcaatggggttttcgttacataattctattgctgtaatagaaggtcacttaggcaaaaaaagcgactttgtaagaacgccaaaatttaatattaacgcactaacagacacttggaaaggcaacaaataccttaaaaaaaatatatcggttaacattattttcgaaggcttattaatgctgtattttgcatttgggatgtatagcgcttttgttgtgggcgatcaaggtggagatttcggattatttccttttcatttaaggctctttttagggtttggttttgtgttttttcagtccctaaccctctaa

SEQ ID NO: 23170 - protein, 291 aa, Unknown
  Obtained from environmental sample
  misc_feature (1)..(291): Xaa is any amino acid
MGRNSKGHFINFNGTAGVWRKTCILDAGNWEGDTLTEDLDLSYRAQLKNWKFKYLEDVETPAELPVVISAARSQQFRWNKGGAENFRKMMWKVLKSKNISKKTKLHGLLHLLNSTMFLNVLIVAVLSIPMLYIKNEYSHLKPYFYVMSFFVISTLIFFICYWVMYKNSYGKGVKNFIQYTALFFTFFSIAMGFSLHNSIAVIEGHLGKKSDFVRTPKFNINALTDTWKGNKYLKKNISVNIIFEGLLMLYFAFGMYSAFVVGDQGGDFGLFPFHLRLFLGFGFVFFQSLTL

SEQ ID NO: 23171 - DNA, 513 bp, Unknown
  Obtained from environmental sample
  misc_feature (1)..(513): n is a, c, g, or t
ttgcaaaagggggatagacaagcacaggaacagctatatcgggactattcccgggtactgtttggcatttgtctcaaatactcacgcaataaaacggaggcggaagataacctacatgatagttttatgactatctatagtaaaatagaacagtttaaacatcaaggctcttttgaaggctggataaagcgtattactgtaaatacagttcttcaaaaatatagaaaagaggaaaatttaactgtggtttccgaaaatatagaggaggaagtgccagaagattcaggttatgtaaatctcgatttggccacattactcagttatatacaagagcttccaaataaataccgcttaaccttcaatctatatgtgttggatggtcatagccataaagaaataagtgaaatgttaggaacgtccatggggacttccaaatccaatcttgcccgggcaagaatgattttaaaagaaaaaattgaggcaaataaggcaggaatcataatggaagggtaa

SEQ ID NO: 23172 - protein, 170 aa, Unknown
  Obtained from environmental sample
  DOMAIN (108)...(157): Sigma-70, region 4
  misc_feature (1)..(170): Xaa is any amino acid
MQKGDRQAQEQLYRDYSRVLFGICLKYSRNKTEAEDNLHDSFMTIYSKIEQFKHQGSFEGWIKRITVNTVLQKYRKEENLTVVSENIEEEVPEDSGYVNLDLATLLSYIQELPNKYRLTFNLYVLDGHSHKEISEMLGTSMGTSKSNLARARMILKEKIEANKAGIIMEG

SEQ ID NO: 23173 - DNA, 375 bp, Unknown
  Obtained from environmental sample
  misc_feature (1)..(375): n is a, c, g, or t
atgagtgaaaataatttagataaattatttcaggagaagttggccaacttccatgaagttccagacgaaaaggtctggaattcaatagccacttccttggataaaaagaaacaaagccgcaagcttatccccctttggtggaaagttggaggagtggctgcaatatttgccatcctcttttttgcgatcgaccccttttctacttctaattccgtagtacctattacctctgatgtggaaataacacccgtagcactaagacaacaattccttaaaggaatcacgccagaagctaccagcatcacgggttatgaagaggaatcttctgatgaaaatcaatttaatccaccaaccaattgggcaagagaaaaatac

SEQ ID NO: 23174 - protein, 125 aa, Unknown
  Obtained from environmental sample
  misc_feature (1)..(125): Xaa is any amino acid
MSENNLDKLFQEKLANFHEVPDEKVWNSIATSLDKKKQSRKLIPLWWKVGGVAAIFAILFFAIDPFSTSNSVVPITSDVEITPVALRQQFLKGITPEATSITGYEEESSDENQFNPPTNWAREKY

SEQ ID NO: 23175 - DNA, 543 bp, Unknown
  Obtained from environmental sample
  misc_feature (1)..(543): n is a, c, g, or t
atgaatagacttctaattttacttttttcaatatttttaattagttgttacaatgaatcaaagttgttgaataacggcctgactcaaaaagcaaaacaaattaccgaatacacaattaaagttgaaaatgattctctgaataataagattcaagacacgcttgtaattaccgaaaagaaatacaacgaaaataaccaaataatcagcagacatcaacggaatttatttgctgacgaaacaatggatattgaattcatttacaataataggaaaaaaataaaaagagaaattgtgacgctttcaaatgacagttcaaattttattgttgattatttctacaaagacacattgcttttggaaacaaaatctgaatccaaaaacgacatttttcaattcaaacaaattggaggctacaaatataattctgacaacaaactaaaagaaagttcattaagacaaatctacattgacgttgaaacatatgacacaattactaatactcttgaaataagtaaatataacgacgaggnatttgtaaactga

SEQ ID NO: 23176 - protein, 180 aa, Unknown
  Obtained from environmental sample
  SIGNAL (1)...(18)
  misc_feature (1)..(180): Xaa is any amino acid
MNRLLILLFSIFLISCYNESKLLNNGLTQKAKQITEYTIKVENDSLNNKIQDTLVITEKKYNENNQIISRHQRNLFADETMDIEFIYNNRKKIKREIVTLSNDSSNFIVDYFYKDTLLLETKSESKNDIFQFKQIGGYKYNSDNKLKESSLRQIYIDVETYDTITNTLEISKYNDEXFVN

SEQ ID NO: 23177 - DNA, 579 bp, Unknown
  Obtained from environmental sample
  misc_feature (1)..(579): n is a, c, g, or t
atgctaacacttagaaagaaaactagtgctagaaccactaattcatatcatcgtttttataagtataataacatcataaaagacctaaaagttactaggcctaaccaagtgtgggtatctgacataacatacattagaactgtaaaaggtttttgctatttggctctaattactgatatgtattccagaaaaataatgggttatgacctgagtgacagcttggaattaaatggatgtgtaagagctcttaataaagcgatttatcaagctaaaaacattcaagggctaatacatcattcagacagaggaatacagtattgcagcaatgtatacacacaaatactcaaaagaaagaagatagatattagtatgacccaagaaaatcattgttacgaaaacgcaatggcagaacgtgtaaacggcatcttaaaagatgaattttacctcgaccaaacctttgataacgtgagtcacgcaaagaaagctgcaaaaagtgcaattaatttatacaatgatgtaagattacatttatctttagattataaaacaccgaatatggtatataaattatcagcttaa

SEQ ID NO: 23178 - protein, 192 aa, Unknown
  Obtained from environmental sample
  DOMAIN (30)...(189): Integrase core domain
  misc_feature (1)..(192): Xaa is any amino acid
MLTLRKKTSARTTNSYHRFYKYNNIIKDLKVTRPNQVWVSDITYIRTVKGFCYLALITDMYSRKIMGYDLSDSLELNGCVRALNKAIYQAKNIQGLIHHSDRGIQYCSNVYTQILKRKKIDISMTQENHCYENAMAERVNGILKDEFYLDQTFDNVSHAKKAAKSAINLYNDVRLHLSLDYKTPNMVYKLSA

SEQ ID NO: 23179 - DNA, 354 bp, Unknown
  Obtained from environmental sample
  misc_feature (1)..(354): n is a, c, g, or t
ttggtttctaatttatgtgctagtaaaagtacaatctccacacaccttaatcatttaaacgatttgaagaaggtgctctattttacaaaaccaggagatcgaaaaaaatattacatcattaatcacgacaatattttaacaagtatagaggtcatgattgaatcttggcaggcacaaaaagaattgcatttggaaattcgagaatataaacaagagaccaacaaatttagagaggatgaagcttctaaatttgaacttgattttcatgatgattacatcgcgtttttagaagaagccacccaatccatttcaaaattgaaatcaaaaataatagaaaagaaacataaattttaa

SEQ ID NO: 23180 - protein, 117 aa, Unknown
  Obtained from environmental sample
  misc_feature (1)..(117): Xaa is any amino acid
MVSNLCASKSTISTHLNHLNDLKKVLYFTKPGDRKKYYIINHDNILTSIEVMIESWQAQKELHLEIREYKQETNKFREDEASKFELDFHDDYIAFLEEATQSISKLKSKIIEKKHKF

SEQ ID NO: 23181 - DNA, 819 bp, Unknown
  Obtained from environmental sample
  misc_feature (1)..(819): n is a, c, g, or t
atgagcataaaaagaaaaaaattagtaattggatttgttgcctttataggtttggtaataccatcgttagtaatagcaaatactatagctaaaaataaacttaaaaactatatcgttaatttaccagagcatatatctttattgtatgacgatttagatgttagtcttttacagggtaatattactttaaaatcccctttgctaacagtcaaaggaaaaacgacaaatcaaattaatgctcaggttaaattaagtagtttatctattaaagattttagttattggaactatttatttaatgacaatttaaagtttgatcacttaaattttgatactccaaaagtaacttattaccacaacccattggctgatacagatcaaggcagtgcgtctgtttttaaaaacataaaaaaaacaatttacattaaaaatcttagcgttaataaggcttcagttgaggtttttaatgtcaaaaatgattccgttttattaagcacaaacaatcttgattttacaatgtcacagattattgttgataataatttagcgtcttcaaagcttttcgattttaaatctagcactttaagcactaataatttaaaatatcagataagcaaatttgaaaacttaagtgttgataaattaaaaatagataatactagaatgactttatctggatttagtttaaaaacaaaatatgataaggtggcattatcaaacgtgatcaccacagagcgtgatcactttgaattagcaactccagaaatacgtattgataattatgattttaagtttgataataccatatatcgggattag

SEQ ID NO: 23182 - protein, 272 aa, Unknown
  Obtained from environmental sample
  misc_feature (1)..(272): Xaa is any amino acid
MSIKRKKLVIGFVAFIGLVIPSLVIANTIAKNKLKNYIVNLPEHISLLYDDLDVSLLQGNITLKSPLLTVKGKTTNQINAQVKLSSLSIKDFSYWNYLFNDNLKFDHLNFDTPKVTYYHNPLADTDQGSASVFKNIKKTIYIKNLSVNKASVEVFNVKNDSVLLSTNNLDFTMSQIIVDNNLASSKLFDFKSSTLSTNNLKYQISKFENLSVDKLKIDNTRMTLSGFSLKTKYDKVALSNVITTERDHFELATPEIRIDNYDFKFDNTIYRD

SEQ ID NO: 23183 - DNA, 498 bp, Unknown
  Obtained from environmental sample
  misc_feature (1)..(498): n is a, c, g, or t
ttggacccctcacttttttcctcgaaagacccgaaaatagacaaatctatttcggagaataaaaaaaaagctgaagagacactggaaattggaaaacctttaaatttcaccaaaaaagaaaaatattcttttggggaatggcttcaattaacctcacaaaagcctaaaaaactaaaatccgaacccaatacatccaataaaggcaccgctaaaaccgagttgaaaccaactcccaaagtagataagctgaaaaagaaaaaatttgaactgatcgacaaattcattgaaacaaaccccaaaattgtacccaaagaaaacacggtaaaagtaaccatcaaggactccctgacttttgataaaaatgaattgatgacggccactttggccaaagtatatntggaacaaaagaagtataaaaaggctatacaggcctacaaaattttaagtttgaaatatccagaaaaaagtagtttctttgcagaccgaataaagcggtag

SEQ ID NO: 23184 - protein, 165 aa, Unknown
  Obtained from environmental sample
  misc_feature (1)..(165): Xaa is any amino acid
MDPSLFSSKDPKIDKSISENKKKAEETLEIGKPLNFTKKEKYSFGEWLQLTSQKPKKLKSEPNTSNKGTAKTELKPTPKVDKLKKKKFELIDKFIETNPKIVPKENTVKVTIKDSLTFDKNELMTATLAKVYXEQKKYKKAIQAYKILSLKYPEKSSFFADRIKR

SEQ ID NO: 23185 - DNA, 459 bp, Unknown
  Obtained from environmental sample
  misc_feature (1)..(459): n is a, c, g, or t
ttgaagttcaaggtacgtttaaagtattcaatcatgaaaaaactaatcttatttattgcagcccttttatttagcacctttttctacgaccaatctatcggacttaacctctttttattcagtatactcactgtggtcattctttttatcaataacaaagcgcattttaaaaattggaaaacccaaatctataccatagcctacctcatcacaggacttaccatcttttttcatagttcttcattatccataattgccaacttagtcgcattcttcacgttaatcggtcatttatctgaaaccaaatcttcaatttacataagttggcttaatggtttgtacaccactatcgcaggactatttcaccgtaattttgctttacccactcccaaaccatacactgagaatttagaaaaaaaagtcaaaatagattatttgcaatgggcgaagatcatttaa

SEQ ID NO: 23186 - protein, 152 aa, Unknown
  Obtained from environmental sample
  misc_feature (1)..(152): Xaa is any amino acid
MKFKVRLKYSIMKKLILFIAALLFSTFFYDQSIGLNLFLFSILTVVILFINNKAHFKNWKTQIYTIAYLITGLTIFFHSSSLSIIANLVAFFTLIGHLSETKSSIYISWLNGLYTTIAGLFHRNFALPTPKPYTENLEKKVKIDYLQWAKII

SEQ ID NO: 23187 - DNA, 423 bp, Unknown
  Obtained from environmental sample
  misc_feature (1)..(423): n is a, c, g, or t
atgaaaacgaaagatcaaattaaacaatctgcacggaaactctttaatgagagaggggtgatgaatgtgacattaagagatgtcgcanatgatttagataaaagctatggaaacataacctatcactttagtaaaaaggaagtgttaattgaaaacctgtatcaagatatgtttgaggaattacaagtaataaatatgaacgtaactgaagataaaagtaatttgttagctaagattattaaagctccttttacaacttttgatcttactatgaagtatatctttttttatatggattttatcgaaatcaggaggaattttcatgaaacttataaaatgatcgaagataataataaaagtaggatgcagatatggaaatattctttaatagaataccgaaatcaaatttcatcccaactgatt

SEQ ID NO: 23188 - protein, 141 aa, Unknown
  Obtained from environmental sample
  DOMAIN (7)...(53): Bacterial regulatory proteins, tetR family
  misc_feature (1)..(141): Xaa is any amino acid
MKTKDQIKQSARKLFNERGVMNVTLRDVAXDLDKSYGNITYHFSKKEVLIENLYQDMFEELQVINMNVTEDKSNLLAKIIKAPFTTFDLTMKYIFFYMDFIEIRRNFHETYKMIEDNNKSRMQIWKYSLIEYRNQISSQLI

SEQ ID NO: 23189 - DNA, 537 bp, Unknown
  Obtained from environmental sample
  misc_feature (1)..(537): n is a, c, g, or t
ttggcactttgggctaatgtaaaccctatgacgctgcttttacattcttttggaggtagcggttacgatattgcttgcgcacaacacaacactcctattctttacaaaattgggcaaccaccactaatcgaagaagtcactttccatccactatttaaagacgagttgttttttgttcaccgcaataaaaagcaaaacagtcgtgactcgattagcacgtacaaacaaaataaaataaatagcgcacttactattcaaaaaataaatgcgataacagctcagttattaaaaacagacaccagattgccgtttgatgctttattaacccaacacgaaaccctaatcgctaaagtcactaatcaaactcctattaaagaggaactgtttccggattataaaaatgctattaaaagtttaggcggctggcgtggcgattttatactcgttactggacctatagactatgtttacgattactttaacaaaaaaggctataccacaattctatcttacagtactcttattttaggtgcttaa

SEQ ID NO: 23190 - protein, 178 aa, Unknown
  Obtained from environmental sample
  misc_feature (1)..(178): Xaa is any amino acid
MALWANVNPMTLLLHSFGGSGYDIACAQHNTPILYKIGQPPLIEEVTFHPLFKDELFFVHRNKKQNSRDSISTYKQNKINSALTIQKINAITAQLLKTDTRLPFDALLTQHETLIAKVTNQTPIKEELFPDYKNAIKSLGGWRGDFILVTGPIDYVYDYFNKKGYTTILSYSTLILGA

SEQ ID NO: 23191 - DNA, 522 bp, Unknown
  Obtained from environmental sample
  misc_feature (1)..(522): n is a, c, g, or t
ttgtctaacgcattaaaagcaatagacaataataatgttttaaaaacatttgagacgtttgatggaccatcacactacaccttacccactcacgcaattcctaaagcattagagagtatctttttagtgtttcagccaattagtaaaaaagagtacaaagaaacaattctaaatctagaaggcaatccagtggattacctgacggaaaaataccaaatgattgatgagttgtttggaatagaaaagccaattttaattaacgattttaaagcaattgaagcagctattaaaaagaaagaaaattgggaatattttgaagatttaggaaaattagctagaaaagaatatccagatacattattaggaaattattatttaggacgcttttatgaagaaacaggagagcctaaaaaagcaatgaaaacataccagtcggcttatgtgctatcagaaatagcaggtattactaaagatcacgttttagaattatcagaacagattaaagcagattttggatattaa

SEQ ID NO: 23192 - protein, 173 aa, Unknown
  Obtained from environmental sample
  misc_feature (1)..(173): Xaa is any amino acid
MSNALKAIDNNNVLKTFETFDGPSHYTLPTHAIPKALESIFLVFQPISKKEYKETILNLEGNPVDYLTEKYQMIDELFGIEKPILINDFKAIEAAIKKKENWEYFEDLGKLARKEYPDTLLGNYYLGRFYEETGEPKKAMKTYQSAYVLSEIAGITKDHVLELSEQIKADFGY

SEQ ID NO: 23193 - DNA, 858 bp, Unknown
  Obtained from environmental sample
  misc_feature (1)..(858): n is a, c, g, or t
atgcacttacngttttctagaaaaatgtctacatttataaaggtaattaactttattttaaccccattcagtttgccattaatatcacttacaaaatatattgaaaaaaaattgggaagtaaaaactctagtttttcagtagaaactttatcacaagcattagagctaacgtcagaaggagcaactactaaagatgagcaaaagattttacaaggaatcgttaatttcggaaacacagaaaccgtacaaattatgattccgagaatcgatatttttgcaatttctgatgatgaatcttacgaagttgttttatcaaaaattttagaaaacggttattccagaaatccagtttacaaagaaaattctgataatattattggcgttttatttgcaaaagatttattagcgcatttaaacaagaaaaattttaaatggcaaaatttggttcgtgaagcttattttgtaccagagaacaaaaaactagatgacttgctaggcgattttagagcacgaaaaaaccatttagcaattgttgttgatgaatatggaggcacaagtggaatcgttaccttacaagacgtaattgaagaaattgttggtgatattaatgacgagtttgatgatgaagatttacattattctaaaattgatgcaaacacttatatttttgaaggtaaaactaccatcaaagatttttgtagggttttagatgatgaagatgaggaaatctttgaacaagaaaaaggcgaaagcgaaacattggctggttttattttagaggtttctggganattccctaaaaagaatcgagaaaataatcttcaagaaatatacgtttactatttgagcattagataa

SEQ ID NO: 23194 - protein, 285 aa, Unknown
  Obtained from environmental sample
  DOMAIN (146)...(199): CBS domain
  misc_feature (1)..(285): Xaa is any amino acid
MHLXFSRKMSTFIKVINFILTPFSLPLISLTKYIEKKLGSKNSSFSVETLSQALELTSEGATTKDEQKILQGIVNFGNTETVQIMIPRIDIFAISDDESYEVVLSKILENGYSRNPVYKENSDNIIGVLFAKDLLAHLNKKNFKWQNLVREAYFVPENKKLDDLLGDFRARKNHLAIVVDEYGGTSGIVTLQDVIEEIVGDINDEFDDEDLHYSKIDANTYIFEGKTTIKDFCRVLDDEDEEIFEQEKGESETLAGFILEVSGXFPKKNRENNLQEIYVYYLSIR

SEQ ID NO: 23195 - DNA, 495 bp, Unknown
  Obtained from environmental sample
  misc_feature (1)..(495): n is a, c, g, or t
ttgatgggatctaacatgatgcgtcaggctgtaccgttgttacgtcctcaagctcctattgttggaactggtttagagagacaagtagcttcagattctcgtgttttaattaatgcagaaggaaatggtgttgtgcaatatgttgatgcaaatgagattgttatcaagtatgaaagaacagaagacgatgctaaagttagttttgatagtgatattaaaacatatccattagttaagtttagaaaaactaaccagggaacttctattaatttaaagccaattgttaaaaaaggcgacaaaattactaaaggacaagttttatctgaaggttacgcaactcaaaagggtgaattggctttaggaagaaatatgaaagtagcctttatgccttggaaagggtacaactttgaggatgcaattgtaatttctgaaaaagttgttcgtgaagatatttttacctctattcacattgatgaatattctcttgaagtttag

SEQ ID NO: 23196 - protein, 164 aa, Unknown
  Obtained from environmental sample
  DOMAIN (36)...(164): RNA polymerase Rpb2, domain 6
  misc_feature (1)..(164): Xaa is any amino acid
MMGSNMMRQAVPLLRPQAPIVGTGLERQVASDSRVLINAEGNGVVQYVDANEIVIKYERTEDDAKVSFDSDIKTYPLVKFRKTNQGTSINLKPIVKKGDKITKGQVLSEGYATQKGELALGRNMKVAFMPWKGYNFEDAIVISEKVVREDIFTSIHIDEYSLEV

SEQ ID NO: 23197 - DNA, 600 bp, Unknown
  Obtained from environmental sample
  misc_feature (1)..(600): n is a, c, g, or t
gtgtcgaccaatagaagtgatgccccagacagttttaaaaaggtaaatgatggaatcataaggatcggttatataggaacacctacccataatgctgacctaaaaatcgttgttgacgcaataaagaaaattgaaaaaatttacgggaacaaagtacaggttgaagtgattggaggctatcaaaatacaaagcctgaatttggcaatagagtaggactgccaaaaaacaaccaatatatcaattttgtaagttggattgacaagcgagtaaactgggatataggcattattcctttagcagatgataatttcaacaaaagtaaaagctatctaaagttccttgaatactctgcattagatttagctattgtatgttcaaagggggtaacgtatgcagatgtatcaagacatagcagtaattgtcttgttgctgaaaatacaaccgaatcatggtttaacaatattgaaaagttaattcttgatactgacttgcgtgttcaattggctaaacaagctagagaagatcttgttacatcatatactgtacagcgaaataaagtagtgtatgaacaggtgtttgaatctgctaaagttcgataa

SEQ ID NO: 23198 - protein, 199 aa, Unknown
  Obtained from environmental sample
  DOMAIN (6)...(175): Glycosyl transferases group 1
  misc_feature (1)..(199): Xaa is any amino acid
MSTNRSDAPDSFKKVNDGIIRIGYIGTPTHNADLKIVVDAIKKIEKIYGNKVQVEVIGGYQNTKPEFGNRVGLPKNNQYINFVSWIDKRVNWDIGIIPLADDNFNKSKSYLKFLEYSALDLAIVCSKGVTYADVSRHSSNCLVAENTTESWFNNIEKLILDTDLRVQLAKQAREDLVTSYTVQRNKVVYEQVFESAKVR

SEQ ID NO: 23199 - DNA, 486 bp, Unknown
  Obtained from environmental sample
  misc_feature (1)..(486): n is a, c, g, or t
atgtttataaactgtaattttaatgcttgttacttatccactattacatttttagaatgtcaatttatagattgtgacctaagtaatagcaaaacatcagacacaacctttaaagatgtagcttttgaaaactgtaagctnttaggcgttttatttaatgactgtaaccaattattaatgtctatgacttttaataattgtcaacttaattttgcatcattttataaagttaaattaattaatacaaaatttactaactgtcaatttgaaaaaacagaatttacagaagctaatgtctcaaaatctgtttttgacaattgtaactttaaatacgctatcttttttaatactaacatagagcaagctaactttttaacctcttacaactactctattcatcctgaaaataataaaattaaaggcgcaaaattttcgaaagaccaaattcaggggttattagatcactataaaattcagatttcttaa

SEQ ID NO: 23200 - protein, 161 aa, Unknown
  Obtained from environmental sample
  DOMAIN (87)...(126): Pentapeptide repeats (8 copies)
  misc_feature (1)..(161): Xaa is any amino acid
MFINCNFNACYLSTITFLECQFIDCDLSNSKTSDTTFKDVAFENCKLLGVLFNDCNQLLMSMTFNNCQLNFASFYKVKLINTKFTNCQFEKTEFTEANVSKSVFDNCNFKYAIFFNTNIEQANFLTSYNYSIHPENNKIKGAKFSKDQIQGLLDHYKIQIS

SEQ ID NO: 23201 - DNA, 390 bp, Unknown
  Obtained from environmental sample
  misc_feature (1)..(390): n is a, c, g, or t
gtgcagaataataaaatactacgtaaaaagtttaatttgcaggtggtatttagcatggctggtgctgtaattagtttagatagaataaatactaaaacagctattcttacacaattatttcatggaactaacgataaattagtgccttataatattgctccacatcatttttgtgataaaaatagtattgggtatttaaaactatatggctctaaagctatagcaaataagctcaaaaaaaataataaccaattttatttatataccattaacagaggaaaccatagttggtctggaaggcctttaaaccaatgtagaaaagaaattgttgattttttatattatgatgttttaaaaaacaacaatagacaaactgaaattacaatataa

SEQ ID NO: 23202 - protein, 129 aa, Unknown
  Obtained from environmental sample
  misc_feature (1)..(129): Xaa is any amino acid
MQNNKILRKKFNLQVVFSMAGAVISLDRINTKTAILTQLFHGTNDKLVPYNIAPHHFCDKNSIGYLKLYGSKAIANKLKKNNNQFYLYTINRGNHSWSGRPLNQCRKEIVDFLYYDVLKNNNRQTEITI

SEQ ID NO: 23203 - DNA, 525 bp, Unknown
  Obtained from environmental sample
  misc_feature (1)..(525): n is a, c, g, or t
atggagcaaattgatagagaacgagcattaattaaatttagaaacggtacacatcaaattataatcgccacagatcttgcagcacgtggtttagatattcctgaattaaattacattattcactatcaattacctttaaaggcagaagagtttacacatcgtaatggtcgtactgcacgtatgaatgcagaagggacatcttatgttatacaatgggaaggagaacgccttccggattttattaaatttgatgatacagtaacgccaaaaggtacagttaatactttaacaacagattgggttacactatttatttctggaggacgtaaagataaaatctctaaaggagatgtagcaggtgtgttgtttaaacaatgtaatctagataaatccgaaattggaattatagaacttaaacaagattgtgtgtttgtagctgtgccaaaaacaaaagcaactattattatcgatacaattaataacacaagattaaaaaagaaaaaggtaagagtgtacactatttaa

SEQ ID NO: 23204 - protein, 174 aa, Unknown
  Obtained from environmental sample
  DOMAIN (1)...(62): Helicase conserved C-terminal domain
  misc_feature (1)..(174): Xaa is any amino acid
MEQIDRERALIKFRNGTHQIIIATDLAARGLDIPELNYIIHYQLPLKAEEFTHRNGRTARMNAEGTSYVIQWEGERLPDFIKFDDTVTPKGTVNTLTTDWVTLFISGGRKDKISKGDVAGVLFKQCNLDKSEIGIIELKQDCVFVAVPKTKATIIIDTINNTRLKKKKVRVYTI

SEQ ID NO: 23205 - DNA, 504 bp, Unknown
  Obtained from environmental sample
  misc_feature (1)..(504): n is a, c, g, or t
atgaaaaataaaataatcatcaacatccttatttttagctttctaagctttggtttaaaagcaggcgtaaacattaaaaatggcaacttttacatttcttattcagatgttttactaaaaaagtataaatctgcctttaaagatattacaagaacatacaattcaaaatctacagaaattggtttgtttggctatggttggggaacaaaatttgaaacctcaattacggtttatcctgatggaactttacaagttaaagaatatggtgctggaggtaaaaccatttattcttccaattttatttctagtgatttaacacaattaatgatcgatgatttaattgatgctatgcaaactgaaggcgatttagaattagacccaactagtattaccaatcaaataaaaaaattaaaaactaatattgaatatcgcttattagtttgggataaatatgttaaaaaaggattgttagaaaaccccacagatttccttaggtctgaatga

SEQ ID NO: 23206 - protein, 167 aa, Unknown
  Obtained from environmental sample
  misc_feature (1)..(167): Xaa is any amino acid
MKNKIIINILIFSFLSFGLKAGVNIKNGNFYISYSDVLLKKYKSAFKDITRTYNSKSTEIGLFGYGWGTKFETSITVYPDGTLQVKEYGAGGKTIYSSNFISSDLTQLMIDDLIDAMQTEGDLELDPTSITNQIKKLKTNIEYRLLVWDKYVKKGLLENPTDFLRSE

SEQ ID NO: 23207 - DNA, 345 bp, Unknown
  Obtained from environmental sample
  misc_feature (1)..(345): n is a, c, g, or t
ttgtattattttacaaatgaaaccaataaaaagaaaacgttcatgagggaattaaaaaatgcaactgcaggtaaaagttggcaaataaaaaaatatgagttgctttctaaaatttatatcgatttaaatgatgcaaaaaatgcccgtttttattttgatgaaatgcagaaaattaatccaatagcaaatgttattttagaagctttagttttatccataaatgataaaaacaacgaagcaaaagaaaaattaaaaacggttaatccattactcttaagagagcagtatttaaagagaaaatataacagcaacacaattaacatcattaaaaaactacaagaatga

SEQ ID NO: 23208 - protein, 114 aa, Unknown
  Obtained from environmental sample
  misc_feature (1)..(114): Xaa is any amino acid
MYYFTNETNKKKTFMRELKNATAGKSWQIKKYELLSKIYIDLNDAKNARFYFDEMQKINPIANVILEALVLSINDKNNEAKEKLKTVNPLLLREQYLKRKYNSNTINIIKKLQE

SEQ ID NO: 23209 - DNA, 924 bp, Unknown
  Obtained from environmental sample
  misc_feature (1)..(924): n is a, c, g, or t
ttggannacacatggtcagaatcggctcgagattggattgtacgtgttgtgcaatccaatcagtattcttatgaaatcctatttattgacgatggcagtacagataattcatggaatgttattaaacaattagcacaaaaagatagcaatgtaaaaggcataaaattccaaaccaactacggaaaatcacaagcattaaacgctggatttaaaattgctcaaggtgatgttgtcattactatggatgctgatttacaagatagccctgatgaaatacctgaattatacaattctattattctagacaaattagaccttgtttctggttggaaaaagaaacgctatgattctaaaatcagaaaaaacatcccttcaaaacttttcaactgggcagcaagaaaaacatcaggtttacacttgcatgattttaattgtgggctcaaagcttacagtaatgaagttataaaaaatgtagatgtgtatggcgaaatgcatcgctatattcctgtactagcaaaaaatgctggctttgtaaaaattgatgaaaaagtggtacagcaccaagccagaaaatatggagaaaccaaatttggaatggaacgctttatacacggttttcttgatttaattactatttggtttttatcaaaattcggtaaaagccccatgcacctctttggattattagggagcttaatgtttgccattggttttttatcaacaatatttataggtgtttcaaaactaatgcgtttattttattaccatattccagtaaaattgattacagataatccttggttttatattgccttaacgactatgnatattggaactttatttttcctatccggatttttaggtgaacttattttacgtacaaaaagagatgaaactcgctantatattagcgataagatcatc

SEQ ID NO: 23210 - protein, 308 aa, Unknown
  Obtained from environmental sample
  DOMAIN (1)...(159): Glycosyl transferase
  misc_feature (1)..(308): Xaa is any amino acid
MXXTWSESARDWIVRVVQSNQYSYEILFIDDGSTDNSWNVIKQLAQKDSNVKGIKFQTNYGKSQALNAGFKIAQGDVVITMDADLQDSPDEIPELYNSIILDKLDLVSGWKKKRYDSKIRKNIPSKLFNWAARKTSGLHLHDFNCGLKAYSNEVIKNVDVYGEMHRYIPVLAKNAGFVKIDEKVVQHQARKYGETKFGMERFIHGFLDLITIWFLSKFGKSPMHLFGLLGSLMFAIGFLSTIFIGVSKLMRLFYYHIPVKLITDNPWFYIALTTMXIGTLFFLSGFLGELILRTKRDETRXYISDKII

SEQ ID NO: 23211 - DNA, 444 bp, Unknown
  Obtained from environmental sample
  misc_feature (1)..(444): n is a, c, g, or t
ttgatggctcagacatcaataaataaggataattttacagatgaaactttagagatgttttctgatttagatgattatgatattttatctgccattaaagaatggacgaatcattcagataaagtgttgtctttattatctaaaatgattgttgatagagagttgttaagaatcgaaattcagaaaactaattttgaagaagctgatttgcaaaagaaaattcaaaagttctctaaaaagttacaattatcagcaaaagaaacgagttattttgtgttttctcaaaaaataatcaatcaagcttacaattcggaaataccaattcttattttaaacaaaaaaggaaagttaaaagatattgcaaaagcatctgatcaattaaacctacaggcattaacaaaacctgttgtaaaatactttatttgttatccaaagtataaatga

SEQ ID NO: 23212 - protein, 147 aa, Unknown
  Obtained from environmental sample
  misc_feature (1)..(147): Xaa is any amino acid
MMAQTSINKDNFTDETLEMFSDLDDYDILSAIKEWTNHSDKVLSLLSKMIVDRELLRIEIQKTNFEEADLQKKIQKFSKKLQLSAKETSYFVFSQKIINQAYNSEIPILILNKKGKLKDIAKASDQLNLQALTKPVVKYFICYPKYK

SEQ ID NO: 23213 - DNA, 483 bp, Unknown
  Obtained from environmental sample
  misc_feature (1)..(483): n is a, c, g, or t
ttgcatttaatgaaatttacagcacaacaaatagcggatattttagaaggtgaagttgagggaaatcctaatgaggaagtttctaaattatctaaaatagaggaaggagaaaaaggatctttaacttttttatccaacccaaaatacaactcttatctttatactacaaatgcttcaatagcaattgtaaacaatagtttagttttagaaaaaaaagtttcatctacacttataaaagtagaagatgcatataaatctttttctaaattattagaattttacaacgaagtaaaaaacaataaacagggtagagaacagcctcattatatttcagattcagcaaaaattggagataacgaatacttaggagctttttcttatataggagaaaatgttgtgattgggaaaaatgttaaaatttatcctaacctctatattggtgataatacaattattggtgatgattgtgtgattttttccggg

SEQ ID NO: 23214 - protein, 161 aa, Unknown
  Obtained from environmental sample
  DOMAIN (6)...(103): UDP-3-O-[3-hydroxymyristoyl] glucosamine N-acyltransferase, LpxD
  misc_feature (1)..(161): Xaa is any amino acid
MHLMKFTAQQIADILEGEVEGNPNEEVSKLSKIEEGEKGSLTFLSNPKYNSYLYTTNASIAIVNNSLVLEKKVSSTLIKVEDAYKSFSKLLEFYNEVKNNKQGREQPHYISDSAKIGDNEYLGAFSYIGENVVIGKNVKIYPNLYIGDNTIIGDDCVIFSG

SEQ ID NO: 23215 - DNA, 861 bp, Unknown
  Obtained from environmental sample
  misc_feature (1)..(861): n is a, c, g, or t
gtgctttttggtgaaaagcatattaacaatcaagctggcaactttagtgtgggcgctatgcaactgcataactacctcctgcatttaaaagaaaacgccttagtgattacacctggtgacagagccgatattattttaggagctttgcaagcacatgtttcagacaactatccttccatatcgggtgttgtgctaactggcggattaatacccgaagattcaattattaaacttattgaaggtctttcagaggttgcacctattatttctgtaaaaggcggcacgttttcggttgttaattgtataggaaatataaaatctcagatttatgctgaaaacaccgaaaagataaccacttccattaagaattttgaaaaatatgtaaaagtagatgcgctgatagagcgtcttattaccttcaaaacaaaagggattacaccaagaatgtttcagtataatttattaaaaaaggcaaaatcacaaaaaaagcatattgttttaccggaaggattagatgaacgtattttaagagctacaaaaagactcattgatcttgatatagtaaaaataacattgcttggtgataaaaaacaaatagaagaaaaattaacaacgcttgatattacattagatttaaacaaagttaatattataaaccccattgaatctactcattttgacacctatgccaaaacactttttgagcttagaaaacacaaaaacgttaatcttgccatggccaaagatttaatgatagacgtttcttattttggaactatgatggtttataaaggcgatgcagatggtatggtttctggcgctgtacacaccacgcacatactattgtgcccgcacttcagt

SEQ ID NO: 23216 - protein, 287 aa, Unknown
  Obtained from environmental sample
  DOMAIN (149)...(287): Phosphate acetyl/butaryl transferase
  misc_feature (1)..(287): Xaa is any amino acid
MLFGEKHINNQAGNFSVGAMQLHNYLLHLKENALVITPGDRADIILGALQAHVSDNYPSISGVVLTGGLIPEDSIIKLIEGLSEVAPIISVKGGTFSVVNCIGNIKSQIYAENTEKITTSIKNFEKYVKVDALIERLITFKTKGITPRMFQYNLLKKAKSQKKHIVLPEGLDERILRATKRLIDLDIVKITLLGDKKQIEEKLTTLDITLDLNKVNIINPIESTHFDTYAKTLFELRKHKNVNLAMAKDLMIDVSYFGTMMVYKGDADGMVSGAVHTTHILLCPHFS

SEQ ID NO: 23217 - DNA, 423 bp, Unknown
  Obtained from environmental sample
  misc_feature (1)..(423): n is a, c, g, or t
ttggtttttataatgaataaagcagaggaaatattaaacatcaaaactgtaaaacctacagcaataagattaattgttttaagacacctattagaacaaaaaaaagcccaatccctaaaagatattgaagataaattaattcatacagatagaagttcaatttttagaacacttaaaacatttttagaaaataaattaattcatagtattgaggatggttctggtatggttaaatatgcagtatgtgctgatgggtgtaactgcgacccaatagacctgcattatcatttttattgttcaaaatgcggcctaacttattgcttngtagaaatacctataccaagtattcagttacctaataattttaaaatgcaacaagccaatatggtaataaaaggactttgtgacaattgtaaccactaa

SEQ ID NO: 23218 - protein, 140 aa, Unknown
  Obtained from environmental sample
  DOMAIN (14)...(132): Ferric uptake regulator family
  misc_feature (1)..(140): Xaa is any amino acid
MVFIMNKAEEILNIKTVKPTAIRLIVLRHLLEQKKAQSLKDIEDKLIHTDRSSIFRTLKTFLENKLIHSIEDGSGMVKYAVCADGCNCDPIDLHYHFYCSKCGLTYCXVEIPIPSIQLPNNFKMQQANMVIKGLCDNCNH

SEQ ID NO: 23219 - DNA, 798 bp, Unknown
  Obtained from environmental sample
  misc_feature (1)..(798): n is a, c, g, or t
atggtttacgtgtccaaagaaatggaaaaacaaaaccttgatattcctttaataattggaggagcaacaacatcaaaagcacacacgtcggttaaaattgcacctcattataaagacgctgtggtacatattaatgatgcgtcaagagctgtaacagttgttggtgaattactaaataaaaataatgttgtttataaggagcaaattagagaagaatacgatgtatttagagaaaaattcttaaacagaaccaaacaaaaagactacataagtattgaaaaggctagaaatagaaaatataaaatagattggcaaacctctaaaattgtaaagccaaaacaattaggaattcaaataatcgaagattttgatattacaaaattagagtcgtttatagattggtctccattttttagaagttgggatttgcatggtaaatatccagatattttaaccgatagcgtggttggtactcaagcaacagatttgtttattgacgctcaagaattattaaaaagaatttttgatgaaaaactattaaaagcaaaagccatctttgggttgtttcctgcaaacagcataaatgatgatgatattgaggtgagtttgtcacctcgagcacagtcaagaggtcttacaaatgaagataaaattaaatttctaaccttacgtcaacaattaaaaaaacgagaaggtgtgcctaatcacgccttagcagattttattgctccaaaagaaacaggaatacaagattatattggtgctttttgcgtctctactggttctcgagccatctga

SEQ ID NO: 23220 - protein, 265 aa, Unknown
  Obtained from environmental sample
  DOMAIN (93)...(265): Vitamin B12 dependent methionine synthase, activation domain
  misc_feature (1)..(265): Xaa is any amino acid
MVYVSKEMEKQNLDIPLIIGGATTSKAHTSVKIAPHYKDAVVHINDASRAVTVVGELLNKNNVVYKEQIREEYDVFREKFLNRTKQKDYISIEKARNRKYKIDWQTSKIVKPKQLGIQIIEDFDITKLESFIDWSPFFRSWDLHGKYPDILTDSVVGTQATDLFIDAQELLKRIFDEKLLKAKAIFGLFPANSINDDDIEVSLSPRAQSRGLTNEDKIKFLTLRQQLKKREGVPNHALADFIAPKETGIQDYIGAFCVSTGSRAI

SEQ ID NO: 23221 - DNA, 495 bp, Unknown
  Obtained from environmental sample
  misc_feature (1)..(495): n is a, c, g, or t
atggttattacagaagattacatcttttttacaaacgatcaaagtaaagctgatgaaataagtagtaacggaaaacttgccaacaatttaagcgactttaaacataaagataaattatcacacagcgtttacctttacacaaaaggaaatattgcagaacttagcaatgactttacaaaaaatttaggcaatatgtacaatccttatagtagttacaatagatatggaaacgatacagctatggatgaaatttcagaaaaaagcagtgagatttacactaaatattatggcgaaaaccattattttatagacacagatggaggcgaatcttttacttatactaaaggaaacaaacactcattaatacagaccattttatatggtgacgaagtagcaaaaactatgagtactatatatgaaaacaataataaagatgaggatgaggatgaaatagaaattgaagaaaccgttatcgaatctacagaatcaaactag

SEQ ID NO: 23222 - protein, 164 aa, Unknown
  Obtained from environmental sample
  misc_feature (1)..(164): Xaa is any amino acid
MVITEDYIFFTNDQSKADEISSNGKLANNLSDFKHKDKLSHSVYLYTKGNIAELSNDFTKNLGNMYNPYSSYNRYGNDTAMDEISEKSSEIYTKYYGENHYFIDTDGGESFTYTKGNKHSLIQTILYGDEVAKTMSTIYENNNKDEDEDEIEIEETVIESTESN

SEQ ID NO: 23223 - DNA, 846 bp, Unknown
  Obtained from environmental sample
  misc_feature (1)..(846): n is a, c, g, or t
gtgtctcaaaatttaaatggagaatacgtgcctgcaaaaggaactctaaaagtttataaacttgtagcacccaaaactgttttaagaccaagaccttggagagcaccagattatcaagagttatctcaagatgaatttaaaatgctatttcctaacgacccttataacaatgaagatacagtgaccaattggaaaaaaggtaaagaagtctttagcaccaatttcgatactgaaaaagacaaaaccattattttcaaaaaactaaagaaatgggattccggtaaatacatcatcgttttagaaagtgaagataaatttggacaagctataaaagacgaagcttacactgctttatatagtgatgctgacaaaacagttgcagattcacaattatttgaagcgcaattagacaaagcaacatacaagcaaagttctatagcaaagctaactattggttctgccgcaaaagacatcactgtaactgttgaaattgagaaagaccatgaaattataatgacccaattggttcgtttaaacaactctaaacagaccataataatccctgtttcagaaagtgatttagggggttttgtagtacatactagttttgctgcttataatgaatttgtatcccgtagttttaaagtcaatgtgccatatcctaaaacggatttagaaattgaaaccaccacttttagagacaaattacaaccaggacaagatgaaacttggagttttaaaattaaaggancaaaaggtgataaagtatccgcccgattactagcaagtatgtatgatgcatctttagatgaatttagccacataactggaattttatccaattaa

SEQ ID NO: 23224 - protein, 281 aa, Unknown
  Obtained from environmental sample
  misc_feature (1)..(281): Xaa is any amino acid
MSQNLNGEYVPAKGTLKVYKLVAPKTVLRPRPWRAPDYQELSQDEFKMLFPNDPYNNEDTVTNWKKGKEVFSTNFDTEKDKTIIFKKLKKWDSGKYIIVLESEDKFGQAIKDEAYTALYSDADKTVADSQLFEAQLDKATYKQSSIAKLTIGSAAKDITVTVEIEKDHEIIMTQLVRLNNSKQTIIIPVSESDLGGFVVHTSFAAYNEFVSRSFKVNVPYPKTDLEIETTTFRDKLQPGQDETWSFKIKGXKGDKVSARLLASMYDASLDEFSHITGILSN

SEQ ID NO: 23225 - DNA, 402 bp, Unknown
  Obtained from environmental sample
  misc_feature (1)..(402): n is a, c, g, or t
gtggatggaattttgatccaagtcattcagagcaaacattcattgaaggaagacactaacccttttatcaatctatcaaaaaaatcaatgttcgactttaatagcactttatacaaagaataccttaaagattttcggaacaatccatcaaaatctcaaattattgttttcgcgggtaattttgctgaaaatagaaaatatgcattgagccaatttgaaagtgaaactttcggtaatacaaagcaaattcttttatctgattatatatccgtatcagagtctgacacttatgctaaactagatgacttgtttngaggaattaaatctattgaatcattaatcgtttttaagaagctgaacaactttgtggcatatatgttggggccacttattctgttgtaa

SEQ ID NO: 23226 - protein, 133 aa, Unknown
  Obtained from environmental sample
  misc_feature (1)..(133): Xaa is any amino acid
MDGILIQVIQSKHSLKEDTNPFINLSKKSMFDFNSTLYKEYLKDFRNNPSKSQIIVFAGNFAENRKYALSQFESETFGNTKQILLSDYISVSESDTYAKLDDLFXGIKSIESLIVFKKLNNFVAYMLGPLILL

SEQ ID NO: 23227 - DNA, 708 bp, Unknown
  Obtained from environmental sample
  misc_feature (1)..(708): n is a, c, g, or t
ttggttgataaatataaactaaacaccatttgtacaagtggaagctgtccaaatatgggcgaatgttggggagaaggaactgcaacatttatgattttgggtaatatttgtacacgttcttgtggtttttgtggtgtaaaaactggaagaccagaaactgttgaatgggatgaacctgaaaaagtagcacgttctataaaaattatgagcattaaacatgctgtaattacctctgtagatagagatgatttaaaagatggtggttctattatttgggcagaaactgtggatgcaattcgtagagcaaacccaaagacaactttagaaactttaattcctgattttcaaggaaacactaagcaaattgatagaattattgaggtacatcctgaagtagtttcgcacaatatggaaactgtaagaaggttaactcgtgaagtgagaattcaagcaaaatacgacagaagtttaggtgttttaaaatacttaaaagaaaaaggaatgcgaactaaaactggtttaatgctaggtttaggagaaaaagaagaggaagtaatacaaaccatgaaagatttacgtgaagtaaattgcgatgtaattacgattggacaatatttacagccaacaaaaaaacatttacctgtaaaagaatttataactccagagcagtttaaaaaatatgaaactatggctagaaatggcttatga

SEQ ID NO: 23228 - protein, 235 aa, Unknown
  Obtained from environmental sample
  DOMAIN (31)...(192): Radical SAM superfamily
  misc_feature (1)..(235): Xaa is any amino acid
MVDKYKLNTICTSGSCPNMGECWGEGTATFMILGNICTRSCGFCGVKTGRPETVEWDEPEKVARSIKIMSIKHAVITSVDRDDLKDGGSIIWAETVDAIRRANPKTTLETLIPDFQGNTKQIDRIIEVHPEVVSHNMETVRRLTREVRIQAKYDRSLGVLKYLKEKGMRTKTGLMLGLGEKEEEVIQTMKDLREVNCDVITIGQYLQPTKKHLPVKEFITPEQFKKYETMARNGL

SEQ ID NO: 23229 - DNA, 783 bp, Unknown
  Obtained from environmental sample
  misc_feature (1)..(783): n is a, c, g, or t
ttgtctttattaaagattgcagcagattatattatcagatataactttaatttctcttttgatgatgcaatgcgcttattcacttctaaattttataaccctgttttaatttacccatcaaattccgaaattgtcaatgcaagaaaatggcgagtatataacccgaattcaattacccaatcacgtctagtattattaatttgtgcaggcttaggatggtatgataaaagtgatatttctgaagtaagggaagatcaattaaatgagttattggaaaaaatatggagaacattacagcagaaaatattgacacccgatggtgacggatttaagttagattttcttcagagtacacaatttgaaatcgcgggtaatgaatatttatgcccagtaacaaataggttagttgataaagtttttagagggtattcacctttaattaaaggaaatttagagatcagtaacatcaactattataaaatagacagtactaaaaattatgaatttccaaaatattcacatccatatcataaagatgaaaataacgaaccaatcaaactagaaaaagtagacgcttggttagaggaaaatagtcaggaggcgagaggcaaaggattatggaataatttacacgagcgtatttttgattatgataaattatatttggcaggagaacattcagcacaacaagataaaggaagactcaagcaattagaagaacaatttgagaaaggtgaaattaaatattttaagctgctctacgacaatggagatggggggtag

SEQ ID NO: 23230 - protein, 260 aa, Unknown
  Obtained from environmental sample
  misc_feature (1)..(260): Xaa is any amino acid
MSLLKIAADYIIRYNFNFSFDDAMRLFTSKFYNPVLIYPSNSEIVNARKWRVYNPNSITQSRLVLLICAGLGWYDKSDISEVREDQLNELLEKIWRTLQQKILTPDGDGFKLDFLQSTQFEIAGNEYLCPVTNRLVDKVFRGYSPLIKGNLEISNINYYKIDSTKNYEFPKYSHPYHKDENNEPIKLEKVDAWLEENSQEARGKGLWNNLHERIFDYDKLYLAGEHSAQQDKGRLKQLEEQFEKGEIKYFKLLYDNGDGG

SEQ ID NO: 23231 - DNA, 429 bp, Unknown
  Obtained from environmental sample
  misc_feature (1)..(429): n is a, c, g, or t
ttgactaatagtttaaaaagtaataagaaattaaattataattctagtagttttaaaatcagaatgattaaaaaaatatatcaaaaattatttaagaataaaacacctgttttcagatatgaagatttgtatatttcaaactcaataaaaggacgagtttttccagggaaatcctgggatgattattattatgctttcttactaaaatctaaatttgttttatgtccatcaggagattttatttggtcttatcgtttttttgaaacaattttaagtggtgcaattccaataatagaagagtattgtgacgtttattcaggctataggtttaaatatctaagcgatgacgctacacagtttatatataacttggatgatgctagatttaattacgatttatgtgtgtcaagaatgacaattaaaggataa

SEQ ID NO: 23232 - protein, 142 aa, Unknown
  Obtained from environmental sample
  misc_feature (1)..(142): Xaa is any amino acid
MTNSLKSNKKLNYNSSSFKIRMIKKIYQKLFKNKTPVFRYEDLYISNSIKGRVFPGKSWDDYYYAFLLKSKFVLCPSGDFIWSYRFFETILSGAIPIIEEYCDVYSGYRFKYLSDDATQFIYNLDDARFNYDLCVSRMTIKG

SEQ ID NO: 23233 - DNA, 753 bp, Unknown
  Obtained from environmental sample
  misc_feature (1)..(753): n is a, c, g, or t
ttgcacattccacatgaaaatgattactttaaagatgcctatcggatttttgaattatgtctattttcaatcttaaaaactgcaagctcaaaattaaaagtctctattattagtaataaatgttcttttgaggttaatcaaagacttttgcagttatacaaagaccaagagattgatgagcttattatagaaaaggaaggcataggaaaaattaatagcctattaaaagcattacgtacagtagaagagcgtttggtaaccattacagatgcagatgttttatttttggatcattgggaggatgaggttgtttctgtttttaaatcttttccaaaagcaggcgctgtttgtcctgtccctgtttacagaaagcatttagatttaacagcaaacatttggagcaaatatctattttcaaatagattaaaatttaaaaaagtaaaagatgttgacgccttagagaattttgcaaaaagtataggttggacccatttaccagaagaatttggtgatagtattggtacactaacagcaaaagacaatactgttgcagttttaggctgttctcattttgttgctacctataaatcagaagtatttaaagcgcttccagaagacaatagtgcttatttaatagatggagatagcgagtttttgtacatggataagccagtagttttaactgatggttatcgattagcaacatacaccaataatgcatatcacttaggtaatgttctcgagccgatctga

SEQ ID NO: 23234 - protein, 250 aa, Unknown
  Obtained from environmental sample
  misc_feature (1)..(250): Xaa is any amino acid
MHIPHENDYFKDAYRIFELCLFSILKTASSKLKVSIISNKCSFEVNQRLLQLYKDQEIDELIIEKEGIGKINSLLKALRTVEERLVTITDADVLFLDHWEDEVVSVFKSFPKAGAVCPVPVYRKHLDLTANIWSKYLFSNRLKFKKVKDVDALENFAKSIGWTHLPEEFGDSIGTLTAKDNTVAVLGCSHFVATYKSEVFKALPEDNSAYLIDGDSEFLYMDKPVVLTDGYRLATYTNNAYHLGNVLEPI

SEQ ID NO: 23235 - DNA, 567 bp, Unknown
  Obtained from environmental sample
  misc_feature (1)..(567): n is a, c, g, or t
ttgaaagagcttcgatcactacaacgtaggtatgaaaaacaaaaagtgaaatctgatgaatacactaaagactggatatcatgttttggcntgatatctaaaattatacagctagaagaaaaccgagaaactgacaataataaaaataaattaattgccttaggaaatacaactgatgtaaatatggctttgaagttcgttgaaactaaatctgaactattacatctatcatgcttatgtgaggatgcggaaatatacccagattttatggatacattacaaaaaactccagcattaaagcaacgtacaattcaattaagtcggatcttactcaagcaaggtaagaaacctattttcttagaaatgggtgataaagaacaattaattgctggaaatgcaatgataagacaaatggctaaaattgccgccccgaatgataagtttgaaggatttagagttgttgctgattatcttgaagccgaaacatacctcactgactcaaaattactagatgccgggtacactgagacacataacaattatatcaacttaccttctcataaatga

SEQ ID NO: 23236 - protein, 188 aa, Unknown
  Obtained from environmental sample
  misc_feature (1)..(188): Xaa is any amino acid
MKELRSLQRRYEKQKVKSDEYTKDWISCFGXISKIIQLEENRETDNNKNKLIALGNTTDVNMALKFVETKSELLHLSCLCEDAEIYPDFMDTLQKTPALKQRTIQLSRILLKQGKKPIFLEMGDKEQLIAGNAMIRQMAKIAAPNDKFEGFRVVADYLEAETYLTDSKLLDAGYTETHNNYINLPSHK

SEQ ID NO: 23237 - DNA, 360 bp, Unknown
  Obtained from environmental sample
  misc_feature (1)..(360): n is a, c, g, or t
atgttacagataatcgaattaaaagaaaaaaatattgttgcaacaaaagcttcgggcaaattgagaaaagaagatatagaaaaaatccatccacttatccacgccatactggacaaaggaatgaaagtccggtggtattttgagatggtcaactttacaggttgggatttacctggtttatgggaagacctaaaaatggacacagcccacgccacggactatgaaaaaatagcaatggtaggagataaaaaatggcagaattggataacccaatttatgaagccttttaccaatgccgatattaagtatttcaatatagaacaaaaggaagatgccaaaaattggattgagagccagtaa

SEQ ID NO: 23238 - protein, 119 aa, Unknown
  Obtained from environmental sample
  misc_feature (1)..(119): Xaa is any amino acid
MLQIIELKEKNIVATKASGKLRKEDIEKIHPLIHAILDKGMKVRWYFEMVNFTGWDLPGLWEDLKMDTAHATDYEKIAMVGDKKWQNWITQFMKPFTNADIKYFNIEQKEDAKNWIESQ

SEQ ID NO: 23239 - DNA, 396 bp, Unknown
  Obtained from environmental sample
  misc_feature (1)..(396): n is a, c, g, or t
atgacggtttacgaatttctagacaaactaagaaagactccagaagagataagctttggagacaccataggtgttattgacacttattataatttttcaccttcaaaattcaccaatggggaagtgattaatgaggccggacaaaattcaggttcctgtaaagtattttcttttgcgcaacatcacaagttgggcaaagaggaaaccttggcctgctttggttcctattaccgaaaagatgtccttgaaaatccaaaaggtacggaccaccaaaacattcgtaattttatgatcagtggttgggagggtatttccttcgataatgaagccccttggcctaaagtgaaaccaagtacatcccagttctccccatatacctgccgtttcatagagtag

SEQ ID NO: 23240 - protein, 131 aa, Unknown
  Obtained from environmental sample
  misc_feature (1)..(131): Xaa is any amino acid
MTVYEFLDKLRKTPEEISFGDTIGVIDTYYNFSPSKFTNGEVINEAGQNSGSCKVFSFAQHHKLGKEETLACFGSYYRKDVLENPKGTDHQNIRNFMISGWEGISFDNEAPWPKVKPSTSQFSPYTCRFIE

SEQ ID NO: 23241 - DNA, 633 bp, Unknown
  Obtained from environmental sample
  misc_feature (1)..(633): n is a, c, g, or t
atggatgagttagaattattaaaaaaacattggaaaagcactgcagatagcaatcaaaaactgtcagctaagcagttataccctatgttattaaaaaagtcttcttctatagtgaaaacacttttttatattagtattgcagaactggtattttggattttaattaatttcctaccactattttcttcaagctatttaaaagacttagaagaaatttatggcaacaacttagccctagtttttctttcagttttaacttttagcgtggttattgtatttgtttacctcttgtacaaagcgtacaaaaaaatagctgttacagataacacaaaacaattaatggcaagtattttaaggactcgaaaaattgtaaagtattacgtaatttataatttaagtatgatctttctaagtgtacctataagcttatactttacatcgcagaatgattctgcgcttcatgataaaataattcactttaccacttcgcaaactatagttttttatcttatcacttttgtggtaacaggagtatgtgttctaatcttttggttgttttacaagcttatatatggtattttattgcgccgtttaaataggaattacttagaattaaaaaaattagaaatgtaa

SEQ ID NO: 23242 - protein, 210 aa, Unknown
  Obtained from environmental sample
  misc_feature (1)..(210): Xaa is any amino acid
MDELELLKKHWKSTADSNQKLSAKQLYPMLLKKSSSIVKTLFYISIAELVFWILINFLPLFSSSYLKDLEEIYGNNLALVFLSVLTFSVVIVFVYLLYKAYKKIAVTDNTKQLMASILRTRKIVKYYVIYNLSMIFLSVPISLYFTSQNDSALHDKIIHFTTSQTIVFYLITFVVTGVCVLIFWLFYKLIYGILLRRLNRNYLELKKLEM

SEQ ID NO: 23243 - DNA, 837 bp, Unknown
  Obtained from environmental sample
  misc_feature (1)..(837): n is a, c, g, or t
ttgttcctaatatttataggcttttctttttccgtgctcttgatatttattgcgccacaaccgggatggtattattggattcttcccttctttgtatattttgctattcgcgaaaacaaattttcatttttaccaattttgattttgcaactagtattcttcatctatttcgcgttaattcccgagtcagattttttctctgtattcaagtttggagaaagtaattttacattttatcgcctttttcaggagaacgagtggatatcccctgatgttttggccagtttagccctcacatttttgcaaacgtgtctaatgctaaatgtatattggatttataaatggggaattaaaaaaaatcttgagaaaaagataaaaaataaaccatttttaattggtattggaggtgattcaggtgttggaaaatcgacattaacggatttattgacgaatctttttggagaacacaacatgaccattatgagaggcgacgatatgcacagatgggagagaggtcatgacaaatgggataaaattacccatttatcaccaaaggctaatcatttgcatgaagatataaagcatttaaaagcattaaaagacggaaaaaaggtgttgcgaagattctatgaccacggttcaggaaagtttacagaaccagctaaggtatatccaaataaaatcatcgaatttgaaggattacatcctttttatatttctgcaaaacgaaaccttttcgacttgaaaatcttcgttgaacccccaaaaaaacttaagatttactttggaaaaaaagtccggaattttaaaaaaaagaaacttttttttaaggaaaag

SEQ ID NO: 23244 - protein, 279 aa, Unknown
  Obtained from environmental sample
  DOMAIN (131)...(278): Phosphoribulokinase / Uridine kinase family
  misc_feature (1)..(279): Xaa is any amino acid
MFLIFIGFSFSVLLIFIAPQPGWYYWILPFFVYFAIRENKFSFLPILILQLVFFIYFALIPESDFFSVFKFGESNFTFYRLFQENEWISPDVLASLALTFLQTCLMLNVYWIYKWGIKKNLEKKIKNKPFLIGIGGDSGVGKSTLTDLLTNLFGEHNMTIMRGDDMHRWERGHDKWDKITHLSPKANHLHEDIKHLKALKDGKKVLRRFYDHGSGKFTEPAKVYPNKIIEFEGLHPFYISAKRNLFDLKIFVEPPKKLKIYFGKKVRNFKKKKLFFKEK

SEQ ID NO: 23245 - DNA, 897 bp, Unknown
  Obtained from environmental sample
  misc_feature (1)..(897): n is a, c, g, or t
atgggtatgttcagggttgcttctttagtgggtataaactttttagcccttcaagaacgaagtctcttctatattgagcctttactactatctatgatgaacatccttatatggctttatttctttgtgaccgaaaaaaagcaaataagttggttctgggtcattttttcagcctttctttttgcgctcacaatatcgcttaaattttcagccttgttcatgattgccctgattggtattgtgcttattttcaagttcaaaacattagagaaaagactaatcgccagtttcctattaataatcatgtccttatttttcttttgtttaatcaattggaatattttttacagtaaggaagttttcagtatggccattcatgattatttttctaatttttggcagtatgcaactggcaacaaagggcaagttgttgaaaatttcaagttaaataatttgaagagaatgataagtgagatattctcttccttagggggattgatatatttattccccgtgattatattttttggtctgagatggtctcctagaaaatcagttgtaatttggttgggttttatatctataatcttattgtctattgtcatgattgtaaaacaacaggtatatattgataggaacatactaccctttcttacggccataatattgaccactggagtaatgttagatcaaatagtcaaacaaattctgaaaaatgacttaaaggaaaaggtgaaaccgatttatctttacttagtaatcgcattgctcatttttctacccatttggggccattcgaagaattatttaaaaacagttttcccgaatgcaaaagaaaacatagccaaggtaattaatggaattcagaaaaagagaatcgcctcgagccgattctga

SEQ ID NO: 23246 - protein, 298 aa, Unknown
  Obtained from environmental sample
  misc_feature (1)..(298): Xaa is any amino acid
MGMFRVASLVGINFLALQERSLFYIEPLLLSMMNILIWLYFFVTEKKQISWFWVIFSAFLFALTISLKFSALFMIALIGIVLIFKFKTLEKRLIASFLLIIMSLFFFCLINWNIFYSKEVFSMAIHDYFSNFWQYATGNKGQVVENFKLNNLKRMISEIFSSLGGLIYLFPVIIFFGLRWSPRKSVVIWLGFISIILLSIVMIVKQQVYIDRNILPFLTAIILTTGVMLDQIVKQILKNDLKEKVKPIYLYLVIALLIFLPIWGHSKNYLKTVFPNAKENIAKVINGIQKKRIASSRF

SEQ ID NO: 23247 - DNA, 378 bp, Unknown; identical to SEQ ID NO: 22833
  Obtained from environmental sample
  misc_feature (1)..(378): n is a, c, g, or t

SEQ ID NO: 23248 - protein, 125 aa, Unknown; identical to SEQ ID NO: 22834
  Obtained from environmental sample
  misc_feature (1)..(125): Xaa is any amino acid

SEQ ID NO: 23249 - DNA, 870 bp, Unknown
  Obtained from environmental sample
  misc_feature (1)..(870): n is a, c, g, or t
ttgaaaggatttgcggtaattcacagggtaaaactaggtctagacttttcgaaaataactgaaaatccaacagaaggtagtattaaagtctcagatgacttcaaaataactgattcaacacctgcgaactataatattttacgaataataatgggtagtacatctgttacaaacaatgacacgtatgtaacaacagatttttctacaaactatttaagtttgtattatatgtttgataacgaaaaaagtgctgaaactaatcttgcagaaattttaaatgaatctattgaattagaagatttaaaagatttcttttttgatagaagatttgctcttaaaaacaaggagttttttaatagattggaaaacgagttttgtaatttcttaacttatcaatctaaagagaatcacacaacagcttttatatttctttatagaatattagaggtgatttctttctcatttcctcttatctacgcttctaaaacttatgattttaaacatacatatgggaagttaaaagaaattttctcgaataattcaggaaattcaaaaggaaaacttggtttttttaaaactgcaattaaagtaatgtttgaagattccgatttacttgaaacatcaattgatattgagttaaacgatgaatttgaaaaaaatgaaaaaatttacaaagcattaaaaagtgtttgcgatgataaaatttttcatactgatacaacagaaaatagtaaaatatcaatttgttttggagaagtaagttcttttataataacacttatgaacaggttttttcatttatttaatagaggagataaaaatttagaatcaattgaaatcattgacccagactatttattctctaactaa

SEQ ID NO: 23250 - protein, 289 aa, Unknown
  Obtained from environmental sample
  misc_feature (1)..(289): Xaa is any amino acid
MKGFAVIHRVKLGLDFSKITENPTEGSIKVSDDFKITDSTPANYNILRIIMGSTSVTNNDTYVTTDFSTNYLSLYYMFDNEKSAETNLAEILNESIELEDLKDFFFDRRFALKNKEFFNRLENEFCNFLTYQSKENHTTAFIFLYRILEVISFSFPLIYASKTYDFKHTYGKLKEIFSNNSGNSKGKLGFFKTAIKVMFEDSDLLETSIDIELNDEFEKNEKIYKALKSVCDDKIFHTDTTENSKISICFGEVSSFIITLMNRFFHLFNRGDKNLESIEIIDPDYLFSN

SEQ ID NO: 23251 - DNA, 789 bp, Unknown
  Obtained from environmental sample
  misc_feature (1)..(789): n is a, c, g, or t
ttgtgcagcgagcgtttttatattgtaagcacaagttcctcttttaattactacaattttaccgttcaaatcacctccattagttacattgttacaaccgtcatttggatcgccactgtcatccactatcaccacaagatctgcagttataggagaaactggcaatggtggcgcaaaattggaatcggctgcataataaacaccagccaacgggccattgttcacagtaagaaaagttcccaagaccttacctggggcactccaaagatacatttgcattcttggtgcaccgccatctggtggtgtggaaaagttagcgttgttcaggccactgccatcttgtgcatcggcaacaacaaaatcatttccattcccaggattgccatagttatttttttgaaagtttccactttcttcatcaaaaccgtaatggtacagaatgtcgtgcatcatattgttcatatagaacaaattggtaagcgctccatccaaaaagttaactgggacctgaggaaggttaaaaggaaaatcaaaagtaagtgttgggccaccatcagcaattccaccattaccattgtttccctttcggtcttcatttgcccaaacattgttacccttagtttcagtaaagtctgcacctgctataccaccccaatcatgccctccaaaaggggaagctgttgggtcaaaagatcagaaaccaatgtaccctccccctccttcaggagcacccatgggccaaaccaaataccccataaggaggaaccaccccccagcgtaacgggctga

SEQ ID NO: 23252 - protein, 262 aa, Unknown
  Obtained from environmental sample
  misc_feature (1)..(262): Xaa is any amino acid
MCSERFYIVSTSSSFNYYNFTVQITSISYIVTTVIWIATVIHYHHKICSYRRNWQWWRKIGIGCIINTSQRAIVHSKKSSQDLTWGTPKIHLHSWCTAIWWCGKVSVVQATAILCIGNNKIISIPRIAIVIFLKVSTFFIKTVMVQNVVHHIVHIEQIGKRSIQKVNWDLRKVKRKIKSKCWATISNSTITIVSLSVFICPNIVTLSFSKVCTCYTTPIMPSKRGSCWVKRSETNVPSPSFRSTHGPNQIPHKEEPPPSVTG

SEQ ID NO: 23253 - DNA, 546 bp, Unknown
  Obtained from environmental sample
  misc_feature (1)..(546): n is a, c, g, or t
atgaaaaaaattatctttgtattacttatcgtattattatttgctagttgtagtaaaaaaattgaagaatcatactttgtaccaaaagacgctattggtgttatgtatgttaatttaaaatcgctttcagaaaaaagtaaagatttagactttaatcaattaaacattaatacacttattgaagataaagcacccaaagagattaagcgttttgtgcaagagttactatcaaaagataatttagataaaacctttagaaaagaatatattttaggctttggtacgtttaaaagactatctggtgttggtggattaatattacctattaaggatgcagcgtcttttgaagcctttatacaaccaatgattgatgaagttcctaatttagaaaaagaaactaatgttggtaaagatcaagaatttactatttacgcaaacaaagaaattgcaattggatggaatggtaaaactgcattaattattggtgcaaataattatgctgctgcagaattaaaggaccttaccacattctcgagccgaatctga

SEQ ID NO: 23254 - protein, 181 aa, Unknown
  Obtained from environmental sample
  SIGNAL (1)...(19)
  misc_feature (1)..(181): Xaa is any amino acid
MKKIIFVLLIVLLFASCSKKIEESYFVPKDAIGVMYVNLKSLSEKSKDLDFNQLNINTLIEDKAPKEIKRFVQELLSKDNLDKTFRKEYILGFGTFKRLSGVGGLILPIKDAASFEAFIQPMIDEVPNLEKETNVGKDQEFTIYANKEIAIGWNGKTALIIGANNYAAAELKDLTTFSSRI

SEQ ID NO: 23255 - DNA, 345 bp, Unknown
  Obtained from environmental sample
  misc_feature (1)..(345): n is a, c, g, or t
ttggatttagtggctttaaaatgtgcttgtcaagtaaatggtgttaccaaattaatgatgatgaaaggcgatgtcctttccggatttgaaactcttaaaatttgtacagcttacgaatataaaggtgaaaccattacgcatttaccttataatatagaacctgaaaatattaaacctatctattcagatttcgctggttggaaagacgatttaaccaaaatgactgaaaaatcgcaattcccaaaagaattaaatgcttatatcgctttcttggaaaaagaattagaaattcccattacggtagtttctgttggaccagatagaaagcaaacaattttcatgtaa

SEQ ID NO: 23256 - protein, 114 aa, Unknown
  Obtained from environmental sample
  DOMAIN (1)...(113): Adenylosuccinate synthetase
  misc_feature (1)..(114): Xaa is any amino acid
MDLVALKCACQVNGVTKLMMMKGDVLSGFETLKICTAYEYKGETITHLPYNIEPENIKPIYSDFAGWKDDLTKMTEKSQFPKELNAYIAFLEKELEIPITVVSVGPDRKQTIFM

SEQ ID NO: 23257 - DNA, 306 bp, Unknown
  Obtained from environmental sample
  misc_feature (1)..(306): n is a, c, g, or t
atgagtacccaaagaacttttggtaagctttctttttcgtttttaagaattaaaaataagctgccaccaataaaaaagatggaaaaaattaaaagaattagcaaaaataacggagtttgtagtgtcataattcaagtatttaaaaataaatttaaagaaaatcttttacacgaaaaactattcctgagttatcctccatattttagcaatcacgtaaagcacaaaaactccgataagtatatacaatcttcttctcttattttggtcgagttctttaaaacgatacaagtttaccgaaatatataa

SEQ ID NO: 23258 - protein, 101 aa, Unknown
  Obtained from environmental sample
  misc_feature (1)..(101): Xaa is any amino acid
MSTQRTFGKLSFSFLRIKNKLPPIKKMEKIKRISKNNGVCSVIIQVFKNKFKENLLHEKLFLSYPPYFSNHVKHKNSDKYIQSSSLILVEFFKTIQVYRNI

SEQ ID NO: 23259 - DNA, 813 bp, Unknown
  Obtained from environmental sample
  misc_feature (1)..(813): n is a, c, g, or t
ttggtgggagctatgcccattatgatttttgtacttatggtttatttagttgtccgtttaaagttaactcctgaaatggcaattggcgcattcaaaagttcaaaaaagcaaattgcttcagaatttgtttctgataaccaggaaattcacgtttctaaaactatttcagaggaagaaaatgttgaagatgaaaaagacgttccccaaccttatattgaagaaaaagtaactccccccccaccagaaaaaataatcctaaagtcagatattgaaggcgatgtggagatggaagtggaacaggctgccgaagaagaagaaattgaaaatataagcgatagattagtaaaggattttggcgaattcgacccgagattggaactgagcaagtacaaatttcccagtatagaactgctgcgagaccacacagctggaagtggaataacgataaaccaagaagagcttgaagaaaacaaaaaccgaattgttgaaaccctcaacaattataaaataggaattgcaaacattaaagccacggttgggccaacggttacactttacgaaattgtgcccgacgctggtgtacgtatttcaaaaataaaaaaccttgaggatgatattgccctttcgctttccgctttaggaattcgtattatagcgccaattcccggtcgcggaaccattggtattgaggttccaaataaaaatccaaaggtggtttctatgcgttcggtgattgcttctgctaaatttcaaaatgcagagatggagcttcctattgctttggaaaaaccatcagcaacgaaacgttgctga

SEQ ID NO: 23260 - protein, 270 aa, Unknown
  Obtained from environmental sample
  misc_feature (1)..(270): Xaa is any amino acid
MVGAMPIMIFVLMVYLVVRLKLTPEMAIGAFKSSKKQIASEFVSDNQEIHVSKTISEEENVEDEKDVPQPYIEEKVTPPPPEKIILKSDIEGDVEMEVEQAAEEEEIENISDRLVKDFGEFDPRLELSKYKFPSIELLRDHTAGSGITINQEELEENKNRIVETLNNYKIGIANIKATVGPTVTLYEIVPDAGVRISKIKNLEDDIALSLSALGIRIIAPIPGRGTIGIEVPNKNPKVVSMRSVIASAKFQNAEMELPIALEKPSATKRC

SEQ ID NO: 23261 - DNA, 648 bp, Unknown
  Obtained from environmental sample
  misc_feature (1)..(648): n is a, c, g, or t
gtgtctaaaccttttaaatcagagtttggttaccatattattaaactgattgaaaaaaatggaatacaaccttttgaggctttagaattagaattaaaaaataaaattaaacgtgattctagatctaaagttattagtgataagcgtattgaaaatttgttacaaacatataatgttgatttgacaacagtagacttaacgcctattattaatatcctatcggatgattattttgcaagtaattggaccattcctgcaacatttaaaggtgaaaaaacactattaattataggaacaaagcaaataccagaaattgaatttgctcaatttttatttaaaagtcaacgtagacgacaagctaaagtgtcattaaaacaattggcagaagataattttaaagtttttgttgaaagtaatttaaaagcgtatcaagaagaaaacttagagtctgaaaaccaagaatatgcacaagtgttaagcgaatatcgtgatggattgttgctgtttgatttgatgganaaccaaatttggaatgctgcaaaacaagattcagtaggattgttagactattacaatcaacacanagctaattactattatgacaccagagttgatgcaattgtggcctcttctgctaaaaaagtgtaa

SEQ ID NO: 23262 - protein, 215 aa, Unknown
  Obtained from environmental sample
  misc_feature (1)..(215): Xaa is any amino acid
MSKPFKSEFGYHIIKLIEKNGIQPFEALELELKNKIKRDSRSKVISDKRIENLLQTYNVDLTTVDLTPIINILSDDYFASNWTIPATFKGEKTLLIIGTKQIPEIEFAQFLFKSQRRRQAKVSLKQLAEDNFKVFVESNLKAYQEENLESENQEYAQVLSEYRDGLLLFDLMXNQIWNAAKQDSVGLLDYYNQHXANYYYDTRVDAIVASSAKKV

SEQ ID NO: 23263 - DNA, 834 bp, Unknown
  Obtained from environmental sample
  misc_feature (1)..(834): n is a, c, g, or t
atggcacagaaaccaagtataccaaaaggcacaagagattttaatccggagcaagttgctaaaagaaattatatttttagtactataaagtcgcagtttgaacgtttcggatttcaaccaatagaaactcctagttttgagaattcagagaccttaatggggaaatatggtgaagaaggcgaccgactgattttcaaaatattgaattctggggattatttgtctaaagttgaagatgctttatatcaaaaaaaggattccaatgcaacgacttcaaaaatctctgaaaaagccttgcgttacgatttaacggttccttttgcgcgttatgtagtgcagcaccaaaacgagattgaattcccgtttaagcgttaccaaatgcaaccggtttggagagccgatcgtccgcaaaaagggcgttttagagaattctatcaatgtgatgccgatgtcgtgggaagtgattctttatttcaagaagttgaatttattcagttgtacgacaacgtgttttcagctttaaaactagaaggtgttaccattaaaataaataaccgaaaaatactatcgggaatagcagaagttatcggggctagcgataagcttatcgatttcacagtggcattagataaattggataaaataggcgaggagaaagtgaaagaagaaatgctaggtaaaggtatttctcaagaaagtattaataaattacagcctttatttacaatttcagggtctttcgagtctcaaattgaaagttttaaaacctattttaaggcacctcggaagaagggaaccaaaaggtatttgaaagaactaattactataaaataa

SEQ ID NO: 23264 - protein, 277 aa, Unknown
  Obtained from environmental sample
  DOMAIN (10)...(178): tRNA synthetase class II core domain (G, H, P, S and T)
  misc_feature (1)..(277): Xaa is any amino acid
MAQKPSIPKGTRDFNPEQVAKRNYIFSTIKSQFERFGFQPIETPSFENSETLMGKYGEEGDRLIFKILNSGDYLSKVEDALYQKKDSNATTSKISEKALRYDLTVPFARYVVQHQNEIEFPFKRYQMQPVWRADRPQKGRFREFYQCDADVVGSDSLFQEVEFIQLYDNVFSALKLEGVTIKINNRKILSGIAEVIGASDKLIDFTVALDKLDKIGEEKVKEEMLGKGISQESINKLQPLFTISGSFESQIESFKTYFKAPRKKGTKRYLKELITIK

SEQ ID NO: 23265 - DNA, 495 bp, Unknown
  Obtained from environmental sample
  misc_feature (1)..(495): n is a, c, g, or t
ttgacggaagacaaagtctatgaagaaatgcttcagcaatattttgaaaaggtcttaaaaacacaggattttacaattaaaagcactgaaaccggtgttattccaatgacagattttccttttgataaagcgaatacccgacaaatcaccaaaattggtactggtggtggctgggtaaaaccttccaccggatattcttttaaaaatacggaaaaacgcataaaccgaattattgagaacattaaaagtgggaaattaccgggagagaatttaataaataataaattcaggaaatatgatgcgatctttttagatgtgcttgcgcagaacaaccaaaagggagaagagattttcacaaaattctacactaaaaattctccacaagacatttttaaatacctggatgaagaaacttcggtttcagaagatctcaaaattatgttgtctctatatagtttcgactttgtgacgtcttttttcagaaaagctttttag

SEQ ID NO: 23266 - protein, 164 aa, Unknown
  Obtained from environmental sample
  misc_feature (1)..(164): Xaa is any amino acid
MTEDKVYEEMLQQYFEKVLKTQDFTIKSTETGVIPMTDFPFDKANTRQITKIGTGGGWVKPSTGYSFKNTEKRINRIIENIKSGKLPGENLINNKFRKYDAIFLDVLAQNNQKGEEIFTKFYTKNSPQDIFKYLDEETSVSEDLKIMLSLYSFDFVTSFFRKAF

SEQ ID NO: 23267 - DNA, 546 bp, Unknown
  Obtained from environmental sample
  misc_feature (1)..(546): n is a, c, g, or t
ttgaaaaacaacgccttaaacttgtttaagttattgattttcagtatcttaatagtcaatttcaacaagattattttggatacaaatagcaataacaaggattacaagttaataaaaatatatgactatgtctgtgaaaaatttgaaacacatttacaatttgaatgcgaacgctttagcaataataatgcaccaaaacttacagatcaggaaattataaccatttatctatttgtgatgcagcaccaagggattattaaaatgaacaagatacatcaatttgcaagtgaatatttaatgggctggtttcctgatctgggaagttaccaagcctttaattatagaataaacagactctctggtgccatgagcactttggcaggcatgcttttaaccgaatttggcccaaagggctgttccaacaagttaagcgtattggattccatgccaattatcacctgttctggaaaacgttcaggtaagttgcaccccaaaaaacgagcaagggatattgttctacaaagggtatgtactattatggaatga

SEQ ID NO: 23268 - protein, 181 aa, Unknown
  Obtained from environmental sample
  misc_feature (1)..(181): Xaa is any amino acid
MKNNALNLFKLLIFSILIVNFNKIILDTNSNNKDYKLIKIYDYVCEKFETHLQFECERFSNNNAPKLTDQEIITIYLFVMQHQGIIKMNKIHQFASEYLMGWFPDLGSYQAFNYRINRLSGAMSTLAGMLLTEFGPKGCSNKLSVLDSMPIITCSGKRSGKLHPKKRARDIVLQRVCTIME

SEQ ID NO: 23269 - DNA, 798 bp, Unknown
  Obtained from environmental sample
  misc_feature (1)..(798): n is a, c, g, or t
ttggacaaagcgtgggaatatcataccgaagtattgaaaatacacgagaaaataggctccaaacagcgcattgcctacagttacaacagtatagggctaattcatgaagggaaaggcgattgcaatttagcattatcgttttttaagaaatccttagaacttattgaaacacttaataataaggacaggattgccgaggccatgactaatatgggcatttgttatcgtaaaatcaatgaccttggcttagccataaagttcttagagtcggcgctggagattacgaatgaaattaaatttgaacacaaaaaagtatatatcctccatgaactgtccattgttcatttaatgctcgaaaactttgacaaagcgtatgcattgctggaagaatccagaatgattattcaaaccataactaataacaaggaattaattttagagaacaataaaattatgtctgattattatttagccatacacaactacaaggagtcctttagctactacaagaaatacatagaagaatcctccaagattttctcgagtactgaaagcgaaagactcgccgaaatgagaattttgtacgaggcagaacgacgcgaaaacgaaattaaattattggagcaagaacgacatttagaagcacaaaaaagaaactttctattgattggtgctctattgttggcaattattgccatgcttataattggagggctctggaacaacataaaaaagaagaaagcaatttacttgcaaagccacaaactatccaaagagaaattaaaaacacaatattag

SEQ ID NO: 23270 - protein, 265 aa, Unknown
  Obtained from environmental sample
  misc_feature (1)..(265): Xaa is any amino acid
MDKAWEYHTEVLKIHEKIGSKQRIAYSYNSIGLIHEGKGDCNLALSFFKKSLELIETLNNKDRIAEAMTNMGICYRKINDLGLAIKFLESALEITNEIKFEHKKVYILHELSIVHLMLENFDKAYALLEESRMIIQTITNNKELILENNKIMSDYYLAIHNYKESFSYYKKYIEESSKIFSSTESERLAEMRILYEAERRENEIKLLEQERHLEAQKRNFLLIGALLLAIIAMLIIGGLWNNIKKKKAIYLQSHKLSKEKLKTQY

SEQ ID NO: 23271 - DNA, 696 bp, Unknown
  Obtained from environmental sample
  misc_feature (1)..(696): n is a, c, g, or t
atgatacaagcaactcaactaccaaaaaaatacggtcaagctaccgttttaaatgtggaatctttagagatccctaaagggcaaacttttggtttggtaggtaataatggcgcaggcaaaactacattctttaacttgttgttagatttaattgagcctaccacaggctatatcactaacaataagattcaggctgataaaagcgaagattggaaaccttttacagggtcattcatagatgaaagttttttgattggttatttaacgccggaagaatatttctattttattggagaattacggggcatgaataaggctgatatcgatacgtttctaaaacagttcgatgaaatttttaacgatgaaattataggaaagaaaaaatatttgagagatctctcaaaaggaaatcagaaaaaagccggaattgtggctgcacttattggaaatccggaagttatcgtattagacgaaccttttgcaaatttagaccctactacgcagatccggttaaagcagatcattaaagaaatgactcaaaatagagatatcaccatccttatttcgagccatgatctcatgcatgttacggaagtgtgtgaacggattgttgtattggaaaaaggcgatgttgtaaaagatatcgaaacatccactgaaacattgaaagaattagaaagccatttcgcagtttaa

SEQ ID NO: 23272 - protein, 231 aa, Unknown
  Obtained from environmental sample
  DOMAIN (27)...(209): ABC transporter
  misc_feature (1)..(231): Xaa is any amino acid
MIQATQLPKKYGQATVLNVESLEIPKGQTFGLVGNNGAGKTTFFNLLLDLIEPTTGYITNNKIQADKSEDWKPFTGSFIDESFLIGYLTPEEYFYFIGELRGMNKADIDTFLKQFDEIFNDEIIGKKKYLRDLSKGNQKKAGIVAALIGNPEVIVLDEPFANLDPTTQIRLKQIIKEMTQNRDITILISSHDLMHVTEVCERIVVLEKGDVVKDIETSTETLKELESHFAV

SEQ ID NO: 23273 - DNA, 468 bp, Unknown
  Obtained from environmental sample
  misc_feature (1)..(468): n is a, c, g, or t
atgtctaaatttagaaagaagaaaaagggaatgcctgcagtgaacactgcatcacttccagatatcgtttttatgctattattcttcttcatggtaacaactaccatgagagagacagatttaagaatagaaaaccctgtattacctagcgcaactgaaattaaaaaattggaagacaaaagtttggtaagtacaatctatgttggtaaatcaactgatgttaacagagatggagcaggttataataaaattcaattgaatgataaaatatctactgcagatcaagttcctgcttttattttaggaaaaagagataaaatagctgagaaattagttccttttatgactacttctattaaagcagacagacgatctaatgtaggtacaattatagatatcagattaaaattaagagatgttaatgctcttaaaattaactattcttctacacctgatgcgaaaaattaa

SEQ ID NO: 23274 - protein, 155 aa, Unknown
  Obtained from environmental sample
  misc_feature (1)..(155): Xaa is any amino acid
MSKFRKKKKGMPAVNTASLPDIVFMLLFFFMVTTTMRETDLRIENPVLPSATEIKKLEDKSLVSTIYVGKSTDVNRDGAGYNKIQLNDKISTADQVPAFILGKRDKIAEKLVPFMTTSIKADRRSNVGTIIDIRLKLRDVNALKINYSSTPDAKN

SEQ ID NO: 23275 - DNA, 861 bp, Unknown
  Obtained from environmental sample
  misc_feature (1)..(861): n is a, c, g, or t
atgaaaatccctatgctaacatgccatatccagatgatggttttagattattatccggtttataaatactggaatatgattaattatttttttccttataaacatataatggataaagactggaatgaaagtttaaaagaaaatattccaccatttattaatgctaaaaacgaattagaatatgaattagcagctttaaagatgattgcagacattaaagacactcatgctaatctttggggaggaaaagataaaattaacgaaatacttggtgacaactatccaaatttccatgtttcatttattgaaaacaagctggttatagacaacttttataatgaagacagtcctagaaacggtttaaaaataggagatattattacgcgtattaacggaaaaaaagttgaagacatcgttacagataatcaagatttttatccagcgtcaaaccagccaactcgtttaagagatattagttttaatttattacgtactacaagcaatagcttagatattgaggtagaagataatggtatcaaattaattaaaacaatacctgtatacaacaaaaaagacattaaggacttttacaaatggtacacaaaagaagaaaacattagtagttatagactacttaaaaataacattggatatgtttcacttaaaaacattaaagatgaggacgtgaataaaataaaaaaagaattaaaaaacaccaaagggattattgtagacattagaaactatccatctgcctttatgccttttaccttaggtagcttctttacctcatctaanacaccttttgttaaatttacaacaggtaatatagattatcctggagaattcacgtttggntga

SEQ ID NO: 23276 - protein, 286 aa, Unknown
  Obtained from environmental sample
  misc_feature (1)..(286): Xaa is any amino acid
MKIPMLTCHIQMMVLDYYPVYKYWNMINYFFPYKHIMDKDWNESLKENIPPFINAKNELEYELAALKMIADIKDTHANLWGGKDKINEILGDNYPNFHVSFIENKLVIDNFYNEDSPRNGLKIGDIITRINGKKVEDIVTDNQDFYPASNQPTRLRDISFNLLRTTSNSLDIEVEDNGIKLIKTIPVYNKKDIKDFYKWYTKEENISSYRLLKNNIGYVSLKNIKDEDVNKIKKELKNTKGIIVDIRNYPSAFMPFTLGSFFTSSXTPFVKFTTGNIDYPGEFTFG

SEQ ID NO: 23277 - DNA, 777 bp, Unknown
  Obtained from environmental sample
  misc_feature (1)..(777): n is a, c, g, or t
atgcgcaaaattatactatcaatcttaggtgttttatttattattgctgccatttttatttctaaatctttagtagataataaaaataaaccaaagcccatagcagctaaagttattaaaactgtatttacagatacggtcaacaatacgactatacctattgtaattgctgcaaatggaaacttaacagctaagcaacgtgtagagctttactcggaagtacaaggtatatttcgtaatggtagttacctttttaaaccaggtcaaaactatcgcaaagggcaaaccttaattcgggtggatgctgcagagtattatgctagtgtacaatcttcaaaaagtaatttatacaactcgatagctgcaataatgccagatttacgtttggattttccagatgtgttccaaaaatggcaaagctatttgactagttttgacttaaacaaaaccacaccaaaattaccagaaatatcatctgataaagaaaactactttattactggtcgtggtattatcacaaattactacaatgtaaaaaatttagagcaacgtttgtctaagtatactataactgcgccttttaatgggattttaacagaggctttggcaacagaaggatctttaattagaaatggtcaaaaactaggagaatttattaatccttcagtttatgagatgcaagtggctattagtaaaagctttgccaatatcttaaaagtaggcgaaaccgttagtttaactaatttagataaaacagaatctatacaggaaatctga

SEQ ID NO: 23278 - protein, 258 aa, Unknown
  Obtained from environmental sample
  SIGNAL (1)...(16)
  misc_feature (1)..(258): Xaa is any amino acid
MRKIILSILGVLFIIAAIFISKSLVDNKNKPKPIAAKVIKTVFTDTVNNTTIPIVIAANGNLTAKQRVELYSEVQGIFRNGSYLFKPGQNYRKGQTLIRVDAAEYYASVQSSKSNLYNSIAAIMPDLRLDFPDVFQKWQSYLTSFDLNKTTPKLPEISSDKENYFITGRGIITNYYNVKNLEQRLSKYTITAPFNGILTEALATEGSLIRNGQKLGEFINPSVYEMQVAISKSFANILKVGETVSLTNLDKTESIQEI

SEQ ID NO: 23279 - DNA, 303 bp, Unknown
  Obtained from environmental sample
  misc_feature (1)..(303): n is a, c, g, or t
atgaaacagtacttagtaataacattcctactctccttaaccctcggattctcccaaaacccgaaccgaacgtttgaatccatcgcttacaaaaacaatgtactggacatcaaagtcagtgacggggtttataaaatcataccgtttagtgaccacatcattgaaaccacttttattcctgaaggagaagtctacaatcccaattcgcatgcggtcgttttaaaaccagaaaaccatacagctaagttgctgaatgttggggactcgtttaaatttcaacagagggagtaccgtaaatatcca

SEQ ID NO: 23280 - protein, 101 aa, Unknown
  Obtained from environmental sample
  SIGNAL (1)...(18)
  misc_feature (1)..(101): Xaa is any amino acid
MKQYLVITFLLSLTLGFSQNPNRTFESIAYKNNVLDIKVSDGVYKIIPFSDHIIETTFIPEGEVYNPNSHAVVLKPENHTAKLLNVGDSFKFQQREYRKYP

SEQ ID NO: 23281 - DNA, 423 bp, Unknown
  Obtained from environmental sample
  misc_feature (1)..(423): n is a, c, g, or t
atgagtataaaagaacttcatagtattgttaaaaatgtgaatgaaatggaacgagaatacacacaaaaatacgatagtgatgaaccagttagattaggtaagtcaggaaaccccataatatccaaaaaaagagaagatatgaatagtttagagtctaaacttaggatcctttcttatggtggaggggatgtagatcctgataaaaaaattaatgttatggagtatttttctaatagttcagagaaattagatggacttgctaaagaatatcctgaacgtcagacttatcaagtaagagcctcttacatgaaagaaataattaatacgtttgataaatttatatcagacgatacttttgatttatatcaagaaaaggctgctttattgttaaccgacaaaaagaaagtcgatgtttttatttga

SEQ ID NO: 23282 - protein, 140 aa, Unknown
  Obtained from environmental sample
  misc_feature (1)..(140): Xaa is any amino acid
MSIKELHSIVKNVNEMEREYTQKYDSDEPVRLGKSGNPIISKKREDMNSLESKLRILSYGGGDVDPDKKINVMEYFSNSSEKLDGLAKEYPERQTYQVRASYMKEIINTFDKFISDDTFDLYQEKAALLLTDKKKVDVFI

SEQ ID NO: 23283 - DNA, 675 bp, Unknown
  Obtained from environmental sample
  misc_feature (1)..(675): n is a, c, g, or t
atgaataaaaaaaatattacagggattcagcaaattggtattggagttgcagatgtacatgttgcttggaaatggtatcgtcaaaattttggagtcgatattggagtttttgaagaagaggccgttgctgagttaatgttgccttatacagaaggtaaaaaacgttcaaggcatgctgtgttggcctacaatatgcaatctggtggtggttttgaagtgtggcagcatacaggtaaaactcctgaaaaagcagcgtttgaattacagttaggtgatataggaatttatatagcaaagttaaaaagtaagaatgtgcagcaagcatttgactttatgaaatcgaagcaattgaatttactatctgaagttgtacaatcaccaaataacaaacctcatttttttgtaaaagacccatttgataatatttttcaaatagttgaagatgattatgtttttgaagaaacagttgcaaaaactggcggaatatttggtgctgtcattggcgtaaacaatattgaggaatcacttaaagtgtatcaagatattttagagtatgacgaagtagtttatgataaaattggagtttttgaagatttttcaggaatctcaggtggagataaaaaagttagaagaatattgctaaaacactctaaaaaaagctcgagccgattctga

SEQ ID NO: 23284 - protein, 224 aa, Unknown
  Obtained from environmental sample
  misc_feature (1)..(224): Xaa is any amino acid
MNKKNITGIQQIGIGVADVHVAWKWYRQNFGVDIGVFEEEAVAELMLPYTEGKKRSRHAVLAYNMQSGGGFEVWQHTGKTPEKAAFELQLGDIGIYIAKLKSKNVQQAFDFMKSKQLNLLSEVVQSPNNKPHFFVKDPFDNIFQIVEDDYVFEETVAKTGGIFGAVIGVNNIEESLKVYQDILEYDEVVYDKIGVFEDFSGISGGDKKVRRILLKHSKKSSSRF

SEQ ID NO: 23285 - DNA, 447 bp, Unknown
  Obtained from environmental sample
  misc_feature (1)..(447): n is a, c, g, or t
atgaaatggaattggggtacgggacttgtagtggcaatggcgttatttatgggatttattctgtatatggttattataatgagtaccaataaaaagtttggtttcgatttagtcacagaagaatattatgctaaagaaatggtatatcaaaaagaaatagacgcggaaacaaacacaaataacttaaaagaaaaaattgtttttgaaactacagataacggcttgaaattaatatttccaaaaacgtttgaagcttcaaaaataaaaggtaacgtgtttttataccgtccgtctaatcaaaaacttgattttaatgtgccattagttctcgaagactctaatgtactcatacctggcgaaaaactaattggtggtcgctggaatattattatcgattgggaatacgagggcaaaccatttatgtataaaaaatcgttcacctattaa

SEQ ID NO: 23286 - protein, 148 aa, Unknown
  Obtained from environmental sample
  misc_feature (1)..(148): Xaa is any amino acid
MKWNWGTGLVVAMALFMGFILYMVIIMSTNKKFGFDLVTEEYYAKEMVYQKEIDAETNTNNLKEKIVFETTDNGLKLIFPKTFEASKIKGNVFLYRPSNQKLDFNVPLVLEDSNVLIPGEKLIGGRWNIIIDWEYEGKPFMYKKSFTY

SEQ ID NO: 23287 - DNA, 399 bp, Unknown
  Obtained from environmental sample
  misc_feature (1)..(399): n is a, c, g, or t
atgaaaacattttcaaacacatataccattttcatatttattttattcttttttacaactctttgtatttcagcacaaaatgatggaattattactgttcaaagcagcgaaaaaataaaggaaatcattactaaaaagaaagcttacaacaaaaatcttaaaaaaattaacggtttcaaaattcaactttataatggaagtgaagaaggtgcatataagatacgtgataacttttcatcaatgtttcccgaaataagtattaaaattcaatttttctctccagaatggaaagtaagagtcggtaattataaaactcgattagaagttgatcgggctttatttgaaattagagaagcttttcctagtgcaattccaataactgaaatgatagatatttaa

SEQ ID NO: 23288 - protein, 132 aa, Unknown
  Obtained from environmental sample
  misc_feature (1)..(132): Xaa is any amino acid
MKTFSNTYTIFIFILFFFTTLCISAQNDGIITVQSSEKIKEIITKKKAYNKNLKKINGFKIQLYNGSEEGAYKIRDNFSSMFPEISIKIQFFSPEWKVRVGNYKTRLEVDRALFEIREAFPSAIPITEMIDI

SEQ ID NO: 23289 - DNA, 843 bp, Unknown
  Obtained from environmental sample
  misc_feature (1)..(843): n is a, c, g, or t
ttggacctttcaaaaacgggagagtataccattacatttcaatacttaggttataagactataaaaaaacaagttaacgttacaaagtttccgtttgtacttgatgttgttttggcagaagaagacattaacttagatgaggttgtaataaattcggatgaaaatccagcaaatgcaattatcagacagaccattgctaaacgaaaagagaatttaaataaacttaaatcgtttaaagccgagttttactcaagaggattactaaaaatgatcgatgtcccagaaaaaattatgggtcaagaggttggcgatttggatggtgcattagactcgaccagaactggtattgtctatttatcagagacaatatccaaactagaataccaatctcctaaacctattaaagaaactattgttgcttctaaaattagtggagacagcaatggttttagttttaataatgcgactgacgtcgaatttaatttttataaaaacacctttgagttaggtagcgagattgtatctcctattgctgactttgcttttaactattacaaatacaaactagtaggtacgttttacgacgacttaggcaaccttattaataaaattgaattacttcctaaacgtaaaaatgataaagcatttggaggctatatatatatcgttgaagaccaatggagtttatttggtacagacgttacactaactggacaacaagcgcaaataccagctgtggatttatttaaaattaaacaacctttacctattacgaccaagaaaaacaatgggtttaaacccacacaattattgatttttgagtttggaatattttggctttaa

SEQ ID NO: 23290 - protein, 280 aa, Unknown
  Obtained from environmental sample
  misc_feature (1)..(280): Xaa is any amino acid
MDLSKTGEYTITFQYLGYKTIKKQVNVTKFPFVLDVVLAEEDINLDEVVINSDENPANAIIRQTIAKRKENLNKLKSFKAEFYSRGLLKMIDVPEKIMGQEVGDLDGALDSTRTGIVYLSETISKLEYQSPKPIKETIVASKISGDSNGFSFNNATDVEFNFYKNTFELGSEIVSPIADFAFNYYKYKLVGTFYDDLGNLINKIELLPKRKNDKAFGGYIYIVEDQWSLFGTDVTLTGQQAQIPAVDLFKIKQPLPITTKKNNGFKPTQLLIFEFGIFWL

SEQ ID NO: 23291 - DNA, 516 bp, Unknown
  Obtained from environmental sample
  misc_feature (1)..(516): n is a, c, g, or t
atgaaatataattacatacttatacttgtatttattgtcttaagttgcaattctcgaagtgaggataaagaatccgtaaataaaaaaattaaagttgccgaaatccctttactcaatataactgaggcgactcgattagctcaattaccactaaattgtatggatactgaatatcctaataaattgggtcaaaccttaggaggaagtgatgatttaaaagccccgaaagaattacacccggcattttatggatgttttgattggcattcagctgtgcatgggcattggagtttagtaagcttgttaaaacaatttccaacaattgaaaaagcggaaattattaaagaaaagcttcttttaaatatgtctaaagaaaatataatgaaggagttacagtactttcaaggcaaacataataaaacctatgagcgtacttatggatgggcctggttgcttaaattggtagaagagatacatacgtgggatgatcccgttgcacaacaattgggaggataa

SEQ ID NO: 23292 - protein, 171 aa, Unknown
  Obtained from environmental sample
  misc_feature (1)..(171): Xaa is any amino acid
MKYNYILILVFIVLSCNSRSEDKESVNKKIKVAEIPLLNITEATRLAQLPLNCMDTEYPNKLGQTLGGSDDLKAPKELHPAFYGCFDWHSAVHGHWSLVSLLKQFPTIEKAEIIKEKLLLNMSKENIMKELQYFQGKHNKTYERTYGWAWLLKLVEEIHTWDDPVAQQLGG

SEQ ID NO: 23293 - DNA, 615 bp, Unknown
  Obtained from environmental sample
  misc_feature (1)..(615): n is a, c, g, or t
ttgaacatttttgctggtgttgagcttcaagaactccaaagatcttttggtgtcattactgaagatccttttaatagcaatcaattttacgtaaatccattttcaacgctacagtataaacctcgcaatggtgtaaaataccgattggtctataacagaaaaattcggagtcctcgtactgccgaaagctcaacggttataaatgatttaaatcctttttttataagaaaaggaaatcctaatttaaaaacagaaaaaacggatgatttctcgttaatagctaatatatacaattacaaatcatcactaaattttacaagtaggattaaatatcagttttctaaagatgcgattatacaaaatattactattgacgatgagtttgttaaaacaaggagttatataaatagtggagagcggaaacggttttctgccttttttaattttagtaaaaaaataaaaggattaggaatacgctatgctataaagaacagtaatttctacaattcgtctacctcattgattaacttacaacttaacgatgtggtttctaaagatgtcttattaggtttgtcattagagaacgctaacaagaatgttatagacctaaactag

SEQ ID NO: 23294 - protein, 204 aa, Unknown
  Obtained from environmental sample
  misc_feature (1)..(204): Xaa is any amino acid
MNIFAGVELQELQRSFGVITEDPFNSNQFYVNPFSTLQYKPRNGVKYRLVYNRKIRSPRTAESSTVINDLNPFFIRKGNPNLKTEKTDDFSLIANIYNYKSSLNFTSRIKYQFSKDAIIQNITIDDEFVKTRSYINSGERKRFSAFFNFSKKIKGLGIRYAIKNSNFYNSSTSLINLQLNDVVSKDVLLGLSLENANKNVIDLN

SEQ ID NO: 23295 - DNA, 822 bp, Unknown
  Obtained from environmental sample
  misc_feature (1)..(822): n is a, c, g, or t
atgacagatcggctgagagatgccacaatttctggtttaagaagacgtggttacactccagaatctataaaaagttttattgaaactgttggagtttctaaacgtgaaaatgtaattgatgtagctttattagaatttaaaatcagagaagatttaaacaaaactgctaaaagagtaatgggtgttttagatcctgtaaaagtggtaattaccaattatcctgaggataaagaagaaatgctagatgccaattataatgattatgaagatggttttggtagtagaaaagttcctttttcaagagaaatttatattgaaaaagaggattttagagaagaagcaaacaagaagttttttaggttgaaattgggtagcgaagttcgtttaaaaaatgcttattttataaaagcaaatagttgcacaaaagatgctgatggaaatgtcattgagattcaatgtacttatgatccattaacaaaatctggaatggatactgaagaaagcaaacgtaaagtgaaaggaactttgcattgggtttctgcaaaacacgctatcaaagcagaagttagagcttatgacaggttgtttttagatgaagctccagatgcacataaagacaaagattttatggaattcatcaatcctgattctttagaaattattgaagcttttgttgaaccaagtttgcaatctgcagaaattggcgaacgttttcagttccaaagaatggggtattttaatgttgataacgattctacaaaagagcatttagtttttaacaaaattgtggggttaaaagattcttggagttcaaaaaaatag

SEQ ID NO: 23296 - protein, 273 aa, Unknown
  Obtained from environmental sample
  DOMAIN (56)...(249): tRNA synthetases class I (E and Q), anti-codon binding domain
  misc_feature (1)..(273): Xaa is any amino acid
MTDRLRDATISGLRRRGYTPESIKSFIETVGVSKRENVIDVALLEFKIREDLNKTAKRVMGVLDPVKVVITNYPEDKEEMLDANYNDYEDGFGSRKVPFSREIYIEKEDFREEANKKFFRLKLGSEVRLKNAYFIKANSCTKDADGNVIEIQCTYDPLTKSGMDTEESKRKVKGTLHWVSAKHAIKAEVRAYDRLFLDEAPDAHKDKDFMEFINPDSLEIIEAFVEPSLQSAEIGERFQFQRMGYFNVDNDSTKEHLVFNKIVGLKDSWSSKK

SEQ ID NO: 23297 - DNA, 942 bp, Unknown
  Obtained from environmental sample
  misc_feature (1)..(942): n is a, c, g, or t
atgagttctgaggtcgatttatatgagaaaaaatatccaaaaaactgggtggttatgcaaaacaagattctacaagcattctataagatgacaattgatgaaaaacgtctgctacttctagctagtccgattgcgaggctaattaacgcaacacaggacgatgctatagagataacagcgtcagattttgcagatgagtgcggtataaaagtcaattcagcatatagtcaaatgcatgatgcaagtcttactttgatgagcaaacagtttagctataagaatgagaaggggaagcgcgtacatgtgcagtgggtcattagatcaatctatgatgaagcatgtgtatcattatgctttacgaaagaagttttactaatgcttaaagagtttgataaaaataatccgttcacaaagtacaagaaggagtacgtccttgcgctgcgtggtgagtattctattgatatgtatcatctagctaagaaacatgaagctatgagtaaattttacatgtcactagaggattatagaaacgaattaggtttaacagatacctatgtgcgtataaacaatttaaaagctcgtactttacatccagctatagacgaaattaacgaaaaaactgatataaagttatcttacgagaatagaaaaaaaggcggtcgagtgattggttttgactttacggttaaggctaagccacagctaaagcaaatacctaaaagtgctacagtagaggtaagggttgctgatttgaaagataagcagatagaagcgatcgtctgtactcaagcatttaaagatgattataaccatctgataagccccacaagccctataaacacagatctaacacaatgggagcctgaaatgtcaaagctgcttaaggctcatcctgaaaaatttaataaccgcccaatctcttattactggcaaagaaagtag

SEQ ID NO: 23298 - protein, 313 aa, Unknown
  Obtained from environmental sample
  DOMAIN (13)...(229): Initiator Replication protein
  misc_feature (1)..(313): Xaa is any amino acid
MSSEVDLYEKKYPKNWVVMQNKILQAFYKMTIDEKRLLLLASPIARLINATQDDAIEITASDFADECGIKVNSAYSQMHDASLTLMSKQFSYKNEKGKRVHVQWVIRSIYDEACVSLCFTKEVLLMLKEFDKNNPFTKYKKEYVLALRGEYSIDMYHLAKKHEAMSKFYMSLEDYRNELGLTDTYVRINNLKARTLHPAIDEINEKTDIKLSYENRKKGGRVIGFDFTVKAKPQLKQIPKSATVEVRVADLKDKQIEAIVCTQAFKDDYNHLISPTSPINTDLTQWEPEMSKLLKAHPEKFNNRPISYYWQRK

SEQ ID NO: 23299 - DNA, 564 bp, Unknown
  Obtained from environmental sample
  misc_feature (1)..(564): n is a, c, g, or t
atgattgattcattttttgaagaattaaatagtgaaattaaaaagggcgtaaccgaaaaagggcatccttttagatttattactatggcaactgtgggaaatgagcctgtagcccgtctacgcacggttgttttgcgagaggtctcaaaagaattaatcttaagtgtttacacagatagccgtactaagaaaatacagcatattgaaacgaacaatttagttagctttttactttaccacccagaaaaaatgttgcaattgaaagtagaaggtatagccaacatagtaacagataccaaaaggcttactgctacttggaacaacattcagccaaatagtagaaaagattacattacggataatagtccaggtagttttattaaaaaccctgaccatgtagaatatttagaagatcagaattactttactattttagatattacgcctacaaaaattgaatatttaaaacttccaagacccaatcataatagagttctttttgtaaaaaccaatgataaatggaatggggaaatttttagttccttaatttttatagaaaaatag

SEQ ID NO: 23300 - protein, 187 aa, Unknown
  Obtained from environmental sample
  DOMAIN (1)...(100): Pyridoxamine 5'-phosphate oxidase
  misc_feature (1)..(187): Xaa is any amino acid
MIDSFFEELNSEIKKGVTEKGHPFRFITMATVGNEPVARLRTVVLREVSKELILSVYTDSRTKKIQHIETNNLVSFLLYHPEKMLQLKVEGIANIVTDTKRLTATWNNIQPNSRKDYITDNSPGSFIKNPDHVEYLEDQNYFTILDITPTKIEYLKLPRPNHNRVLFVKTNDKWNGEIFSSLIFIEK

SEQ ID NO: 23301 - DNA, 300 bp, Unknown
  Obtained from environmental sample
  misc_feature (1)..(300): n is a, c, g, or t
atgattgcaaccgttaaaaacaaagccatttttagcagtaatacattttcgataaaccttgttacttacccaactaatcacagcgtaatgaaccacattgatccggtgcagcaagggcgctattacaaactcaactttgtattagtaaaacctaaaagcggtggggtgtttaaatgcgctaaatgtattattaactggtttaatagggtgtatttatttaggcccgataagtacgaacacagcgtatctaaaatcgagtctggaaagcgtgtgctactgagctttgcacttaatatatga

SEQ ID NO: 23302 - protein, 99 aa, Unknown
  Obtained from environmental sample
  misc_feature (1)..(99): Xaa is any amino acid
MIATVKNKAIFSSNTFSINLVTYPTNHSVMNHIDPVQQGRYYKLNFVLVKPKSGGVFKCAKCIINWFNRVYLFRPDKYEHSVSKIESGKRVLLSFALNI

SEQ ID NO: 23303 - DNA, 846 bp, Unknown
  Obtained from environmental sample
  misc_feature (1)..(846): n is a, c, g, or t
atgaaaaaggtacttaattatttaccctacatttttattgtgctcttaattatgggaattttagcacaattctatttcaaattgtggaattttggtttcataaatttactgatattactaactgtaattacaatagtggtttttgtaattccacagaaaattgttagaactttcttagcgtttgcacttttcttttttatagggatttcagccgtattttttaataatgataccaattatacaaactattataaaactgcagtaaagaaagaatcaacagtaattttaaagatccaaaaagtattaaaaccaagtgcgtatcattttaaatatgaagcaacagttttacaagtcgatactttaaaaacaagaggtgaaattttgctaaatatttcaaaagatagcatcttaagttctttaaaggttgatgaactattgtatgcaaaaccagcatttgtaacgataaatgctcctttaaatccccatcaatttaactataaattctatttagcgaaacaaggcattcatcaacaagtatttttagaaaaagaagggtttaaaagtttagggttagatcagttttcgttgataggaattgctgcaaaaattagagataaaattcaagaatcactcaagaaatataattttaaagttgatgaattagcagtaataaatgcattgttgttaggacaaagacaagaaatatcaaaagatttaattgaagattattcaaaagcaggagccattcatattttggcagtttctggtttgcatgttggtattatattgtttattttatcaagtttgttaaaacctttagagagaataaaacatggacgcgtttaa

SEQ ID NO: 23304 - protein, 281 aa, Unknown
  Obtained from environmental sample
  misc_feature (1)..(281): Xaa is any amino acid
MKKVLNYLPYIFIVLLIMGILAQFYFKLWNFGFINLLILLTVITIVVFVIPQKIVRTFLAFALFFFIGISAVFFNNDTNYTNYYKTAVKKESTVILKIQKVLKPSAYHFKYEATVLQVDTLKTRGEILLNISKDSILSSLKVDELLYAKPAFVTINAPLNPHQFNYKFYLAKQGIHQQVFLEKEGFKSLGLDQFSLIGIAAKIRDKIQESLKKYNFKVDELAVINALLLGQRQEISKDLIEDYSKAGAIHILAVSGLHVGIILFILSSLLKPLERIKHGRV

SEQ ID NO: 23305 - DNA, 744 bp, Unknown
  Obtained from environmental sample
  misc_feature (1)..(744): n is a, c, g, or t
ttgtcgggtataacacttcacaaagtgtctggaccgcatccatcggggaatgttgggacacaaataaacaagatcgatccagtaaataaaggcgaaacagtatggacggtaagtgcacaagaccttgttattattggggagttattattaactggtaaatttaatgcgaagcgtactattgctttagcaggatcttcagttaaaaaacctagatatttcaaaactattataggtagtgaagtagcaactatggtttttgataacggtgtagataaaaacggtaacgatcgtattatctctggaaatgttttaacaggtaaacaagttaaagcagatgggtatttagattattatagcaatataataacagtaattcctgaaggtgatgattacgagttgtttggatggactaagcctgtatttaataaagtgtcgacgtctagagcgttgactttttcttggttaaccccaaataaaaaatacgacttaaatacgaattcaaacggagagcatagaaattttgtaaccacgggaacttacgaggaggtttttcctctagatatttacccaatgcaaattctaaaagcgtgtatgtatcaagatttagatgaaatggaagctttaggaatgtacgaagtggcacctgaagattttgctttaactgagtttgtatgtgtgtctaagcaaccacatcaagatattattagaaaaggtttagacttaatgcttaaagaaatcggataa

SEQ ID NO: 23306 - protein, 247 aa, Unknown
  Obtained from environmental sample
  DOMAIN (1)...(246): Na(+)-translocating NADH-quinone reductase subunit A (NQRA)
  misc_feature (1)..(247): Xaa is any amino acid
MSGITLHKVSGPHPSGNVGTQINKIDPVNKGETVWTVSAQDLVIIGELLLTGKFNAKRTIALAGSSVKKPRYFKTIIGSEVATMVFDNGVDKNGNDRIISGNVLTGKQVKADGYLDYYSNIITVIPEGDDYELFGWTKPVFNKVSTSRALTFSWLTPNKKYDLNTNSNGEHRNFVTTGTYEEVFPLDIYPMQILKACMYQDLDEMEALGMYEVAPEDFALTEFVCVSKQPHQDIIRKGLDLMLKEIG

SEQ ID NO: 23307 - DNA, 651 bp, Unknown
  Obtained from environmental sample
  misc_feature (1)..(651): n is a, c, g, or t
ttgatgaggtactttgttcttttagtgattttcattgtaacaattatgtatagctgtagtcttttaaaaaaaaagatgatattaaaaaaagagctcaaacattctattacccataaatttatactattcactggacttgttgttcttgtttttatcccttcaatttgctttagtcaaatagatgaaatttttggcggaattaaaatgtctgatgatataggtactgttaaacaaaagatggaaacatattgtgcctcgatgaaagaaattaatgctgaagtaattatctttcctttagcacaaaatagggaacaacaccttatctgtactgattgtaacctgtatgactatttcttttttaataaacttgcatttactttttcagacaataaaatgaattttatctcggcatacggagatggtgtttataagcttcttgataatgaattttataaaggatacaagttctatactggaaaagataatatggtaataaatgaaaaagatagcttggttatgtttcttaccgaggaaggactgcacactaacttgttcgcttggaaaaacccatatttatcgttaaacaaagagactgttaagtacagtacttctgctaagattccagaggtttttaagttggcgaatcactaa

SEQ ID NO: 23308 - protein, 216 aa, Unknown
  Obtained from environmental sample
  misc_feature (1)..(216): Xaa is any amino acid
MMRYFVLLVIFIVTIMYSCSLLKKKMILKKELKHSITHKFILFTGLVVLVFIPSICFSQIDEIFGGIKMSDDIGTVKQKMETYCASMKEINAEVIIFPLAQNREQHLICTDCNLYDYFFFNKLAFTFSDNKMNFISAYGDGVYKLLDNEFYKGYKFYTGKDNMVINEKDSLVMFLTEEGLHTNLFAWKNPYLSLNKETVKYSTSAKIPEVFKLANH

SEQ ID NO: 23309 - DNA, 540 bp, Unknown
  Obtained from environmental sample
  misc_feature (1)..(540): n is a, c, g, or t
gtgccaaatagggtctttccagtcaataaaaaaattgatttattcgctggcaatgtaattgaaaatatcgccataggggaatttgctcctgatatggaacgtattacccaaatttgcaaggcgataggcatattggaatttatagagaacttgccaaatggcttcggtacttatttaggagaaaatggagctacattatcaggcgggcaaaaacaacggattgctattgccagagcattgtacaaaaagtcagagattttagtattagacgaggcaacttcatcattagacagctcctcagaaaattatattcaaaaaacagttaacaacttaagagaaaataataagaccataataaatatcgcacatcggttgagtacaattatcaatgctgataaaattgttgtacttgataaaggaaaagttttggagaaggctcacatgatatgctatttactaaaaaaggacactattataacttgtgggagcagccagatcccnactagggagaaattgatgtctttttcaattttaagataa

SEQ ID NO: 23310 - protein, 179 aa, Unknown
  Obtained from environmental sample
  DOMAIN (3)...(140): ABC transporter
  misc_feature (1)..(179): Xaa is any amino acid
MPNRVFPVNKKIDLFAGNVIENIAIGEFAPDMERITQICKAIGILEFIENLPNGFGTYLGENGATLSGGQKQRIAIARALYKKSEILVLDEATSSLDSSSENYIQKTVNNLRENNKTIINIAHRLSTIINADKIVVLDKGKVLEKAHMICYLLKKDTIITCGSSQIPTREKLMSFSILR

SEQ ID NO: 23311 - DNA, 843 bp, Unknown
  Obtained from environmental sample
  misc_feature (1)..(843): n is a, c, g, or t
ttgccttattggctgatgtctagtgatgaattgagatcattgattattggtaagactgaacacgaggctacatctcaaaacaatattatttacgaggcaatcacttacgctagattacttgaagccggatatgttcaggatatcggagcagagccaaatggaggggctgaagcagcactcagcgtcgataaaactgaagagcaggttttgaattttgatagagataagccagttccgtttaagttgacacaatttgtaaagcacattgacaaggttcagggccgtaaggcggggaaacaagatcatttagcggcatctgcaggccgagataaagttgataatatacttaaaaaactcaaagtccttcgttccaaccctcaacttagttttttattgaaagaatatactgaggagtcttcgcctaagctacaggaaatattgtcacaatttgtaggtgaagcggatgggaaagatatccgtattatcgatatatcaggtctcccaaacgaagtagccggaccgttgacagcattaatatctcgccttctatttcaatacaagctctggcaaacaagggatgaaagagagaaagaccctgtactatttgtctgtgaagaagcacatcgttatgtaccgaatcatggcgaagcacaatataaagaagctcaagatgctattcgtcgtattgccaaagaaggtcggaaatacgggctaggactaggtcttatttctcaaagccctccgatgtggaaagtacagttctttctcagtgtaactcctggaatggtcttaggttgtcgaattccagtgatcaagaacatgtatcaaagtttttacctgaaa

SEQ ID NO: 23312 - protein, 281 aa, Unknown
  Obtained from environmental sample
  misc_feature (1)..(281): Xaa is any amino acid
MPYWLMSSDELRSLIIGKTEHEATSQNNIIYEAITYARLLEAGYVQDIGAEPNGGAEAALSVDKTEEQVLNFDRDKPVPFKLTQFVKHIDKVQGRKAGKQDHLAASAGRDKVDNILKKLKVLRSNPQLSFLLKEYTEESSPKLQEILSQFVGEADGKDIRIIDISGLPNEVAGPLTALISRLLFQYKLWQTRDEREKDPVLFVCEEAHRYVPNHGEAQYKEAQDAIRRIAKEGRKYGLGLGLISQSPPMWKVQFFLSVTPGMVLGCRIPVIKNMYQSFYLK

SEQ ID NO: 23313 - DNA, 609 bp, Unknown
  Obtained from environmental sample
  misc_feature (1)..(609): n is a, c, g, or t
atgttcaaatttccttggacacctccaaaaaacccaatattagcaaggtttattaatgaaattgttcatggagaagaaagtgatattaatgaaattggcgaaccaaaaagtcattatgaaatgtatttagatgccatgaaccaaattggtgcaaatacaaaccaaatagaaaattttgtaacagaaattatttctggaaaaactattgatactgctttaaatgaaattaaagttaatgaaaaagttgctgattttgtaaaattcacttttgatattatagcaactaaacaacctcatcttattgcagcttcttttacatttggtagagaagatgtaattcctgatatgttcttaaaaattattgaaaattcagattcagacaatcaatcttacacgaagttaaaatattatttagaacgtcatatagaattagatggagatgaacatggtccactttctttaaaaatgattactgaactttgtggagaagatgaacaaaaatgggcaagcaccttaaaagtagccaaagaatctttacaacacagaatattactttgggacacaattaataatcttattcaaaaagataaacttgttttatcaatttaa

SEQ ID NO: 23314 - protein, 202 aa, Unknown
  Obtained from environmental sample
  misc_feature (1)..(202): Xaa is any amino acid
MFKFPWTPPKNPILARFINEIVHGEESDINEIGEPKSHYEMYLDAMNQIGANTNQIENFVTEIISGKTIDTALNEIKVNEKVADFVKFTFDIIATKQPHLIAASFTFGREDVIPDMFLKIIENSDSDNQSYTKLKYYLERHIELDGDEHGPLSLKMITELCGEDEQKWASTLKVAKESLQHRILLWDTINNLIQKDKLVLSI

SEQ ID NO: 23315 - DNA, 315 bp, Unknown
  Obtained from environmental sample
  misc_feature (1)..(315): n is a, c, g, or t
atgaatcattctgttttaggatacacctcagtaaattctataaagtctaaacagtattatagagaagtaatctcggaaattgaagtttttaataatgataaaattatttttaaaaataacattaacgaagactttttattagaaaacaaaagcaattatgtaaatactgaaatttatatagatgaattaaaatctttacaaactaacacgctacaattaatagcctcacattgtataccaaacacaaaagactgtaatacttaccgtatagccattaatacctcaggcgattatactataaaacgacaaagttaa

SEQ ID NO: 23316 - protein, 104 aa, Unknown
  Obtained from environmental sample
  misc_feature (1)..(104): Xaa is any amino acid
MNHSVLGYTSVNSIKSKQYYREVISEIEVFNNDKIIFKNNINEDFLLENKSNYVNTEIYIDELKSLQTNTLQLIASHCIPNTKDCNTYRIAINTSGDYTIKRQS

SEQ ID NO: 23317 - DNA, 1059 bp, Unknown
  Obtained from environmental sample
  misc_feature (1)..(1059): n is a, c, g, or t
gtgcccacaactattttggcttatcaacattcccgtacatttagagagcgtttaaaggatttcccagttacggtagattatctaaatcgttttagaacggctaaagaaaaacgtgaaacattagctaatctagaatctggagctgtagatattattattggcacacaccaattggtgaataaaaatgtcaagtttaaagatttaggtttgctaattgtagatgaagagcagaaatttggcgttgccgtaaaagaaaaattaaaaaccttaaaagacaatgtagatgtcctgaccttaacggcaacaccaattccaagaaccttgcaatttagcttgatggctgctcgcgacttatcagttattacaacgcctccacctaatagatacccaatagaaagtcatgtcattcgatttaccgaggagagcattcgcgatgccgtaacctatgaaattcagcgcggtggacagatatttttcatccacaaccgcattgaaaacatcaaggaagtagcaggtatgattcaacgactagttcctgacgctaaaattggcattggtcacggccaaatggaaggaaaaaaactagagcaattgatgttagcttttattaatggtgaatttgatgtattagttagtaccaccattgtagaaagtggtttagatgttccgaatgccaacactatttttattaataacgcgaataattttggcttaagtgatttgcaccaaatgcggggacgcgtagggcgaagcaataaaaaagctttttgttatttcattacaccagaatattcggctatgaccgaagatgctagaaaagcggattacagctttgggagcaattttagcgaatttaggcagccggttttaatattggccatgaaggatttaggaaattcggtggtgctggccgaatttattaggtgggggagcaaaaggggtttttataaatggaaattgggttttgaatccctatccaaaaaatttctcaaatggaagccctttgacgaacctgaaaagaaaacacaaattttgccgaatttttattgtaagaagtga

SEQ ID NO: 23318 - protein, 352 aa, Unknown
  Obtained from environmental sample
  DOMAIN (2)...(111): DEAD/DEAH box helicase
  misc_feature (1)..(352): Xaa is any amino acid
MPTTILAYQHSRTFRERLKDFPVTVDYLNRFRTAKEKRETLANLESGAVDIIIGTHQLVNKNVKFKDLGLLIVDEEQKFGVAVKEKLKTLKDNVDVLTLTATPIPRTLQFSLMAARDLSVITTPPPNRYPIESHVIRFTEESIRDAVTYEIQRGGQIFFIHNRIENIKEVAGMIQRLVPDAKIGIGHGQMEGKKLEQLMLAFINGEFDVLVSTTIVESGLDVPNANTIFINNANNFGLSDLHQMRGRVGRSNKKAFCYFITPEYSAMTEDARKADYSFGSNFSEFRQPVLILAMKDLGNSVVLAEFIRWGSKRGFYKWKLGFESLSKKFLKWKPFDEPEKKTQILPNFYCKK

SEQ ID NO: 23319 - DNA, 627 bp, Unknown
  Obtained from environmental sample
  misc_feature (1)..(627): n is a, c, g, or t
atgagtgatgctttaaaacatgagtgcggaattgcactgataagattacgtaaacctttagaattttataaagaaaaatatggaagtgctttttatggtgtaaataaaatgtacttaatgatggaaaagcaacacaatcgtggtcaagatggtgctggttttgcaagtattaaaatggacacgcttccaggagaacgttacattagtcgtgtacgctccatagcacaacaacctattcaggatatttttgcacaaattaacgaacgtgtaaataaagagttagcacaacatccagaataccaagatagcgttgcgcttcaaaaaaaacacataccttatattggtgagttactattaggacacgtgcgttatggtacgtttggtaaaaacagtgtggaaagtgtccatccttttttaagacaaaataactggatgcatcgtaacctgattttggcaggtaactttaatatgactaatgttaaagagctgtttaaaaacctagtggaccttggacaacatccaaaagaatatacagacaccattactataatggaaaaaataggtcactttttagatgatgcagtaagtaaaatctataaagaccctaaaaaaggaaggttatggtaa

SEQ ID NO: 23320 - protein, 208 aa, Unknown
  Obtained from environmental sample
  DOMAIN (33)...(189): Glutamine amidotransferases class-II
  misc_feature (1)..(208): Xaa is any amino acid
MSDALKHECGIALIRLRKPLEFYKEKYGSAFYGVNKMYLMMEKQHNRGQDGAGFASIKMDTLPGERYISRVRSIAQQPIQDIFAQINERVNKELAQHPEYQDSVALQKKHIPYIGELLLGHVRYGTFGKNSVESVHPFLRQNNWMHRNLILAGNFNMTNVKELFKNLVDLGQHPKEYTDTITIMEKIGHFLDDAVSKIYKDPKKGRLW

SEQ ID NO: 23321 - DNA, 603 bp, Unknown
  Obtained from environmental sample
  misc_feature (1)..(603): n is a, c, g, or t
atggatttattttcttcggatacaataacaaatattttaccttttgatggcacaacgaattatcatggaattattttagataaaagtcagtgtgatttttattatcaacaattattagaaaaaattaattggaaaaatgacgaagccattatttttggaaagaagattatcaccaaaagaaaagtagcttggtatggaagttctgaatattcttacacttattctaaagttacaaaaacagctaatctttggatcaaggaattgctagaactcaaagaaatcgtcgaaaaagaaagtaaggaaacgtataattcttgcttgttgaatttatatcattcaggagaagaaggcatggcttatcattctgatggcgaaaaaatgatgaagaaaaatggcgcgattgcttctgtatctttaggagcagaacgtaaattttcttttaaacataaagaaaacaaacaacgaattgatattgtattagaaagaggaagtttattggtgatgaaaggcgaaactcaaaagtattggttgcacagattgccaccaaccaaaaaagtgaattcgccaagaataaatttaacgtttagaacaatagaattataa

SEQ ID NO: 23322 - protein, 200 aa, Unknown
  Obtained from environmental sample
  DOMAIN (102)...(199): 2OG-Fe(II) oxygenase superfamily
  misc_feature (1)..(200): Xaa is any amino acid
MDLFSSDTITNILPFDGTTNYHGIILDKSQCDFYYQQLLEKINWKNDEAIIFGKKIITKRKVAWYGSSEYSYTYSKVTKTANLWIKELLELKEIVEKESKETYNSCLLNLYHSGEEGMAYHSDGEKMMKKNGAIASVSLGAERKFSFKHKENKQRIDIVLERGSLLVMKGETQKYWLHRLPPTKKVNSPRINLTFRTIEL

SEQ ID NO: 23323 - DNA, 435 bp, Unknown
  Obtained from environmental sample
  misc_feature (1)..(435): n is a, c, g, or t
atgaaatattacatatcaatacttattacggttttaataacatgtaataaccattcacagaacaataattttatagccacctataaaataaactatactatggttaattatgattcaattttaaatacgatgaaacaaaaaagtaagggttttatggaaatggctaaaaaagatattatagaaacaaagtctagtataaaagaattagaaaaaattaattttattttaaagtataataacaatgaatcaacctattgtcaagaaaaaactattttcgtaaatgaaaatggaatgcgaaaactatttccactactaaacataaaggatgatcgtgaaatttacaccaataaagataaaaatcacatgaatttaaatgcctttggagaaaaacttaatctagaaataggaaagggtgaatggcaaataacaaatgaa

SEQ ID NO: 23324 - protein, 145 aa, Unknown
  Obtained from environmental sample
  SIGNAL (1)...(19)
  misc_feature (1)..(145): Xaa is any amino acid
MKYYISILITVLITCNNHSQNNNFIATYKINYTMVNYDSILNTMKQKSKGFMEMAKKDIIETKSSIKELEKINFILKYNNNESTYCQEKTIFVNENGMRKLFPLLNIKDDREIYTNKDKNHMNLNAFGEKLNLEIGKGEWQITNE

SEQ ID NO: 23325 - DNA, 312 bp, Unknown
  Obtained from environmental sample
  misc_feature (1)..(312): n is a, c, g, or t
atggaacattatagtttgaaaatatttgctatttttgattttatgaaaaagaaagattacttctcttactttgtaaaagatgaataccaagctattttaagcaatttaatttcaattagacaagaaaaaggatatacacaataccaagtaggatacaaacttggtatcagtgataatgcctattcaaaattagaaaatggtcacaccaagttagatgtgcaacgtttaatattcattttacaaatttttgatgtaaaccttagcgatttttttggagaatttaaggagtttaaagattttaaagaaaaataa

SEQ ID NO: 23326 - protein, 103 aa, Unknown
  Obtained from environmental sample
  DOMAIN (36)...(90): Helix-turn-helix
  misc_feature (1)..(103): Xaa is any amino acid
MEHYSLKIFAIFDFMKKKDYFSYFVKDEYQAILSNLISIRQEKGYTQYQVGYKLGISDNAYSKLENGHTKLDVQRLIFILQIFDVNLSDFFGEFKEFKDFKEK

SEQ ID NO: 23327 - DNA, 969 bp, Unknown
  Obtained from environmental sample
  misc_feature (1)..(969): n is a, c, g, or t
atgacagatcggctcagcgaccgatatctggaccgcacccagtattataaaattgcgcaattgcagcaaaccaacgccgaagtccaaattataggaaaaattacccacattaaaaccgtagaacaaaaacgcggaaaaagactcgtcgctacttttattgatgaaactggaacaatggaattggtttggtttcgaggtcaaaaatggattcgggaaaatttaaagctgaatgtttcctatgtgattttcggaaaaacgaattatttcaacaacagtttttccatgccgcaccctgaaatggaattgctcgatgcccatgaaaaaagtatccgttctgccatgcaacccgtgtatccttccactgaaaaattagggaatagcggcatcacaaatagggtgataaatggactgatgcaacagctgttcttagagagcaaaaatgccttcgccgagaccctctcaaaaccacttttggaacagctcaaattggcctcaaaaaaggaggcacttttcaacatacattttccaaaaagccaggcacatttagcacgggcacagtaccgattaaagtttgaagaattgttctatatccaactgcaattaatccgtaaaaacctccttcataaatcgaaaattaagggctatccttttgataaaatcggacacaatttcaacaccttttttgcggagcatttaccctttgatttgaccgaagcgcagaagcgggtcatcaaagaaattcgaaacgatttgggaagcaatgcccagatgaaccgactcttgcaaggcgatgtaagttctggaaagaccatagtagcgctaatgtcaatgtttatagctattgaacatggttttcaagcctgtttaatggcaccgactgaaattttgtcagtacagcactaccacagtttagttgaaatatgtaaaagactgaaacccagtattggaatactaacaggctcaactaaa

SEQ ID NO: 23328 - protein, 323 aa, Unknown
  Obtained from environmental sample
  DOMAIN (28)...(103): OB-fold nucleic acid binding domain
  misc_feature (1)..(323): Xaa is any amino acid
MTDRLSDRYLDRTQYYKIAQLQQTNAEVQIIGKITHIKTVEQKRGKRLVATFIDETGTMELVWFRGQKWIRENLKLNVSYVIFGKTNYFNNSFSMPHPEMELLDAHEKSIRSAMQPVYPSTEKLGNSGITNRVINGLMQQLFLESKNAFAETLSKPLLEQLKLASKKEALFNIHFPKSQAHLARAQYRLKFEELFYIQLQLIRKNLLHKSKIKGYPFDKIGHNFNTFFAEHLPFDLTEAQKRVIKEIRNDLGSNAQMNRLLQGDVSSGKTIVALMSMFIAIEHGFQACLMAPTEILSVQHYHSLVEICKRLKPSIGILTGSTK

SEQ ID NO: 23329 - DNA, 477 bp, Unknown
  Obtained from environmental sample
  misc_feature (1)..(477): n is a, c, g, or t
ttgtttttaatgaaaattttctcaaacactttagtatttaaaagaattacaattcttgtttctcttgtaattgttactttaattctttggaatacctatactttctttcaaaaatttaaacaagctgaaagagcaaaaatggaaattcatggtgaagccattaaagaattaaggaccgataatttagcagatttagataaaaacatctctggacttcctttaaatatcattagcagaacaaaagatattccatttattttggttgatgctgatggagccataaaaggctcaaacaatctagatcctgaacaagaaaacgactctacatatttggctaatcagttagccattatgaagaaacaaaaccaacctattgaagtagattatttaggaaaaacagattatatttattacagagattcagctttattagacaaacttacttattatcctttgggctttattgttgaattttag

SEQ ID NO: 23330 - protein, 158 aa, Unknown
  Obtained from environmental sample
  misc_feature (1)..(158): Xaa is any amino acid
MFLMKIFSNTLVFKRITILVSLVIVTLILWNTYTFFQKFKQAERAKMEIHGEAIKELRTDNLADLDKNISGLPLNIISRTKDIPFILVDADGAIKGSNNLDPEQENDSTYLANQLAIMKKQNQPIEVDYLGKTDYIYYRDSALLDKLTYYPLGFIVEF

SEQ ID NO: 23331 - DNA, 480 bp, Unknown
  Obtained from environmental sample
  misc_feature (1)..(480): n is a, c, g, or t
ttgccaatcgtttttttaaaatgggtccaaacccgacttaaaaagcagaatattgtagctgttacaaaacaacttttcgattatttagaatccagaagttctaaacaaatctcgttttcattttcatcaactgacaaagaattgtatacaaatttaaatacagaattatttggttgggtaattgagaacctcatcaaaaatggtattgatgccatgtctggaaaaggcgaattaaatctacagattgaaaacgaaccaaagagagtaaaaatcacgctttctgatacaggaaaaggaatgtctaaaaaattattcaagcaaatatttaagccaggttttaccaccaaaaagcgtggttgggggttgggtttatcgctctcaaaacgtattatagaagattatcataatggaaaaatctttgtaaaaaaatcagaaattgacaaaggaacaacctttcaaattttattgaataaagtttag

SEQ ID NO: 23332 - protein, 159 aa, Unknown
  Obtained from environmental sample
  DOMAIN (52)...(159): Histidine kinase-, DNA gyrase B-, and HSP90-like ATPase
  misc_feature (1)..(159): Xaa is any amino acid
MPIVFLKWVQTRLKKQNIVAVTKQLFDYLESRSSKQISFSFSSTDKELYTNLNTELFGWVIENLIKNGIDAMSGKGELNLQIENEPKRVKITLSDTGKGMSKKLFKQIFKPGFTTKKRGWGLGLSLSKRIIEDYHNGKIFVKKSEIDKGTTFQILLNKV

SEQ ID NO: 23333 - DNA, 744 bp, Unknown
  Obtained from environmental sample
  misc_feature (1)..(744): n is a, c, g, or t
atgtcgttggtgcactaccaaaataccaaaaaagtcttggcgttgagtcaaaggtntatcatgccgttttacgacaatgagtttaaaaagaaaaataagtttaaggttgtaaatacaggctatttaaagctcggaagacttcgctatgaatatgaaatactcagaccgattgttcctttggaatttgcaattttactcgttgatatacctggcttacttgatcgttcagatgtctattcttatgaagacgatgttgaacgatttttagctttccaattggccgttttagactggttgacaaggaaagtcaaaaaaccatcgattattcactgccatgatcatcaaacagggtttataccttttttaatgtcacatgctagtaaattcagcagtctaaaagagttaccaagcatttttacgatccacaatgctcagtatcaaggacaatttggttacgataagctcaagtattttcctgaatttgatttaaagaaaatgggccttattgattgggatggttccattaatcctatggctacggccattaaaagttcatggcgggtgacaactgtatcgcctgggtatctagaagaattaaaggccaatgcaaatggtttggaggagttggtcaatcaggaatctgataaattttcagggatattgaatggcatagatacagacgtttggaacccagaaacggatcagcacttagcgaaaaattattctaataaaagcattaaataa

SEQ ID NO: 23334 - protein, 247 aa, Unknown
  Obtained from environmental sample
  misc_feature (1)..(247): Xaa is any amino acid
MSLVHYQNTKKVLALSQRXIMPFYDNEFKKKNKFKVVNTGYLKLGRLRYEYEILRPIVPLEFAILLVDIPGLLDRSDVYSYEDDVERFLAFQLAVLDWLTRKVKKPSIIHCHDHQTGFIPFLMSHASKFSSLKELPSIFTIHNAQYQGQFGYDKLKYFPEFDLKKMGLIDWDGSINPMATAIKSSWRVTTVSPGYLEELKANANGLEELVNQESDKFSGILNGIDTDVWNPETDQHLAKNYSNKSIK

SEQ ID NO: 23335 - DNA, 651 bp, Unknown
  Obtained from environmental sample
  misc_feature (1)..(651): n is a, c, g, or t
atgcccacaaacgtattatcacttataaaaggaactgaatttccaaattcatatatggttattagcgctcattatgatcatttaggaattagaaaagaagcggggcaagaggatttcatctataacggagctgatgatgatgcatctggaacaagtgcattattcagttttgctgaatatcttaaaaagaacccacctagacattctgtaatattagcggcttttgatagtgaagaactgggcttaaaaggttctaaatattttgtagacaattctattattcctttagaatctattatggtgaatttgaatatggatatgattagccgcaataccaagaatgaattatatgtcgtagggacacgttataatgagacattgaaagctttgatatcaaactttaaagcttcaggaaaagtaaaactattaacgggacatgatggtggtgatggcaaacaaaattggactggttcgtcagatcatggatcttttcataataagaagattccatttttatattttggtgtagaagaccataaagattaccataaagcaaccgatcattatgaaaatattcatccagaattttataaaaatgctgtaagtaatattatttctgtatttaataaaatcgatgccatacaattataa

SEQ ID NO: 23336 - protein, 216 aa, Unknown
  Obtained from environmental sample
  DOMAIN (18)...(90): Peptidase family M20/M25/M40
  misc_feature (1)..(216): Xaa is any amino acid
MPTNVLSLIKGTEFPNSYMVISAHYDHLGIRKEAGQEDFIYNGADDDASGTSALFSFAEYLKKNPPRHSVILAAFDSEELGLKGSKYFVDNSIIPLESIMVNLNMDMISRNTKNELYVVGTRYNETLKALISNFKASGKVKLLTGHDGGDGKQNWTGSSDHGSFHNKKIPFLYFGVEDHKDYHKATDHYENIHPEFYKNAVSNIISVFNKIDAIQL

SEQ ID NO: 23337 - DNA, 543 bp, Unknown
  Obtained from environmental sample
  misc_feature (1)..(543): n is a, c, g, or t
atgaatccccacaaaccacatatcattgccgaaggtagcgttcaatacacattgggagaacttaagaataaccaaatgctttatgattttgataaaatgctaatctacctcaatgccaaaggaaaactgctgtttggaaagaaattcaaaatttttgaagatgaccgagagattttattcaaactctgcaattattacatcaaagatgaagctaattgcaaaaaactggacatcgatatcgataaaggcattttactttctggtcctgttgggtgtggcaagaccagtctaatgaaactattacgccatattgtaccacataacaaaccctatgaggttattccaacccgaaacatcacttttgcctttacaacattgggtacactatcattgaaaactaccgagaataacaatttttatggtttcgatgaattaggtgtggaacctactggaaggcattttggtaaggactgtaatgtgatgggccaaatcttactttctcgctatgatttgttcttagaacttaagattaagacccctgcc

SEQ ID NO: 23338 - protein, 181 aa, Unknown
  Obtained from environmental sample
  misc_feature (1)..(181): Xaa is any amino acid
MNPHKPHIIAEGSVQYTLGELKNNQMLYDFDKMLIYLNAKGKLLFGKKFKIFEDDREILFKLCNYYIKDEANCKKLDIDIDKGILLSGPVGCGKTSLMKLLRHIVPHNKPYEVIPTRNITFAFTTLGTLSLKTTENNNFYGFDELGVEPTGRHFGKDCNVMGQILLSRYDLFLELKIKTPA

SEQ ID NO: 23339 - DNA, 669 bp, Unknown
  Obtained from environmental sample
  misc_feature (1)..(669): n is a, c, g, or t
atgatgaaaaaaatttctttattaatattgataataataggtagttgtcaaacaacagtaatgaaagaagagaaaaatactagtttttatgttggtacttatacaaacggaaacagtaaaggaatttataaatatcagattaatactgaaggaaaactaaaagaaattggtttaatggcaacaaccattaaccctacttttctagcaaaatctaaaaataacaaactgctctttgcagttggagaaacggatgaagcaggtacaggttttataaaatcttttaaaataaccaaagactcgctaatagagattagtaaagaaaaaagcggtggtgctggcccctgctttgttgcagtggattctagaaattatattcttactgctaattatggtggtggaaatattggtttactaaaagcagatgcactaggtgcattaaaaccattgttatatacccaacaacatacaggcaaaggaaccacagaaagacagcaggcgccacatgcccattctacttggtttcacccagtaaaagatgagataatatctatagatttaggtacaaataatttgtggttttctaaaattgatacgcaaaaggatgagtttatttttaccgtgcagaaaaaatttaaaaatggaaaaaaggtgctggcccaagacacctaa

SEQ ID NO: 23340 - protein, 222 aa, Unknown
  Obtained from environmental sample
  SIGNAL (1)...(18)
  misc_feature (1)..(222): Xaa is any amino acid
MMKKISLLILIIIGSCQTTVMKEEKNTSFYVGTYTNGNSKGIYKYQINTEGKLKEIGLMATTINPTFLAKSKNNKLLFAVGETDEAGTGFIKSFKITKDSLIEISKEKSGGAGPCFVAVDSRNYILTANYGGGNIGLLKADALGALKPLLYTQQHTGKGTTERQQAPHAHSTWFHPVKDEIISIDLGTNNLWFSKIDTQKDEFIFTVQKKFKNGKKVLAQDT

SEQ ID NO: 23341 - DNA, 657 bp, Unknown
  Obtained from environmental sample
  misc_feature (1)..(657): n is a, c, g, or t
ttgaatgaatttgaaaataataagcctgttgctgatttttattgtaatacctgtaatgaacaatacgaattaaaaagcaaaataggtttaaaagttggtaaacaaattgttgatggtgcttactcaacgatgattgaaagagttaattctgatacaaatcctaattttttctttttgacatacaataacaaggactggaaagtgaataattttttaattattcctaaacactttttcgttcctgatattatttacgaacgtaaacctttaagtaaaaatgcaaaaagagctggttggataggatgtaatattaatttgcagaagatacctcagaatgggcgaatatatttgattaaaaattctgaaacagttccaatacataaagtacgtgaaaattggaataaaacaacttttctaaaatcaaaaaaattaaatagcagaggttggatattagatgtcttaatttgtattgatagaattaattctaataatttttcacttgaaaatatatataaatttgaaagtgaattgaaaataaaatatccaaataataatttcattaaagataaaattaggcaacagttacaaatattgcgcgacaaaggaataattgaatttacatcacgaggtaattataaaaaaataaatgatttttaa

SEQ ID NO: 23342 - protein, 218 aa, Unknown
  Obtained from environmental sample
  DOMAIN (1)...(215): Dam-replacing family
  misc_feature (1)..(218): Xaa is any amino acid
MNEFENNKPVADFYCNTCNEQYELKSKIGLKVGKQIVDGAYSTMIERVNSDTNPNFFFLTYNNKDWKVNNFLIIPKHFFVPDIIYERKPLSKNAKRAGWIGCNINLQKIPQNGRIYLIKNSETVPIHKVRENWNKTTFLKSKKLNSRGWILDVLICIDRINSNNFSLENIYKFESELKIKYPNNNFIKDKIRQQLQILRDKGIIEFTSRGNYKKINDF

SEQ ID NO: 23343 - DNA, 786 bp, Unknown
  Obtained from environmental sample
  misc_feature (1)..(786): n is a, c, g, or t
atgatgtttgatgtaaaatcttctacagtttcagaaattgcaaacgatttaataaaacacgtaaaccaaacagatttatcggtttcagagaaaaaagcgattactattttagaaaaatgggatggaaattatttaaaagaggcagttgcaccaacaatttacaatcgttttttatatgaagttttggcaaatacgtataaagatgaattaggaaatagttttgagttgtttatcaattctcaattgcaagatcaagtattgccaattcaaattaatagagcaaattctgtttggtgggatgatattaaaacaccaaataaaacagaaaacagacaagaaattatcacgaattcttttaaaagcagttttgagtttttagaaaatcaattagggaataatgtggatgattggttctggaaaagagttatttctgtagaacatgaacacgcaattggtaaagctggtggacttttaagaacgttttttaatgtaggtccttttgaaactgttggtggtaatgaagtaattaacaatcaaatttttaaattagatagtacaggcatttataaaataacagctggtccatcaacaagaagagtcatagatttttctgatatagaaaacagtttagcgattttaccaacaggacaatctggaaacgtttttagtgatcattataaagatcaagctcaaagatttgtagatggtgaatttgcagaaatgaaactaaatgaagtgcaaataaaaagaagtgaaaatgtattgatttttaaaactaaaaaataa

SEQ ID NO: 23344 - protein, 261 aa, Unknown
  Obtained from environmental sample
  misc_feature (1)..(261): Xaa is any amino acid
MMFDVKSSTVSEIANDLIKHVNQTDLSVSEKKAITILEKWDGNYLKEAVAPTIYNRFLYEVLANTYKDELGNSFELFINSQLQDQVLPIQINRANSVWWDDIKTPNKTENRQEIITNSFKSSFEFLENQLGNNVDDWFWKRVISVEHEHAIGKAGGLLRTFFNVGPFETVGGNEVINNQIFKLDSTGIYKITAGPSTRRVIDFSDIENSLAILPTGQSGNVFSDHYKDQAQRFVDGEFAEMKLNEVQIKRSENVLIFKTKK

SEQ ID NO: 23345 - DNA, 504 bp, Unknown
  Obtained from environmental sample
  misc_feature (1)..(504): n is a, c, g, or t
atggctgaagaaattattaatcgcgtagcaaatagtaaattaattacactagaccttgaagattactatccaaaaggacaacgtgttttattagatattaaagattggttgttacaggaattggttttaaaagaaaaagattttagagaatatatcaaaaatcacgattggagtcagtaccaaaatcaatacgtagctatcacttgtagtgcagatgctatcattccggattgggcttttatgttattggtcgtaaatttagaaccttttgtcgaaaagtgccatattggaacactagaggatttagagacttccatttatcaagacttaatcagtgctattgatggtacaatataccaagataaacctgtaataattaaaggttgtagtaacaagccagtgcctataaacgcttatgttatgataactaacaagcttaaaccatatgctaaatctatcatgtatggagaggcgtgttcctttgtccctttatacaaacgttaa

SEQ ID NO: 23346 - protein, 167 aa, Unknown
  Obtained from environmental sample
  misc_feature (1)..(167): Xaa is any amino acid
MAEEIINRVANSKLITLDLEDYYPKGQRVLLDIKDWLLQELVLKEKDFREYIKNHDWSQYQNQYVAITCSADAIIPDWAFMLLVVNLEPFVEKCHIGTLEDLETSIYQDLISAIDGTIYQDKPVIIKGCSNKPVPINAYVMITNKLKPYAKSIMYGEACSFVPLYKR

SEQ ID NO: 23347 - DNA, 483 bp, Unknown
  Obtained from environmental sample
  misc_feature (1)..(483): n is a, c, g, or t
atggctgagatagaagcnaggagtttttatcaaaatataacagaacaaaatttggttaaaaatggagattttcttccttttaaagaagtttcggcatatttatcatccacaaaagcaataattaaaatagatcaaaatcattttaaagctataaagttagattgttttaaaggtccagaatttgaaatgttagataaacatcaacaaaaaaaaattacaacagaactttttacaatttctaatgatcaaaatagaatgggtataaaactgaatgaagttttggataataatttacctcaaatcttaacatctgctgttttgcctggaactgtgcagcttacgccatcaggaaaattaattgttttaatgagagattgtcaagtaacaggaggctatccaagagtgttactgctttctgaattttcaataaataggttagcgcaaaaaactacaaatcaaaaaattagctttaatactatttga

SEQ ID NO: 23348 - protein, 160 aa, Unknown
  Obtained from environmental sample
  misc_feature (1)..(160): Xaa is any amino acid
MAEIEARSFYQNITEQNLVKNGDFLPFKEVSAYLSSTKAIIKIDQNHFKAIKLDCFKGPEFEMLDKHQQKKITTELFTISNDQNRMGIKLNEVLDNNLPQILTSAVLPGTVQLTPSGKLIVLMRDCQVTGGYPRVLLLSEFSINRLAQKTTNQKISFNTI

SEQ ID NO: 23349 - DNA, 759 bp, Unknown
  Obtained from environmental sample
  misc_feature (1)..(759): n is a, c, g, or t
atgattcatattgagattattgctgacagcccaaaagattttatagagcaaatgcaagatgcacttggtggagaaaccactgaaagatggagcgaatttgttttaaaaatcaacaacgaaaatgggattggcagtattcgttttattccttttgattggggtgtaaatttgcttgatttcgatattaagtttcataaagaaattacgttgcacattaaagcaaatgatgaatttaatccaatacgtttcatttacccaactgtaggaaacatcaaacacaaatttggtattcatgaaaaggagaaagaggtaaatcaatttcaatcgttaatttacactaataaaactggtggttttaatgatattatttttcctaaaaatgagaaattagaaattaatgtgattcagattattagaaagcattttttaaagaaacgaaccacaaacgtatcaaccttaaataaaaaattatacgaagtttttgtagatacagatcatgataatagatttgccaattatgggattatgaatcttaaaatggcagatttaattataaaaatgcataaaattaaagcaaaaggaatgcttagaatcttnaagattgaagcaaaaatttacgaaattttatccatgcacattcagcaacataacagacttttagaaggtgatactttgcctgaatctatgaacaaaagcgagttaaaaattgttagaaaagttgcaaatgctaattttaaaacacctgcaaaagagtattct

SEQ ID NO: 23350 - protein, 253 aa, Unknown
  Obtained from environmental sample
  misc_feature (1)..(253): Xaa is any amino acid
MIHIEIIADSPKDFIEQMQDALGGETTERWSEFVLKINNENGIGSIRFIPFDWGVNLLDFDIKFHKEITLHIKANDEFNPIRFIYPTVGNIKHKFGIHEKEKEVNQFQSLIYTNKTGGFNDIIFPKNEKLEINVIQIIRKHFLKKRTTNVSTLNKKLYEVFVDTDHDNRFANYGIMNLKMADLIIKMHKIKAKGMLRIXKIEAKIYEILSMHIQQHNRLLEGDTLPESMNKSELKIVRKVANANFKTPAKEYS

SEQ ID NO: 23351 - DNA, 357 bp, Unknown
  Obtained from environmental sample
  misc_feature (1)..(357): n is a, c, g, or t
atgaacatattcatagactcaaatattttatttcaagattacttttttgaaaataagtcaaataaaaaattgctcgaatattgcgacgaaggactattaaatctgtttatgtctgaaatagtacgattggagttgagaagacagtttcaaaaagagattgaagaaaaaaacaggataataagaaagataattaaggattctaaaagactaaaattagagagcgagattagtgagatttcaataagtgaacaatttacaaaatttgatgagttttataataagcttaaaatgtatgacaacttttgcatattgaaatacaaaaatgattttttacctgatattgtgacagagctataa

SEQ ID NO: 23352 - protein, 118 aa, Unknown
  Obtained from environmental sample
  misc_feature (1)..(118): Xaa is any amino acid
MNIFIDSNILFQDYFFENKSNKKLLEYCDEGLLNLFMSEIVRLELRRQFQKEIEEKNRIIRKIIKDSKRLKLESEISEISISEQFTKFDEFYNKLKMYDNFCILKYKNDFLPDIVTEL

SEQ ID NO: 23353 - DNA, 708 bp, Unknown
  Obtained from environmental sample
  misc_feature (1)..(708): n is a, c, g, or t
atgataaaaccaattaaaaaaaatgacaatcggagtgttgatttaacatttagctggttatctaaagctattggcactaaatggctttcgtgggagaagttggctgccgaatggatgaagatgcaaacaacttctattgacgtcaaaagagtagctcttacttttttattagaaaaatattttttaatacatgctccctatgcatctaatatcgatactttttttagtggttcaaatggtcatataagtaattcagatgaatttattgaagtaatgaaaatatcaggtgtcaacgaccttaacgagcaggcaaggagaccaaattatatagttgatttcattgactttgtcatcgagaagcattttacagttcgtgatcaaaataatgtctccataaaaacggttgttaacccatttacaaaggttaaatttaaaagtgttcctcttgagactgttcgccaaccactcccttataaatatatactctcgctaagagatataatttcaccgagtaacgataaaacaactaagcatgataatacatcccactgtccatcattcaaagattggctttgggcacaagctcaaacaggggtacgttcaggaacaaggggtggtgattggttcgaggtacctgaaagtttaattaacaaagatgatcctgactgcgtttggcgccaaagaaaatcaaatcaaaagcgctactga

SEQ ID NO: 23354 - protein, 235 aa, Unknown
  Obtained from environmental sample
  misc_feature (1)..(235): Xaa is any amino acid
MIKPIKKNDNRSVDLTFSWLSKAIGTKWLSWEKLAAEWMKMQTTSIDVKRVALTFLLEKYFLIHAPYASNIDTFFSGSNGHISNSDEFIEVMKISGVNDLNEQARRPNYIVDFIDFVIEKHFTVRDQNNVSIKTVVNPFTKVKFKSVPLETVRQPLPYKYILSLRDIISPSNDKTTKHDNTSHCPSFKDWLWAQAQTGVRSGTRGGDWFEVPESLINKDDPDCVWRQRKSNQKRY

SEQ ID NO: 23355 - DNA, 459 bp, Unknown
  Obtained from environmental sample
  misc_feature (1)..(459): n is a, c, g, or t
atggatgaaagcggctttgagcacgagactattcgctctcatggctatgcaccgattggtgagccttgtatcgatagctacaactggcaaggtaaaaagcgaaccaacgttatcggtgctctgtatgaaaagatgctgtttgcaattgattactttacgcacaacattaacagcagcatattctacgactggtgcaagttcacacttattccaagtcttaaaactaaatgcgtgattgtaatggataatgctagatttcataagagtaagcgtattcaaaaactattaaacaggcatggtcatcgtattctatggctgccaccctacagccctgatttgaaccctattgagaagaaatgggctcaggtgaagtttctacgccaaggctggatggaaaacgacttatccaaattgttttatgatgtttgtcctaaccataacaattttattttgaactga

SEQ ID NO: 23356 - protein, 152 aa, Unknown
  Obtained from environmental sample
  misc_feature (1)..(152): Xaa is any amino acid
MDESGFEHETIRSHGYAPIGEPCIDSYNWQGKKRTNVIGALYEKMLFAIDYFTHNINSSIFYDWCKFTLIPSLKTKCVIVMDNARFHKSKRIQKLLNRHGHRILWLPPYSPDLNPIEKKWAQVKFLRQGWMENDLSKLFYDVCPNHNNFILN

SEQ ID NO: 23357 - DNA, 744 bp, Unknown
  Obtained from environmental sample
  misc_feature (1)..(744): n is a, c, g, or t
ttgtttatgtcagctaaagtaataattgtaggtggtggttttgcagggttgtctgtagcaaaacagttgtgctcaaaggaatttgatgtaacaattattgataagaccaatcatcatgtatttcaaccattgctttatcaagtagctacagctgctttgtcacccggtgatatcgcaattcctattagagccatcttctcgaaaaagaaaaacattaaagttttattaggggaagtaacctcagttgatacagagaataatttaatagaagttaaaggtcaagattcccatcatttcgactacttaattttagcacctggaacaaactataattactttgggaatgagcaatggaaaaaatatgcaccgggcttaaaaaccatttccaatgcattaaatattagagagaagattctcatttctttagaaaaagcggagcaaatttctaatccagagctccgaaaaaaacatcttacttacgtaattattggcggaggacctacaggtgttgaaatggctggctctattgcagaaatcgcaaagcgtaatatgatgcgggactatcgcacttttaatagtaatgataccaccatttatttagtagaagcggccgatggaatcttaaatggttatcctgaagtgctttctaagaaggcgcaagaaaacgttagaaaaatatgggtgtggaaaatcttaataaaatcacccgttggaaaaaatttcctcctggaaagtaattattga

SEQ ID NO: 23358 - protein, 247 aa, Unknown
  Obtained from environmental sample
  DOMAIN (6)...(247): Pyridine nucleotide-disulphide oxidoreductase
  misc_feature (1)..(247): Xaa is any amino acid
MFMSAKVIIVGGGFAGLSVAKQLCSKEFDVTIIDKTNHHVFQPLLYQVATAALSPGDIAIPIRAIFSKKKNIKVLLGEVTSVDTENNLIEVKGQDSHHFDYLILAPGTNYNYFGNEQWKKYAPGLKTISNALNIREKILISLEKAEQISNPELRKKHLTYVIIGGGPTGVEMAGSIAEIAKRNMMRDYRTFNSNDTTIYLVEAADGILNGYPEVLSKKAQENVRKIWVWKILIKSPVGKNFLLESNY

SEQ ID NO: 23359 - DNA, 747 bp, Unknown
  Obtained from environmental sample
  misc_feature (1)..(747): n is a, c, g, or t
gtggaaaaggcatcagcggttgatgtacttcgccttcagataagacagaacgagttgattcaacagaaagaagtgctggaacaagattatttggcggagcaagcgctctttaataatcttntgaatcgtgatgaaaatattgccgtagaggtcgtaaagcagatgataattcccgaagaagatgtgtttattttgactgacaatctacagcttaacccagaacttattaaatacgataaattatatgaatctatcgaagaagccgaattattaaaccaaaaagagagtgcgcccaatatcggttttggtttggactatgtgcctgtatcagaacgtccagatatgaatttttccgataatggtaaagacattgtgatgcctatggtttctatttcaatccccattttcaataataaatataagtcagtgacaaagcaaaatgaattgaaacaattggaaataaaatcacagaaagaagagaggctcaataaccttgaaacacgtcttgcacaagctatttataatagaaatacaatgagaataaagtttaatgtacagacagataatttaaagcaggctaatgatgccgaaggaattctaattaaaaattatgagaccggtaccatagattttaatgatgtgctcgatgtacaagaattgcaattaaggtttcaaatcaatttaatcgaatctacaaaaggctattatttaaagtctgccttgataaactatttaataaataaataa

SEQ ID NO: 23360 - protein, 248 aa, Unknown
  Obtained from environmental sample
  misc_feature (1)..(248): Xaa is any amino acid
MEKASAVDVLRLQIRQNELIQQKEVLEQDYLAEQALFNNLXNRDENIAVEVVKQMIIPEEDVFILTDNLQLNPELIKYDKLYESIEEAELLNQKESAPNIGFGLDYVPVSERPDMNFSDNGKDIVMPMVSISIPIFNNKYKSVTKQNELKQLEIKSQKEERLNNLETRLAQAIYNRNTMRIKFNVQTDNLKQANDAEGILIKNYETGTIDFNDVLDVQELQLRFQINLIESTKGYYLKSALINYLINK

SEQ ID NO: 23361 - DNA, 876 bp, Unknown
  Obtained from environmental sample
  misc_feature (1)..(876): n is a, c, g, or t
ttggtcgacaatgaaagccctgacaattgccctctgatttgcgaggaatatgccaaaaaagacgaccggattaaagtaatccacaaagaacacggaggacttttgagtggcagaaaagaagggcttaggaacgccaaggggaagtatgtcgcttatattgacggtgatgattgggtagataagttttatctcgacattttatttatacttgccgaagttaacaattctgaccttgttgtgacgggacattttagggagttcgatggaaaaattgaaacagtaaggcctgtatatacaggtgtttttgaggaaaatgaaattaaatcttcgatactaccaaaagtcatgtataatggtactttttgtgaacctgaaataactacctatgtgtggagtaaactgttcaaaagggagttgctcaatgaaataatatttgaagttcccgaagaaattgttatgggagaagacgctgccatcacttatacctatttatctatttcaaaaaaacttacaataagcagaataccgctttattactacaggcaaagagatggttccatcctaaaatcagttaaaaccccaaaagtagagtattacagattggggctgttaaaagattttctggaaataaaattaagtccttttcttaataaaaagaacttaaacacacaaatactatattatctttactccttaattttggtaagatcaggaggattaatcaatgatgcctccggaaatatcattttcaatccttttttaaaaacagaaaagaactctaaagttattgtatacagttcaggttcttttgggcggcatcttatatcatccaatagcaaaagcatttttttcaattgtcaaatggatagattttga

SEQ ID NO: 23362 - protein, 291 aa, Unknown
  Obtained from environmental sample
  misc_feature (1)..(291): Xaa is any amino acid
MVDNESPDNCPLICEEYAKKDDRIKVIHKEHGGLLSGRKEGLRNAKGKYVAYIDGDDWVDKFYLDILFILAEVNNSDLVVTGHFREFDGKIETVRPVYTGVFEENEIKSSILPKVMYNGTFCEPEITTYVWSKLFKRELLNEIIFEVPEEIVMGEDAAITYTYLSISKKLTISRIPLYYYRQRDGSILKSVKTPKVEYYRLGLLKDFLEIKLSPFLNKKNLNTQILYYLYSLILVRSGGLINDASGNIIFNPFLKTEKNSKVIVYSSGSFGRHLISSNSKSIFFNCQMDRF

SEQ ID NO: 23363 - DNA, 447 bp, Unknown
  Obtained from environmental sample
  misc_feature (1)..(447): n is a, c, g, or t
atgatgaaaaaaattgagattagaaccgtaaatgttacgcaatatttacaacctttaagagaaggtggttctttaccagcaatcgtaaaagctgatgatggctttttatatgtgctaaaatttagaggtgcaggtcaaggtaaaaaagctttaatttccgaatttattggtggtgaattggctagagcaatgggtttaaaagttcctgaattggtttttatgaacttagatgattccttcagcaaaacagaacctgatgaagaaattcaagatttgctaaaatttagtgtaggtttaaatctcggtttgcattatttatcgagcgcaattacttatgatcctttggtttctaaagtggatgcttttacagcttctaaagtgggtattttagataatttgattagccaatatagaccgaacctgccaaaaaacacaaattctttttaa

SEQ ID NO: 23364 - protein, 148 aa, Unknown
  Obtained from environmental sample
  misc_feature (1)..(148): Xaa is any amino acid
MMKKIEIRTVNVTQYLQPLREGGSLPAIVKADDGFLYVLKFRGAGQGKKALISEFIGGELARAMGLKVPELVFMNLDDSFSKTEPDEEIQDLLKFSVGLNLGLHYLSSAITYDPLVSKVDAFTASKVGILDNLISQYRPNLPKNTNSF

SEQ ID NO: 23365 - DNA, 909 bp, Unknown
  Obtained from environmental sample
  misc_feature (1)..(909): n is a, c, g, or t
ttgatggctgaggggcgttgctattataaaatgcaattgtctaaaagtatatcctataaattatctgtttttaaaacagataaaaatcaaaataaatctaaaaacgagcaaagcggacaattagatttaaatgcagatcaacaaaaagatttgtcaacaacatccattaattttgatcaagatacaaaagtgataattctacttttaatttttgattccacagataatattattggtatggatagaatcgtttataacgataatgaagacaataatcttaatgttaaaaaaaatattgcagaaaaaattgataatattagtgtcaaaatttctgcgcaattagtaaataatgaagttgaggctaaaatagaaacagctcaacaaaatgactttacaaccataaaagctacagctttcaataaaaccgaaattacaaaaagtttaatctttaaattaatggtttttgataaagaagaaagtgtagataaccttctagaagacaaaaagcaacgctttataatatctgccaaccaaaaaatagaacttgctgaggcttcatttaatattattggagatcagccagttatttgcgtcatgcttatttatgacttagataataatttgataggtcaagaccgagtggtttataatgataagtcaaatttagatatagaaaataaacaaaaattattagataaattaaaagaggaacaggcaaactctcaagacgtcaataaaggtaaaagagatggtttagagttaaaaggaatcgtagttgaagacacaaaaacaaaaccaggtagggacttttacaagttattttattctttatacactcaaaataatattaacgggaataaagtagtgacaatcaagggagtattagcattaggtagaaacacgaaatag

SEQ ID NO: 23366 - protein, 302 aa, Unknown
  Obtained from environmental sample
  misc_feature (1)..(302): Xaa is any amino acid
MMAEGRCYYKMQLSKSISYKLSVFKTDKNQNKSKNEQSGQLDLNADQQKDLSTTSINFDQDTKVIILLLIFDSTDNIIGMDRIVYNDNEDNNLNVKKNIAEKIDNISVKISAQLVNNEVEAKIETAQQNDFTTIKATAFNKTEITKSLIFKLMVFDKEESVDNLLEDKKQRFIISANQKIELAEASFNIIGDQPVICVMLIYDLDNNLIGQDRVVYNDKSNLDIENKQKLLDKLKEEQANSQDVNKGKRDGLELKGIVVEDTKTKPGRDFYKLFYSLYTQNNINGNKVVTIKGVLALGRNTK

SEQ ID NO: 23367 - DNA, 882 bp, Unknown
  Obtained from environmental sample
  misc_feature (1)..(882): n is a, c, g, or t
atggtcagaattcggctgaggccaaaaagatatatttatgcagcactttttatactagtgatattcttgattgtcacgctgattattagaagaaatgaaaaaatccaaaaaagattgaatattgaactttacaacaaaaccactaaattggttgaaaatgaaaaggaattacgagacatcaatgaaaccaaggacaagttgttctctattataggtcatgatcttagaggtcctatcgctgctttccaaggacttttaaaactctataaagatcgtgaaatagatggtaaggagttcttagggtttatacccaaactaagctcggatattgaacatatatcattcactcttaataacttattatcgtggggtcgtacacaaatgaatggatctgtaaccaaaccaggaatagtttcactagagaatctagttaatgaaaacattaatttactagctgaaaccgctgatgccaaatctctcaaaatcatcaataaaatgaccgcaaatatcctttcgtggtccgatagtgaccagattgacattgttatacgcaatctaatgagtaatgccataaaattcacccctgaagaaggaatgattaccatagatgctttggaaagaagtaatacttgggaaatttcagtacgagatacaggtgtaggtattgatagtgaaacccaaaagaagatcttcgataaaaattcgaatataactacttatggtacaaacgacgaanaaggtactggtttgggactatcactttgtaaggaaatggttgaaaagaatagcgggaaaatatgggttgagagttttagaccaaatggtacctgtttctattttacgctgcctaagcttcgtgacaaatttcagagagccgggtaa

SEQ ID NO: 23368 - protein, 293 aa, Unknown
  Obtained from environmental sample
  DOMAIN (63)...(129): His Kinase A (phosphoacceptor) domain
  misc_feature (1)..(293): Xaa is any amino acid
MVRIRLRPKRYIYAALFILVIFLIVTLIIRRNEKIQKRLNIELYNKTTKLVENEKELRDINETKDKLFSIIGHDLRGPIAAFQGLLKLYKDREIDGKEFLGFIPKLSSDIEHISFTLNNLLSWGRTQMNGSVTKPGIVSLENLVNENINLLAETADAKSLKIINKMTANILSWSDSDQIDIVIRNLMSNAIKFTPEEGMITIDALERSNTWEISVRDTGVGIDSETQKKIFDKNSNITTYGTNDEXGTGLGLSLCKEMVEKNSGKIWVESFRPNGTCFYFTLPKLRDKFQRAG

SEQ ID NO: 23369 - DNA, 333 bp, Unknown
  Obtained from environmental sample
  misc_feature (1)..(333): n is a, c, g, or t
ttgatgagctnagacatttataaacacnngatagggaagaaacgcttgataaaacagcccaaaaatcccgataaaacctttttggataccctagaaagaaggctgaaaaaaaaatatgccgatcccaacgaacctttgagcattcacgatttgtttcgtaaaagaaaaaaggaagctttccgggccatacttaaattagattggaaagtacgaacgctgaaactgcaagaagtacacttgatttcaaaattgattcccgaaattgaagccagcaaagaaactgtaaaggcaaaagcccctcattatttgaatctcgatagcaatggtaactaa

SEQ ID NO: 23370 - protein, 110 aa, Unknown
  Obtained from environmental sample
  misc_feature (1)..(110): Xaa is any amino acid
MMSXDIYKHXIGKKRLIKQPKNPDKTFLDTLERRLKKKYADPNEPLSIHDLFRKRKKEAFRAILKLDWKVRTLKLQEVHLISKLIPEIEASKETVKAKAPHYLNLDSNGN

SEQ ID NO: 23371 - DNA, 555 bp, Unknown
  Obtained from environmental sample
  misc_feature (1)..(555): n is a, c, g, or t
atggtaactaagaagaaggttaaaaaaaatcttaaatactgggttatccgtgcgttacttctttttaaaagttttaacatgaagcatgccattgttatttgtagcgaagcaaggggtggtagtacttggctcatggagttgctttccaacattccaaactccatcattaattgggaacccgtgcatgtaaccaatggtgttgtggattcacaattaaaattggggtggcggcctttaatactaaaggataactacgataaaaatttaaaaaatctttttgagaaaatctttactctcaaggcttgcaataaatggactttacgttatgtagatattgcccacattaaagatgcaaaatacgtcatcacaaaatttgtgaggatgaatcaatcattgccttggcttgtacatcaattcccaactttacaacgcaagccaatttttttgttgcgtcatcctattacaacttgtatcagcaggcttaaaacttttgaaaggggaaacgatatacaaaccataaaacgaaaaaaaactagggagttttgttgtgcctaa

SEQ ID NO: 23372 - protein, 184 aa, Unknown
  Obtained from environmental sample
  misc_feature (1)..(184): Xaa is any amino acid
MVTKKKVKKNLKYWVIRALLLFKSFNMKHAIVICSEARGGSTWLMELLSNIPNSIINWEPVHVTNGVVDSQLKLGWRPLILKDNYDKNLKNLFEKIFTLKACNKWTLRYVDIAHIKDAKYVITKFVRMNQSLPWLVHQFPTLQRKPIFLLRHPITTCISRLKTFERGNDIQTIKRKKTREFCCA

SEQ ID NO: 23373 - DNA, 855 bp, Unknown
  Obtained from environmental sample
  misc_feature (1)..(855): n is a, c, g, or t
atgatgttctttcagaacaaaactgatattgttcatattcagcattcatacttatttcctaaaattttggagctgctacatttggaagccagcaaaaggcccaaaattataattacgctccgtggcggtgatacgtatgtaaaaccttggatagataaaaaatggagtaacttttataaaaattttggtaataaagttgatgcttttgtggtgatgagtgaccaccaaaaccaatatttgcaaaccaaatggaatattgataaaagtagaattcataccataccaatttcttttggcgaaaactttaaggcaaattttaaaagaccaaaacaaaaggaaataactattatttctgtttttaggatgtgttgggaaaaaaatatttctggaaacttattagttataaaagaactgttgcgtcgtggtttgcctgtacattacaatatgtatggtgacggtcccgattcgggccaagttccatatttaattgatgcatatgatttatctgaagcagtaacttattatggaaagatagaaaattcagaattaaaaaaatgcatagtacattcagattttatgttgcaattaagccactcagaagcattcccgacttctgttctcgaggcacaatcgttaggattgcctgcaattgtttccaatgctggtggtcttccagaagctgtaattaataataaaagtggttattgcacagaagcttatgattataaaagtgctgcggattacattgagattttatggaaaaatcccgagcagtatgaagccttttcaaaagcagcaattgagaantgcccaatcaaatctcagccgaattctgaccttgcgctgtccnggtag

SEQ ID NO: 23374 - protein, 284 aa, Unknown
  Obtained from environmental sample
  DOMAIN (100)...(269): Glycosyl transferases group 1
  misc_feature (1)..(284): Xaa is any amino acid
MMFFQNKTDIVHIQHSYLFPKILELLHLEASKRPKIIITLRGGDTYVKPWIDKKWSNFYKNFGNKVDAFVVMSDHQNQYLQTKWNIDKSRIHTIPISFGENFKANFKRPKQKEITIISVFRMCWEKNISGNLLVIKELLRRGLPVHYNMYGDGPDSGQVPYLIDAYDLSEAVTYYGKIENSELKKCIVHSDFMLQLSHSEAFPTSVLEAQSLGLPAIVSNAGGLPEAVINNKSGYCTEAYDYKSAADYIEILWKNPEQYEAFSKAAIEXCPIKSQPNSDLALSX

SEQ ID NO: 23375 - DNA, 723 bp, Unknown
  Obtained from environmental sample
  misc_feature (1)..(723): n is a, c, g, or t
atggggtctacttcgttggcctataaaaacagagaattgattgggcacagtaaagagtatcatgctaaaggatatggttcacctatagggttgttaaaaggaattaatattgcgattgaagatatgtcacccactgatttggaagcctatggaatttatgaaggtaaaaccgtggatttagcttttgaaggaggaatacacgttaaaggtgaaattattacaggaaagcgaaatttaaaaggtaagataattttaatatcatttaaaaattgcacggttaaacattatgataaagttgtatttgatcctgattggggaatctatgatatggctgttggtaaagaattaatatcggcatattcaggggttgcagatcctgaaaattatgagcttgctattgaaacttctaaggaaaaaacacataaaataatatattcagatagcgatcgcaacttgcataaattatatcaggaagtccgaaatattagagaaaataatgatttgaataacgaaacaatatcaactatttttaatgctgtttctcatgaataccctaatgattggctattgtctttagaaatttatgaattgatttataatcaaaattcaccattaaaagagcgtgtacttaagcacttagaaaatttggcctcaaaaaaagaggttaccaatcttattagagacggattgaaattattggaacttgaatttaaaaaaatataa

SEQ ID NO: 23376 - protein, 240 aa, Unknown
  Obtained from environmental sample
  misc_feature (1)..(240): Xaa is any amino acid
MGSTSLAYKNRELIGHSKEYHAKGYGSPIGLLKGINIAIEDMSPTDLEAYGIYEGKTVDLAFEGGIHVKGEIITGKRNLKGKIILISFKNCTVKHYDKVVFDPDWGIYDMAVGKELISAYSGVADPENYELAIETSKEKTHKIIYSDSDRNLHKLYQEVRNIRENNDLNNETISTIFNAVSHEYPNDWLLSLEIYELIYNQNSPLKERVLKHLENLASKKEVTNLIRDGLKLLELEFKKI

SEQ ID NO: 23377 - DNA, 342 bp, Unknown
  Obtained from environmental sample
  misc_feature (1)..(342): n is a, c, g, or t
ttgggggcccttggattgggtaaattgaactttgagaacccctccatttatgggcgggatttttttcctcaattgggaaatcaatggggcctggggatgaagaaaaaattcccttttttttgttgggccgaaacgatttggattccaaaaccccggctcaatgtttgtgatcctgatttgccttttaagcttaatttagaagaatttgcaaacaaaatggcatacgtaaagagttttaaaggtatatcaaagttattgcatctaaaaattagggactatgaaataagtaccggtattcaaatttccggccggtttatcactgttttgatgatgataatttaa

SEQ ID NO: 23378 - protein, 113 aa, Unknown
  Obtained from environmental sample
  misc_feature (1)..(113): Xaa is any amino acid
MGALGLGKLNFENPSIYGRDFFPQLGNQWGLGMKKKFPFFCWAETIWIPKPRLNVCDPDLPFKLNLEEFANKMAYVKSFKGISKLLHLKIRDYEISTGIQISGRFITVLMMII

SEQ ID NO: 23379 - DNA, 846 bp, Unknown
  Obtained from environmental sample
  misc_feature (1)..(846): n is a, c, g, or t
atggcacttattaaagatcttaaaaatgtcgctgaaggttcgtttaacgaaacacaggttgatcaggatgtttttgttttaacttatcaaaatgaaacgtctaataatcagattgttgagcgatttattgatagtggttttattcaatttcatttttgtttaaagggtaatagtgactttatatttaacaatggtaactacgttttaaatattgctgaagaaacctcattgctgctttataatccgcaaaaggacttgccaattaatctacatgtaaagcctgattgttggttggtttctgttttaatatctataaaaaagtttcatggtttgttttctcaagaagccgattatatcacgtttttaagtagtgataataaggataaaaaatattacaaggatggaaagatttcgccatctatggctattgcattaaatcaaattattaattataacttaaactcatctattaaaaccttgtattttaaaggaaaagcatatgagttacttagcttgtattttaatagaggagaggatgctaatattgatcagtgtccctttttagtagatgaatctaatgttgctaaaattaagcaagccaaagatattgtaattgctagaatggcagagccaccaactttacaagaattgtctgaagaaataaatttatcgcttaaaaaattaaaagaaggttttaagcagatttatggagactctgtttttagttttttgtttgattataaaatggaggttgcaagaaagcttttagagacaggttcgcacaatgttaacgaggttggtttgcgtgttggaatagtacggctagccatttatcgctgcttttaa

SEQ ID NO: 23380 - protein, 281 aa, Unknown
  Obtained from environmental sample
  misc_feature (1)..(281): Xaa is any amino acid
MALIKDLKNVAEGSFNETQVDQDVFVLTYQNETSNNQIVERFIDSGFIQFHFCLKGNSDFIFNNGNYVLNIAEETSLLLYNPQKDLPINLHVKPDCWLVSVLISIKKFHGLFSQEADYITFLSSDNKDKKYYKDGKISPSMAIALNQIINYNLNSSIKTLYFKGKAYELLSLYFNRGEDANIDQCPFLVDESNVAKIKQAKDIVIARMAEPPTLQELSEEINLSLKKLKEGFKQIYGDSVFSFLFDYKMEVARKLLETGSHNVNEVGLRVGIVRLAIYRCF

SEQ ID NO: 23381 - DNA, 588 bp, Unknown
  Obtained from environmental sample
  misc_feature (1)..(588): n is a, c, g, or t
atgaagttatcacaccttgatggtgtattagtagctccaggttttggagagcgtggtatagaaggaaaaataacagcaattaaatatgtacgcgaaaacaacattccgtttttaggaatttgtttaggtatgcaaatggcagttattgagttttgtcgtaacgtcatgggattagcagatgctaactctacagaaatggattctaatactacaaatccagttattgatattatggaagaccaaaaaaccatcacagataaaggaggaacaatgcgtcttggtgcttgggattgccatatcgaaaaagagtctatagcttataaagtctaccaatctcaagatattaaagagcgtcacagacatagatatgagtttaatagtaattttaaaactcaaattgaagctgcaggattaaaagcaactggttataatcctgatacaaaattggtcgaaattgttgaaaatccatctcatccttggtttgttggtgtgcaataccacccagaatataaaagtacagtagccaatccacatcctttatttgtggaatttgtaaaagcaagtttaaagcacagtaagaaaaaataa

SEQ ID NO: 23382 - protein, 195 aa, Unknown
  Obtained from environmental sample
  DOMAIN (1)...(187): Glutamine amidotransferase class-I
  misc_feature (1)..(195): Xaa is any amino acid
MKLSHLDGVLVAPGFGERGIEGKITAIKYVRENNIPFLGICLGMQMAVIEFCRNVMGLADANSTEMDSNTTNPVIDIMEDQKTITDKGGTMRLGAWDCHIEKESIAYKVYQSQDIKERHRHRYEFNSNFKTQIEAAGLKATGYNPDTKLVEIVENPSHPWFVGVQYHPEYKSTVANPHPLFVEFVKASLKHSKKK

SEQ ID NO: 23383 - DNA, 846 bp, Unknown
  Obtained from environmental sample
  misc_feature (1)..(846): n is a, c, g, or t
atggtcagatcggctcgagctcgagattcggctcgaggatattttatgacaggaatttcagctgctgtagatgcctgtttaaagattgatgggcttattagcattaatccttatagttcaccgattgatgccgagctcacaccgttggtgctttggcaatatatccgctcgaataaaaaacagatcacattgttcggggatgattcttggtattcgcaaggcaacaatttatccgtaacctttaacggtgttgggccgaagtataaatatcaacttaaagccctaacacttggtatgtatacgcaaggctcaggacaaggcatggagcctcttgcatggactacgatacgtaggaatattgctaaccttaagcgccttgctaagtggcttgaacgttatggcattgagagcttcggtggcttagataaactgccagaattgcgtttgcgcaatatcatattggacttggtgcaagcgtctgatgtaaagaagcatccatcttatgcacagtcacttctatctgccatctattggttgaagctttattcagtagttaaaagcgagccgtttttcgatttgatgaatgaatattttttgccatttaccttattaaaaaaagaacgcagaaataaacattcagtcattccgattcaaataatgaagcaagttcttaaggcaagcgaagagcacgttaatgccgttgagaagatcatcgataattggcactgcctgcaaatcaaactcaatgatggtgttgaatacgcaccgaaaaagtaccttaaaaactcgacatacgttgatggattaaatgagtcagaatctgctgaatttagacgaatattatga

SEQ ID NO: 23384 - protein, 281 aa, Unknown
  Obtained from environmental sample
  misc_feature (1)..(281): Xaa is any amino acid
MVRSARARDSARGYFMTGISAAVDACLKIDGLISINPYSSPIDAELTPLVLWQYIRSNKKQITLFGDDSWYSQGNNLSVTFNGVGPKYKYQLKALTLGMYTQGSGQGMEPLAWTTIRRNIANLKRLAKWLERYGIESFGGLDKLPELRLRNIILDLVQASDVKKHPSYAQSLLSAIYWLKLYSVVKSEPFFDLMNEYFLPFTLLKKERRNKHSVIPIQIMKQVLKASEEHVNAVEKIIDNWHCLQIKLNDGVEYAPKKYLKNSTYVDGLNESESAEFRRIL

SEQ ID NO: 23385 - DNA, 759 bp, Unknown
  Obtained from environmental sample
  misc_feature (1)..(759): n is a, c, g, or t
atgcaagaagattttttacactatctctggaaacttaaaaaatttgaaaccttaaatctccagaccacaaaaggagagcaagttattatccagaatgtaggcacacataattatcatactggtccagatttttttaatgcgcaacttataattgctggtcaattatgggctggcaatgtcgagatccatattaaatctagcgattggtacgtgcataatcatgaagttgatccaaattacgataatgtaattttacatgttgtttgggagcatgacacacctgtttttagaaaagacaactcagaaatcccaaccatccagcttaaaaattatgtatcacaagtggctttaaataattatgctaagttatttaataataaacaaacttggattaattgcgaaaacacgattgctaatgttactccttttgttgtctcaaattggttagagcgtttgttttttgagcgtttagagagtaaagcaaaagctattgaagcgatattaaaaacttctaataataactgggaagctgttttgtttaaattacttgctaaaaattttggtcttaaagttaatggcgacgctttttttagtttggctaatagttttgatttttcggtcgttagaaaacagcanagtaatttacaaagtttagaggctttgttttttggtcaagcagggtttattggatcaggatattcaggacgcgtattatattgcactacaaaaaagatatgcgtttttaaaacaaaaatttaa

SEQ ID NO: 23386 - protein, 252 aa, Unknown
  Obtained from environmental sample
  misc_feature (1)..(252): Xaa is any amino acid
MQEDFLHYLWKLKKFETLNLQTTKGEQVIIQNVGTHNYHTGPDFFNAQLIIAGQLWAGNVEIHIKSSDWYVHNHEVDPNYDNVILHVVWEHDTPVFRKDNSEIPTIQLKNYVSQVALNNYAKLFNNKQTWINCENTIANVTPFVVSNWLERLFFERLESKAKAIEAILKTSNNNWEAVLFKLLAKNFGLKVNGDAFFSLANSFDFSVVRKQXSNLQSLEALFFGQAGFIGSGYSGRVLYCTTKKICVFKTKI

SEQ ID NO: 23387 - DNA, 504 bp, Unknown
  Obtained from environmental sample
  misc_feature (1)..(504): n is a, c, g, or t
ttgagccttaaaatgatacaaaaactcacagcacatatcaacacaaatgttccttttttaaaggataaaaaattactaattgctatttctggtggcttagattctgttgttttgtatcaccttttagcaactttaaattttgatatttctttagctcattgcaattttaatttgcgtgaaaaagaaagtgatttagatgaagaatttgtaaagaaaatatcacaaaaaacgtctaatcagatttttataaaatcatttgatacagaaaaatactccatagacaataaactttctacacaaattgcagccagagaattgcgttatacttggtttcaagaattgatcggaaaacacaatttcgattatattttaacagctcatcatgcagatgataatttagaaacttttttgatcaattttaccagaggaactggtttgggaagttttactggtattcctaaaaatcacgaaaaatatggaccttccttggtgcccttttcctga

SEQ ID NO: 23388 - protein, 167 aa, Unknown
  Obtained from environmental sample
  DOMAIN (24)...(167): PP-loop family
  misc_feature (1)..(167): Xaa is any amino acid
MSLKMIQKLTAHINTNVPFLKDKKLLIAISGGLDSVVLYHLLATLNFDISLAHCNFNLREKESDLDEEFVKKISQKTSNQIFIKSFDTEKYSIDNKLSTQIAARELRYTWFQELIGKHNFDYILTAHHADDNLETFLINFTRGTGLGSFTGIPKNHEKYGPSLVPFS

SEQ ID NO: 23389 - DNA, 312 bp, Unknown
  Obtained from environmental sample
  misc_feature (1)..(312): n is a, c, g, or t
atggaggttttccaaaaaatatttgaaattggtgacagagaatggagaggaattggtaaaatacctaatagtggttatgtgttaacaaaagagtttaaagattttgatgcagaattaaaatttggaatcagtaatataacagtacctgaaaatcctgattgtattgctggagagattttaagaggaattaaaaaacctcatgaatgcaatcaattcgcaaaaacatgcaatccttctaaccctttaggcgcacccatggtgtcgtcagaaggcgcatgtgcggcttactatcatttttcaaatactatatag

SEQ ID NO: 23390 - protein, 103 aa, Unknown
  Obtained from environmental sample
  DOMAIN (1)...(102): Hydrogenase formation hypA family
  misc_feature (1)..(103): Xaa is any amino acid
MEVFQKIFEIGDREWRGIGKIPNSGYVLTKEFKDFDAELKFGISNITVPENPDCIAGEILRGIKKPHECNQFAKTCNPSNPLGAPMVSSEGACAAYYHFSNTI

SEQ ID NO: 23391 - DNA, 312 bp, Unknown
  Obtained from environmental sample
  misc_feature (1)..(312): n is a, c, g, or t
gtgaactccactttagatgaatttactaaattacatagaatcaagatatggtcgcaaaaaccttggcagaaaaatcatcaattgattaaaggttttttagaacttgaatcaagtaatggttttgttgatttggaccaattaatcgaatactgctcaaatcactttgatggcgcaaaaggcgaatggaaaaataatttcaactccatgaaaactgatcttggaaacgctcatggcaagatcttttttactgttggaaataggttaaaaatttatagtgaagcaaggagagaaatagataaatttaattggtaa

SEQ ID NO: 23392 - protein, 103 aa, Unknown
  Obtained from environmental sample
  misc_feature (1)..(103): Xaa is any amino acid
MNSTLDEFTKLHRIKIWSQKPWQKNHQLIKGFLELESSNGFVDLDQLIEYCSNHFDGAKGEWKNNFNSMKTDLGNAHGKIFFTVGNRLKIYSEARREIDKFNW

SEQ ID NO: 23393 - DNA, 747 bp, Unknown
  Obtained from environmental sample
  misc_feature (1)..(747): n is a, c, g, or t
ttggcggcaacggccatagtagttactgtactattactttttgtattcatcaccatgaaccaacggaacagaaacaagcagttgaaactggaagccgagcaacagcgagcggatgaggcgatatattcgatgcgtatagaccaactgaaacagagcgaaaaggcgcgacaggaagagcgcgaacggattgccgaggagctgcatgacagtgttttaggacagttatatggcatacgtgtaaattgggagtttcaggatttggaagatgagaatggggttaccataacgaaacaagagcagctaaataatttacttaaggtagaaaaagagattaggaacctgtcccacaatttagtagccaatattcctgataatcccacccatattttggaaaacttcaggactcttttaaaggaaaaaagtgagttggggcagtttaaatatcattttaaatgcagtgaagggattgattgggaggaaattgatgaatactgcaagctaaatttgtatcgaataattgaggaggcgctgcacaatattgtgaaacactccggggcttccaaggtacaagttactataattgaagaagatgggagcataaccgcaaccattattgacaatggtaaaggattcgggaaaaagggcaataaaaaaggaataggattgagaaacatgcgctcaagggcaaaaaagattggtgctgttttaacgatcccaaaaaagggaaaagagagttgccctttttaa

SEQ ID NO: 23394 - protein, 248 aa, Unknown
  Obtained from environmental sample
  DOMAIN (164)...(241): Histidine kinase-, DNA gyrase B-, and HSP90-like ATPase
  misc_feature (1)..(248): Xaa is any amino acid
MAATAIVVTVLLLFVFITMNQRNRNKQLKLEAEQQRADEAIYSMRIDQLKQSEKARQEERERIAEELHDSVLGQLYGIRVNWEFQDLEDENGVTITKQEQLNNLLKVEKEIRNLSHNLVANIPDNPTHILENFRTLLKEKSELGQFKYHFKCSEGIDWEEIDEYCKLNLYRIIEEALHNIVKHSGASKVQVTIIEEDGSITATIIDNGKGFGKKGNKKGIGLRNMRSRAKKIGAVLTIPKKGKESCPF

SEQ ID NO: 23395 - DNA, 411 bp, Unknown
  Obtained from environmental sample
  misc_feature (1)..(411): n is a, c, g, or t
atgaaaaacgtcctattttttatctttttgagcattttaatttcttgcaaaccagaaattaaccaagaaaaccgaatcaaagaagatgtaacttttttagcttcggatgcattagaaggaagacaaactggtactgaaggcgaaaaaaaagcaggcaaatatatttcaaatcgcttcaaagaattaagcttacaaccaaaaggaactcaaaattatttacaacctttttcatttagaccaaaaacgaatcctcatgatgaagttaaatttgatgtaaatggagatggaaccattacaggaaataatgttgttggctttttagataataaagcagaaaacaccataattattggtgcacattatgatcatttaggttttggtggtgaaggttcttttacagagattctataa

SEQ ID NO: 23396 - protein, 136 aa, Unknown
  Obtained from environmental sample
  misc_feature (1)..(136): Xaa is any amino acid
MKNVLFFIFLSILISCKPEINQENRIKEDVTFLASDALEGRQTGTEGEKKAGKYISNRFKELSLQPKGTQNYLQPFSFRPKTNPHDEVKFDVNGDGTITGNNVVGFLDNKAENTIIIGAHYDHLGFGGEGSFTEIL

SEQ ID NO: 23397 - DNA, 579 bp, Unknown
  Obtained from environmental sample
  misc_feature (1)..(579): n is a, c, g, or t
atgagcagaaattggggctatgttgaatacgataccatttataaatctagcgaattaatgactaggcaacttttagaaatagtgagtaaaggagggaaccttcttctaaataatggtccaacgccaaaaggtgaaataaccaaagctgctagtgatggattagccgagatgggctattggatgaacaaaaactcagaaggtatttatggcgcgtcaccgtggaaaatttcaaatgaattattaactgaaatcactcagaattctgaggatgaaaagtcggataaagagaataccatgaaagatgctgaaaatgatgtgacttcaaagctcatttttcctgaagttagttttaccactaaagatggttttgtgtacgcttatgttgccagtgcaactgaacctgatgtgatgattaaagcatttgcacttgataaactattaaaaatcaaagctgtaaaaatgttaggtacggagcaaaaagtaacctggactcaaacagctaacggtcttagtattaaactacctcagtattctgaaaatgaaatccctataaccggatatcaaattgaacttaattaa

SEQ ID NO: 23398 - protein, 192 aa, Unknown
  Obtained from environmental sample
  misc_feature (1)..(192): Xaa is any amino acid
MSRNWGYVEYDTIYKSSELMTRQLLEIVSKGGNLLLNNGPTPKGEITKAASDGLAEMGYWMNKNSEGIYGASPWKISNELLTEITQNSEDEKSDKENTMKDAENDVTSKLIFPEVSFTTKDGFVYAYVASATEPDVMIKAFALDKLLKIKAVKMLGTEQKVTWTQTANGLSIKLPQYSENEIPITGYQIELN

SEQ ID NO: 23399 - DNA, 729 bp, Unknown
  Obtained from environmental sample
  misc_feature (1)..(729): n is a, c, g, or t
atggcagggacaactaatggttcttgggggtatagaaaagatgacacggagtggcgtaaaccgctatttatgctaaatgcattgattgcatcagcaagcagaaatggaaactatttattgaatatcggaccaatggccaacggattgatgcctgcggaacctgttgaaaatttgaaaattgcaggtgcttggttaaaagaaaacggggcttcggtttacggtacaacaccatcgccatttccatggaattatgattggggttatgttactgaaaagccaaataaaattttcttaaatgtctttacatggcctaaaaacaatcagattgatttaaacggattgctaacaaaagtggataagattcatgtgttgggatcaactaaactagtgaaatttaagcaagacggacgttttttaaccattgatttgactggcgttgaaagaaaagaatttgcaacaccattagttgtggaatataaagatgccgaattaaaaatagatgagggtatctcccaaaacgcggagaataatatccgtttagacagaattaccagcacgtatcttaaagatatagccatgtcttcttggacctttaaagtgcatacccctgggacgtttaaaattaatattgtttccaacgaaaaaggaaatcaccataagccagtttggacaggatcggaacaaaaaggagtgttcaggttgcaggaaaaattattccggcacatttaa

SEQ ID NO: 23400 - protein, 242 aa, Unknown
  Obtained from environmental sample
  misc_feature (1)..(242): Xaa is any amino acid
MAGTTNGSWGYRKDDTEWRKPLFMLNALIASASRNGNYLLNIGPMANGLMPAEPVENLKIAGAWLKENGASVYGTTPSPFPWNYDWGYVTEKPNKIFLNVFTWPKNNQIDLNGLLTKVDKIHVLGSTKLVKFKQDGRFLTIDLTGVERKEFATPLVVEYKDAELKIDEGISQNAENNIRLDRITSTYLKDIAMSSWTFKVHTPGTFKINIVSNEKGNHHKPVWTGSEQKGVFRLQEKLFRHI

SEQ ID NO: 23401 - DNA, 486 bp, Unknown
  Obtained from environmental sample
  misc_feature (1)..(486): n is a, c, g, or t
ttgatttttattggttctaatactgatattttcggatatggacacgaaggagaaggaggaaataatactagtgcgttaattaaaagaattaataacataccaaaagcagattattatactttattaattggaactaatgactggaaaaatgacattgaaactgctttcttaaatatagtaaaagttacagatcatttgatgtatctaaatcccaatgcgaaaatattatacttaacaccaattccaactgttaacaaagaaagagatttctttaatacaagtttaaaagaaaagttattgttaaaattcaaagaaaatagaaatatgttggtcttagatttaggaaaggaaatgaggagaaataaaaattgggagtcagattatttaagtagtgatggacttcatcaaagttatgaaggagttcgatttatgagtgaattaatagcagaaaaaataaaaactactgccaacaatggctataagtaa

SEQ ID NO: 23402 - protein, 161 aa, Unknown
  Obtained from environmental sample
  misc_feature (1)..(161): Xaa is any amino acid
MIFIGSNTDIFGYGHEGEGGNNTSALIKRINNIPKADYYTLLIGTNDWKNDIETAFLNIVKVTDHLMYLNPNAKILYLTPIPTVNKERDFFNTSLKEKLLLKFKENRNMLVLDLGKEMRRNKNWESDYLSSDGLHQSYEGVRFMSELIAEKIKTTANNGYK

SEQ ID NO: 23403 - DNA, 561 bp, Unknown
  Obtained from environmental sample
  misc_feature (1)..(561): n is a, c, g, or t
ttgaaatttgataccatttacattccaaatcaattaatgaaaaatatattaaatggaaaaaatatcaaatttattaatagaaacataaaaagtaaagatgctaacaatttatttgtagaacttaaaaatgctattgacaaacaagaaactgaaaatatcgaattttatctacgacaatttattagcaagttaaaatcctactctcaagaaaacgaaaatgaatattctgaattaaacttaaataatttcaagcaaattaataactacattgaaactcatatttacaacaaatttagtctaaacgaactatcaaaaattgcgaacattaataaatttggatttgctaaaaaattcaaaacatcaacaggtatgtcaccaattaattacatattgatgaaaaaaatattttcaagcaaaaagttaattaatcagcaaacagaacttacaacaatagcgtatcaatacaattttacagacttggcacatttttccaaaacgttcaaacgttttgttggaatttcacctaaaaattaccaacaaagcattattcaaaaattataa

SEQ ID NO: 23404 - protein, 186 aa, Unknown
  Obtained from environmental sample
  DOMAIN (85)...(131): Bacterial regulatory helix-turn-helix proteins, AraC family
  misc_feature (1)..(186): Xaa is any amino acid
MKFDTIYIPNQLMKNILNGKNIKFINRNIKSKDANNLFVELKNAIDKQETENIEFYLRQFISKLKSYSQENENEYSELNLNNFKQINNYIETHIYNKFSLNELSKIANINKFGFAKKFKTSTGMSPINYILMKKIFSSKKLINQQTELTTIAYQYNFTDLAHFSKTFKRFVGISPKNYQQSIIQKL

SEQ ID NO: 23405 - DNA, 666 bp, Unknown
  Obtained from environmental sample
  misc_feature (1)..(666): n is a, c, g, or t
atggctacatttaaaatagaaggaggtcatcaacttaaaggagaaattactccgcaaggcgcaaaaaatgaatccttacaaatattaagcgctgttttattaactccagacaaagtaacaatatctaatattcccgatatacgagacgttaataaactcatcgatttattggaaaatttaggcgtaatgatccaaaaaaatggcccgggatcatacacttttcaagcagctaatattaatctcaattatctaaagtccccacagtttaaagaagagggcagaggcttacgaggatcaataatgatagttgggccattgttagcccgttttggtgaaggttatattccaaaacccggaggagataaaattgggagaagacgtctggatactcattttgaaggttttataaagcttggagcaaaatttatttataacgaagaagaccatttttatggagtggaggctgacaagctaaagggtacttatatgttactggatgaggcatcagtaacaggaactgccaatattattatggcagcagtattggctgaaggaaaactactatttataatgctgcttgtgaaccttatttacagcaattatgtaaaatgctcaatagaatgggagcggaaatacaggaatggggtcttacaagttgtatattga

SEQ ID NO: 23406 - protein, 221 aa, Unknown
  Obtained from environmental sample
  misc_feature (1)..(221): Xaa is any amino acid
MATFKIEGGHQLKGEITPQGAKNESLQILSAVLLTPDKVTISNIPDIRDVNKLIDLLENLGVMIQKNGPGSYTFQAANINLNYLKSPQFKEEGRGLRGSIMIVGPLLARFGEGYIPKPGGDKIGRRRLDTHFEGFIKLGAKFIYNEEDHFYGVEADKLKGTYMLLDEASVTGTANIIMAAVLAEGKLLFIMLLVNLIYSNYVKCSIEWERKYRNGVLQVVY

SEQ ID NO: 23407 - DNA, 555 bp, Unknown
  Obtained from environmental sample
  misc_feature (1)..(555): n is a, c, g, or t
atgcatagtttactttcaaatctaaaaattaatataaacgataaaatttaccttaaagatccagaatcttctgatttaggtaaacgtattgttgaaaacagtatccaactaattgatgagattggatttgatttatttacgtttaaaaaattaggtactaaaattggctctaacgagagtagcatttatcgttattttgaaagcaaacacaaactactaatctaccttacctcttggtattggagctggctagaatatcaattggtttttgctactaacagtattgcaaatccaaaacaaaaaattgaaaaagctattgaggtccttgcacaatcagcaactttagactctaatttctctcatatcgatgaggtacttttaaaacgtattgtaattaacgaatactctaaatcatacctaactaaagaggtcgataacgaaaataaggaaggttactttctagtatacaaaagactggttacacgactacatgatatggtactaaccattgataaggattattcgtatgcctttagtttatcaagtactgtatga

SEQ ID NO: 23408 - protein, 184 aa, Unknown
  Obtained from environmental sample
  DOMAIN (30)...(76): Bacterial regulatory proteins, tetR family
  misc_feature (1)..(184): Xaa is any amino acid
MHSLLSNLKININDKIYLKDPESSDLGKRIVENSIQLIDEIGFDLFTFKKLGTKIGSNESSIYRYFESKHKLLIYLTSWYWSWLEYQLVFATNSIANPKQKIEKAIEVLAQSATLDSNFSHIDEVLLKRIVINEYSKSYLTKEVDNENKEGYFLVYKRLVTRLHDMVLTIDKDYSYAFSLSSTV

SEQ ID NO: 23409 - DNA, 354 bp, Unknown
  Obtained from environmental sample
  misc_feature (1)..(354): n is a, c, g, or t
atgcaatcaaatttaaaagtattaaaaaagcatcgtatttattcaaaagaatttaaacttcaattggttaacgattttgagtctggaaaatttagtgttcctcaattagaaaaactttatggtatttctaatccaaccatttacagttggattcataaattttctacctttaacgaaaaaggaacaagaatagtagagatgaaagaaagtagttcanaaaaactaaaagaattagctcaaaaagttaaagaattagagcagattgttggaaaaaaacaaattaaaattgattatttggagaaaatgattgatatcgcanaagaggatttaaatatcgatattaaaaaaaactaa

SEQ ID NO: 23410 - protein, 117 aa, Unknown
  Obtained from environmental sample
  DOMAIN (11)...(99): Transposase
  misc_feature (1)..(117): Xaa is any amino acid
MQSNLKVLKKHRIYSKEFKLQLVNDFESGKFSVPQLEKLYGISNPTIYSWIHKFSTFNEKGTRIVEMKESSSXKLKELAQKVKELEQIVGKKQIKIDYLEKMIDIAXEDLNIDIKKN

SEQ ID NO: 23411 - DNA, 696 bp, Unknown
  Obtained from environmental sample
  misc_feature (1)..(696): n is a, c, g, or t
atgctaaaattagatcagcagtttcaagaaatagaaagtaatcgaattacacttatagaaacactttcaagtttaataggtcaacctttaaatgaatcaacactctttcaaaacacattattagaagcacaattaaaaactggaataaacagacctgaattagagttatttcaactcaaaaaagatgagattgagagttcaaaaaacttaatttctaagcaaaacacacctaaattattaggttttgcgacgggtggttatggcaatcctggattgaacatactcgataattcatttcaaactttttatactgtgggtgttaaattgaactggaaagtattcgactggaattctatcaaaaaacagcaagaatcactagcaatcaataaggatatcgtggataacgaanatgaaatatttgaattanacactaatattgatttagatcaacagcaaaaagaaattattaaaattgaaggatttatcctttcagatgaagcaattataaatcttagaagagatgtgcttaaaaccgcagaatcgcaacttaaaacggaatcattacttcgtccgattatattacagaattcacccatttatacgaagatgaaaactctatgggaaagcatgaaattcagttaccacttgcaaaagccaatttacatagtatcaaaggtccataacaccttccgatga

SEQ ID NO: 23412 - protein, 231 aa, Unknown
  Obtained from environmental sample
  misc_feature (1)..(231): Xaa is any amino acid
MLKLDQQFQEIESNRITLIETLSSLIGQPLNESTLFQNTLLEAQLKTGINRPELELFQLKKDEIESSKNLISKQNTPKLLGFATGGYGNPGLNILDNSFQTFYTVGVKLNWKVFDWNSIKKQQESLAINKDIVDNEXEIFELXTNIDLDQQQKEIIKIEGFILSDEAIINLRRDVLKTAESQLKTESLLRPIILQNSPIYTKMKTLWESMKFSYHLQKPIYIVSKVHNTFR

SEQ ID NO: 23413 - DNA, 735 bp, Unknown
  Obtained from environmental sample
  misc_feature (1)..(735): n is a, c, g, or t
ttgtttttagaaaattctaaagcacaacaattcaaatggctctcaaccttttctgatgcaaataatgaagaagtcataagtgaattaaatgcatttgttgatgcatatggagattggataagagataaaagaaataaagtaaacgaccaagaaaaaacaatagctaatcaagagcttaacaaatgctattgggattatgagcgaatgaaagaaaatattagtactcttctttcaaatgaaacaaatatagaatcttttagattaatgaattctgctatgtttatgcaaatatggcattctgtaaatactaaaaaagacaaagtccttccattaatggaagatgtaaatttttcaaacttcaatgccgatttttataaaaaagctagtgacaaattattttcagaaatagaatctacttcttggagagcctttcaattggcctttatcttattaaatttagatggtatttttaaaaatgaagatgacattaattgggaaaaaagaaatgaatatgttgacttagtttggtttccaactggtggaggaaaaacagaggcttatcttgggttaatagcattaactataataaaccgtagaaaacttcacaaggaaagaggtggtggaactgcggcaataatgaagtaccacttaaggctattaacattacagcagtttcaaagagctactttgatgataatggcacttgaatttattagacgttggggatgtttctaa

SEQ ID NO: 23414 - protein, 244 aa, Unknown
  Obtained from environmental sample
  misc_feature (1)..(244): Xaa is any amino acid
MFLENSKAQQFKWLSTFSDANNEEVISELNAFVDAYGDWIRDKRNKVNDQEKTIANQELNKCYWDYERMKENISTLLSNETNIESFRLMNSAMFMQIWHSVNTKKDKVLPLMEDVNFSNFNADFYKKASDKLFSEIESTSWRAFQLAFILLNLDGIFKNEDDINWEKRNEYVDLVWFPTGGGKTEAYLGLIALTIINRRKLHKERGGGTAAIMKYHLRLLTLQQFQRATLMIMALEFIRRWGCF

SEQ ID NO: 23415 - DNA, 810 bp, Unknown
  Obtained from environmental sample
  misc_feature (1)..(810): n is a, c, g, or t
gtgatcaaatcgatcatttaccttttattcctgatcttttcactgacgattatagcgtatttagcggaagattatattggggtcgattttccaaatcatacaggatggtggatttccaataaaatattctggatggttacggcctattttatcatttgttccttgttgttttcattcattagactggccaatgataaatttggaaagggaattatgttcaaaatgctcatcggacgttacaaaaatccgagggaggtagagaaaatattcatgtttttagacatgaaatcgtctaccgcacatgctgaagaacttggccatttaaaatatagtatgcttattcaggactgttttttctatctcaacaagattattaataaatatgatgctgaagtatatcagtatgtcggtgatgaagcggtgctaagttggacgccaaaaagaggcatcagacacctcaattgtatcaaattattcttcgattttgatcggaaattgaaacgacattctaagtattataagaaaaagtatggtatacagcctgaatttaaggcaggtttacatacaggaaagattattattgcagaggtaggaaccgtaaaaaaggaactggcataccatggggatgtcatcaattctacatcgcgcattcaggaaaaatgtaatgattttaatgagtccttattgatatctgaagacttaatgaaccaattacagttaacctctaagtacgaagccatttctctaggtgatgaactattggatggcaaaactgaagaactcaaaatttttgccatccatagaaagtaa

SEQ ID NO: 23416 - protein, 269 aa, Unknown
  Obtained from environmental sample
  SIGNAL (1)...(19)
  misc_feature (1)..(269): Xaa is any amino acid
MIKSIIYLLFLIFSLTIIAYLAEDYIGVDFPNHTGWWISNKIFWMVTAYFIICSLLFSFIRLANDKFGKGIMFKMLIGRYKNPREVEKIFMFLDMKSSTAHAEELGHLKYSMLIQDCFFYLNKIINKYDAEVYQYVGDEAVLSWTPKRGIRHLNCIKLFFDFDRKLKRHSKYYKKKYGIQPEFKAGLHTGKIIIAEVGTVKKELAYHGDVINSTSRIQEKCNDFNESLLISEDLMNQLQLTSKYEAISLGDELLDGKTEELKIFAIHRK

SEQ ID NO: 23417 - DNA, 837 bp, Unknown
  Obtained from environmental sample
  misc_feature (1)..(837): n is a, c, g, or t
gtgatcgctgaggtctcatcccctaaggcaagcgtacgactcctttttacggatgaagaccaaacattcgacattataaccgtagatagccaaggaaaacctattcagcaaaatgatttagaggtaaaagtttataaagtagaatggcgctggtggtggaactcttctgaggataatttatcaaaatacacctcaagctcctaccataaaccttttatggagaccaaagtaaataccgatgctgaaggaaaagcgcactttaaaattaaggtgcctgaagcagaaagcggacgctatttaattcgtgtttccgatcctaaaaatggccacgcgacaggaagaaccgcctatttttataaaaactggtggtctaaacaacctggtgcagataaagaagccgcaaaaatgttggtttttgctgccgataaagaaaattacaatgtgggtgaaacagcaaaaatcacatttccttcaggaaccgctggtcgtgcattagtaagtatcgaaaacggtaacgaagtattagaacatatatgggtggaaacggaacaaggcgaaacggttatagatatccccgttactaaaaatatgacgcctaacgtttttgtaaacatttcattattacagccacacgctacaacagccaacgatttaccactgcgattatttggcgtaatcccccttttagtagaagataaagacacaaaactacaacctgaaatccagatgccaaacgtcttgcgtcctgaggaagagttcaccataaccgtttcagaaaaaaacgataaagcaatgacctatactattgcggttgttgaaaaagtttactcgatttaa

SEQ ID NO: 23418 - protein, 278 aa, Unknown
  Obtained from environmental sample
  DOMAIN (128)...(263): Alpha-2-macroglobulin family N-terminal region
  misc_feature (1)..(278): Xaa is any amino acid
MIAEVSSPKASVRLLFTDEDQTFDIITVDSQGKPIQQNDLEVKVYKVEWRWWWNSSEDNLSKYTSSSYHKPFMETKVNTDAEGKAHFKIKVPEAESGRYLIRVSDPKNGHATGRTAYFYKNWWSKQPGADKEAAKMLVFAADKENYNVGETAKITFPSGTAGRALVSIENGNEVLEHIWVETEQGETVIDIPVTKNMTPNVFVNISLLQPHATTANDLPLRLFGVIPLLVEDKDTKLQPEIQMPNVLRPEEEFTITVSEKNDKAMTYTIAVVEKVYSI

SEQ ID NO: 23419 - DNA, 348 bp, Unknown
  Obtained from environmental sample
  misc_feature (1)..(348): n is a, c, g, or t
ttgaacactttttacaaaataataagtgatgaaacagtattactaaaactaaagaaaaaaagtgatattggattttggcaatatcaaatactagggttactaagcttttttgccaataatcaatttgattatctttttatcacaaacaaaagaatattagtcttaattaaagacactgtagttacaaacatagagtatcataattttaaagaattaaaatttaacagcatgaataatactttaagttttaatgactcaaataatcaacaacaacagttatccttaaataagttaagattaacctaccgaaaagataccgtttataaaagaaaaaattacctgccctaa

SEQ ID NO: 23420 - protein, 115 aa, Unknown
  Obtained from environmental sample
  misc_feature (1)..(115): Xaa is any amino acid
MNTFYKIISDETVLLKLKKKSDIGFWQYQILGLLSFFANNQFDYLFITNKRILVLIKDTVVTNIEYHNFKELKFNSMNNTLSFNDSNNQQQQLSLNKLRLTYRKDTVYKRKNYLP

SEQ ID NO: 23421 - DNA, 312 bp, Unknown
  Obtained from environmental sample
  misc_feature (1)..(312): n is a, c, g, or t
atgagaaattcatattcatcactctccgtcgcaattgcagatttacaagaccacggttttaacgaagattttaaccttgtaggagaaggcattgaatctaaatcacttaaaaaacaatggaaagcaggtgagttaaatgttattaagttctatcgttttgaagggatgactgaccccggagacaataccattctctatttaattgaagcgcaagatggaaccaaaggcttgcttgtagatgcttacggtgccgatcaaggcgagatttctccagaaatgattaaaaaacttaccattcatcatgacgaataa

SEQ ID NO: 23422 - protein, 103 aa, Unknown
  Obtained from environmental sample
  misc_feature (1)..(103): Xaa is any amino acid
MRNSYSSLSVAIADLQDHGFNEDFNLVGEGIESKSLKKQWKAGELNVIKFYRFEGMTDPGDNTILYLIEAQDGTKGLLVDAYGADQGEISPEMIKKLTIHHDE

SEQ ID NO: 23423 - DNA, 924 bp, Unknown
  Obtained from environmental sample
  misc_feature (1)..(924): n is a, c, g, or t
atggctcagctggtacttgaagatgaagctgcagagcaaattcaatcaataagaactgccattttacaaagtaatacagtagatgacttactcgctgccgcaattgaaattattagtattattgtaaaaaatattaataacgagcgccaatctgcgcaaagttttttagtgtctttaaataaaaccttagaagagttacaccattcgattttttcgactagtaaacattccgaatctatggggattgagtttgacgcattaaataaacgtattaaaactaaaattaataatcttaatgagcaaaccaagagtaccacctcaatttcatcgttaagaaaattagttgatcatgaattaaagtccctcggtgaagattttattgccaaagaagaacttgaacgcaaagatcgcaaagtacttataaccagctttgatgaaataaataatcgtattggcagcttagaaaataaactcactaaatataaaaagcgccttaacgatcaacgttttaaaagcctgctcgatagcctaactaaactgccaaatagagccgccttcgatgagcgctataatcacgaaatgcacttatttaatgtgcaagcatccgatgttactctagcggtaatagacgtagattattttaagtcaataaacgacaggtttggtcatacggctggagatattacgctacaagttattgctaaagccttgcaaaaatcgatagaaaaaacagactttatagcgcgttatggcggcgaagaatttgtactcttaatgccaggcacctctttagagcatgccattccacaactcgaaaaacttaaaaagaatataaaaaagatcccgtttaagtttaaagataagcaaatagaaattacagtgtcacttggtgcaactcagtttaaacaggtgacacattattaa

SEQ ID NO: 23424 - protein, 307 aa, Unknown
  Obtained from environmental sample
  DOMAIN (168)...(306): GGDEF domain
  misc_feature (1)..(307): Xaa is any amino acid
MAQLVLEDEAAEQIQSIRTAILQSNTVDDLLAAAIEIISIIVKNINNERQSAQSFLVSLNKTLEELHHSIFSTSKHSESMGIEFDALNKRIKTKINNLNEQTKSTTSISSLRKLVDHELKSLGEDFIAKEELERKDRKVLITSFDEINNRIGSLENKLTKYKKRLNDQRFKSLLDSLTKLPNRAAFDERYNHEMHLFNVQASDVTLAVIDVDYFKSINDRFGHTAGDITLQVIAKALQKSIEKTDFIARYGGEEFVLLMPGTSLEHAIPQLEKLKKNIKKIPFKFKDKQIEITVSLGATQFKQVTHY

SEQ ID NO: 23425 - DNA, 645 bp, Unknown
  Obtained from environmental sample
  misc_feature (1)..(645): n is a, c, g, or t
gtgaatgaattagtgagttattttaaacttaatacttctttagatttattctatcgtgtaggtattggtagtattgataataccaagttaaaagcctttgcctcatcacgaagtaatgcttttatgagttactttaaaaacaaaatttataaaccttcagtttctaaagacattcataaagaagaagtcacttccaaatacgacatgttagtatttggaaaagaagaagaaaaacttaactatacacttgctaattgctgtaacccaattccgggagataaggtgttcggttttttaacaattaacgatggattaaaagttcacaaaaaaaactgccctaatgctgtaagtttacaatctaactatgcgtatagaattatgcaggccaaatggatagactctacacagcaagtatatacctcacagattatcttatctggaattgataatttagggttagttaacgatattacaaaactaatttcaggtaatatgcacgttaacatgaagagtatcagcttttcaagtgacgatggtatatttacaggtaaaataacagttcaggtaaaaaatcaggccatgttaaaaaagcttattaacaagcttaaacaaattaatggaattgacaaagttacgcgagtataa

SEQ ID NO: 23426 - protein, 214 aa, Unknown
  Obtained from environmental sample
  misc_feature (1)..(214): Xaa is any amino acid
MNELVSYFKLNTSLDLFYRVGIGSIDNTKLKAFASSRSNAFMSYFKNKIYKPSVSKDIHKEEVTSKYDMLVFGKEEEKLNYTLANCCNPIPGDKVFGFLTINDGLKVHKKNCPNAVSLQSNYAYRIMQAKWIDSTQQVYTSQIILSGIDNLGLVNDITKLISGNMHVNMKSISFSSDDGIFTGKITVQVKNQAMLKKLINKLKQINGIDKVTRV

SEQ ID NO: 23427 - DNA, 315 bp, Unknown
  Obtained from environmental sample
  misc_feature (1)..(315): n is a, c, g, or t
tgcaaaaattatcgagccagagggttatacttttggtataataaaaaactattacactctggatccgcaatagctcttctttgtgtatatctgacggcgtgggacgaatatgatacttgggatgttaaaatttggcctctaatttcaaagataaaagaagctgactaccaaggtcgttttaaacaccttcctgaaattcaaaaagctataactattggttttggcgatgaccaaaattcattcagagagcaattaaaaaaggtatatcaaatatatatatgtggatacttcagtaggctcactgagaacttctag

SEQ ID NO: 23428 - protein, 104 aa, Unknown
  Obtained from environmental sample
  misc_feature (1)..(104): Xaa is any amino acid
MKNYRARGLYFWYNKKLLHSGSAIALLCVYLTAWDEYDTWDVKIWPLISKIKEADYQGRFKHLPEIQKAITIGFGDDQNSFREQLKKVYQIYICGYFSRLTENF

SEQ ID NO: 23429 - DNA, 441 bp, Unknown
  Obtained from environmental sample
  misc_feature (1)..(441): n is a, c, g, or t
atggaacaaagttttttcgctggtccatttaatggtaagaaaacttcaataattatcctgtctaaagatgagttagttattcgtgagcattcaacaaaggaatcgtggaagtatggtttttccaaacaattagggtttcctagtcagccgtttgctgaacttttaaacaaaatgattgatcgaaatacaattgctcaggttttaaagaattcaacattttctaagtatcaattgtcagaaatcgaaaagattgaattaatccatagttctatgagaaataaattttccatacatcttaaaaatggttctgaacttaaattttccatacttaatagaggaaaaaccgaatattacttctctcttttttcagcgaaatatccagatttaacagttgagttaaataggccagaaaccttaattcaaaaagcgcttaattattaa

SEQ ID NO: 23430 - protein, 146 aa, Unknown
  Obtained from environmental sample
  misc_feature (1)..(146): Xaa is any amino acid
MEQSFFAGPFNGKKTSIIILSKDELVIREHSTKESWKYGFSKQLGFPSQPFAELLNKMIDRNTIAQVLKNSTFSKYQLSEIEKIELIHSSMRNKFSIHLKNGSELKFSILNRGKTEYYFSLFSAKYPDLTVELNRPETLIQKALNY

SEQ ID NO: 23431 - DNA, 486 bp, Unknown
  Obtained from environmental sample
  misc_feature (1)..(486): n is a, c, g, or t
atgaaaaacacaatactactttcagtaattctgctattattattttcttgtaataataatagtgacataaaccgcgaaaccagcacaaaggattttacagaaattaaaacagacaataaaagtaaaaatcttcaaggtgcctggcaattagtaagtttctataactatgtcaacgataaaatcaaagattccacaatctccaatgccaatcaaaaacaaattaaattgtttaccgatggaaaatttatgtggagtaaaaaaagacctgcagattcaaccgaatggtttgcttttggtaaatacaacattaatgataatattctaacggaacatgttgaatatggatcattaactatggataatatcatgaaacttcgaaaaacctttgaatacgaactaatactttcaaaaaatagatttagtcaagtagaattggacgagaatggatcaagaatatattcagagaattatataaaattagaataa

SEQ ID NO: 23432 - protein, 161 aa, Unknown
  Obtained from environmental sample
  SIGNAL (1)...(16)
  misc_feature (1)..(161): Xaa is any amino acid
MKNTILLSVILLLLFSCNNNSDINRETSTKDFTEIKTDNKSKNLQGAWQLVSFYNYVNDKIKDSTISNANQKQIKLFTDGKFMWSKKRPADSTEWFAFGKYNINDNILTEHVEYGSLTMDNIMKLRKTFEYELILSKNRFSQVELDENGSRIYSENYIKLE

SEQ ID NO: 23433 - DNA, 552 bp, Unknown
  Obtained from environmental sample
  misc_feature (1)..(552): n is a, c, g, or t
gtgaaagttaaaagttcatttcatataaattttaaattacagggcaaatcatttgttaattatgatgaattaattgatttttctctaagtatttctcccgaaataaatttatttctcaaagaatggtttagtgctgaaggatttgttgaagtaaaaacttccggttccactggaatatcaaaaatgatacgtattcagaagaagcagatggttcatagcgcaatggccacaggtgaatattttaacttaggcagtaattcaaagacgttgttgtgcatgtctccggcttatattcccgggaaaatgatgcttattagagcgctgactttaggttggcatttagatgtggtggatccaagttcaaatcctttaaagaattgttccgaacattatgattttacggcaatggttccattacaattacatcattctctggatgatatttataaaataagaaaaataatagtcggaggtggagcagtatcaaaagagctgtcagcaaaaattcaaaatatcgaaactgaaatattgagaccctcgagccgaatctga

SEQ ID NO: 23434 - protein, 183 aa, Unknown
  Obtained from environmental sample
  misc_feature (1)..(183): Xaa is any amino acid
MKVKSSFHINFKLQGKSFVNYDELIDFSLSISPEINLFLKEWFSAEGFVEVKTSGSTGISKMIRIQKKQMVHSAMATGEYFNLGSNSKTLLCMSPAYIPGKMMLIRALTLGWHLDVVDPSSNPLKNCSEHYDFTAMVPLQLHHSLDDIYKIRKIIVGGGAVSKELSAKIQNIETEILRPSSRI

SEQ ID NO: 23435 - DNA, 690 bp, Unknown
  Obtained from environmental sample
  misc_feature (1)..(690): n is a, c, g, or t
gtgaatgcaataatgctgcaaagatatgtaaaaacttcggatataactattgcagtaattcctttaggaactggaaacgattggataaaaacctataacattcctaatcatattaaaaaatctattgaaatcatcaaccaaaaaaagaccattttacaagatattggtatgttaacaactgttgataaaaaacgaacctactttaataacgcagctggtttaggctatgatgcttacattgttaacaaacttaaaaagcttaaaaactttggagctgcatcttatcttttagcaggaatttatggtttattcttttataaaaaatctatattttctatttcttttgatcataaaaaaattgaaacaacttgtttaatgacagttatcgggctttgtaaattttctggaggtggcatgcagtttaccaaagatgttgatgcttctgacggattttttgatattaccatcgctaaaaatattacttttttagatttagtattgaatatcaataaattatattcaggaaaaattgtgcatcataaaaagtgtgaaacgtataaaacgaaagaaatatgtgtacatccaaataacaataaatgctttgttcaggcagatggtgagttgattggtactggaaaagttagtgcaaaaatcttagaaaaagcgattaattttgttgtaaatacataa

SEQ ID NO: 23436 - protein, 229 aa, Unknown
  Obtained from environmental sample
  misc_feature (1)..(229): Xaa is any amino acid
MNAIMLQRYVKTSDITIAVIPLGTGNDWIKTYNIPNHIKKSIEIINQKKTILQDIGMLTTVDKKRTYFNNAAGLGYDAYIVNKLKKLKNFGAASYLLAGIYGLFFYKKSIFSISFDHKKIETTCLMTVIGLCKFSGGGMQFTKDVDASDGFFDITIAKNITFLDLVLNINKLYSGKIVHHKKCETYKTKEICVHPNNNKCFVQADGELIGTGKVSAKILEKAINFVVNT

SEQ ID NO: 23437 - DNA, 474 bp, Unknown
  Obtained from environmental sample
  misc_feature (1)..(474): n is a, c, g, or t
ttgagagttgttttatttatgccatttttgtttataattaaaattcctaaaatgagatccctatgtatacttttagtagatgatgataaaattgaaagactaaaatttaaaaaagtttgtcaagaggttaacttcgaaagtaacgttattgaagcaaaagatggtgaaacagctttactacttttagatgattgtaaaaccccttttgatttgattatttcagatttaaatatgcctggaattgatggctttgagttcttatctactttaaaaaataactcaaaattaaaaaatattccgattgtaattttatctacatcacaaagaaaaattgatttagatagatgttataaatttggaatttctggctactttacaaaaccactaaaattttctgactatagtgatagtgttatttctttattaaaatactgggataaagcaagtttatcttcaagattatatgctagttaa

SEQ ID NO: 23438 - protein, 157 aa, Unknown
  Obtained from environmental sample
  DOMAIN (21)...(146): Response regulator receiver domain
  misc_feature (1)..(157): Xaa is any amino acid
MRVVLFMPFLFIIKIPKMRSLCILLVDDDKIERLKFKKVCQEVNFESNVIEAKDGETALLLLDDCKTPFDLIISDLNMPGIDGFEFLSTLKNNSKLKNIPIVILSTSQRKIDLDRCYKFGISGYFTKPLKFSDYSDSVISLLKYWDKASLSSRLYAS

SEQ ID NO: 23439 - DNA, 474 bp, Unknown
  Obtained from environmental sample
  misc_feature (1)..(474): n is a, c, g, or t
atggaagatggtagtgtttatgatcttcctcctcatttttttgcaccttatgactatcaatttacattaggcaatttcaaatttttaagtccaaataagatattaccaattacagctggtgtggcaggaataaatactggtcggttttttaataaggaattaaatgaaaatgaaatattaattctagagaaaaatgagggtcaggttcatttagacacaaaaaaaaacgaatcatttaattactttttgaaacaatatgtacgtaactggaataataaggacgaagtgtgcaacttcttgcatatgctgcagcctccaaggttactattaacattttcgacgaacaccattcctaggaatgaaaagaaaatcacaagaatcagcataaccgaagtcacttccttctattcaaaaaaaatgggatatcaggtgttaagaactcaggaattaaagagtatttcaattgaagattga

SEQ ID NO: 23440 - protein, 157 aa, Unknown
  Obtained from environmental sample
  misc_feature (1)..(157): Xaa is any amino acid
MEDGSVYDLPPHFFAPYDYQFTLGNFKFLSPNKILPITAGVAGINTGRFFNKELNENEILILEKNEGQVHLDTKKNESFNYFLKQYVRNWNNKDEVCNFLHMLQPPRLLLTFSTNTIPRNEKKITRISITEVTSFYSKKMGYQVLRTQELKSISIED

SEQ ID NO: 23441 - DNA, 582 bp, Unknown
  Obtained from environmental sample
  misc_feature (1)..(582): n is a, c, g, or t
atgagcaattatcacatcaagcatttagaggaatattatcaagtatatagaaagtcgattcgagaaccagagaatttttgggcagaaattgcagaagaacactttgtttggagaaaaaaatgggataaagttttagaatgggattttgccaaacccacagtaaaatggtttgaaggagcacaactaaacattacagaaaattgtattgataggcatttaactacaagagctgataaaactgctattttatttgaacctaataatccagaggaaccagcagaacatattacctacaaacaattatcagaaagagtcaatcagtttgcgaatgttttaaaagaaaaaggcgtaaaaaaaggtgatagagtttgtatttatgtgcccatgattcctgaattggccattggcaccttaacttgtgcaagaattggcgcaaatccctctgtagtttttgcaaggtttttcatcctccacattaagcctctagaaataaaggattctgattgtaaaaaaagccattaccagggatgggtccttttgagggaaaaaaaccaatcgattttaaaaggaattggaagatga

SEQ ID NO: 23442 - protein, 193 aa, Unknown
  Obtained from environmental sample
  misc_feature (1)..(193): Xaa is any amino acid
MSNYHIKHLEEYYQVYRKSIREPENFWAEIAEEHFVWRKKWDKVLEWDFAKPTVKWFEGAQLNITENCIDRHLTTRADKTAILFEPNNPEEPAEHITYKQLSERVNQFANVLKEKGVKKGDRVCIYVPMIPELAIGTLTCARIGANPSVVFARFFILHIKPLEIKDSDCKKSHYQGWVLLREKNQSILKGIGR

SEQ ID NO: 23443 - DNA, 651 bp, Unknown
  Obtained from environmental sample
  misc_feature (1)..(651): n is a, c, g, or t
ttgatggtttcggtgatgaaggttttattccacgttgttggactttttcaggtcaataattttccttggataaatagagtcccaaaatcaattgttattggaattgcaaatgttgacagaagaagagattttacttacccaactacaattgcagaagatcaaaaaagagatccaacttctggtgaatcagcaaacttcatttcatttattgaaaaagaattgcaaccatatattgaaaagaaatacaaaaccaatgattcaaaaactattattggacaatcagcaggcggacttttagcaacagaaattttaataaaaaaaatgcaccttttcaacaaatacataatcataagtccaagtttgtggtgggataatggttctctattaaatgaaaaatcggaaatctatcaagagaattttaaaggacatatcgatatttatattggagttgggaaagaaggacttgcaccaacagaaatccctcacgttatggaagttgatgcaaatttattagccgagaaattgaaaagcgcaaaaagcaaaaatgtaaaagtgtattttgattatttgccacaagaagaccacgcaacaattacgcatcaagcaatttttaatgcgttgagaattttatatccaaaaacagataaatag

SEQ ID NO: 23444 - protein, 216 aa, Unknown
  Obtained from environmental sample
  misc_feature (1)..(216): Xaa is any amino acid
MMVSVMKVLFHVVGLFQVNNFPWINRVPKSIVIGIANVDRRRDFTYPTTIAEDQKRDPTSGESANFISFIEKELQPYIEKKYKTNDSKTIIGQSAGGLLATEILIKKMHLFNKYIIISPSLWWDNGSLLNEKSEIYQENFKGHIDIYIGVGKEGLAPTEIPHVMEVDANLLAEKLKSAKSKNVKVYFDYLPQEDHATITHQAIFNALRILYPKTDK

SEQ ID NO: 23445 - DNA, 876 bp, Unknown
  Obtained from environmental sample
  misc_feature (1)..(876): n is a, c, g, or t
ttgctattaataaaatgcaattgtctaaaagtatatcctataaattatctggtttttaaaacagataaaaatcaaaataaatctaaaaacgagcaaagcggacaattagatttaaatgcagatcaacaaaaagatttgtcaacaacatccattaattttgatcaagatacaaaagtgataattctacttttaatttttgattccacagataatattattggtatggatagaatcgtttataacgataatgaagacaataatcttaatgttaaaaaaaatattgcagaaaaaattgataatattagtgtcaaaatttctgcgcaattagtaaataatgaagttgaggctaaaatagaaacagctcaacaaaatgactttacaaccataaaagctacagctttcaataaaaccgaaattacaaaaagtttaatctttaaattaatggtttttgataaagaagaaagtgtagataaccttctagaagacaaaaagcaacgctttataatatctgccaaccaaaaaatagaacttgctgaggcttcatttaatattattggagatcagccagttatttgcgtcatgcttatttatgacttagataataatttgataggtcaagaccgagtggtttataatgataagtcaaatttagatatagaaaataaacaaaaattattagataaattaaaagaggaacaggcaaactctcaagacgtcaataaaggtaaaagagatggtttagagttaaaaggaatcgtagttgaagacacaaaaacaaaaccgggtagggacttttacagttattttattctttatacacntcaaataatattaacggggaataaagtagtgaccatcaaggagggtatagcataa

SEQ ID NO: 23446 - protein, 291 aa, Unknown
  Obtained from environmental sample
  misc_feature (1)..(291): Xaa is any amino acid
MLLIKCNCLKVYPINYLVFKTDKNQNKSKNEQSGQLDLNADQQKDLSTTSINFDQDTKVIILLLIFDSTDNIIGMDRIVYNDNEDNNLNVKKNIAEKIDNISVKISAQLVNNEVEAKIETAQQNDFTTIKATAFNKTEITKSLIFKLMVFDKEESVDNLLEDKKQRFIISANQKIELAEASFNIIGDQPVICVMLIYDLDNNLIGQDRVVYNDKSNLDIENKQKLLDKLKEEQANSQDVNKGKRDGLELKGIVVEDTKTKPGRDFYSYFILYTXQIILTGNKVVTIKEGIA

SEQ ID NO: 23447 - DNA, 771 bp, Unknown
  Obtained from environmental sample
  misc_feature (1)..(771): n is a, c, g, or t
ttggccgaaaataaacagcaacaactaacagagttttataaacaagggactgaactacaggttgtgctaaggcacttagcagagcaaaaaagtgcacttgatgagcacacgattgtggctgcaacagatttaaaaggcactatcacttttgttaataaaaagttttgtgaaataagtggttatgacgaacacgagttaataggtaaaaaccaccgtattcttaattcgggcactcacccaaaacagttttttaaagaaatgtaccaaaccctaaaacagggaaaagtatggcatgggaaaatatgtaataaagccaagcaaggtaatttatattgggtagataccaccatagcgccatttttagatgaaaatgctaagccacaaagctatatagccattcgaacagatttaaccgcattaaagttacaagaaatagagctagaagagcataaagcacaactacagttggtaatagatactaccgctgtgggaatttgggattggtacattgacacaggtaaagtcacttttaatcaccgttgggctgaaataattggctataccttagatgagttaggcccagcagtaataggcacttggtataagtatgcccacccagacgatttaatcgtttcggagcaaaaattaaacgctcatttttctggtgaaacagactattacgttaatgaagcacgtatgaaacataaacaaggtcattgggtatggatactagacactcagccgaatctgatacatcgctgttccccataa

SEQ ID NO: 23448 - protein, 256 aa, Unknown
  Obtained from environmental sample
  DOMAIN (98)...(140): PAC motif
  misc_feature (1)..(256): Xaa is any amino acid
MAENKQQQLTEFYKQGTELQVVLRHLAEQKSALDEHTIVAATDLKGTITFVNKKFCEISGYDEHELIGKNHRILNSGTHPKQFFKEMYQTLKQGKVWHGKICNKAKQGNLYWVDTTIAPFLDENAKPQSYIAIRTDLTALKLQEIELEEHKAQLQLVIDTTAVGIWDWYIDTGKVTFNHRWAEIIGYTLDELGPAVIGTWYKYAHPDDLIVSEQKLNAHFSGETDYYVNEARMKHKQGHWVWILDTQPNLIHRCSP

SEQ ID NO: 23449 - DNA, 387 bp, Unknown
  Obtained from environmental sample
  misc_feature (1)..(387): n is a, c, g, or t
gtgttnnnngggttatcgctggncgtcagacgttgcggatggttagatttggtggctttgcgctatgccgttcaagttaacggagttacccaactaataatgatgaaagcagatgttttgagtggtttcgaaaaattaaaggtttgtactgcttataattacaaaggcaaaacaattcaccatttaccgtataatattgaagccgaaaacgtaacgccaatcttcacagaaatgaaaggctggtatgcagatttaaccaaaatgagcgaagcttcacaattgccaaagacgttgaatgattatattgatttccttgaaaaggaactggaagtgcctatcaaaatagtttctgtgggaccagacagaaaacagaccattcatcggtaa

SEQ ID NO: 23450 - protein, 128 aa, Unknown
  Obtained from environmental sample
  DOMAIN (2)...(127): Adenylosuccinate synthetase
  misc_feature (1)..(128): Xaa is any amino acid
MXXGLSLXVRRCGWLDLVALRYAVQVNGVTQLIMMKADVLSGFEKLKVCTAYNYKGKTIHHLPYNIEAENVTPIFTEMKGWYADLTKMSEASQLPKTLNDYIDFLEKELEVPIKIVSVGPDRKQTIHR

SEQ ID NO: 23451 - DNA, 510 bp, Unknown
  Obtained from environmental sample
  misc_feature (1)..(510): n is a, c, g, or t
atggaaagccttttgttacgcatattccattttatttacaacgaaacctccaaaaaactggttgcacatatagaccgaaataatccgcagcttgaaaccttaactgagaatgccgaagttaccgttgtcttcaaagggccagatacctatatttcacccagtgtttatacaacgccacaattaccaacgtggaattacatcattgttcacgtaacagggaaactaaaactaatccacgaaccagaagccgtaaagcagacaatgattggcatgacagaatttttagaaggtgaagaacaaaaatttattctaaaaaaagacgacccaagaatggaacggctcatcaattacattcaagcttttgaaattgaaatcaccaattgggaagggaaatttaagctttcgcaggataaaaacgcacaggattttgagaatgcaaaagaggaattaataaaaaaatccagaaaggatgtttctggatttgtaaatggagtttataaatctaactaa

SEQ ID NO: 23452 - protein, 169 aa, Unknown
  Obtained from environmental sample
  DOMAIN (1)...(128): Negative transcriptional regulator
  misc_feature (1)..(169): Xaa is any amino acid
MESLLLRIFHFIYNETSKKLVAHIDRNNPQLETLTENAEVTVVFKGPDTYISPSVYTTPQLPTWNYIIVHVTGKLKLIHEPEAVKQTMIGMTEFLEGEEQKFILKKDDPRMERLINYIQAFEIEITNWEGKFKLSQDKNAQDFENAKEELIKKSRKDVSGFVNGVYKSN

SEQ ID NO: 23453 - DNA, 396 bp, Unknown
  Obtained from environmental sample
  misc_feature (1)..(396): n is a, c, g, or t
atgaaacaattaaaaactataaaatacagatatcttattgcgttaatgctgcttattacagtaagtgttacagcgcaacaaaaattaagtaaaattgaccaatcggttagggcaaataaagacgtaaccgtagatctaaatactagtcataccaatattattgtagaaacttggaataaggattatatagaggttgaagcttatattgaaagtaaaaagttgaccaaacaagagatgcaaaaagcattggacaattgggatgttgctttaacaggagactcggattatgtaaaaataacgtctaaaggatcaagaggtatttggtcagatgacatgagcgtaacgatattggatgaagcgtctattgaggctttagctaatctccctgaaagttag

SEQ ID NO: 23454 - protein, 131 aa, Unknown
  Obtained from environmental sample
  misc_feature (1)..(131): Xaa is any amino acid
MKQLKTIKYRYLIALMLLITVSVTAQQKLSKIDQSVRANKDVTVDLNTSHTNIIVETWNKDYIEVEAYIESKKLTKQEMQKALDNWDVALTGDSDYVKITSKGSRGIWSDDMSVTILDEASIEALANLPES

SEQ ID NO: 23455 - DNA, 417 bp, Unknown
  Obtained from environmental sample
  misc_feature (1)..(417): n is a, c, g, or t
atgggaggagtttcttctggaaattttgaaattaacgaaaaaggaaatggattatttacaggagaaatttctttagataataatggtggattttcttccttaagatatcgatttgataaaattaatgttgagaattttactaaagtcattttgaaaattaaaggtgatggaaaaaaatatcaatttagagtaaaagataattctcaaaatgattattcatacatacaatcttttgaaacttcaaataattgggagcttatagaaattaacttatctgatatgtatcctgcttttagaggtagaaatttagatatgagtaatttttcatcaaccaaaattgaagaaattgcactacttattggaaataaaaaagaggaaacttttcgattggaaataagtaaaatttatctacaataa

SEQ ID NO: 23456 - protein, 138 aa, Unknown
  Obtained from environmental sample
  misc_feature (1)..(138): Xaa is any amino acid
MGGVSSGNFEINEKGNGLFTGEISLDNNGGFSSLRYRFDKINVENFTKVILKIKGDGKKYQFRVKDNSQNDYSYIQSFETSNNWELIEINLSDMYPAFRGRNLDMSNFSSTKIEEIALLIGNKKEETFRLEISKIYLQ

SEQ ID NO: 23457 - DNA, 771 bp, Unknown
  Obtained from environmental sample
  misc_feature (1)..(771): n is a, c, g, or t
ttggctgtaaagatgattttaaatacccaacataacggaaaggtagatgaaaagcagtacattcttatagagatcccaagaggaattgatcgttttgtagaaattccttcagaagacgacaagaaatacattataattctagatgatctcattagatataatttacagagtatctttaatatttttgactacaaaagtatttcggctcatatgattaaaatcacccgtgatgccgaattagatatggcgggggatttaagtaagagttatatagaaaaactattgtctagtgtaaaagatagaattgaaggtcagcctgtaagatttgtatacgataaaaacattgagccagataccttacactttttactatcaaaaatggggattgatgattcagatagtttaattcctggtgggcgataccataatcgaagagattatatgaaattcccaagcctgggagctaagaatttgttatacaaaaaatacagtccgcttcccgttaaaggcttaagcttacaaggaagtttactacaaaaaattgccgaaaaggattatttacaatatacaccctatcataccttttcctacacagtaaaatttttgagagaagctgctttagatcctaaagtgcaaactattaaaattactatttaccgtctagcggaaatttcacatatcgcaagttcgcttatcaatgccgttaaaaatggaaaaagtgtcaccgtttcgatcgagttaagagcacgtttgatgtgcaaccagccataa

SEQ ID NO: 23458 - protein, 256 aa, Unknown
  Obtained from environmental sample
  DOMAIN (1)...(255): Polyphosphate kinase
  misc_feature (1)..(256): Xaa is any amino acid
MAVKMILNTQHNGKVDEKQYILIEIPRGIDRFVEIPSEDDKKYIIILDDLIRYNLQSIFNIFDYKSISAHMIKITRDAELDMAGDLSKSYIEKLLSSVKDRIEGQPVRFVYDKNIEPDTLHFLLSKMGIDDSDSLIPGGRYHNRRDYMKFPSLGAKNLLYKKYSPLPVKGLSLQGSLLQKIAEKDYLQYTPYHTFSYTVKFLREAALDPKVQTIKITIYRLAEISHIASSLINAVKNGKSVTVSIELRARLMCNQP

SEQ ID NO: 23459 - DNA, 501 bp, Unknown
  Obtained from environmental sample
  misc_feature (1)..(501): n is a, c, g, or t
atgaatataagtacggttggggaagacggttttcctaaaactcgtatagtattgcttaaaaagttttctaaagatggttttgttttttacactaactataaaagtgagaaaggtttagctatagaaaaacacccgaaagtgtgtttatcttttttttggccagcagccgaaagacaggttattattaaaggaattgtagaaaaaactccacaagaacagtcgagtaattattttgcttctcgccctaaaggcagtcaaatgggagcaattgtttctccgcaaagtcagccaatccctaatagggaatttttagaagaaaaattgagcgaactacaaaaagaagaaagcgaacttaaacgcccagagcattggggtggttatattgtaaaacctcaagaaatggagttttggcaaggaagagctaataggcttcacgataggtttttatataccttagattcaaaaactaatgattggaatatcgttcgtttagcaccataa

SEQ ID NO: 23460 - protein, 166 aa, Unknown
  Obtained from environmental sample
  DOMAIN (1)...(73): Pyridoxamine 5'-phosphate oxidase
  misc_feature (1)..(166): Xaa is any amino acid
MNISTVGEDGFPKTRIVLLKKFSKDGFVFYTNYKSEKGLAIEKHPKVCLSFFWPAAERQVIIKGIVEKTPQEQSSNYFASRPKGSQMGAIVSPQSQPIPNREFLEEKLSELQKEESELKRPEHWGGYIVKPQEMEFWQGRANRLHDRFLYTLDSKTNDWNIVRLAP

SEQ ID NO: 23461 - DNA, 339 bp, Unknown
  Obtained from environmental sample
  misc_feature (1)..(339): n is a, c, g, or t
ttgaaagagaaagagcttttgttgggtgaaatacatcatagagttaaaaataatattgctattatttccgctttcttgcagctagaacagttttcaattcaaaataaaactgcgagcgatattatagataaaagcattggaagaataaaagtaatggccactatccatgagttattgtataccaacgaaaatttttcagatataaatctagggcaaatgattgaatacctttgcgaaataattcagaagaattttggtaaatatggtgaaattaattttaatgctgatgtcgagccgatgaaattttatattaaacagccatttcctttggccttaaag

SEQ ID NO: 23462 - protein, 113 aa, Unknown
  Obtained from environmental sample
  DOMAIN (10)...(97): Histidine kinase
  misc_feature (1)..(113): Xaa is any amino acid
MKEKELLLGEIHHRVKNNIAIISAFLQLEQFSIQNKTASDIIDKSIGRIKVMATIHELLYTNENFSDINLGQMIEYLCEIIQKNFGKYGEINFNADVEPMKFYIKQPFPLALK

SEQ ID NO: 23463 - DNA, 573 bp, Unknown
  Obtained from environmental sample
  misc_feature (1)..(573): n is a, c, g, or t
gtgaagtttttatttcgattgttttttgttgttctgtgtattattttttatcaatgtgatgctccaaagaaaaaagagatttcaacaaaagaaattcaaaaagaggaaaaaatcatagaaaaagacacaataaaagttgaagaagaaaataaatggaacaccatcaatagctcaaataccgaagaatttttattaacttatggagaagaaaatccagaaactaaagttattattaaaaccaaatttggcaatataaaaattcgcttgtttaatgatgttcctgcacacagagctagttttatttatctaacaaaaaacgaatattttaatacaacagttatttatagagtcgccaaaaattttgtaattcaaggaggtaattccgataattatttaactgtagaacaaagaacaaaacacggaaattacttaataaaacctgaattcaaaaaacacagaattcataaatatggttctttagctgctgcaagagaatgggataataatccaaataaactatccaatccttttgagttttatgtggttcagaataaaaaaggagctccgcattag

SEQ ID NO: 23464 - protein, 190 aa, Unknown
  Obtained from environmental sample
  misc_feature (1)..(190): Xaa is any amino acid
MKFLFRLFFVVLCIIFYQCDAPKKKEISTKEIQKEEKIIEKDTIKVEEENKWNTINSSNTEEFLLTYGEENPETKVIIKTKFGNIKIRLFNDVPAHRASFIYLTKNEYFNTTVIYRVAKNFVIQGGNSDNYLTVEQRTKHGNYLIKPEFKKHRIHKYGSLAAAREWDNNPNKLSNPFEFYVVQNKKGAPH

SEQ ID NO: 23465 - DNA, 636 bp, Unknown
  Obtained from environmental sample
  misc_feature (1)..(636): n is a, c, g, or t
atgctagaacagaatcaaaaagtagaaagcggaaggactcaagaacgcaacaggatttctgaagaactccatgatggtgttattggcaaattgtttggtacacgcatggggttgggttttttaaagttagatgttgaccctaaaacaacaaaaaaacatcaggagttcataaatgatcttcaacatttagaaaaagatattagagatatatcacacgatttaatcaatacggaaaaatacaaaacagaaaattttgctgctttgataaaacatttggttactgaacaatctattcttggaaattatgaattcgagttacacattgatgatgcaattctgtggtctgaaatcagcatatttattaaaatgaacctttaccgaattgttcaagaatcaatccacaatgtcaataaatacgcaaaagcatcaaagatacttgctgattttagaatacaagataaaaatattcaacttaaaattagcgacaacggggtaggatttaatgtgtcaaaaaaatcaaaaggaatagggttaaaaaacatgaagtcccgaacacgaaaaatacacggagaaatgaaactaatatctaatgaaaaaggaactagtctagaaatagtggttcctgtaacaacttaa

SEQ ID NO: 23466 - protein, 211 aa, Unknown
  Obtained from environmental sample
  DOMAIN (120)...(210): Histidine kinase-, DNA gyrase B-, and HSP90-like ATPase
  misc_feature (1)..(211): Xaa is any amino acid
MLEQNQKVESGRTQERNRISEELHDGVIGKLFGTRMGLGFLKLDVDPKTTKKHQEFINDLQHLEKDIRDISHDLINTEKYKTENFAALIKHLVTEQSILGNYEFELHIDDAILWSEISIFIKMNLYRIVQESIHNVNKYAKASKILADFRIQDKNIQLKISDNGVGFNVSKKSKGIGLKNMKSRTRKIHGEMKLISNEKGTSLEIVVPVTT

SEQ ID NO: 23467 - DNA, 309 bp, Unknown
  Obtained from environmental sample
  misc_feature (1)..(309): n is a, c, g, or t
gtgcctccacaagtaagtctaaaaaatggtttaccttatcatgaatggtttatagaatttacaaacgaaccagaaaatttagaagaatttgcaaccaaaattgatgcttctatgcaagctcaaaatatttattatttcgatttaattacagggaaagttttacgtcctttaattgttagaaaggtaaaaaaaggtggttttcatgaatatatgaagtcgattggtaaatttggtgggcaaaataaaattccacaattgtctgataacagaaaaattgcggatgttttagaaaactttttagaaaaataa

SEQ ID NO: 23468 - protein, 102 aa, Unknown
  Obtained from environmental sample
  misc_feature (1)..(102): Xaa is any amino acid
MPPQVSLKNGLPYHEWFIEFTNEPENLEEFATKIDASMQAQNIYYFDLITGKVLRPLIVRKVKKGGFHEYMKSIGKFGGQNKIPQLSDNRKIADVLENFLEK

SEQ ID NO: 23469 - DNA, 744 bp, Unknown
  Obtained from environmental sample
  misc_feature (1)..(744): n is a, c, g, or t
gtgtttgtattgggtggagttttgtcttttttattgattttggtaaccacttttatcatcacttttacacctgttaaagaatatattcctggatattcctctaccgatttaaaaataaaagcgacaaaattagcgttccaaacagattctttaaaaagaaaattagaccttttaaacgattataccattgctttaagacctattttaactggcgaaattaagcccaatattttagattctgaaaccattgaagcagagaaaatcatcataaaagatagtttgctaaatgcaagcagagaagattctatttttagagaaaaaatagaaagtcaagatcgttttcctattcagaataatgcaacaaacaatgcaaaaattgtattttttgcgcctttaaatggaactatttctcaagattacgattcaaaaacaaaacatttagctgtagatattgttgctaaaaaaaatgcaccagtaaaagccactgcagatggtagcgttattttttctggctggactaaagaaactggttatgtaattattttaaagcacgctcataattacatttctgtatataaacacaatggaaatttactaaaacaacaaggagattttgtaaaatctggcgaagttatagcaagtgtaggttctacaggagaactttctactggaccacatttacattttgaactttggagtgatggttatgctgttaatcctacaaatttgatcgattttaaataa

SEQ ID NO: 23470 - protein, 247 aa, Unknown
  Obtained from environmental sample
  DOMAIN (144)...(240): Peptidase family M23
  misc_feature (1)..(247): Xaa is any amino acid
MFVLGGVLSFLLILVTTFIITFTPVKEYIPGYSSTDLKIKATKLAFQTDSLKRKLDLLNDYTIALRPILTGEIKPNILDSETIEAEKIIIKDSLLNASREDSIFREKIESQDRFPIQNNATNNAKIVFFAPLNGTISQDYDSKTKHLAVDIVAKKNAPVKATADGSVIFSGWTKETGYVIILKHAHNYISVYKHNGNLLKQQGDFVKSGEVIASVGSTGELSTGPHLHFELWSDGYAVNPTNLIDFK

SEQ ID NO: 23471 - DNA, 816 bp, Unknown
  Obtained from environmental sample
  misc_feature (1)..(816): n is a, c, g, or t
atggctggcggaggcttttttgacatcgggtattttgacaaagcgttggaatatcataccgaagtattgaaaatacacgagaaaataggctccaaacagcgcattgcctacagttacaacagtatagggctaattcatgaagggaaaggcgattgcaatttagcattatcgttttttaagaaatccttagaacttattgaaacacttaataataaggacaggattgccgaggccatgactaatatgggcatttgttatcgtaaaatcaatgaccttggcttagccataaagttcttagagtcggcgctggagattacgaatgaaattaaatttgaacacaaaaaagtatatatcctccatgaactgtccattgttcatttaatgctcgaaaactttgacaaagcgtatgcattgctggaagaatccagaatgattattcaaaccataactaataacaaggaattaattttagagaacaataaaattatgtctgattattatttagccatacacaactacaaggagtcctttagctactacaagaaatacatagaagaatcctccaagattttctcgagtactgaaagcgaaagactcgccgaaatgagaattttgtacgaggcagaacgacgcgaaaacgaaattaaattattggagcaagaacgacatttagaagcacaaaaaagaaactttctattgattggtgctctattgttggcaattattgccatgcttataattggagggctctggaacaacataaaaaagaagaaagcaatttacttgcaaagccacaaactatccaaagagaaataa

SEQ ID NO: 23472 - protein, 271 aa, Unknown
  Obtained from environmental sample
  misc_feature (1)..(271): Xaa is any amino acid
MAGGGFFDIGYFDKALEYHTEVLKIHEKIGSKQRIAYSYNSIGLIHEGKGDCNLALSFFKKSLELIETLNNKDRIAEAMTNMGICYRKINDLGLAIKFLESALEITNEIKFEHKKVYILHELSIVHLMLENFDKAYALLEESRMIIQTITNNKELILENNKIMSDYYLAIHNYKESFSYYKKYIEESSKIFSSTESERLAEMRILYEAERRENEIKLLEQERHLEAQKRNFLLIGALLLAIIAMLIIGGLWNNIKKKKAIYLQSHKLSKEK

SEQ ID NO: 23473 - DNA, 324 bp, Unknown
  Obtained from environmental sample
  misc_feature (1)..(324): n is a, c, g, or t
atggattttaacaagactttaactatttggtattcagaacataagcgcgacctcccctggcgcaaaaccaaaaacccctatcacatctggttatcggaaataattttacaacaaacccaaatcgctcaaggactcccatattacgacgctttcgtcagcaaatatcccaccgtttttgatcttgccaatgctcaagaaggcgaggttttaaaactttggcaaggtttgggctattactctagagcccgaaatttacacaccacagcgaaacatattaccaatgatcttaatggcatctttccaaacacctacaaggacctctaa

SEQ ID NO: 23474 - protein, 107 aa, Unknown
  Obtained from environmental sample
  misc_feature (1)..(107): Xaa is any amino acid
MDFNKTLTIWYSEHKRDLPWRKTKNPYHIWLSEIILQQTQIAQGLPYYDAFVSKYPTVFDLANAQEGEVLKLWQGLGYYSRARNLHTTAKHITNDLNGIFPNTYKDL

SEQ ID NO: 23475 - DNA, 804 bp, Unknown
  Obtained from environmental sample
  misc_feature (1)..(804): n is a, c, g, or t
ttgggcgttattgtccgtacggttgctgaaggtaaaaaagtggctgagctagatactgattngcagaacctattgagccgttggacagcaatgtgcaagaaactcaacaaggcccctcacccaagtaaagtacttggagagatgaacaaagcatcttcaattttgagggacatcttcaacgattcgttctcaagtattgttgtagatgatgaagagttatatatgcaaatcaaagattacgtgcatcaaattgcaccaaaaaaggaatctattgtaaaacattatcaaaatggcgtgcccatttttgaaaaacatggtattgagaggcaaataaaaacctctttcggacgtacagtctctatggctaaaggtgcgtatattgtgatagaacacaccgaagcactccatgttattgatgtgaacagtggcaatagatccaataaagaaaaaaatcaagaggatactgccttagaagtcaatatgatttcagctactgaaattgccagacaattgcgtttacgtgatatgggaggtattatagtagtggattttattgatatgggtaatgcagagaatcggaaaaaactgtacaatcatcttcgtgacgaaatgaaagatgataaagcaaagcataagatattacctcctagcaaattcggtctgatccaaattaccagacaacgcgtgcgcccagaaaggaatattgaaacaaaagaagaaaacccgaatgttagtggggaggagattgaagcgccaattaaggtggtacaacgcatcactcaagacatgctcgagccgatctga

SEQ ID NO: 23476 - protein, 267 aa, Unknown
  Obtained from environmental sample
  misc_feature (1)..(267): Xaa is any amino acid
MGVIVRTVAEGKKVAELDTDXQNLLSRWTAMCKKLNKAPHPSKVLGEMNKASSILRDIFNDSFSSIVVDDEELYMQIKDYVHQIAPKKESIVKHYQNGVPIFEKHGIERQIKTSFGRTVSMAKGAYIVIEHTEALHVIDVNSGNRSNKEKNQEDTALEVNMISATEIARQLRLRDMGGIIVVDFIDMGNAENRKKLYNHLRDEMKDDKAKHKILPPSKFGLIQITRQRVRPERNIETKEENPNVSGEEIEAPIKVVQRITQDMLEPI

SEQ ID NO: 23477 - DNA, 381 bp, Unknown
  Obtained from environmental sample
  misc_feature (1)..(381): n is a, c, g, or t
atggataacgaagaagctatactaaacggtcagtttagtattagcttattggataaaagtaagtatgaagcacaaatcaatgatattataaaattaagcattaataaagtgtatcaatctaaagatgtagtagataaagaaattgctggttaccaaatattaaattcattattaaatacttacagtaaagctgtcaataatacttttttaggaaaagctactaattatgataagctaataatgaaaggtttaccgtcaacattagactttaatacagatagtttgtatgtaagattgctaaatgtatgtcattatgtatctttaatgtctgatagtcaagcaattattgaatacagaaaaataaaagggtttagtttataa

SEQ ID NO: 23478 - protein, 126 aa, Unknown
  Obtained from environmental sample
  misc_feature (1)..(126): Xaa is any amino acid
MDNEEAILNGQFSISLLDKSKYEAQINDIIKLSINKVYQSKDVVDKEIAGYQILNSLLNTYSKAVNNTFLGKATNYDKLIMKGLPSTLDFNTDSLYVRLLNVCHYVSLMSDSQAIIEYRKIKGFSL

SEQ ID NO: 23479 - DNA, 846 bp, Unknown
  Obtained from environmental sample
  misc_feature (1)..(846): n is a, c, g, or t
ttgaaaaaagctgctatagacaattttacagacaaatctttaggagatgctttgagtactttaagtggtgtatcttctttaaacactggtaattctattgtaaaacctatgattcatggtttacacagtagcagattgttattgattaataacaatgtaagaatgtttgaccaagaatggggagatgaacatgcacccaatatcgacattaatgctagtgaaaaaattacggttgtaaaaggtgcaaatactttaaaatatggtagtgatgccattggtggtttaattttaattgaaccaaaaaagtatgctgttaaagattcactttttggaagcacaatttcttcatttaactctaatggttttggtggtaatataaattcagaaattgtaaaaacctacaaatctggtttgtacgcaaaattacaagctaattacaaacagtttggcgattttaaagctccagattattacttaactaatggtggtttaaaaagcataaatacttcttttagaatcggttacaatggttatgaaaaagggtttagtgcttattatagttttgttgataatgaatttgccattttacaatcttctcatattgggaatgtaaatgatttggtaaactccattaacaatagagaaccaagagtaattgaagatttttcgtatgatataaattttcctaaccaagcaattacgcatcatttggcaaaaattgaagcgtataaaagaattaaagggtttggaaaattatcggttcaatatgatttacaaattaatagacgacaagagttgattaagaagaggagattaaaaaatacgccagtatcgctccggccataa

SEQ ID NO: 23480 - protein, 281 aa, Unknown
  Obtained from environmental sample
  misc_feature (1)..(281): Xaa is any amino acid
MKKAAIDNFTDKSLGDALSTLSGVSSLNTGNSIVKPMIHGLHSSRLLLINNNVRMFDQEWGDEHAPNIDINASEKITVVKGANTLKYGSDAIGGLILIEPKKYAVKDSLFGSTISSFNSNGFGGNINSEIVKTYKSGLYAKLQANYKQFGDFKAPDYYLTNGGLKSINTSFRIGYNGYEKGFSAYYSFVDNEFAILQSSHIGNVNDLVNSINNREPRVIEDFSYDINFPNQAITHHLAKIEAYKRIKGFGKLSVQYDLQINRRQELIKKRRLKNTPVSLRP

SEQ ID NO: 23481 - DNA, 696 bp, Unknown
  Obtained from environmental sample
  misc_feature (1)..(696): n is a, c, g, or t
ttggttaatacgtttagtctttnatcgagagaacgggagcttcatatatacgcgccaaaaggattaaaagaagtgataacacttcaaatgaaattatctagtagttggacgagttatcctctattttttcatgaattaagttctaaacaatcagaattaatttatgaagatgataaagttgaagtatatactattccattaaaacatcgtatctataccaacggtnttctattcaaggagaaagaaaatgaacgtaaattagatattaatgctgttaatgaagctaatatagataaggcttattatagaaaattgaaacaaggatttgacgttgagaatgaagatggtattttaattagtaacgcaaaagtgacaaaagacccttcgccagctaaaagttatgctttttgtagtgatacggtttataatgaagatataattccactaattaaagactgtacagttttgtatcacgaatcgacattcttagataaaaacgaatcactttgtataccaacaaagcatagtacagcaagacatgcggctacgatagctaaaaaagcaaatgtaggtacattaatactcggacattattctacacgttacaatggctacgatgagtttaaaacagaagctcaaactgtttttgataatgtgcttttagcgaaagatggtaaagtgtttgattttagctaa

SEQ ID NO: 23482 - protein, 231 aa, Unknown
  Obtained from environmental sample
  misc_feature (1)..(231): Xaa is any amino acid
MVNTFSLXSRERELHIYAPKGLKEVITLQMKLSSSWTSYPLFFHELSSKQSELIYEDDKVEVYTIPLKHRIYTNGXLFKEKENERKLDINAVNEANIDKAYYRKLKQGFDVENEDGILISNAKVTKDPSPAKSYAFCSDTVYNEDIIPLIKDCTVLYHESTFLDKNESLCIPTKHSTARHAATIAKKANVGTLILGHYSTRYNGYDEFKTEAQTVFDNVLLAKDGKVFDFS

SEQ ID NO: 23483 - DNA, 369 bp, Unknown; identical to SEQ ID NO: 21935
  Obtained from environmental sample
  misc_feature (1)..(369): n is a, c, g, or t

SEQ ID NO: 23484 - protein, 122 aa, Unknown; identical to SEQ ID NO: 21936
  Obtained from environmental sample
  misc_feature (1)..(122): Xaa is any amino acid

SEQ ID NO: 23485 - DNA, 360 bp, Unknown
  Obtained from environmental sample
  misc_feature (1)..(360): n is a, c, g, or t
atgagcatccgcgtaggcgaagttattgcagtacatggtaccaagctagttcttaaaatcgacgagcagtctagcaaagaaactcttttctacgagggtgacaaatacaagggagtgtcgatccgcgagtacctgtcaatccagcgtggattccgcgacattatttgcacggtcgagggggaattcttggacgaaagccggacagagttccgcgacggcnagcaaacctttgtccgaaaagtagaggcaagacccataggctacttcgaccaaactggttttaccaaggcatcaagtttctgccaaatgatcaagacactgcccacctgttgtccgaagaaggatcagatccatctttga

SEQ ID NO: 23486 - protein, 119 aa, Unknown
  Obtained from environmental sample
  misc_feature (1)..(119): Xaa is any amino acid
MSIRVGEVIAVHGTKLVLKIDEQSSKETLFYEGDKYKGVSIREYLSIQRGFRDIICTVEGEFLDESRTEFRDGXQTFVRKVEARPIGYFDQTGFTKASSFCQMIKTLPTCCPKKDQIHL

SEQ ID NO: 23487 - DNA, 834 bp, Unknown
  Obtained from environmental sample
  misc_feature (1)..(834): n is a, c, g, or t
ttgggagggcgttacaaagacccattggccgaacttgttaaaattgatgcacaatctattggtgtaggacaataccaacacgatgtggaccaaacaaagcttcaaaaatcgctggatatggttgtagaaaactgtgtgaatgctgttggggttaatataaatactgccagtaatagtttactgagttatgtgtctggtatcggaccaaaattagccgaaaacatcttgaactatcgtcacgaaaacggcacattctcttcgagaaaagaaattaaaaaagtagcgcgattaggagacaaagcgttcgagcaaagcgctccatttttaagaataaaagacgctaaaaatccgctagatgattctgctgtccatccagaaagctatgctattgtaaaagaaatggctaaagatttaaacgttactgttaaagaactcattggtaattcggccttattaaaacaactcaacttaaaaaaatattgtaacggttcggtgggattattaacgttggaagacattgttaaagaattagaaaaaccaggtttagatattagagaacaagcaaaagtttttacatttaatcaaaacattaaaaccataaccgatttacaagtagggcagttattaccaggtatcgttaataacatcactaattttggatgttttgtagatgtaggaattaaagaaagtggtttaatacacgtgtctaatttaagcgatagttttgtaaaagacgttaatgaacacgtgagtttacatcaacaaatactagttaaagtattggaagtagatgttcccagaaaacggattcaacttcaattgcataaaaaataa

SEQ ID NO: 23488 - protein, 277 aa, Unknown
  Obtained from environmental sample
  DOMAIN (202)...(275): S1 RNA binding domain
  misc_feature (1)..(277): Xaa is any amino acid
MGGRYKDPLAELVKIDAQSIGVGQYQHDVDQTKLQKSLDMVVENCVNAVGVNINTASNSLLSYVSGIGPKLAENILNYRHENGTFSSRKEIKKVARLGDKAFEQSAPFLRIKDAKNPLDDSAVHPESYAIVKEMAKDLNVTVKELIGNSALLKQLNLKKYCNGSVGLLTLEDIVKELEKPGLDIREQAKVFTFNQNIKTITDLQVGQLLPGIVNNITNFGCFVDVGIKESGLIHVSNLSDSFVKDVNEHVSLHQQILVKVLEVDVPRKRIQLQLHKK

SEQ ID NO: 23489 - DNA, 624 bp, Unknown
  Obtained from environmental sample
  misc_feature (1)..(624): n is a, c, g, or t
atgaacgaggatggtacgatggcacgtttaccacaattaatgaaagtagccaaaaagttcgatcttaagattgtatctatagaagatttgatcgcttaccgaatggaatatgattcgttaattgaaaagaaagaagacttcgatattgaaactcgtttcggaaattttagacttagagcctatttacaaactacaaataatcaaattcatattgccttaacaaaagggacttggaaatctgatgaaccagtcttaactcgtgttaacgctacattggttaacaatgatattttaggtactttaactaataatgcagaccaaaagttagatgatatgtttaatgttatcaatactgaaggaaaaggtgctattatatttatcaaccagcaagctgagtctatgaacttgttaactcgcttatctattcttaaagaaaaccaagttgcaggaaaattagttaaagctccaagtattggtatggattctaaagattttggtatcggtgcacaaatattacacgatcttaaggttagtaaacttaaattaatatctaacagtctccaaaccaaacgtgttgggatgattggatatggtttggagattgttgagtatgtacaatattaa

SEQ ID NO: 23490 - protein, 207 aa, Unknown
  Obtained from environmental sample
  DOMAIN (39)...(207): GTP cyclohydrolase II
  misc_feature (1)..(207): Xaa is any amino acid
MNEDGTMARLPQLMKVAKKFDLKIVSIEDLIAYRMEYDSLIEKKEDFDIETRFGNFRLRAYLQTTNNQIHIALTKGTWKSDEPVLTRVNATLVNNDILGTLTNNADQKLDDMFNVINTEGKGAIIFINQQAESMNLLTRLSILKENQVAGKLVKAPSIGMDSKDFGIGAQILHDLKVSKLKLISNSLQTKRVGMIGYGLEIVEYVQY

SEQ ID NO: 23491 - DNA, 801 bp, Unknown
  Obtained from environmental sample
  misc_feature (1)..(801): n is a, c, g, or t
ttggcctttgcctgtattattctcttttttgtgggagcaccactaggagctttaattcgtaaaggtggacttggattaccaatggttatagcaattgtcttatttttaacctatcatttctttggtatttttgccaaaaatacggcagaaaaaggaagctttagtccaataattggtacatggttatccactgctgtgatgttacctcttagtatttatttaaccacacgtgctacaaatgataaaggtgtatttgaatttgatgccattatagttcctttaaaacgcttatttacttcaaagaataaattagtactttcagaaagcgatacaaagacctttaattattataaaagatactccattgaggaacttattgctattataaagaagcaagatgaattcgatttagacaaaaaacctaaagaaattgcacttcataatttgttagaccgaaaaattccactagaaggattaaaatctgaaggattaacaattccagataatctcattaaagcaagagttctactaaaagattataaagattactccaaaacaagtttagtgagttatggtattggtgttgttttactggtattacattttgtgtttaagaataataaattacaggaaatagcagaatcgtctttaagtttaagtattatcgcttttatattctttgctatatatgtaatcgttgatgccttcgtgtattcaaattctacaaactataaatcaagaggtaaaagattaatccctctatataatcttaacccttcactctaccctttaaatacgtga

SEQ ID NO: 23492 - protein, 266 aa, Unknown
  Obtained from environmental sample
  misc_feature (1)..(266): Xaa is any amino acid
MAFACIILFFVGAPLGALIRKGGLGLPMVIAIVLFLTYHFFGIFAKNTAEKGSFSPIIGTWLSTAVMLPLSIYLTTRATNDKGVFEFDAIIVPLKRLFTSKNKLVLSESDTKTFNYYKRYSIEELIAIIKKQDEFDLDKKPKEIALHNLLDRKIPLEGLKSEGLTIPDNLIKARVLLKDYKDYSKTSLVSYGIGVVLLVLHFVFKNNKLQEIAESSLSLSIIAFIFFAIYVIVDAFVYSNSTNYKSRGKRLIPLYNLNPSLYPLNT

SEQ ID NO: 23493 - DNA, 921 bp, Unknown
  Obtained from environmental sample
  misc_feature (1)..(921): n is a, c, g, or t
atgttcaaagaaaggcggaagcctctaaagagacttcaggtattaaaaactcccaattttagtccttacatccacaaccctgttaattttgaaatactaattgacaaatgtcttgagcccaatttatataatgcgcgggtattaattgattttctcaaaatagctaaaaagaaaaaactagatgattatcctgttcatataaaatttaatactggattgaatcgattaggattttccaagaatgatattgatcatataattaatagtttagcaaacgctcctcaagtaaaagttaagtcattattttcacatttagcagcatcagaagataaaaacgaagaggaatttacgcatcaacagatacgatcttttatagctattgctacagaatttactcaaaagattgggtataagcctatgttacatcaattaaatacctccggtgtgctgaactatccaaacgctcaatttgatatggtgcgttgcggaatagggttgtatggctttggtaatgatcctaattatacaaggcaccttaaacttgttgcagcattaaaaagtattatttcgcaaattcatttcatagaacctaacgagagtgtaggatataatagggcatttaaatctactaaacccacgaaaacagcaacaattcccattggtcatgccgatggaattcatagggcatttgggaatggaaaaggatatgttaccataaaaggcaaaaaggcacccatcgttggtaatgtctgtatggatatgctaatggtaaatatttcagatattgattgtaaagaaggagatgaggtggttatttttgataatcaagaaactgttaatgatttagcccaaaggattgataccatatcttatgaaattttaacggctatttcacaacgtgttaaaagaatcgttaaataa

SEQ ID NO: 23494 - protein, 306 aa, Unknown
  Obtained from environmental sample
  DOMAIN (2)...(172): Alanine racemase, N-terminal domain
  misc_feature (1)..(306): Xaa is any amino acid
MFKERRKPLKRLQVLKTPNFSPYIHNPVNFEILIDKCLEPNLYNARVLIDFLKIAKKKKLDDYPVHIKFNTGLNRLGFSKNDIDHIINSLANAPQVKVKSLFSHLAASEDKNEEEFTHQQIRSFIAIATEFTQKIGYKPMLHQLNTSGVLNYPNAQFDMVRCGIGLYGFGNDPNYTRHLKLVAALKSIISQIHFIEPNESVGYNRAFKSTKPTKTATIPIGHADGIHRAFGNGKGYVTIKGKKAPIVGNVCMDMLMVNISDIDCKEGDEVVIFDNQETVNDLAQRIDTISYEILTAISQRVKRIVK

SEQ ID NO: 23495 - DNA, 537 bp, Unknown
  Obtained from environmental sample
  misc_feature (1)..(537): n is a, c, g, or t
atgcaagatacatctaaacaatatgatgctgtaattgaaggttgcagaagtttattcatcaaaaaaatgtctgattatggttctgcttggcgaattttacgcttgccatcattaacggatcaaattttcatcaaagcacaaagaattagacagttgcaagaaaatgaggtaagaaaagtagatgaaggagaaaaatctgaatttattggcattatcaattattcaataatggcacttattcaattagaaaaaggtgttgtggaaaatcctgatttaaccactgaacaagcaacaattttatacgataaacacagcaaaattaccaaagaattaatgatgaataaaaatcatgattatggtgaagcttggagagaaatgcgtgtttctagtttaacagatttaattttacagaaattattacgcgtaaaacaaattgaagataataaaggaaaaacaatcgtttctgaaggaattgatgccaattatcaagacatgattaattacgctgtttttgcgatgattcatttagaaaagtaa

SEQ ID NO: 23496 - protein, 178 aa, Unknown
  Obtained from environmental sample
  DOMAIN (22)...(82): Domain of Unknown Function (DUF1599)
  misc_feature (1)..(178): Xaa is any amino acid
MQDTSKQYDAVIEGCRSLFIKKMSDYGSAWRILRLPSLTDQIFIKAQRIRQLQENEVRKVDEGEKSEFIGIINYSIMALIQLEKGVVENPDLTTEQATILYDKHSKITKELMMNKNHDYGEAWREMRVSSLTDLILQKLLRVKQIEDNKGKTIVSEGIDANYQDMINYAVFAMIHLEK

SEQ ID NO: 23497 - DNA, 498 bp, Unknown
  Obtained from environmental sample
  misc_feature (1)..(498): n is a, c, g, or t
gtggttaaggttttagattctaagacttatttttttaaattattcaaaagttatcataccaactattacttcaaaattattgatttacaagttgataaggattggttttctgttatggtttataaaactataaatgaagttaatcgaaccgattatcctgatttgtatgactatattgataaaataatcggaaaaataataaataatcaagccaactataataatccttctaaagcatttctgattcaaattttaaggatttacactaagaaatttaaatggattgaattaattaaaactaaaaagttactgggattaattgatgattttaatctaaaagttgaagacatttatattccgcgaataagcatgcaacataaatctcttacagatattgagaataatttgttacgccaaaacaaggattacaaagttttttataaagcattaaataataaaatttcttattgttttagtaaaagaaataatgataattaa

SEQ ID NO: 23498 - protein, 165 aa, Unknown
  Obtained from environmental sample
  misc_feature (1)..(165): Xaa is any amino acid
MVKVLDSKTYFFKLFKSYHTNYYFKIIDLQVDKDWFSVMVYKTINEVNRTDYPDLYDYIDKIIGKIINNQANYNNPSKAFLIQILRIYTKKFKWIELIKTKKLLGLIDDFNLKVEDIYIPRISMQHKSLTDIENNLLRQNKDYKVFYKALNNKISYCFSKRNNDN

SEQ ID NO: 23499 - DNA, 783 bp, Unknown
  Obtained from environmental sample
  misc_feature (1)..(783): n is a, c, g, or t
atgggaaagataacaggatttttagaatacgaaagagtagatgaaccttatataacggttgagaaacgcttagaaaattataaggaatttaccattccgttagaggagaaaaaactaaaagatcaaggcgcacggtgtatggattgtgggattcctttttgccatagcggctgtccgttagggaatctcattccagattttaatgataaagtgtataaaggccgatggaaagaagcggcgcaaattttacattccaccaacaacttccctgaatttacgggtagattatgtcctgcaccctgtgaagaggcctgtgttttaggcatcaatgaagatccagtttccatagaaaatatcgaaaaaaacatcgttgaaaaagcgtttgaagaaggttggattacggcacatccaccaaaaacaagaaccgataaaaaagtagcggtaattggttcaggacctgcagggttggcagcggcacaacaacttaatagagcaggccatttggttactgtttttgagcgcgatgccaaagtaggcggtttattgcgttatggcatccccgattttaaactggaaaaacagattattgatagacgtgttgctgtacttgaagaagaaagtatcccatttaccaccnatgctcacgttggtcaaaacatcagtgtagaaaccataaaagccgattttgatgctgtcgtattgtgcggcggaccactgaaagaaggagaattccctataaaggtaatccacctgaaaggtgtcctcaggctatggatttcttaa

SEQ ID NO: 23500 - protein, 260 aa, Unknown
  Obtained from environmental sample
  misc_feature (1)..(260): Xaa is any amino acid
MGKITGFLEYERVDEPYITVEKRLENYKEFTIPLEEKKLKDQGARCMDCGIPFCHSGCPLGNLIPDFNDKVYKGRWKEAAQILHSTNNFPEFTGRLCPAPCEEACVLGINEDPVSIENIEKNIVEKAFEEGWITAHPPKTRTDKKVAVIGSGPAGLAAAQQLNRAGHLVTVFERDAKVGGLLRYGIPDFKLEKQIIDRRVAVLEEESIPFTTXAHVGQNISVETIKADFDAVVLCGGPLKEGEFPIKVIHLKGVLRLWIS

SEQ ID NO: 23501 - DNA, 366 bp, Unknown
  Obtained from environmental sample
  misc_feature (1)..(366): n is a, c, g, or t
atgcccattgtaaagcctttcaaagcatggagacctaaccctagatccgctagcgaaatcataagtgtcccttatgatgtgattaatactgaagaagcgagagagctagcccaaaacaaaccctatagctttctacatgtaatcagaccagaaataggtctttctgaagatactgatatacactcagaaaaagtctatcaaaagggaaaagagaatctagattcgattttaagctcttctgaatttttacaagaggataaggatgcactttatttatataaattgatttggagaggaagatctaaatcgggaatatttgggtgcataagcactagtgaatatgatgaaggtctcgagccgatctga

SEQ ID NO: 23502 - protein, 121 aa, Unknown
  Obtained from environmental sample
  misc_feature (1)..(121): Xaa is any amino acid
MPIVKPFKAWRPNPRSASEIISVPYDVINTEEARELAQNKPYSFLHVIRPEIGLSEDTDIHSEKVYQKGKENLDSILSSSEFLQEDKDALYLYKLIWRGRSKSGIFGCISTSEYDEGLEPI

SEQ ID NO: 23503 - DNA, 327 bp, Unknown
  Obtained from environmental sample
  misc_feature (1)..(327): n is a, c, g, or t
atgatttttggatatgctagggtaagtactaacgaacaaaatctcgacttgcaaattgatgtctttttgaaagaaggaattaaggttaaaaacatttatgctgataaggtttcaagcactaaagaagaacgcaaaaacctaagcaagcttttagactttgtcagggaaggagataccattgtagtttggaaactggaccgtttggccagaagtctcattcattttacgaattacatcaatcagctcaatgaaaaaggagtgaagttcaaaagtatcaccgaaccttttttggataccaccgacaagtcttcacactcccaattttag

SEQ ID NO: 23504 - protein, 108 aa, Unknown
  Obtained from environmental sample
  DOMAIN (2)...(108): Resolvase, N terminal domain
  misc_feature (1)..(108): Xaa is any amino acid
MIFGYARVSTNEQNLDLQIDVFLKEGIKVKNIYADKVSSTKEERKNLSKLLDFVREGDTIVVWKLDRLARSLIHFTNYINQLNEKGVKFKSITEPFLDTTDKSSHSQF

SEQ ID NO: 23505 - DNA, 564 bp, Unknown
  Obtained from environmental sample
  misc_feature (1)..(564): n is a, c, g, or t
ttgcctccggataaatacactccatacggttacaataatagaaatgagtattacctgaaaaattggtatttaacccctgctgtttttgatggtaaatggcatttatattccaataaagatctcgaggatttatatactgatattacccgaacaacagtgaatttcatatatcctgaaaatctgtatttggctaccaattacagaagcttcggtatttcgaaattcccaggtggtcaacaagtgcagttggaagccatacaacagaagaattgcgaaattcttctaagcccattcaagaagtttactacacacgttacccctcatatgacaatggtaacagatattgatgcttccaaatatgataaaattgcccaagggatttcgattaacaaagtagcaaaattcatatttgaaaatctaggtgaataccctcattctcagttattggtcagtaataaggactatagtataaatcctttatatggcattaaccaattaccctcttttgtaagaccttatgaggaaacattttcatttgaaatgaaattccttaaaacggcttga

SEQ ID NO: 23506 - protein, 187 aa, Unknown
  Obtained from environmental sample
  misc_feature (1)..(187): Xaa is any amino acid
MPPDKYTPYGYNNRNEYYLKNWYLTPAVFDGKWHLYSNKDLEDLYTDITRTTVNFIYPENLYLATNYRSFGISKFPGGQQVQLEAIQQKNCEILLSPFKKFTTHVTPHMTMVTDIDASKYDKIAQGISINKVAKFIFENLGEYPHSQLLVSNKDYSINPLYGINQLPSFVRPYEETFSFEMKFLKTA

SEQ ID NO: 23507 - DNA, 366 bp, Unknown
  Obtained from environmental sample
  misc_feature (1)..(366): n is a, c, g, or t
gtgctgacgtttaaagtgttgggcgctacaaaagcatataaattattaccaactcaactgttatctaatttagacttattaaccaaatttgcctttggggaaactgtaacgaagcgtgtggagttgtataaaaaatatttatcagtaaacgataaaaaatatttagattgggcgatagagcatatggtatgttggaatcaaagtgaagcgataccacaaaccattcatatacacggtgatgcagaccttgtttttcctcatcattatttgggcgattgtatcactattaaaggcggcacacatattatgatattaaataagtacaaatggtttaacgagaatttgccaaagctaattttaggttaa

SEQ ID NO: 23508 - protein, 121 aa, Unknown
  Obtained from environmental sample
  misc_feature (1)..(121): Xaa is any amino acid
MLTFKVLGATKAYKLLPTQLLSNLDLLTKFAFGETVTKRVELYKKYLSVNDKKYLDWAIEHMVCWNQSEAIPQTIHIHGDADLVFPHHYLGDCITIKGGTHIMILNKYKWFNENLPKLILG

SEQ ID NO: 23509 - DNA, 900 bp, Unknown
  Obtained from environmental sample
  misc_feature (1)..(900): n is a, c, g, or t
ttgcttagtactaaactgtctgaggcgaataagatgctgattgatttgcaatcgagcaaaaaggatatatcggccaatcaaataaaagagaaactttatgcttcttccgaatcagttacttttttcgaagtagcacaagattttcttgatgatttagaggcaaatgaaaagctgtctaggctttcaacagataaagcaagaattaatcacgttttaaaatttaccacatcaaagcagcttacctttcaagaaattgatgaaaattttttaaagaaatttaaaacctacctccgtaaaaaacacaacctatcagaaaggtcgatagtaaataatcttattgtgattagaactatctataacagagccattaaattgggtatcgtagatagaaaactttacccattcggttcagataaaatacggattaagttccctgaaaccgaaaaaataggccttaccaaaaatgaggttataaaacttgaatccgttgaaaatttgaccgacaacgagactcacgctagaaatgtttggcttttcagtttttattttgctggaattcggatagctgatgtattgaaaattcgttgggccgatatttatgacaacaggcttcattatcgaatgaacaagaattcaaaactgttatcccttaaaattccagataaaatatttccgattttggaatactatcaggacagtaaacaaaatgatgatgattttatattcccagaaatgaaaaaggcaaatttacaagatgcaaaggatgtttatgctaaaacaaaaacggccaacaagaaattcaacaaatatttggtaacggtagctgataaagctaaaatatcaaaaaaagtaactatgcacattgctagacatacatttgggaatatatcggaaagataa

SEQ ID NO: 23510 - protein, 299 aa, Unknown
  Obtained from environmental sample
  misc_feature (1)..(299): Xaa is any amino acid
MLSTKLSEANKMLIDLQSSKKDISANQIKEKLYASSESVTFFEVAQDFLDDLEANEKLSRLSTDKARINHVLKFTTSKQLTFQEIDENFLKKFKTYLRKKHNLSERSIVNNLIVIRTIYNRAIKLGIVDRKLYPFGSDKIRIKFPETEKIGLTKNEVIKLESVENLTDNETHARNVWLFSFYFAGIRIADVLKIRWADIYDNRLHYRMNKNSKLLSLKIPDKIFPILEYYQDSKQNDDDFIFPEMKKANLQDAKDVYAKTKTANKKFNKYLVTVADKAKISKKVTMHIARHTFGNISER

SEQ ID NO: 23511 - DNA, 822 bp, Unknown
  Obtained from environmental sample
  misc_feature (1)..(822): n is a, c, g, or t
atgttcgatttgtacgttttaaaccttcagcttttggtggaagttcaaaaactagcagcaaaaagattggcactttctaaaaagaaaattcttgccacaaaagaagatctaaagcccaacacaaaatttatcgataataaattaatcaatcttattgcagaaagcataagtattgaaagttatattgaaacaaacagtttaaataattgggaattagatagtgaatacgtgaaaattattttagatgaattgcaaaaaagtgatttatataaaaaatatttagacactgtagaagactcttataaagttgatcaagcttttattgttaactttttcaaagaaataattgctcctaatgaaaagttagcagattattatgaagacatgatgatttcttgggttgatgatattccttttgtaaacacatggattgttaggtctttaagcaaacaaaaagcaagtaatagttttacgctaggtgttttgtataaagattcagatgatgaagcttttgtaagcaaactgtttagaaaaactgttctaaaacagcataattacgaacaagatattgccgataaaactccaaattgggaaactgataggattgcagatattgacatgattcttattaaaatggcaataacagagtttattgagtttccatctataccaacaagagtaactattaacgaatacatagaaattgcaaaagattactcaacagtaaaaagtagttattttattaatggagtattagataaaatttctaaagaacttacaaatgataaaagaattgttaaaataggtagaggtttgttgtaa

SEQ ID NO: 23512 - protein, 273 aa, Unknown
  Obtained from environmental sample
  DOMAIN (144)...(259): NusB family
  misc_feature (1)..(273): Xaa is any amino acid
MFDLYVLNLQLLVEVQKLAAKRLALSKKKILATKEDLKPNTKFIDNKLINLIAESISIESYIETNSLNNWELDSEYVKIILDELQKSDLYKKYLDTVEDSYKVDQAFIVNFFKEIIAPNEKLADYYEDMMISWVDDIPFVNTWIVRSLSKQKASNSFTLGVLYKDSDDEAFVSKLFRKTVLKQHNYEQDIADKTPNWETDRIADIDMILIKMAITEFIEFPSIPTRVTINEYIEIAKDYSTVKSSYFINGVLDKISKELTNDKRIVKIGRGLL

SEQ ID NO: 23513 - DNA, 912 bp, Unknown
  Obtained from environmental sample
  misc_feature (1)..(912): n is a, c, g, or t
ttgcaaaagcgatgcagaaatgatgaagaaacttttgagtcgaattatattgcagttgttcaaggcggtagagaaacaaatacaatcctgtttaatgaacgctttgatattattttctttactggtagttcaaaagttgggaaagtcgtaatgaaagcagcagcagaacacttatcaccagtagtattggaattaggaggcaaaagcccttgtattgttgatgctgatgcaaacattgatgttgcagcaaagcgtattgcttggggcaaattgataaatgcaggtcaaacttgtatagcaccagattacctttttgctcatcattctattaaagaggaattattggataaaattgccaagaacataaaagaaatgtatggcaatgatattaaagaaagtcgattctatccccgtattgtaaatcaacgagcaattgacaggttagaaaagttgatgaaccaagggaaaatacattcaggtggagaaattgatgaaaaagaaagatttattgcaccaacaattattgataatgtaaaacctgattttttgattatgcaagaagaaatatttggcccaattttaccagtaatgacttttgagcatattgatgaaactatcgaatacatcaataaaaatgaaaagccattagctttttactattttggaaaaaataaggatgccataaatgttttagcaagaacaacatctggtggtgcttgtattaacgacaccctgatgcatataaccaatcataatttaccttttggtggtgttggcaatagtggactgggaaaatatcacggaaaagaaagctttttagcttttagcaatcaaaaagcagttgtttccacaccaacgtggatagatttacctttaaaatatgcgccttttaagtattttaatttaatatag

SEQ ID NO: 23514 - protein, 303 aa, Unknown
  Obtained from environmental sample
  DOMAIN (2)...(285): Aldehyde dehydrogenase family
  misc_feature (1)..(303): Xaa is any amino acid
MQKRCRNDEETFESNYIAVVQGGRETNTILFNERFDIIFFTGSSKVGKVVMKAAAEHLSPVVLELGGKSPCIVDADANIDVAAKRIAWGKLINAGQTCIAPDYLFAHHSIKEELLDKIAKNIKEMYGNDIKESRFYPRIVNQRAIDRLEKLMNQGKIHSGGEIDEKERFIAPTIIDNVKPDFLIMQEEIFGPILPVMTFEHIDETIEYINKNEKPLAFYYFGKNKDAINVLARTTSGGACINDTLMHITNHNLPFGGVGNSGLGKYHGKESFLAFSNQKAVVSTPTWIDLPLKYAPFKYFNLI

SEQ ID NO: 23515 - DNA, 450 bp, Unknown
  Obtained from environmental sample
  misc_feature (1)..(450): n is a, c, g, or t
atgggtttttttaagaaaattgataaagtattcaaatcatcagaaagttttaatttgatggaaagaacagaagtagatcttcaaattgaagaaaatataaaaactgttggcatcaataaatttgcaacttccaaatatggagatttatatttaagagtaaatgaattaggaggttttttaattttggaaacaattattgtaagtgcaactgacttgaaaagcaaaaaaggaagttcgttaacatttagcaatgaaaatgcaattttaaaattagcttctgatgaaaacaaaattgaatctgatttttctaaatccgtaaataaatctgtcacaaaaatagattacaatattactactgaagaagctgaatattttaaggaacctacttataatgaagttagttttaaaattaatggaaatgaaattttattctctataattaacgaataa

SEQ ID NO: 23516 - protein, 149 aa, Unknown
  Obtained from environmental sample
  misc_feature (1)..(149): Xaa is any amino acid
MGFFKKIDKVFKSSESFNLMERTEVDLQIEENIKTVGINKFATSKYGDLYLRVNELGGFLILETIIVSATDLKSKKGSSLTFSNENAILKLASDENKIESDFSKSVNKSVTKIDYNITTEEAEYFKEPTYNEVSFKINGNEILFSIINE

SEQ ID NO: 23517 - DNA, 624 bp, Unknown
  Obtained from environmental sample
  misc_feature (1)..(624): n is a, c, g, or t
ttgcaataccattccgcatccctcaaatgctatcgatttaagcgatataatggcaaaagaggtaaagaaattaatgcatcatatatgagaaaaaagggcttcatattactattaatcttattcagcatatcaatgaatggacaaactgaaatgctcatcgggcagatttcaggcagatctattgttcgagaaaatttcgatgaagaaggtgcttttctcaataaacaaacttttgaagctggtgaaacaataaagaaaaatgaatattacgaaattaaggtggttacggaattgtttgataaagacaaaaaatccaccgataaatatacaacgacctatcgctgtaagcctgatgaagccagtgtaatggtaatggcatttccattttcaaacccaaaattaaaagaaactgagatcaataccacttctgaaaattttaaagagctatacgatttggaaaacttggaagaaatagaactggaaatgagttttgactcgggtctgctgattttttttggttcaaaaagcattataaaaatttacgaccgaacattggaaagcaacaaaaaccatattaattcaaaaataaatattaaggcctatgcgtggggaaattcgcattaa

SEQ ID NO: 23518 - protein, 207 aa, Unknown
  Obtained from environmental sample
  misc_feature (1)..(207): Xaa is any amino acid
MQYHSASLKCYRFKRYNGKRGKEINASYMRKKGFILLLILFSISMNGQTEMLIGQISGRSIVRENFDEEGAFLNKQTFEAGETIKKNEYYEIKVVTELFDKDKKSTDKYTTTYRCKPDEASVMVMAFPFSNPKLKETEINTTSENFKELYDLENLEEIELEMSFDSGLLIFFGSKSIIKIYDRTLESNKNHINSKINIKAYAWGNSH

SEQ ID NO: 23519 - DNA, 426 bp, Unknown
  Obtained from environmental sample
  misc_feature (1)..(426): n is a, c, g, or t
ttgggagaaatgaataagataatcgaaaatatcgccaattggttggtcgccttgaaggagagaaaagacaaaatccaccagaacattaatgcctttatgagacgaggaaataatggaccgatcgtaggggctgtcgtttttgggactattgccgttctttcatccattaatctttacaaagaacacggcaaactttggcttgccctgccttccatttgtttattgatacttttcttttttgggatcatggtatcggatgcttataaagagaaagtgaagtacccaagcccgagttcacaaatgaaacctgggcggtttccatatggattttcaaggagcgggttctttaaagggatctatgggtcccttgaccccattagtaatatccgggacgaaaacctaacaagctttctccattttttatga

SEQ ID NO: 23520 - protein, 141 aa, Unknown
  Obtained from environmental sample
  misc_feature (1)..(141): Xaa is any amino acid
MGEMNKIIENIANWLVALKERKDKIHQNINAFMRRGNNGPIVGAVVFGTIAVLSSINLYKEHGKLWLALPSICLLILFFFGIMVSDAYKEKVKYPSPSSQMKPGRFPYGFSRSGFFKGIYGSLDPISNIRDENLTSFLHFL

SEQ ID NO: 23521 - DNA, 564 bp, Unknown
  Obtained from environmental sample
  misc_feature (1)..(564): n is a, c, g, or t
ttgtttattatgatgatatctaaaaccataaaaatattaaatgaatctaaaactatcctctatccaacagatactgtttgggggattggatgtgatgctacttgtgaaaaagcagtagaaaaaatatatttaataaagcgacgctctgaaagtaagagtttgattattttggtagattcttgggagatgctgctcaattatgttaatatgattccagaaaaagtaaattgtattcttacaggttcatctaaaccaactactgttatttacaacaatccacaagggttggctaaaaatgtgattgccaatgacaatacagttgctattagaattgtaaatgatgggtttgcccatgaattgattcaacaatttggaaaaccaatagtttctacatcagcaaatatctctggagaatccaatccaaaatctttcaaagaaataaatcctacacttttggatagcgtagattatatcgtaaatttgccccttgaaaataaaagtggaattgcctctcaaattgtgaaagttcacaatagtggcaaaatcgaatttttgagaaagtaa

SEQ ID NO: 23522 - protein, 187 aa, Unknown
  Obtained from environmental sample
  DOMAIN (11)...(180): yrdC domain
  misc_feature (1)..(187): Xaa is any amino acid
MFIMMISKTIKILNESKTILYPTDTVWGIGCDATCEKAVEKIYLIKRRSESKSLIILVDSWEMLLNYVNMIPEKVNCILTGSSKPTTVIYNNPQGLAKNVIANDNTVAIRIVNDGFAHELIQQFGKPIVSTSANISGESNPKSFKEINPTLLDSVDYIVNLPLENKSGIASQIVKVHNSGKIEFLRK

SEQ ID NO: 23523 - DNA, 318 bp, Unknown
  Obtained from environmental sample
  misc_feature (1)..(318): n is a, c, g, or t
ttgaactgtgttttagaatctaacaacaacgctaaatctcttttcacagatggaaatttagaaatctcagaaactttcaattgttttttacttgctaattttaaaatattatcccaattaaaatctgcaaataatacttcttgcttaattccgaattcttttaaaattgatcttttaacaactccaaattctgctactttaattttacctaagcttaaagcaattccctcagaaaatatatcgtttttagttggcgaagttttaaaaccactaattcctaatctttctaaaactgatgctataattccttttacataa

SEQ ID NO: 23524 - protein, 105 aa, Unknown
  Obtained from environmental sample
  misc_feature (1)..(105): Xaa is any amino acid
MNCVLESNNNAKSLFTDGNLEISETFNCFLLANFKILSQLKSANNTSCLIPNSFKIDLLTTPNSATLILPKLKAIPSENISFLVGEVLKPLIPNLSKTDAIIPFT

SEQ ID NO: 23525 - DNA, 378 bp, Unknown
  Obtained from environmental sample
  misc_feature (1)..(378): n is a, c, g, or t
atgtcatccatttttacaaaaatagtaaacggagaaattccgtgttataaagtagccgaaaccgaagattttttagccttcttagatgttaatcctaatgctaaaggacataccttatgtattcctaanaaagaagtaaataaactttttgatttagaccaaaccacttatactcagttaatgctattttccagaaaagtggcaatagctttagaaaaagctgtgccttgtaaacgtgntggtgtaagtgtaattggtttagaagtaccacatgtacatgtgcatttaataccattaaataccatggaagacgcagggtttataataaagtggctttaccaaaagaagattttgaggcttagcaaaagcaattgctgg

SEQ ID NO: 23526 - protein, 126 aa, Unknown
  Obtained from environmental sample
  DOMAIN (3)...(102): HIT domain
  misc_feature (1)..(126): Xaa is any amino acid
MSSIFTKIVNGEIPCYKVAETEDFLAFLDVNPNAKGHTLCIPXKEVNKLFDLDQTTYTQLMLFSRKVAIALEKAVPCKRXGVSVIGLEVPHVHVHLIPLNTMEDAGFIIKWLYQKKILRLSKSNCW

SEQ ID NO: 23527 - DNA, 597 bp, Unknown
  Obtained from environmental sample
  misc_feature (1)..(597): n is a, c, g, or t
atgaccagactcctatctatgtatacaaaacaaagcacgatgataaaaaacaaattacatggtgaggaagttttagggtatccaagtaaagcggttgtacaatctttgaaacgtagtttaaaacaggttcaaaaagaaatgaaaaccttggaggacaaactcctgatattagttaaagaaatgcatcaagatgtattaacccgcttaaaaagtattccagggattggaaacaaaaccgcattaatgttagttgttcttacggatggttttgagcgttttaatagcggaagtgagttgtgtagttatgcgggtttaacgcctgtaattagaaagagtggaagcagtgtaaaaggacgacctcgaatcagcaagataggcaatcaaaggctgcgtaatttattatttatgtgcagttttaatgcttgtaaatacaacaaggcttgcagagaaatttacgaacgaattgttgccaagggtaagagtaaaaaattagcattaattgcagtctgtaataagctgttaaaacaggcttatgctattgcaaaatcaggattaatatatgatgacacttatagaagtactttagtgaaaagttaa

SEQ ID NO: 23528 - protein, 198 aa, Unknown
  Obtained from environmental sample
  DOMAIN (40)...(152): Transposase IS116/IS110/IS902 family
  misc_feature (1)..(198): Xaa is any amino acid
MTRLLSMYTKQSTMIKNKLHGEEVLGYPSKAVVQSLKRSLKQVQKEMKTLEDKLLILVKEMHQDVLTRLKSIPGIGNKTALMLVVLTDGFERFNSGSELCSYAGLTPVIRKSGSSVKGRPRISKIGNQRLRNLLFMCSFNACKYNKACREIYERIVAKGKSKKLALIAVCNKLLKQAYAIAKSGLIYDDTYRSTLVKS

SEQ ID NO: 23529 - DNA, 819 bp, Unknown
  Obtained from environmental sample
  misc_feature (1)..(819): n is a, c, g, or t
atggtggccaccaatgcttttggaatgggaattgataaatctgatgtaaaaacagtaatacatattaacttacctgatagtatagaaagttattttcaagaagcgggacgtgctggtcgtgatgaagctaaagcttatgctgtaattttaaaaaacaacaatgataatactgctttaaacaatcagtttttaaaagttttaccaacggtagattttgtaaaaattgtttacagaaaactatgtagctattttcaaatatcctatggtgaaggtgcatatcaaacctttgattttaattttaatgagttttgcaaaacttataaatttaacactgtaactacatacaacgccttaaacatattggacaataccagtataataacgcttagtaagcaatttaataaacgtattgaggtccaatttttaattagtagtcacgccttatttaaatacttggacgcacataaagattttgaaattattataaagtctatattaagaacttatggcggaatttttgagcatagtacaaaaataaatagcagtcttatttctgataaagcaggaattaaagaaatgagacttgtatatgttttagaacaattagctaaagatgaagttattacattacttattaataaaacagatgctcaaattacctttatagaacctcgtgaagacgaaaaaaccataaatcgtattgcatcaataattaaacaacaaaacacattaaaacaaaaacaagtacaagcagtattggattatattaataatgaccaactttgcaaaagcatacaactactaacttanttttggtga

SEQ ID NO: 23530 - protein, 272 aa, Unknown
  Obtained from environmental sample
  misc_feature (1)..(272): Xaa is any amino acid
MVATNAFGMGIDKSDVKTVIHINLPDSIESYFQEAGRAGRDEAKAYAVILKNNNDNTALNNQFLKVLPTVDFVKIVYRKLCSYFQISYGEGAYQTFDFNFNEFCKTYKFNTVTTYNALNILDNTSIITLSKQFNKRIEVQFLISSHALFKYLDAHKDFEIIIKSILRTYGGIFEHSTKINSSLISDKAGIKEMRLVYVLEQLAKDEVITLLINKTDAQITFIEPREDEKTINRIASIIKQQNTLKQKQVQAVLDYINNDQLCKSIQLLTXFW

SEQ ID NO: 23531 - DNA, 456 bp, Unknown
  Obtained from environmental sample
  misc_feature (1)..(456): n is a, c, g, or t
ttgaaagcaaaaaaaatagtaattacaggaggtccaagcacaggaaaatcggcaattataaacgaattaactaagcgtggctatacttgctacgaagaaatttctcgtcaagtgacgcttgaagcaagagaaaaaggtattgatcaaatgtttttaacgcaaccgttattatttagcgagctattattaaaaggtcgcgagcaacagtataaagacgctgaaaatagcgatagtgaatttgtttttttagacagaggtgttcctgacgttgtggcatacatggattatgcaaacgaagattatcctgatgcttttataaaatcgtgccaagataatgtgtacgattacgtatttatattagcaccttggcaggaaatttaccaaagtgatgctgtgcgctacgaaagttttgaagaccccaaaattattcataaaaacctttttaaaaacttataa

SEQ ID NO: 23532 - protein, 151 aa, Unknown
  Obtained from environmental sample
  misc_feature (1)..(151): Xaa is any amino acid
MKAKKIVITGGPSTGKSAIINELTKRGYTCYEEISRQVTLEAREKGIDQMFLTQPLLFSELLLKGREQQYKDAENSDSEFVFLDRGVPDVVAYMDYANEDYPDAFIKSCQDNVYDYVFILAPWQEIYQSDAVRYESFEDPKIIHKNLFKNL

SEQ ID NO: 23533 - DNA, 420 bp, Unknown
  Obtained from environmental sample
  misc_feature (1)..(420): n is a, c, g, or t
atgaaaaaattaactacaattttattcaaaaaatttcctgcatttaacctgcaagaattattagtagtattagtgatcataggtattctattactactagccttacctaacttaatgcctcttatttctaaaactaaaagccttgaggctcaaacacaattgaagcatatttacaatcttgaaaaacagtacttctttatgcactcaaagtacagcacagattttaatactattgattttgaagcacccaaaacagtacaagaaaatggcaatgccaattacacgtacgaaattatcgaaacatctaatactgcttttaaagcacgtgcgacttcgattaccgattttgacggtgatggtatattcaacgtttgggaaatagatcataatgattcacctagagaaatagttaaagattaa

SEQ ID NO: 23534 - protein, 139 aa, Unknown; identical to SEQ ID NO: 22396
  Obtained from environmental sample
  misc_feature (1)..(139): Xaa is any amino acid

SEQ ID NO: 23535 - DNA, 480 bp, Unknown
  Obtained from environmental sample
  misc_feature (1)..(480): n is a, c, g, or t
atggcaaagtttaaactagacgaaattgatcatcagattcttgatatgttgatagaaaacacaagagttccttttacagatatagctaaaaaattattaatttcagctggtacagttcacgttagagtgaaaaagatggaagatgcagggataattaaaggatcgtcattaacgcttgattatcgtaaattagggtattcatttatagcttacgtaggtgtgtttttacaaaatacttctaaaacgtcttttgttttggagcgtataaacgaaattccttttgtgactgtagcgcatgttactacaggcaaatttaatatcttttgtaaaattagagctagaaacactgagcatgcaaaggatgtaatctttatgttagatgacatagaaggtgtttacagaacagaaacaatgatatctttagaagaaagcattaacgataaaaaacgtttaatgcacagtatttttaacgaattataa

SEQ ID NO: 23536 - protein, 159 aa, Unknown
  Obtained from environmental sample
  DOMAIN (30)...(127): AsnC family
  misc_feature (1)..(159): Xaa is any amino acid
MAKFKLDEIDHQILDMLIENTRVPFTDIAKKLLISAGTVHVRVKKMEDAGIIKGSSLTLDYRKLGYSFIAYVGVFLQNTSKTSFVLERINEIPFVTVAHVTTGKFNIFCKIRARNTEHAKDVIFMLDDIEGVYRTETMISLEESINDKKRLMHSIFNEL

SEQ ID NO: 23537 - DNA, 360 bp, Unknown
  Obtained from environmental sample
  misc_feature (1)..(360): n is a, c, g, or t
atgttacagaactattctaaccagtttaatttaaaatatattggtatgcgaaaagttattgtagattataaaaaattaacacctgaggtattaaatttacttactcaaaagtttccggatggttatggcgataaagatattatcacctttgacaatcataacaatgaaactattgaagctgttgaagtccaaactaaagatacgatctatttagtcaaggttagctgtaaattacattacacgatgaccaattttgattctgaaattaacttagaaacaaatagcgatggtcatgttgttgtagattttaaccaaaaacaacttgacagcaatttgattttatctgatgaagaagaataa

SEQ ID NO: 23538 - protein, 119 aa, Unknown
  Obtained from environmental sample
  misc_feature (1)..(119): Xaa is any amino acid
MLQNYSNQFNLKYIGMRKVIVDYKKLTPEVLNLLTQKFPDGYGDKDIITFDNHNNETIEAVEVQTKDTIYLVKVSCKLHYTMTNFDSEINLETNSDGHVVVDFNQKQLDSNLILSDEEE

SEQ ID NO: 23539 - DNA, 648 bp, Unknown
  Obtained from environmental sample
  misc_feature (1)..(648): n is a, c, g, or t
atggactacaataaaaatgtttatgacagtgttttggacctaatcgggaacacgcctttaattaaactaaaaaaaataacctctgattgcaaaggtagctttctagcgaaagttgaagcgttcaatccaggacattcgtctaaggataggattgctttatatattattgagcaagcagaaaagcaggggattttaaagcctggtgatacaataattgagacaacctctggaaatactggttttagtattgctatggttagtgttttaaaaggatacgattgtattctagcagttagctcgaagtcttctccagataaaattgatatgcttaaaacaatgggcgctaaggtttatgtttgtcctgcaaatgtagcagccgacgacccaaggtcatattataaagtagcacaacgtttacacgaagaaattgaaggatcagtttatataaaccaatactttaatactttaaacggcgaagcacattaccaaactacgggtccagaaatttgggaacaaacaaatggtaaaataacacatttaattgcgtgtagtggaactggaggaacaatttctggaacagcgaaatatttaaaagaacaaaatcctaacgtaaaagttattggtgtagatgcttacggctctgtataa

SEQ ID NO: 23540 - protein, 215 aa, Unknown
  Obtained from environmental sample
  DOMAIN (11)...(215): Pyridoxal-phosphate dependent enzyme
  misc_feature (1)..(215): Xaa is any amino acid
MDYNKNVYDSVLDLIGNTPLIKLKKITSDCKGSFLAKVEAFNPGHSSKDRIALYIIEQAEKQGILKPGDTIIETTSGNTGFSIAMVSVLKGYDCILAVSSKSSPDKIDMLKTMGAKVYVCPANVAADDPRSYYKVAQRLHEEIEGSVYINQYFNTLNGEAHYQTTGPEIWEQTNGKITHLIACSGTGGTISGTAKYLKEQNPNVKVIGVDAYGSV

SEQ ID NO: 23541 - DNA, 504 bp, Unknown
  Obtained from environmental sample
  misc_feature (1)..(504): n is a, c, g, or t
atgagcactaatatagcaacattacaaccgccaatagcgaataaaattccaaagacgttagaaatacataacgatgttagaatagataactatttctggttaaacgatcgtgaaaacccgtcggttacagagtatttagaagccgaaaatgcatacaccaaagcagttttaaaacatactgaacaatttcaagcagatttgtttgaagaaatgaaatcccgtattaaggaagatgatacttcggtaccttataaatataatggttattggtacattacgcgctacgaaaaaggaaaagattaccctgtgtacttgcgtaaaaaagaaagtttagatgctgaagatganatcctttttgattgtaacgaaatgtcaaaaggaatagcctactttaagttaggagggatttctataagtccagataatacaatggcaagtttttctattgatacagtaagtaaaagacaatatactttgcaaattaaaaaatttggttacaggtga

SEQ ID NO: 23542 - protein, 167 aa, Unknown
  Obtained from environmental sample
  misc_feature (1)..(167): Xaa is any amino acid
MSTNIATLQPPIANKIPKTLEIHNDVRIDNYFWLNDRENPSVTEYLEAENAYTKAVLKHTEQFQADLFEEMKSRIKEDDTSVPYKYNGYWYITRYEKGKDYPVYLRKKESLDAEDXILFDCNEMSKGIAYFKLGGISISPDNTMASFSIDTVSKRQYTLQIKKFGYR

SEQ ID NO: 23543 - DNA, 387 bp, Unknown
  Obtained from environmental sample
  misc_feature (1)..(387): n is a, c, g, or t
atggtacaacaagtaacacaaggaattaaaatttcggtaaaaaccgagttcgacggcacattttacaaaaaccgtaaaatgcaatatgcctttgcctataacgtgaccattgagaaccaaagcaaagacacagttcagctaacttcacgcagctggaaaatcaaggattcactaaacaatacagaaattgtggaaggtgaaggtgtaataggtcaaaaaccaatactctcacctggagagaagcactcttacactagtggttgccttcttttatcaccttttggagcaatgaaggggcattacaatatggttaactttacaactacccgaaagtttagggtctccattcctcttttcaatttgagcgcacccttttcgatgaattaa

SEQ ID NO: 23544 - protein, 128 aa, Unknown
  Obtained from environmental sample
  DOMAIN (3)...(124): Protein of unknown function (DUF525)
  misc_feature (1)..(128): Xaa is any amino acid
MVQQVTQGIKISVKTEFDGTFYKNRKMQYAFAYNVTIENQSKDTVQLTSRSWKIKDSLNNTEIVEGEGVIGQKPILSPGEKHSYTSGCLLLSPFGAMKGHYNMVNFTTTRKFRVSIPLFNLSAPFSMN

SEQ ID NO: 23545 - DNA, 789 bp, Unknown
  Obtained from environmental sample
  misc_feature (1)..(789): n is a, c, g, or t
atgagacaccatatattactgcctacagatttttcagacaatgctatgagtgctgcgctttatgcaataaaattatataataaagaaccgtgtacgttttatttcttgcacgcctggtcgttttctagttcaactactagaacgtatattagttctgactatatagataaactggaagagaaagctaaacaacaattagtggagtttaaggagcaagctcaaggacatagtgcgaatggacttcacaaatttgatactatttatagtaaacaacctcttttgaaaactatggaagaagttattgaaacccatagaatagatttaattgttatgggtacaaacggggcgtctggaacaaataggtttctgtttggaagtaatgctgtaaacattattaataaaataaaattatgccctattttggttattccatctgggttcgattatgtgaaaccagaacagattgcttttcctacagattttaacagattgtatggagaagagatgctgccaataaaacaattttctaagttacataattctaaaattagtatatttcatattagtgagggtgacgatcttacagaaaaacaagacaacaatttagcgttgttaaaagagtgttttgaagactatgaacacagttttcattggatgcccaataatggcacanaagaaagtgctataaaagaattcttggaagggaatggtattaatattctagtaatgataaactataagcacagttttatcgagagtatgacaagagagcccattgtgaaaaaatag

SEQ ID NO: 23546 - protein, 262 aa, Unknown
  Obtained from environmental sample
  DOMAIN (1)...(144): Universal stress protein family
  misc_feature (1)..(262): Xaa is any amino acid
MRHHILLPTDFSDNAMSAALYAIKLYNKEPCTFYFLHAWSFSSSTTRTYISSDYIDKLEEKAKQQLVEFKEQAQGHSANGLHKFDTIYSKQPLLKTMEEVIETHRIDLIVMGTNGASGTNRFLFGSNAVNIINKIKLCPILVIPSGFDYVKPEQIAFPTDFNRLYGEEMLPIKQFSKLHNSKISIFHISEGDDLTEKQDNNLALLKECFEDYEHSFHWMPNNGTXESAIKEFLEGNGINILVMINYKHSFIESMTREPIVKK

SEQ ID NO: 23547 - DNA, 429 bp, Unknown
  Obtained from environmental sample
  misc_feature (1)..(429): n is a, c, g, or t
atggtacaagaacacaatttagcaatatttagagggacagttaagtttaaatcgaacactcaaaaaatttggggcgttttaatatttttatctttaataacagcagtagaagtaattttaggtattttcaaacctcaagttttacttacaccggttttaggtatgaaagctttaaactggatctttatcatcctaacactagtgaaagcgtattatatcgcatgggattttatgcacttaagagacgaaaaaccagcattgcgtagagtaattgtttggacagctgttttcttaattagctacttaatttttatcttattacaagaaggtggatatatcgaatctgtttttagaaacggctttgtgaaaaaacacattctaatagctaataatatagtgttaaacataaagaaaaggtggtttatttaa

SEQ ID NO: 23548 - protein, 142 aa, Unknown
  Obtained from environmental sample
  misc_feature (1)..(142): Xaa is any amino acid
MVQEHNLAIFRGTVKFKSNTQKIWGVLIFLSLITAVEVILGIFKPQVLLTPVLGMKALNWIFIILTLVKAYYIAWDFMHLRDEKPALRRVIVWTAVFLISYLIFILLQEGGYIESVFRNGFVKKHILIANNIVLNIKKRWFI

SEQ ID NO: 23549 - DNA, 372 bp, Unknown
  Obtained from environmental sample
  misc_feature (1)..(372): n is a, c, g, or t
atgaataaattagcagtaatattacttgttgtaattgtcgcatttttaagttgtgatggacgtgatcgtgttaaaaaatctaagacacaattacttactgaaagtaacatgctacaatcttttaagacacaagcaacttttttcccagaagcgtatacagaatccaccactgataccattttaagtaatggctttagggttaaaattaaaaattatacagatatggatcattctgtattgggttatacctcagaaaacgtcataaagtctaaacactatttcagagaagtaatttcagaaattgaagtttttaaaaatgataaaattattttcaaaaataatattaatgaaccatttttattagaaaaatag

SEQ ID NO: 23550 - protein, 123 aa, Unknown
  Obtained from environmental sample
  SIGNAL (1)...(17)
  misc_feature (1)..(123): Xaa is any amino acid
MNKLAVILLVVIVAFLSCDGRDRVKKSKTQLLTESNMLQSFKTQATFFPEAYTESTTDTILSNGFRVKIKNYTDMDHSVLGYTSENVIKSKHYFREVISEIEVFKNDKIIFKNNINEPFLLEK

SEQ ID NO: 23551 - DNA, 312 bp, Unknown
  Obtained from environmental sample
  misc_feature (1)..(312): n is a, c, g, or t
atgacaaaactacttacatactttctactaatttcatttttatcttgtaataaaaaagttcaagacgaagtaaaaacagatgagaatcacaaaaaagcacctgaattgaatatagcggaatctgatagtttgaatttaaccgagttattagcagataatccatttgaactaaatatcagttccaaaaaattaactgaatttcctgacttgagtagttatgaaatacattctctaaatgtttcgaacaataaaataaaatcaattccgcaaaccaaattaccaaaaaaattaaggacattgatgccaatataa

SEQ ID NO: 23552 - protein, 103 aa, Unknown
  Obtained from environmental sample
  misc_feature (1)..(103): Xaa is any amino acid
MTKLLTYFLLISFLSCNKKVQDEVKTDENHKKAPELNIAESDSLNLTELLADNPFELNISSKKLTEFPDLSSYEIHSLNVSNNKIKSIPQTKLPKKLRTLMPI

SEQ ID NO: 23553 - DNA, 381 bp, Unknown
  Obtained from environmental sample
  misc_feature (1)..(381): n is a, c, g, or t
atggagaaagttatagatattgactctgaaaacaatgtctttgaagttataattatcgaatcctttaatggaattgaaattggtgaaatttatagtggattatatgacaaatattgcggaccaattattaacgaaaaaggaaaatggctgatttatggaaattttaattctgaaaatcaaattgtaataaatcattgtggattatcacgtagttttgagaatcctgaaaataataattcagcatcaaatccacctgaaccattaccaccgaacacattgatatcaaaatctgaatctgaaaagagaatgactgaatggaaaaaaagagctaaatctgatttagataaagaaataatatatttgagaaaacgaataaaataa

SEQ ID NO: 23554 - protein, 126 aa, Unknown
  Obtained from environmental sample
  misc_feature (1)..(126): Xaa is any amino acid
MEKVIDIDSENNVFEVIIIESFNGIEIGEIYSGLYDKYCGPIINEKGKWLIYGNFNSENQIVINHCGLSRSFENPENNNSASNPPEPLPPNTLISKSESEKRMTEWKKRAKSDLDKEIIYLRKRIK

SEQ ID NO: 23555 - DNA, 507 bp, Unknown
  Obtained from environmental sample
  misc_feature (1)..(507): n is a, c, g, or t
atgtttctgttttctgtcttttcaggcggtttaaggtttggagatataatagaattaaagtggaataattacaatactaaaacgcataaaataactaagacaatacgtaaaacaaacagacagcatagtattagaataggtcaagtggcaatagatattttagaaaaatataaaacagaaaatgtaaatcaagatgatataatatttcctttcgcaaatattgataacgaatattttacagacagagaacaaagagcaaaagtagtgagacaagcaatagcattaagcaatatgtatttaactaaaatgggtaaaactttagaatttccattttctttaacctttcatattagtagacatacatttgctaccagagcattaaacaatggtatgcgtatagaacacgtttcaaaacttatggatcattccgatattggaataacacaggtatatgcaaagattataagtagtgaattagataaagcagtagataaatacatcaattaa

SEQ ID NO: 23556 - protein, 168 aa, Unknown
  Obtained from environmental sample
  DOMAIN (2)...(161): Phage integrase family
  misc_feature (1)..(168): Xaa is any amino acid
MFLFSVFSGGLRFGDIIELKWNNYNTKTHKITKTIRKTNRQHSIRIGQVAIDILEKYKTENVNQDDIIFPFANIDNEYFTDREQRAKVVRQAIALSNMYLTKMGKTLEFPFSLTFHISRHTFATRALNNGMRIEHVSKLMDHSDIGITQVYAKIISSELDKAVDKYIN

SEQ ID NO: 23557 - DNA, 981 bp, Unknown
  Obtained from environmental sample
  misc_feature (1)..(981): n is a, c, g, or t
ttgggagaacatgacagatcggccgagatcccacaaactagctatacacctttttataaacaattaatatcagactctgaaacgctctggaaaattatatcgccaccactaactcaagatttttttaatttttaccttattactaaagataactttattcgcatagcgccgcctaacgaggctttaaatgcgccagctaattatacatttacacaaagtacgcgctttaattacgctaaggcgcttactaatcctcaacataggcctgtttggtctaaagtttattacgatactatatggcataaatgggctattagcttaacggttcctatttataaagagggtgagtttttaggtgttactggcagtgacatcgcgctaaaaacattaatatcgcaattgccaattggcggaaaagaaaaacagttagtggtatttgacagccaagggcagttattagcgcaccccaatttaacccaatcaagttatgcacaatatggtaaagcaggtaaaaaactactccctgaggactttattgatcccacattacaagtaattgtagatgatgcgattaaaatgcaacggtctgaatatgccgactcattcaaattaaataatgaagcgtatattattaatattcataaaatagatggcttagattggtatgtaggggtatataaaaaacgttcttcaacattctcagcattagcagatttaaagatgaagttttttgggctatttatactctatgccattttagtcgccttactcttacatcaagcactttatcagctagtacttaggcgtatacattctttggtttatgccgttacaaactttggtcaaggccagttacaaatagaatttccaaaagaaaacaaagatggaataggcactctcaacggctcatttaaagacatgaccattgaaattagaaaagctatagatggggcttaccagcgtattattgaaaaagaaatt

SEQ ID NO: 23558 - protein, 327 aa, Unknown
  Obtained from environmental sample
  DOMAIN (91)...(168): Cache domain
  misc_feature (1)..(327): Xaa is any amino acid
MGEHDRSAEIPQTSYTPFYKQLISDSETLWKIISPPLTQDFFNFYLITKDNFIRIAPPNEALNAPANYTFTQSTRFNYAKALTNPQHRPVWSKVYYDTIWHKWAISLTVPIYKEGEFLGVTGSDIALKTLISQLPIGGKEKQLVVFDSQGQLLAHPNLTQSSYAQYGKAGKKLLPEDFIDPTLQVIVDDAIKMQRSEYADSFKLNNEAYIINIHKIDGLDWYVGVYKKRSSTFSALADLKMKFFGLFILYAILVALLLHQALYQLVLRRIHSLVYAVTNFGQGQLQIEFPKENKDGIGTLNGSFKDMTIEIRKAIDGAYQRIIEKEI

SEQ ID NO: 23559 - DNA, 858 bp, Unknown
  Obtained from environmental sample
  misc_feature (1)..(858): n is a, c, g, or t
atgaagaaattattttgcattttaagcatcctaatactatttggttgtggctccacatcgcaagcacaaaattataaaacacataaggtaaaacctggtgaaaccatagaggctattgccagacaatatcagctaacgccttttgatatttacgctttaaacccggatgccaaaaaggaattaaaaaccaatgcggttttaattattccaaataaaaaaataaatcaatcagcaccacatgccgctattgaaaaggagttaacaggatttaaaactcataaagtaaagcgtagagaaacattatacagcttatctaaagagtatggtgtggaacaagacgaaataaaaaaacacaacacctttttatatgccaacaacctacgtaaaggcgatgaaataaaaatacctgtttataaaaaagtgtttacagtttctcaaccagaagaaacagccaaaacctataccgttttaccaaaagaaggaaaatggcgtattgcatataaatttggaataacagttgctgaattggaggctttaaatcctggaatgagtcctattttacaagaaggcgaagttattaatgtgccaaatattggtaatacagaagagaagcccgtagataatcaatattcgtattatgaggttttgcctaaagaaggtttttaccgtctgaaagtgaaattaggtttggagcaaagtcaattggaaacgttaaatccagaattaattgaaagcggactgaaagtagggatgattttaaaagtccctttcaatgcccctattgaagatgaaaacataaaattagaaagcacgggattaaccaaactctatttcaagttacaaaccggaaacctatag

SEQ ID NO: 23560 - protein, 285 aa, Unknown
  Obtained from environmental sample
  SIGNAL (1)...(20)
  DOMAIN (154)...(196): LysM domain
  misc_feature (1)..(285): Xaa is any amino acid
MKKLFCILSILILFGCGSTSQAQNYKTHKVKPGETIEAIARQYQLTPFDIYALNPDAKKELKTNAVLIIPNKKINQSAPHAAIEKELTGFKTHKVKRRETLYSLSKEYGVEQDEIKKHNTFLYANNLRKGDEIKIPVYKKVFTVSQPEETAKTYTVLPKEGKWRIAYKFGITVAELEALNPGMSPILQEGEVINVPNIGNTEEKPVDNQYSYYEVLPKEGFYRLKVKLGLEQSQLETLNPELIESGLKVGMILKVPFNAPIEDENIKLESTGLTKLYFKLQTGNL

SEQ ID NO: 23561 - DNA, 834 bp, Unknown
  Obtained from environmental sample
  misc_feature (1)..(834): n is a, c, g, or t
atggaaagggagtgtgggagacacattcgtggaaataataaccaccccattttaggattgccacaggaagagaatcaattttctgtaacgcaagtaccccctaaaacttttggcaggttattcaaaactagtagaaatatactgtttattgggttagaagataaagaaggttatggcgtaaaaaaaaatctctatgcatcaccacagatgaccatgacgattattggtacagatcaatcttcgctggccaatcaaattaatactcataaagatgaaattatttcagtttttaaaaatgctgatttaaaattatttcaaaaaaaaataaccaaagaacattgggaaactaaggatatcaaaacattattaaatctagggatccaattaaaaatacccaaagattatgcattggtaaaagacactggtgattttttgtggtttcgacaagatattgacaaaggaagtatgaacattatttcttacgtgttgcctctgatagaaaatgacagtatcgaaaataccattgtagcggccagagatactatagggaaaaaacatattccaggtcagtttgacgggacttatatgatcacagaagcagcatatactccttttacaaaaaaaacagagttaaataataatccttcttttgaaaccagaggtaaatgggaagtgaaaggtgattttatggctggcccttttttaaattacacggtcatcgataaagaaaataatcgtttgctagttgtggaaggatttacctatgcaccatcaataaaaaaacgtgattatatgtttgagcttgaagccatactcaaaacattaaaaatttga

SEQ ID NO: 23562 - protein, 277 aa, Unknown
  Obtained from environmental sample
  misc_feature (1)..(277): Xaa is any amino acid
MERECGRHIRGNNNHPILGLPQEENQFSVTQVPPKTFGRLFKTSRNILFIGLEDKEGYGVKKNLYASPQMTMTIIGTDQSSLANQINTHKDEIISVFKNADLKLFQKKITKEHWETKDIKTLLNLGIQLKIPKDYALVKDTGDFLWFRQDIDKGSMNIISYVLPLIENDSIENTIVAARDTIGKKHIPGQFDGTYMITEAAYTPFTKKTELNNNPSFETRGKWEVKGDFMAGPFLNYTVIDKENNRLLVVEGFTYAPSIKKRDYMFELEAILKTLKI

SEQ ID NO: 23563 - DNA, 429 bp, Unknown
  Obtained from environmental sample
  misc_feature (1)..(429): n is a, c, g, or t
ttgcgattaatgattttaaagaagatggaaaaacactttcaatatcctctttttctatgcttattttatgttactttttcattttcccaaaccgaaaaagaatataaaataaacacgattgccttttacaatcttgaaaatctttttgactacgaaaacgaccccattacttttgacgatgatcgtactcccgagggcaaggatcattggacgaaggaaacttacgaggctaaattgatgaatatggcaaaagtgatttctgagattggagaagacgttacaagcacttctccagctttaataggggtaagcgaaatagaaaaccgacgcgtcctggaagatcttttgaaccaaaaacctttggtgaacaaggattatggcattgtacactttgatagcccagaccgtcgcggtatgancgtgcactga

SEQ ID NO: 23564 - protein, 142 aa, Unknown
  Obtained from environmental sample
  misc_feature (1)..(142): Xaa is any amino acid
MRLMILKKMEKHFQYPLFLCLFYVTFSFSQTEKEYKINTIAFYNLENLFDYENDPITFDDDRTPEGKDHWTKETYEAKLMNMAKVISEIGEDVTSTSPALIGVSEIENRRVLEDLLNQKPLVNKDYGIVHFDSPDRRGMXVH

SEQ ID NO: 23565 - DNA, 705 bp, Unknown
  Obtained from environmental sample
  misc_feature (1)..(705): n is a, c, g, or t
ttgttcaaggaacgagacaaaacatttctttttggaactgataatattaaggttctaacagaaggttcaacctattttataagatctagaagatcaataaccattgaacccattggagaccgttatatactatgcaaaataaatggtttgcttcaaatgaatgataaaaaaacagataccattcctgggcttaatccaaaactgcataatgactttagaagtatggacatcattaatacgaacgaagtacttgccggaagcgagaagaagttataccatataacactccaaaatgacagttttaaaattcagacttttgatatgagtcgcttcccctctttaaaacaatttcgggcattgaaggttgatggcaataatttatggatggctgggagagatatgttactcaaagtggatcttgaacttttattgaaaaaagatacagttatagcaaagaaatataatactatgtctcattttttggaaaacgacatcgatttcaattcacttttgattactgatgacaaaactattttagccacgtctctgagcggaatgcttgcctttaacgagaaatcttttcttcccaacacacaacctccaaaattggatatttcgcaaattcttttgttttccgagcctttggaagatagccttttcagaaccaacaaaggtatcgttctcccctttcaaaaaactatttaa

SEQ ID NO: 23566 - protein, 234 aa, Unknown
  Obtained from environmental sample
  misc_feature (1)..(234): Xaa is any amino acid
MFKERDKTFLFGTDNIKVLTEGSTYFIRSRRSITIEPIGDRYILCKINGLLQMNDKKTDTIPGLNPKLHNDFRSMDIINTNEVLAGSEKKLYHITLQNDSFKIQTFDMSRFPSLKQFRALKVDGNNLWMAGRDMLLKVDLELLLKKDTVIAKKYNTMSHFLENDIDFNSLLITDDKTILATSLSGMLAFNEKSFLPNTQPPKLDISQILLFSEPLEDSLFRTNKGIVLPFQKTI

SEQ ID NO: 23567 - DNA, 921 bp, Unknown
  Obtained from environmental sample
  misc_feature (1)..(921): n is a, c, g, or t
atggaggctttaacatttacaaatccgaggaactttcattaccaataccgcatgaaaggacttcgggacgggaaacgaatggtcacaccctacaaaagacccaaacgtagtattttttaccttcctccaggtaaatatatttttgaatttattgcagacaatggtgatgatgtatggcagacccagccctatcaatattcatttgtgataacagtcccgttttggaagacttggttcttttgggtttctcttttatctattacttcgattagtgttttccttttttattatttcaaaaacaaggccgagcaaagaagaaacgaagcctacacacacaaccttataaaagctcaagaggaagaacgcactcgagtggcacgtgaacttcacgacagcgtggggcaaaaattgatgctccttaccaaaaaaaccaaaagtactggaaaccaagaaatggaaactttagcgaccaatacgctgcaagaattacgggctatctctagaggattacatccagcaacactagaacgattgggccccgcagctgcaattagaaatatggttgatgaggtagatgcaaatacaaatattttttttacccacgaaattgaagatattgatactttgttaagcaaagaagcatccttacatttgtatagaatcatccaagaagttttgaacaatattgtaaaacacgccgaggccaaagccgcttctgtgactattgagaaaaagaaaaataccattgaagcaattattgcagacaatggaaaaggctttgaattttctgaaaaggttaaaatcagtgaaagcttgggcatgaaaaccttattggagcgagcaaaaattttacactcaaaaattgattttaaaagtcaaattaataaaggaacaactgtaacgcttacaattccaatttaa

SEQ ID NO: 23568 - protein, 306 aa, Unknown
  Obtained from environmental sample
  DOMAIN (213)...(306): Histidine kinase-, DNA gyrase B-, and HSP90-like ATPase
  misc_feature (1)..(306): Xaa is any amino acid
MEALTFTNPRNFHYQYRMKGLRDGKRMVTPYKRPKRSIFYLPPGKYIFEFIADNGDDVWQTQPYQYSFVITVPFWKTWFFWVSLLSITSISVFLFYYFKNKAEQRRNEAYTHNLIKAQEEERTRVARELHDSVGQKLMLLTKKTKSTGNQEMETLATNTLQELRAISRGLHPATLERLGPAAAIRNMVDEVDANTNIFFTHEIEDIDTLLSKEASLHLYRIIQEVLNNIVKHAEAKAASVTIEKKKNTIEAIIADNGKGFEFSEKVKISESLGMKTLLERAKILHSKIDFKSQINKGTTVTLTIPI

SEQ ID NO: 23569 - DNA, 891 bp, Unknown
  Obtained from environmental sample
  misc_feature (1)..(891): n is a, c, g, or t
ttgactatcacggaggtcagattgaaaaccataaatatcgcaatgcttggtaccggggggatgagcaaataccacagttacggttttaagattgcagatcatttttttgatcttgatataaagatctgtttaaaactacttgtaggtagatcaaatgataaaaaacatctggcgagtaaatatggttttgaaaaatatagtacaaacataaatgatgcttttaaagacgatattgatcttgtggatatcattactccaaattattctcatattccacttgtaaaaaaggcagcagcagctaataaaattattttttgtgaaaaaccggtcgggatggattataaggaagcacttgaaggttataaggcagttgaagtaagtaaagtcttaaattgtgttaattttaattttagaaaagctacccctgttgcacttataaaagatattattgaaaagaaaaaaatcggagagatctatacctggaagatcgattttcttgctgatgatggaagcgatattaataatcccataaactggttttaccagaaaaaattcagtggagggggtgcaaattacgaccttaatgtccatcttatagatcttgcacattttctggttggtgatattgaaagtattgtaagtcttcaaaaaacttttataaaagaaagaaaggatgagagcaaaaaaggtaaggtacctgtcgatacagatgactatacaagttgtcttgcaaattttaaaaatggggctgcaggtctttttgatgccttccggatctctaccggtgacagattggactgttccctggaaatcaggggggtccccgggtgcagtaaaatggggactatccagaatttcaatttccttggaatttataccttttcaaaataa

SEQ ID NO: 23570 - protein, 296 aa, Unknown
  Obtained from environmental sample
  DOMAIN (11)...(135): Oxidoreductase family, NAD-binding Rossmann fold
  misc_feature (1)..(296): Xaa is any amino acid
MTITEVRLKTINIAMLGTGGMSKYHSYGFKIADHFFDLDIKICLKLLVGRSNDKKHLASKYGFEKYSTNINDAFKDDIDLVDIITPNYSHIPLVKKAAAANKIIFCEKPVGMDYKEALEGYKAVEVSKVLNCVNFNFRKATPVALIKDIIEKKKIGEIYTWKIDFLADDGSDINNPINWFYQKKFSGGGANYDLNVHLIDLAHFLVGDIESIVSLQKTFIKERKDESKKGKVPVDTDDYTSCLANFKNGAAGLFDAFRISTGDRLDCSLEIRGVPGCSKMGTIQNFNFLGIYTFSK

SEQ ID NO: 23571 - DNA, 522 bp, Unknown
  Obtained from environmental sample
  misc_feature (1)..(522): n is a, c, g, or t
ttgaaaaataaagatgaaattcaaggctactatgcagactgttatgtgttaacgggaaaaagaaattacgcttttattattcaattattggattacttcacaccaaatagacgagaattagctgatgaatatgaagttcctcaatattctgataatccaatagagatacttgaaaatgctgacgaagcaattaaatttctatgcaaaaacaaagaaataaaacacacactttattgggaaaacccagataaaactgaaatgaaaggtttggaattattttttactgatgataaatatttaatatgtggaatatattgtgatacaaaatttccaaatacagaaattgaagatcattattttgaaaagttaaaaaacatttgcaaatctgaacaaggttatattgcctatgaagaaccttctgtgcataatagtaaagagtttatcgaaatagcaaaaaactgggaattgaataatagaaatgaagaccataaaaaatttttattatataatcaaaaagactaa

SEQ ID NO: 23572 - protein, 173 aa, Unknown
  Obtained from environmental sample
  misc_feature (1)..(173): Xaa is any amino acid
MKNKDEIQGYYADCYVLTGKRNYAFIIQLLDYFTPNRRELADEYEVPQYSDNPIEILENADEAIKFLCKNKEIKHTLYWENPDKTEMKGLELFFTDDKYLICGIYCDTKFPNTEIEDHYFEKLKNICKSEQGYIAYEEPSVHNSKEFIEIAKNWELNNRNEDHKKFLLYNQKD

SEQ ID NO: 23573 - DNA, 909 bp, Unknown
  Obtained from environmental sample
  misc_feature (1)..(909): n is a, c, g, or t
atggctcaggatttagtagatttctgtattgaaaaatatgagaaagaaatcgcaatattattggaagattcgtttagcgaggttttaagtctaaatgaaattaaaacagcaagtgtaccttatcataattttatttttaatgcttcaaaacgttttgaaaatataataaaatcagctggtcctgattttgaattggtaattaaaaatatgccagaaaatgattggtatattcttagttgtacaattataatgagtttttgttataactatgacactaattttaaaagaccgttatattatgagattccaaatgaaaatggtattgtaagaatttacaagattacttataatgcagatttcatggaaattattcctactgaagctgctcctaaattaactgataaagactttgacgaattattagataattttgaaaatatagagttgtggaaagaaaaatttcctcctaacagttatatatcaaaaggatttgtaatatctaatatttttgatgttacggacgatcagtctatttcaaacataaaaacaaccttaataaaaaatagtaaacgtaaagacgaaagctttatggtagattttcaaaaagtcttccgttcgttattaggagttactgatttggaggtgggattttctatttataataaagaagaaaacaccttaatgaaggtgcatgattctagtattaacagttttttgcttaaagctaaagaggagtttaagtgtgagaatttattttgtcattacagttatgataaaattttaaaaagtaaagctaaccttgctatatctgatgtagatgctaattttaaaaaatcaaaaggtaagtctcctcaggttaaagttttaaaagagcaaggttttaaaaagtgccattttttgcacaattag

SEQ ID NO: 23574 - protein, 302 aa, Unknown
  Obtained from environmental sample
  misc_feature (1)..(302): Xaa is any amino acid
MAQDLVDFCIEKYEKEIAILLEDSFSEVLSLNEIKTASVPYHNFIFNASKRFENIIKSAGPDFELVIKNMPENDWYILSCTIIMSFCYNYDTNFKRPLYYEIPNENGIVRIYKITYNADFMEIIPTEAAPKLTDKDFDELLDNFENIELWKEKFPPNSYISKGFVISNIFDVTDDQSISNIKTTLIKNSKRKDESFMVDFQKVFRSLLGVTDLEVGFSIYNKEENTLMKVHDSSINSFLLKAKEEFKCENLFCHYSYDKILKSKANLAISDVDANFKKSKGKSPQVKVLKEQGFKKCHFLHN

SEQ ID NO: 23575 - DNA, 732 bp, Unknown
  Obtained from environmental sample
  misc_feature (1)..(732): n is a, c, g, or t
atggaggattattttgctaaagtagatgctaatctgaaagtgatatattattatcgtaaaaattacgatgatactattagcttgataaacaaaaatatgtctgccttgttagataaaaacaaagtagaagcacaagctaggtatcctcacttttttgagcgttntaaaacggatggtgttgagcataatatgtacattggagagtctattacaaaagaagattcgtttaacgagttgtacttgtataatttaagattgtggcaaatgcaagtcatgattgatatggaaacgtctttttacaccaaacagcataaatatcctattgcgcttgatgttgcatcaatgattttagtgtttaatcaaccgttatctattagatttagagcagatgagaaacactttgatgtggatggtacttataatgcaagatacgaggtggttaaaaaacgagttgataaagctaatattaaaggtacagacgagcgcattactgctaagggtaagttaacaattgtctattctcagcaagacgatgagtttgaatacttaaaatatgttagatttttacaatcaaaacataaattaggtgatgaggtagaaatattagagttagaggatttacaaggagtaactggcttaaaagctattagagttaatatcttgtatcaagaccaaaacaatacaaagcagttttacacgtataacgatttaatgcaggctataaaatcctaa

SEQ ID NO: 23576 - protein, 243 aa, Unknown
  Obtained from environmental sample
  misc_feature (1)..(243): Xaa is any amino acid
MEDYFAKVDANLKVIYYYRKNYDDTISLINKNMSALLDKNKVEAQARYPHFFERXKTDGVEHNMYIGESITKEDSFNELYLYNLRLWQMQVMIDMETSFYTKQHKYPIALDVASMILVFNQPLSIRFRADEKHFDVDGTYNARYEVVKKRVDKANIKGTDERITAKGKLTIVYSQQDDEFEYLKYVRFLQSKHKLGDEVEILELEDLQGVTGLKAIRVNILYQDQNNTKQFYTYNDLMQAIKS

SEQ ID NO: 23577 - DNA, 360 bp, Unknown
  Obtained from environmental sample
  misc_feature (1)..(360): n is a, c, g, or t
ttgcgatctagcattttgcaaggcccgcaccacgcagtgtacatatccatcataatctttttaggtgtcttttgttggagttcaactgctttatctaaagttatccagttaatctcttgggcagatacaacaaccgttgttaaaagcccaacggctaaaagtaatatgtgttttttcataatcttatctcttcaaaaggtatcccaaagttacaaaaaaataaaaacgccctcaacgaggcgcctccattttatttttctcttatataattatcttacattatgcatcaaacgttttaatatagggtttaaaaccaaccgcgattacaccaatagcgattgggaaccaagtaaaaattaa

SEQ ID NO: 23578 - protein, 119 aa, Unknown
  Obtained from environmental sample
  misc_feature (1)..(119): Xaa is any amino acid
MRSSILQGPHHAVYISIIIFLGVFCWSSTALSKVIQLISWADTTTVVKSPTAKSNMCFFIILSLQKVSQSYKKIKTPSTRRLHFIFLLYNYLTLCIKRFNIGFKTNRDYTNSDWEPSKN

SEQ ID NO: 23579 - DNA, 645 bp, Unknown
  Obtained from environmental sample
  misc_feature (1)..(645): n is a, c, g, or t
ttgtgcaacattcaaaaaaacattccactacatatgaacattgataaaactaataaaaaattactcgaattatataagagtaaatatccaaacctttctaatttattaaccgaaaaaaataagtctttagaacattcggacaaagcaaccaatccacttttactgaaaattgacgagaattatgcaaatgcgaaattcaagattatgttttttggacaagagacaaacacttggcttggagaacaaaataatgcggaatttttaggtcaaattgaaccagtttataatctttatgaagacttttttttaagtaataattgctattcttatggtggacaattttggaatggagtaagcagatgtgttcaattagtggaacaagaaattaatgaaaaggttggtgtcgtatggaataatattataaaagttgggaaatgtggaaaaggagcaccttttgcaagtattcaagaaattcaatttgaacattttaatgtatttaaagacgaaattgatattttaaaacctgatttaatggtattcttttctggaccaaattatgataacccaataagaaaagcattcgngaaaaatagagaaaaaaatcgattggatggatttaccggaaagacaacttttgtgaattag

SEQ ID NO: 23580 - protein, 214 aa, Unknown
  Obtained from environmental sample
  misc_feature (1)..(214): Xaa is any amino acid
MCNIQKNIPLHMNIDKTNKKLLELYKSKYPNLSNLLTEKNKSLEHSDKATNPLLLKIDENYANAKFKIMFFGQETNTWLGEQNNAEFLGQIEPVYNLYEDFFLSNNCYSYGGQFWNGVSRCVQLVEQEINEKVGVVWNNIIKVGKCGKGAPFASIQEIQFEHFNVFKDEIDILKPDLMVFFSGPNYDNPIRKAFXKNREKNRLDGFTGKTTFVN

SEQ ID NO: 23581 - DNA, 486 bp, Unknown
  Obtained from environmental sample
  misc_feature (1)..(486): n is a, c, g, or t
ttggaggcgctccttttcgacaggctcagtcaactttcagcgtttaagggtacacgcttgaaccagaatcctaacataaaaaacaaatttaaaagaatgaaaaaaatcacattgaccctaatcttctgcggactaaccttaatcggaaaatcccaaactgtaagtgtcgaaaaatcaattttcggaatacaaactggttttttaggaatttgggtacaaaatgaatcaaaattaaccaatctcattgcgttgagaagcgaaattggtctcgatacaggagtttccataagcgatggcaataatataacgggatttttgctcacacctgtcttaacactcgaacctagatggtattacaatttgaacaagcgggcaagtaaatcaagacggacagatggaaacagcggaaatttcatctcaataaagaccacatatcatcctgattggtttgtcatttctaatgaaagtaacctcagccgaatctga

SEQ ID NO: 23582 - protein, 161 aa, Unknown
  Obtained from environmental sample
  misc_feature (1)..(161): Xaa is any amino acid
MEALLFDRLSQLSAFKGTRLNQNPNIKNKFKRMKKITLTLIFCGLTLIGKSQTVSVEKSIFGIQTGFLGIWVQNESKLTNLIALRSEIGLDTGVSISDGNNITGFLLTPVLTLEPRWYYNLNKRASKSRRTDGNSGNFISIKTTYHPDWFVISNESNLSRI

SEQ ID NO: 23583 - DNA, 348 bp, Unknown
  Obtained from environmental sample
  misc_feature (1)..(348): n is a, c, g, or t
ttgaagaatacattatatcatattaccattactgattttacaaccgaaacaggttatacttctgatttcgatttaacttatcaattgtttgggcagcctttattctcggctccaattgtattggtgagtcatgccttgacgggtaactctgaagtagctggagaaaatggttggtggagtggaattataggaaaaaacaagttaatcaataccgataaatacacggttttatgttttgacataccagggaatggatatgactccaattcagaaaaactcatcaaaaattacaaagattttaagccgagagatattgctaaattttttggattgggattagagttttga

SEQ ID NO: 23584 - protein, 115 aa, Unknown
  Obtained from environmental sample
  misc_feature (1)..(115): Xaa is any amino acid
MKNTLYHITITDFTTETGYTSDFDLTYQLFGQPLFSAPIVLVSHALTGNSEVAGENGWWSGIIGKNKLINTDKYTVLCFDIPGNGYDSNSEKLIKNYKDFKPRDIAKFFGLGLEF

SEQ ID NO: 23585 - DNA, 717 bp, Unknown
  Obtained from environmental sample
  misc_feature (1)..(717): n is a, c, g, or t
atgaaagatgaatctaaatacttgatcaaaaaactggtacgacaagtcaccatatactgtagtttgatggtgttaatactaacagctacccttctgttttattttgatgcctttgccaaagatccaatgcccttagcggaaattacactgggcccagtagcatcagaatatgatatttctttattggacgattccaaagaaaatgaagttataaaatatggtcatgagctcttcaaaaatacacccagatatattggccccgacaatggcgacccagacatggtgtattcaggcaatagattggcatgtaacaattgtcatttgcaagccggcacgaaacctttttccggatcattgattggaattataaataggtttccacagtttcggggcagggaaaataaagtaggtacaattgaggaacggataaatggctgtatggagcgaagtatgaacggaaggaaaatctcccctgacggaaaggaaatgaaagcatttgtcacctacctgacatggctgagtagatttgcccctgaagacggaaaagtatctggtaaagggttcttgaaagttgaaatcccccatagagccgtcaatttaaaaaatggtaaacaggtttttgaaacgaactgcattgtatgtcatggcagaaatgggcaaggggtaaaaacaccggatgagttttacctatcaatatccaccactttggggcgatga

SEQ ID NO: 23586 - protein, 238 aa, Unknown
  Obtained from environmental sample
  misc_feature (1)..(238): Xaa is any amino acid
MKDESKYLIKKLVRQVTIYCSLMVLILTATLLFYFDAFAKDPMPLAEITLGPVASEYDISLLDDSKENEVIKYGHELFKNTPRYIGPDNGDPDMVYSGNRLACNNCHLQAGTKPFSGSLIGIINRFPQFRGRENKVGTIEERINGCMERSMNGRKISPDGKEMKAFVTYLTWLSRFAPEDGKVSGKGFLKVEIPHRAVNLKNGKQVFETNCIVCHGRNGQGVKTPDEFYLSISTTLGR

SEQ ID NO: 23587 - DNA, 624 bp, Unknown
  Obtained from environmental sample
  misc_feature (1)..(624): n is a, c, g, or t
gtgaaaaagatttgttttttattcttttgctttatgacctacatcgctgttggtcaaggtgaaaagtacattacggttaaaaaatcatttgaggttatgggtggtggttttgatataactgttatttgtgtcgatgaagaactagggtatatttatatacaagaagccttagctgaggttcaaagaattgaaaaactaatttcttcttgggacgaagcttctgaaaccagtctcattaataaaaatgcaggaattaaacctgtgccagtcagttgggaactttataaacttatagaaagatctatacaaatttctgaaataacaaacggtgcttttgatattacttacacagcacttgaagatatttggaagttcgatggttctatgagaactttgccaaataaacttgaggtaaaaggagctgtttctagaacagggtataagaacataatattgaatagtaaggatcaaacggtttatcttaataaaaagggtatgcgaatatcttttggtggtataggcaaggggtttgcggcagataaggcaaaagccttgctagtatcaaaagatgtgaaggcgggtattataaattttgatggagatattaccacttgggggtactaa

SEQ ID NO: 23588 - protein, 207 aa, Unknown
  Obtained from environmental sample
  SIGNAL (1)...(18)
  DOMAIN (6)...(207): ApbE family
  misc_feature (1)..(207): Xaa is any amino acid
MKKICFLFFCFMTYIAVGQGEKYITVKKSFEVMGGGFDITVICVDEELGYIYIQEALAEVQRIEKLISSWDEASETSLINKNAGIKPVPVSWELYKLIERSIQISEITNGAFDITYTALEDIWKFDGSMRTLPNKLEVKGAVSRTGYKNIILNSKDQTVYLNKKGMRISFGGIGKGFAADKAKALLVSKDVKAGIINFDGDITTWGY

SEQ ID NO: 23589 - DNA, 828 bp, Unknown
  Obtained from environmental sample
  misc_feature (1)..(828): n is a, c, g, or t
ttgagggtctctaccagtattattccacgaataacagatgtgataaccaatgatattgtcgcatggcagaacagacctttagaaccagtctatttaattgtttggatggatggtattgtgttcaaggttcgagagaactctaaagtaattaacaaaaccatttatatcgccgtaggacttcgtagggatggtaaaaaagaagtccttgggctttggttaggtaagaatgaatcagcagcattttggatgagtgttttaacagacttaaaagctcgtggtgtagaagacctgctcattacagcaaccgataatcttaatggttttacagatactataagaacagtatttccagaatctaaaactcaaatttgtgttgtacatcaaatacgtaatgcttgtaggtatgtagtttggaaagacaaaaaagcctttacaaaagatatgaaaaatatctacaatgcaccaacaaaacaggcagcagaagcagccttaagcgactttgctactacttgggaaagcaaatattcttatgccattaaaagttggagagataactgggaagaattaactgtattttttgaatttcctttagaaataagaaaaattatttataccactaaccttattgaaaacttaaatggaaaaattagaaaatacaccaaaaataaattatcattcccaacagatcaggctgtgatgaaatccgtatatttggctgtaagagaagcaaccaaaaaatggtcaatgcctattagaaattggggaattattctcaatcaattcttaaccatatatgaaaaaagaggtcagactttaagtaaaagataa

SEQ ID NO: 23590 - protein, 275 aa, Unknown
  Obtained from environmental sample
  DOMAIN (1)...(250): Transposase, Mutator family
  misc_feature (1)..(275): Xaa is any amino acid
MRVSTSIIPRITDVITNDIVAWQNRPLEPVYLIVWMDGIVFKVRENSKVINKTIYIAVGLRRDGKKEVLGLWLGKNESAAFWMSVLTDLKARGVEDLLITATDNLNGFTDTIRTVFPESKTQICVVHQIRNACRYVVWKDKKAFTKDMKNIYNAPTKQAAEAALSDFATTWESKYSYAIKSWRDNWEELTVFFEFPLEIRKIIYTTNLIENLNGKIRKYTKNKLSFPTDQAVMKSVYLAVREATKKWSMPIRNWGIILNQFLTIYEKRGQTLSKR

SEQ ID NO: 23591 - DNA, 363 bp, Unknown
  Obtained from environmental sample
  misc_feature (1)..(363): n is a, c, g, or t
atggagacaacagaaacaaaaacagctacaccaatagtaaacacagaaacatctgaaggtaaaaccacagcaatcattgcctatataaccttcattggtttaatcatcgcttttgtaacaaacaacgaaaagaaaaataaatttgtccaataccacattcgtcaatcattagggcttgccattactggattggttctaggagccattgggatgatacccattttaggttggattatcaacattcttggcttttttgtaatggtctacatgtgggtaatgggtctaatgaacgccatcaatgaaaaacaaagaccaattccaattttgggtaaaaaatatgaagaatggtttaagaatatttaa

SEQ ID NO: 23592 - protein, 120 aa, Unknown
  Obtained from environmental sample
  DOMAIN (26)...(118): Uncharacterised protein family (UPF0132)
  misc_feature (1)..(120): Xaa is any amino acid
METTETKTATPIVNTETSEGKTTAIIAYITFIGLIIAFVTNNEKKNKFVQYHIRQSLGLAITGLVLGAIGMIPILGWIINILGFFVMVYMWVMGLMNAINEKQRPIPILGKKYEEWFKNI

SEQ ID NO: 23593 - DNA, 546 bp, Unknown
  Obtained from environmental sample
  misc_feature (1)..(546): n is a, c, g, or t
atgaatattacaagagaaaacatagatgcattaaacgcagttgtaacggtagatatcgcaaaagacgattacaataacaaagttcaaaaaatcttaacagattataagaaaactgcgaacattccagggtttagaaaaggccaagtgccaatgggaatggtgaaaaagcaatacggtaaagcggtattaatagaagaagtaaacaaacttcttcaagagtctttaaataaatatttatctgaagagaagttagatgttttaggacagccattgccaaaaattcaaaataacattaattgggaaggtgacaatttttcttttgaatttgaattaggattagctccagaatttgatgttgatttaaaaggaaagaaagcaattaaacattatacgattgttgccgacgataaaatgattgacgagcaagtagaacgtgttcaaaaacaatacggaaaactaatctctcaagatactgttgaagaagatagcgaaattactggtgtttttaaaaatgaaaaaaaggcattgagaataccacgactttaa

SEQ ID NO: 23594 - protein, 181 aa, Unknown
  Obtained from environmental sample
  DOMAIN (1)...(153): Bacterial trigger factor protein (TF)
  misc_feature (1)..(181): Xaa is any amino acid
MNITRENIDALNAVVTVDIAKDDYNNKVQKILTDYKKTANIPGFRKGQVPMGMVKKQYGKAVLIEEVNKLLQESLNKYLSEEKLDVLGQPLPKIQNNINWEGDNFSFEFELGLAPEFDVDLKGKKAIKHYTIVADDKMIDEQVERVQKQYGKLISQDTVEEDSEITGVFKNEKKALRIPRL

SEQ ID NO: 23595 - DNA, 306 bp, Unknown
  Obtained from environmental sample
  misc_feature (1)..(306): n is a, c, g, or t
ttgcaaaaacaatactacacaacacatatgtctcgaaaaaatcaaactttaggcgaattcattattgaaaaccaatcgtcttttaaatacacctctggagaattatcccgattaattaactcaattagattagctgcgaaagtggtaagtcacgaagtaaacaaagccggattagtagatattattggggctgctggcgatacaaatattcaaggtgaagaccaacaaaaattggatgtgtatgccaacgacaaatttatacaaacgcttaaaaacagaaatatagtttgtggtatttgcaagtga

SEQ ID NO: 23596 - protein, 101 aa, Unknown
  Obtained from environmental sample
  misc_feature (1)..(101): Xaa is any amino acid
MQKQYYTTHMSRKNQTLGEFIIENQSSFKYTSGELSRLINSIRLAAKVVSHEVNKAGLVDIIGAAGDTNIQGEDQQKLDVYANDKFIQTLKNRNIVCGICK

SEQ ID NO: 23597 - DNA, 756 bp, Unknown
  Obtained from environmental sample
  misc_feature (1)..(756): n is a, c, g, or t
ttgagggtcttaaagattgtgttatggtttaatcctttagtgtatttatatcaaatcagaattagtaatattcacgaatttttagcggatcaaaatgcagtaaaattcaataaatcagagtattatcaacaattattacagcaagtttttaatgttaaaacgtatgcttttatcaatccatttttcaatcaatcattaatcaaaaaacgaatcattatgttacaaaaatcaaaaacgaaacagacacatttagttaagtatttattattaattcctatggttttaggaatgttagtctattcatcttgttccaacgaaagtgaagtaaccaaagacccaatagtaaatatgcagaccgaaacattagatgtaaacaacagtaagcaaataggtgtagacctgccattttctgctattgatcaatcccctttatttgaagcctgtaaaacgcttgttgacaaagaccaacaaaaaaaatgtttttcagatcaagtatctaatcatgtcctaaacaattttaatactaaattagctgataatttagatttaaaaaaaggaatcactaaggtgtttgtaagttttaaaataagtaaaacaggagagattattgatgtcatgtcaagagcagaacatcctgatcttgaggtagaagccaatcgtgtaataaataatctacctaaattgacacctggtatgcatgaaggtaaagcagtagatgttgtttacggtttaccaatcgcgtttaaaattaaataa

SEQ ID NO: 23598 - protein, 251 aa, Unknown
  Obtained from environmental sample
  misc_feature (1)..(251): Xaa is any amino acid
MRVLKIVLWFNPLVYLYQIRISNIHEFLADQNAVKFNKSEYYQQLLQQVFNVKTYAFINPFFNQSLIKKRIIMLQKSKTKQTHLVKYLLLIPMVLGMLVYSSCSNESEVTKDPIVNMQTETLDVNNSKQIGVDLPFSAIDQSPLFEACKTLVDKDQQKKCFSDQVSNHVLNNFNTKLADNLDLKKGITKVFVSFKISKTGEIIDVMSRAEHPDLEVEANRVINNLPKLTPGMHEGKAVDVVYGLPIAFKIK

SEQ ID NO: 23599 - DNA, 330 bp, Unknown
  Obtained from environmental sample
  misc_feature (1)..(330): n is a, c, g, or t
atgcaaaaatcgattgaaaaattagatcccattccagaatttataatagttgatggtaataaatttaaaccttataaaaatatcccccacgaaactataattaaaggagatagtaaatttttaagtattgctgctgcttcagttttagcaaaaacgtatcgcgatgcttatatgaatactattcataaagaattcccgatgtacaattggaaacaaaacaaaggatatcctacaaaagaacatcgcgcagctattagaaaatatggtattacaaaataccacagaaagagtttcaaacttttgccagagcaattaacacttgaaatttaa

SEQ ID NO: 23600 - protein, 109 aa, Unknown
  Obtained from environmental sample
  DOMAIN (1)...(101): Ribonuclease HII
  misc_feature (1)..(109): Xaa is any amino acid
MQKSIEKLDPIPEFIIVDGNKFKPYKNIPHETIIKGDSKFLSIAAASVLAKTYRDAYMNTIHKEFPMYNWKQNKGYPTKEHRAAIRKYGITKYHRKSFKLLPEQLTLEI

SEQ ID NO: 23601 - DNA, 333 bp, Unknown
  Obtained from environmental sample
  misc_feature (1)..(333): n is a, c, g, or t
atgaatattaaaaataaagaatcttatatacttatttcttcggatgaaaattcgttctcaaaattctataatttacttttagagaaactacctaattataaaaaacaacatatcgttttaaatatttctgatacaataagtacaaataaagaagattttttactatttttagatattgcaacacaaaaaaaggtagagaaaacatcttttgtaattatttctgaatctgtaaatatggatgattatcctgaagattttaatatagtacctactttaattgaagcagaagatattatagaaatggaaaatatggaaagagaattaggcttttaa

SEQ ID NO: 23602 - protein, 110 aa, Unknown
  Obtained from environmental sample
  misc_feature (1)..(110): Xaa is any amino acid
MNIKNKESYILISSDENSFSKFYNLLLEKLPNYKKQHIVLNISDTISTNKEDFLLFLDIATQKKVEKTSFVIISESVNMDDYPEDFNIVPTLIEAEDIIEMENMERELGF

SEQ ID NO: 23603 - DNA, 561 bp, Unknown
  Obtained from environmental sample
  misc_feature (1)..(561): n is a, c, g, or t
atgatgcaaggtggaatggattatttctggacactttttcatcctgaagacattaaactttggcttaaaagtttaacaaatttaatgacgtttaccatgactgaattaaatgatgagcagcgtaaaagaatgagctatacttggaattacaggattaaaaacgcctcaaacaagtatgtgaatattattcaaaacacaactcctctgcaatttgacgatgctaaaaaaccaattattggcatggcacattacactgttttagatggagatatgcatatggatatttgtgcaagtgcaaaatatttaaacgataataacgagtatgaaaccttgttttatgaaaatgtgtatagccaaaaattactagatgttttcacaaatagagaaagagatattataaggttaattattacaaaaaataaaagtgaagttattgcagataaattaaatattagcattcacactgtaaatactcacagaaaaaacatcttaaaaaaaataaatattgattccacttttgagttaatcagttattttaaaaacaacccaaaactgatataa

SEQ ID NO: 23604 - protein, 186 aa, Unknown
  Obtained from environmental sample
  DOMAIN (122)...(179): Bacterial regulatory proteins, luxR family
  misc_feature (1)..(186): Xaa is any amino acid
MMQGGMDYFWTLFHPEDIKLWLKSLTNLMTFTMTELNDEQRKRMSYTWNYRIKNASNKYVNIIQNTTPLQFDDAKKPIIGMAHYTVLDGDMHMDICASAKYLNDNNEYETLFYENVYSQKLLDVFTNRERDIIRLIITKNKSEVIADKLNISIHTVNTHRKNILKKINIDSTFELISYFKNNPKLI

SEQ ID NO: 23605 - DNA, 960 bp, Unknown
  Obtained from environmental sample
  misc_feature (1)..(960): n is a, c, g, or t
ttgcttatcgcgaatgattacagacgttttaactacacaccttacgcttataaaactactaactacggtaaaacatgggagcgtattgtagacgaaaatgatgttaaaagttacaccttatcaattattgaagatctagaagaaccaaacttactatttttaggtacagatgatggtttatacgtatctataaacgcaggtaataattggactaaatggacggaaggtttccctactgtttctgtaaaagacttagtaatccatcctagagagcatgatttagtaattgggacttttggacgtgctgcttgggttttggacgatattagaccattacgtgctatagcaaaaaacaaacaagttatagacagtaaaataaccctattctctcctcctattgcctatcaagcagcttaccaacaaccaacaggaagtcgatttggtgcagatgctatgtttaatggagataacagaggtcgtggtgcacaatttacgtatttggttaatcctgtaaaagcttcaaaagaagagaaaaatgacgatgatgatgataaagcaaatgattctgatgctgatgacgataaaaatgaaattaaatgggattctatttcattaaaaatatacaatggagataagttaattagaaccttaaaacgtaaggttccagaagataaaggattacataaatggacttggtatatggacgaaaaaggtggcgacagaccatcaagaaccgttagaaaaagctctagagaatctggaggtgtagatgtaaaaacaggtaactacaaagctattttagaatatggtgaccaaacttcagaatccatgattactgtagcgtcagatccaagactagaagtttctaccaaaaatacagatgctgtctatgctgctttaaaagagatgaaaaatatccgtcaaatacggctgatccacctaagcattagccgaaaataa

SEQ ID NO: 23606 - protein, 319 aa, Unknown
  Obtained from environmental sample
  misc_feature (1)..(319): Xaa is any amino acid
MLIANDYRRFNYTPYAYKTTNYGKTWERIVDENDVKSYTLSIIEDLEEPNLLFLGTDDGLYVSINAGNNWTKWTEGFPTVSVKDLVIHPREHDLVIGTFGRAAWVLDDIRPLRAIAKNKQVIDSKITLFSPPIAYQAAYQQPTGSRFGADAMFNGDNRGRGAQFTYLVNPVKASKEEKNDDDDDKANDSDADDDKNEIKWDSISLKIYNGDKLIRTLKRKVPEDKGLHKWTWYMDEKGGDRPSRTVRKSSRESGGVDVKTGNYKAILEYGDQTSESMITVASDPRLEVSTKNTDAVYAALKEMKNIRQIRLIHLSISRK

SEQ ID NO: 23607 - DNA, 801 bp, Unknown
  Obtained from environmental sample
  misc_feature (1)..(801): n is a, c, g, or t
atgcaacgtttaatttcaatcataataccttgttacaatgattcagattttatctgtaaagcggtcgattcggctctcaatcaaacctatcccaacattgaaattattgtagttgatgatggttcagatgcgaaaaccaaattggtgcttaaagctctagagtcaaaaatcacaaagctaattacccaacacaatcaaggtcagagtgtagcaaggaataatgggattaaagtggcaaaaggagactatattttgaatctggattctgatgatttttttgagtcaaccttttgcgaaaaggctgttttaaaatttcacgaggacactagcattaaaattgtaacttgtttagcaaaacgctttagcaaaaaagggacgattgatgtgtttacaccaagaggtggtgctatccataattttttatttgccaattcggctttgggttcttccatgtttaaaagaaaagattgggagttagttggtggctatgaagaggaattgcacattttaggttttgaagattgggaattttatattcaactattaaagagtggaggttatgcctacgtactcaacgaggttttgttccattaccaagtgagggaaaactcaaccactgaccgcatacgtcatttaaaattggataaattcaaactaattattttaaaacaccaagatctgtataaagataatttcgaaaatttagtcaataatcttttagaaaggatcagaaaagaaagtatagaaaagggtaaaaataccgaaccgattggattttgtaattgggaaaaacatttttaa

SEQ ID NO: 23608 - protein, 266 aa, Unknown
  Obtained from environmental sample
  DOMAIN (6)...(161): Glycosyl transferase
  misc_feature (1)..(266): Xaa is any amino acid
MQRLISIIIPCYNDSDFICKAVDSALNQTYPNIEIIVVDDGSDAKTKLVLKALESKITKLITQHNQGQSVARNNGIKVAKGDYILNLDSDDFFESTFCEKAVLKFHEDTSIKIVTCLAKRFSKKGTIDVFTPRGGAIHNFLFANSALGSSMFKRKDWELVGGYEEELHILGFEDWEFYIQLLKSGGYAYVLNEVLFHYQVRENSTTDRIRHLKLDKFKLIILKHQDLYKDNFENLVNNLLERIRKESIEKGKNTEPIGFCNWEKHF

SEQ ID NO: 23609 - DNA, 603 bp, Unknown
  Obtained from environmental sample
  misc_feature (1)..(603): n is a, c, g, or t
ttgaaagtatcctatttgaaatgctgtgattctgttggattaccatcagattcttctaatacccctctaagtttgtgtgattttnaaaatgtaattaattctagagagatttttaatgccaatgaaaaaccaaaagcaatcacatttttaaaaaataaagttagcaatcaactaaaaaaattgacggttcatattcctaatgatgagcattatactactaggctagccaaattaaatgctgccaatgtagattttactgatgttgacaccgtaaataaaatgattgctaaaaataactttccaaatcctgtaaaaaagcaacccaattatttaaaacctctcttttatgtaattcttttaaatagtatttttccttttttgatttggaaaaaaatgtcaaaaaacattaaagaaattgaatttattgacaccatgaaatatgctgtaaacgtgattagttttcctatattttatagcttgcaagcatttgtaattcaatatttctttggctggaaagttgctttgatttattttgttgcttcgtttttatcaattttattatacaccaagttttctgtgacgaatactgaagatttagtttaa

SEQ ID NO: 23610 - protein, 200 aa, Unknown
  Obtained from environmental sample
  misc_feature (1)..(200): Xaa is any amino acid
MKVSYLKCCDSVGLPSDSSNTPLSLCDFXNVINSREIFNANEKPKAITFLKNKVSNQLKKLTVHIPNDEHYTTRLAKLNAANVDFTDVDTVNKMIAKNNFPNPVKKQPNYLKPLFYVILLNSIFPFLIWKKMSKNIKEIEFIDTMKYAVNVISFPIFYSLQAFVIQYFFGWKVALIYFVASFLSILLYTKFSVTNTEDLV

SEQ ID NO: 23611 - DNA, 834 bp, Unknown
  Obtained from environmental sample
  misc_feature (1)..(834): n is a, c, g, or t
atggatcagaatcggctcgagatcatatacaaaagaggtagctggaaacgattatgtcaattagccggaaaaacagaaaacttcaattctgataatgaaaaagctatcgtttctgctatttcaaacaaatggctatctacaaattcactcagttatttttctttcattttaaaaattgcaaaacagaattttaaggtgacaatttcagaattgaatgaaaatgaaaaaaccatgcttctaatgttgcattacgatgtttggcagaaagaagaaggtttcgattctttagaaaaaagtattctccaaattggaaataatcttgttctagtcgaagaaataaaggaaattctagaatttttaattgataatatagacttcaaagaattaccgattaaacttccatatgaacaaccattaaaattacatagtcgttatacaagagaccaaatattaactgctttccaatttagtagtttcacaaaaaaatcatctaatagagaaggaactgcattgaatatagatttgaataccgaattactttttatcaaccttattaagtccgaagaaaacttttcaccaaccacaatgtatgatgattatgctgtaaatgaattactatttcattggcaaactcaaaactctgcaagacctgataaaggaaaaggattgtcttacataaaacatcaagaggacaataaacgaattttactttttgttcgcgaaaaagcaaaagatgaatttaggaatacaaaaggttatgtttttataggagaaggaaatataaaagaccactacggttcaaaaccaatgagtatttattgggaaataaaatga

SEQ ID NO: 23612 - protein, 277 aa, Unknown
  Obtained from environmental sample
  misc_feature (1)..(277): Xaa is any amino acid
MDQNRLEIIYKRGSWKRLCQLAGKTENFNSDNEKAIVSAISNKWLSTNSLSYFSFILKIAKQNFKVTISELNENEKTMLLMLHYDVWQKEEGFDSLEKSILQIGNNLVLVEEIKEILEFLIDNIDFKELPIKLPYEQPLKLHSRYTRDQILTAFQFSSFTKKSSNREGTALNIDLNTELLFINLIKSEENFSPTTMYDDYAVNELLFHWQTQNSARPDKGKGLSYIKHQEDNKRILLFVREKAKDEFRNTKGYVFIGEGNIKDHYGSKPMSIYWEIK

SEQ ID NO: 23613 - DNA, 921 bp, Unknown
  Obtained from environmental sample
  misc_feature (1)..(921): n is a, c, g, or t
atggctgcaagttatgattactatgtgctaggtggagttagtgtagccccgaataataagttagtttcttttggaatagacactgttagtcgcagacaatatattattcaatttaaagatttggaaacaggaaatatttttcctgaaaaaatagaaaattctacaggttatgcggtttgggctaatgataataagacagttttttatacaaaaaaagacccaattactttaagaagcgataaaatttacaaacatattctaggtactgacccgtctaatgatgtagaaatatttcatgaaaaggatgatacattcagtacatttgtatataaaacaaaatctaaaaagtttatagttgtaggttctggaagtacccttactgatgagtatcaggtcttaggggctgataatcctaatgaaaatttacgcatcattcagcctcgcacgagaggattagagtacggaatttcacattacaatgattatttttatattcttactaataaagataatgcgaccaattttaaattgatgcgcactcctgaagataaaactactattgaaaattgggaagatgtaatcccgcatagggatgatgttttattggaagacatttcaatttttaaagattatttggtcttggaagaaagaaataatggattgaacaaaattcgcataaaacgttgggatggttcggctgattattatttgccttttgatgaagaaacttattcagtaggagtttataataatcctgagtttgatacagacattattcgatatggatatcaatcatttactactccgtcttcaattattgattttaatatggcagataaatctaaagatattaaaaaagaacaggaagtgttagggggaaaatttgacaagagtaattataagagtgaaagaattggctga

SEQ ID NO: 23614 - protein, 306 aa, Unknown
  Obtained from environmental sample
  DOMAIN (1)...(288): Prolyl oligopeptidase, N-terminal beta-propeller domain
  misc_feature (1)..(306): Xaa is any amino acid
MAASYDYYVLGGVSVAPNNKLVSFGIDTVSRRQYIIQFKDLETGNIFPEKIENSTGYAVWANDNKTVFYTKKDPITLRSDKIYKHILGTDPSNDVEIFHEKDDTFSTFVYKTKSKKFIVVGSGSTLTDEYQVLGADNPNENLRIIQPRTRGLEYGISHYNDYFYILTNKDNATNFKLMRTPEDKTTIENWEDVIPHRDDVLLEDISIFKDYLVLEERNNGLNKIRIKRWDGSADYYLPFDEETYSVGVYNNPEFDTDIIRYGYQSFTTPSSIIDFNMADKSKDIKKEQEVLGGKFDKSNYKSERIG

SEQ ID NO: 23615 - DNA, 681 bp, Unknown
  Obtained from environmental sample
  misc_feature (1)..(681): n is a, c, g, or t
atgaacaacttaaatgcaaattacgaaagaatattggaagtattacaaaaaatatcaaaagaacaacttttaacctatcaaaggcgtcaaccaaagttgagtgatttagaactgattagtttaagtcttacagctgaatttatgggaatagatagtgagaatgatttattcagaaaacttcccaagcctatttctgctaaaattgaacgaagtgtttacaacagaagaagacgaaaattagtaaattatatcgatggtattcgattaaaactagcttctcattttaatgaatttgaagattattttattgtagatagcatgcctttggaggtttgtaaattatctcgaagttctcgttcaaaaatatgtaaagaagatacttacgcatttcctgacaaaggctattgtgcttctcaaagttctaattattatggttataaattacatgctgtttgttctgtaaatggtgtttttcagagtattgatttgagtccagcatctgtacatgatgtgaattatcttaaagatattacccaacaaataagtgattgtactttaattggcgatagaggttatttgtcagcagaaatacaactcaatttatttgaaacctgcaatattaaactaaacacacctatgagaaacaatcaaaaaaattacaaaaaacaaccttatttttag

SEQ ID NO: 23616 - protein, 226 aa, Unknown
  Obtained from environmental sample
  misc_feature (1)..(226): Xaa is any amino acid
MNNLNANYERILEVLQKISKEQLLTYQRRQPKLSDLELISLSLTAEFMGIDSENDLFRKLPKPISAKIERSVYNRRRRKLVNYIDGIRLKLASHFNEFEDYFIVDSMPLEVCKLSRSSRSKICKEDTYAFPDKGYCASQSSNYYGYKLHAVCSVNGVFQSIDLSPASVHDVNYLKDITQQISDCTLIGDRGYLSAEIQLNLFETCNIKLNTPMRNNQKNYKKQPYF

SEQ ID NO: 23617 - DNA, 744 bp, Unknown
  Obtained from environmental sample
  misc_feature (1)..(744): n is a, c, g, or t
ttggctcagatctttatttatggtttgttaacacgccaggatttgctgaacttgtattttagtcacttaaaaatgtcattaggcggcggtatggctgtacaacgcccagttgctgaaaaatggcaaacagttacaaaatctaaattaatggaagggtatggtttaaccgagtgttctcctttagttaccgttagtccttatgacttaactgcatataatggctcaattggtttaccggctccaagtaccgaaatcaaattaattcttgataatggccaagaagcagcaaaaggtgaaccaggagagctttgggttaaaggcccgcaagttatgcttggttactacaaacgcccagatgcaaccgctgagagcttacaagatggctggtttgctaccggtgacatagcaacttatgacgacgaaggtttcttttatatagtcgatcgtaaaaaagatatgattattgtctcgggctttaatgtattccctaacgaaattgaagaagttgttgccatgcacgacggagtgcttgaagtagcagctattggtatccctcacgatacgagtggtgaacaagttaaagtttttgttgtaaaaaaagacccttctttaactgaaaaagatataataaaacactgtcgtgataatttaactaattataaggtgcctaagcttgttgagtttagggatgagttacctaaaactaacgtaggtaaaatactcagaagagccttgaaagattag

SEQ ID NO: 23618 - protein, 247 aa, Unknown
  Obtained from environmental sample
  misc_feature (1)..(247): Xaa is any amino acid
MAQIFIYGLLTRQDLLNLYFSHLKMSLGGGMAVQRPVAEKWQTVTKSKLMEGYGLTECSPLVTVSPYDLTAYNGSIGLPAPSTEIKLILDNGQEAAKGEPGELWVKGPQVMLGYYKRPDATAESLQDGWFATGDIATYDDEGFFYIVDRKKDMIIVSGFNVFPNEIEEVVAMHDGVLEVAAIGIPHDTSGEQVKVFVVKKDPSLTEKDIIKHCRDNLTNYKVPKLVEFRDELPKTNVGKILRRALKD

SEQ ID NO: 23619 - DNA, 603 bp, Unknown
  Obtained from environmental sample
  misc_feature (1)..(603): n is a, c, g, or t
atgactccgatgatgattaaagatgtttctgaatattgctcaaacttgcttacaagttctaaatgcaaagagctgccatttcacaatcttgagcatacaaaagaagttgttcaaaatgtaaagtacttatgtgcagcaatggatatcaattcgctagaaacagatttgttaattattgcagcttggtttcacgacacaggattttctaaaacatacaaagaccacgaagccgaaagtatcataattgctaaaaagtttctttccagtataggaatggaaagcaatagtattagtacaatttgtaattgtatagaagccacaaagatgcctcaaagtccaacagatagattatctgaaattctgtgcgatgcagacatttttcatataagtaactcgcatttcttttacagaaaattattgcttcgtagagaatgggagttattctgtgatattaaaacaacaaataaagaatggcatttattgaatctcaaatttttaaaagagcatcactttagaagtgattatggaaagcaaactttagaaatcggcaagcaggaaaatcttcataaagttgaaaacattttaaactatttcaatgaataa

SEQ ID NO: 23620 - protein, 200 aa, Unknown
  Obtained from environmental sample
  DOMAIN (29)...(130): HD domain
  misc_feature (1)..(200): Xaa is any amino acid
MTPMMIKDVSEYCSNLLTSSKCKELPFHNLEHTKEVVQNVKYLCAAMDINSLETDLLIIAAWFHDTGFSKTYKDHEAESIIIAKKFLSSIGMESNSISTICNCIEATKMPQSPTDRLSEILCDADIFHISNSHFFYRKLLLRREWELFCDIKTTNKEWHLLNLKFLKEHHFRSDYGKQTLEIGKQENLHKVENILNYFNE

SEQ ID NO: 23621 - DNA, 417 bp, Unknown
  Obtained from environmental sample
  misc_feature (1)..(417): n is a, c, g, or t
gtgactggttatgatgacaaaactggagcttgcattatcgaaagaggcaacagctaccaaccttctaagcttgctgaccagtttgatgcgaacaatattaaaaatccaaaatacgaatacgaaaagtatggagttgagtatgcccgttcaagtgttatacgaagaaaagtattgctacgatcaaatggtaagtgtgagtactgtttatcagatggattcattacaaacagcggcgataaatacttggaaacacaccatatcctccctttaagtcaaggcggcgatgattcatttataaatgttattgcactatgtcctaaagaccaccgaaaggctcattttgaaaaagactcttttctaactcaggaaagtttgagcactatagtgaaagcaaagcttacagttgggaactgctaa

SEQ ID NO: 23622 - protein, 138 aa, Unknown
  Obtained from environmental sample
  DOMAIN (63)...(116): HNH endonuclease
  misc_feature (1)..(138): Xaa is any amino acid
MTGYDDKTGACIIERGNSYQPSKLADQFDANNIKNPKYEYEKYGVEYARSSVIRRKVLLRSNGKCEYCLSDGFITNSGDKYLETHHILPLSQGGDDSFINVIALCPKDHRKAHFEKDSFLTQESLSTIVKAKLTVGNC

SEQ ID NO: 23623 - DNA, 402 bp, Unknown
  Obtained from environmental sample
  misc_feature (1)..(402): n is a, c, g, or t
atgggtggtaaatctgccaatgaagatgtttatgaagataagtgtaaccactctagcaatatggaaaatctagcgaccaaagcagaaagagattctattaaatacatgcaaattcgttttatggaagaccataagaatgaagagtttgtaggtgtaatatcaggagtgacggattggggtatctatatcgaaattatctctaataaatgtgaaggtatggtaagtgtacgcgacatgaaagatgatcattatcaatttgatgaagaccattacgctttaataggtcaaaactctaaaataatgtaccaacttggagatgaggttattgttagagtgaagaatacagatttagtaaaaaaacatcttgattttactttattaggtaaaaaagaagataattaa

SEQ ID NO: 23624 - protein, 133 aa, Unknown
  Obtained from environmental sample
  DOMAIN (42)...(127): S1 RNA binding domain
  misc_feature (1)..(133): Xaa is any amino acid
MGGKSANEDVYEDKCNHSSNMENLATKAERDSIKYMQIRFMEDHKNEEFVGVISGVTDWGIYIEIISNKCEGMVSVRDMKDDHYQFDEDHYALIGQNSKIMYQLGDEVIVRVKNTDLVKKHLDFTLLGKKEDN

SEQ ID NO: 23625 - DNA, 477 bp, Unknown
  Obtained from environmental sample
  misc_feature (1)..(477): n is a, c, g, or t
ttgaaatcttcattttttgccttagacgataaaccgactttaaagatagaaaaagaacgtttagaacgtataattaatcaggatattcctgcggctagacaatcgttttctaaattaaatttgccagaatcgtatcgtaatttaaccgaactagaaatccctgaagatttcacaatggggtatattaaccacgtagggtttagagcaggaacctgtacaccattctttttctacgacttggactacgaaatacaaacgccgttgcgtattaacacctaccacgttttagattttgcgcttttaaagcattattctttactagataaaaaaatgatactaaaccgtattataaatgaagtaaaaaaggtgaatggtgagtttgtaccagtatttcataattatacctttggaaatatagagcgttggaaagggtataaagaactttttaatattataatagaatctacaaatgagtaa

SEQ ID NO: 23626 - protein, 158 aa, Unknown
  Obtained from environmental sample
  misc_feature (1)..(158): Xaa is any amino acid
MKSSFFALDDKPTLKIEKERLERIINQDIPAARQSFSKLNLPESYRNLTELEIPEDFTMGYINHVGFRAGTCTPFFFYDLDYEIQTPLRINTYHVLDFALLKHYSLLDKKMILNRIINEVKKVNGEFVPVFHNYTFGNIERWKGYKELFNIIIESTNE

SEQ ID NO: 23627 - DNA, 801 bp, Unknown
  Obtained from environmental sample
  misc_feature (1)..(801): n is a, c, g, or t
atgcttttgatcaatttacaaaaaaagcattataaaaaattaatgcaaaaatttgatattacagagttacaacttaaagatgccattcatgaaattgaacgtttaaatccaaaacccggaggatcatacgctggaaacaacagaattgtagaacacgtcgtgcctgattttgctataaaaattgttgatggcgagttagagcttactttaaatggtcgtaatgcgccagaattacatgtttctagagaatatagtaacatgatgaaaggttataaagaaagtaaagataaaagtaagtcgcaaaaggatgcagttatgtttataaaacaaaaactagatgcagccaagtggtttatagatgccatcaaacaacgtcaacaaactttatttgttacaatgagtagcatcatgcattaccaaaaagaatattttttaacaggtgatgagcgcaatctaaaaccaatgatattaaaagatattgctgacgagattgaaatggatgtttcaacagtatcacgtgtggctaatagcaaatacgtagatacaccttacggaactaagttgataaaagaatttttctctgaatcgatgactaacgatcaaggtgaggaagtatccacaagagaaattaaaaaaatattagaaactgtcattgaagaagaaagcaaaaagaaaccgcttacagatgaagctttagctaaaatattaaaagaaaaaggctatcctattgcacgacgtacagttgctaaatatagagagcaattggatataccagttgctagattgcgtaaaaaaatataa

SEQ ID NO: 23628 - protein, 266 aa, Unknown
  Obtained from environmental sample
  DOMAIN (105)...(265): Sigma-54, DNA binding domain
  misc_feature (1)..(266): Xaa is any amino acid
MLLINLQKKHYKKLMQKFDITELQLKDAIHEIERLNPKPGGSYAGNNRIVEHVVPDFAIKIVDGELELTLNGRNAPELHVSREYSNMMKGYKESKDKSKSQKDAVMFIKQKLDAAKWFIDAIKQRQQTLFVTMSSIMHYQKEYFLTGDERNLKPMILKDIADEIEMDVSTVSRVANSKYVDTPYGTKLIKEFFSESMTNDQGEEVSTREIKKILETVIEEESKKKPLTDEALAKILKEKGYPIARRTVAKYREQLDIPVARLRKKI

SEQ ID NO: 23629 - DNA, 723 bp, Unknown
  Obtained from environmental sample
  misc_feature (1)..(723): n is a, c, g, or t
ttgtacttttgcgtgttttttaatgataattctgaaaaagctatacaatatatgaaagataagaggatattatatgtatcatctgaagtggtgccttatttaccggaaacagaaatttcttcaatgtcatttgaaacacctaggatgatcaatcagcaaggtggacaaataagaattttcatgcctagatatggaaatatcaacgaaagaagacatcaattacatgaagttatccgtctttctggtattaatttagttgtgaatgatttagacatgcctttaattattaaagtagcctctatacctaaagaacgtattcaagtttactttatagataacgatgaatattttaaaagaaaagcaacacttacagatgaggatggaaatttattttctgataatgatgaaagagctatcttttttgctaaaggtgttattgaaaccgttaaaaaattaaattggtcaccagatattattcacgttcatggatggttagcctctttactaccactatatttaaagcaattttacaaagacgaacctttatttaacgaaagtaaaattgttacttcagtatataaaagtggctttgaaaacgagttaaattcaaaattagttgataaaattaaatttgataatattgatgaagatcaaataaaggatttagttaagcctacttataataatctaatgaaggtagcaatagacaactctgatgcctaa

SEQ ID NO: 23630 - protein, 240 aa, Unknown
  Obtained from environmental sample
  misc_feature (1)..(240): Xaa is any amino acid
MYFCVFFNDNSEKAIQYMKDKRILYVSSEVVPYLPETEISSMSFETPRMINQQGGQIRIFMPRYGNINERRHQLHEVIRLSGINLVVNDLDMPLIIKVASIPKERIQVYFIDNDEYFKRKATLTDEDGNLFSDNDERAIFFAKGVIETVKKLNWSPDIIHVHGWLASLLPLYLKQFYKDEPLFNESKIVTSVYKSGFENELNSKLVDKIKFDNIDEDQIKDLVKPTYNNLMKVAIDNSDA

SEQ ID NO: 23631 - DNA, 762 bp, Unknown
  Obtained from environmental sample
  misc_feature (1)..(762): n is a, c, g, or t
atgaaaaaattagctgtattaattgtattagtatgcacaatattatcgtgcaacgaagggacaaaacaaaaccagcgtatggtcccaaaatcttcaggaaacttatataacgttagtgttgttgtagataacgagttatggaaaggtaatgttggagacgctattagagacgtattaactactgtagtacctggattaccacaaccagagcctatgtttgatattaatcaaattccgccacaagtattctctggatttgctgcaaaaaatagaattgttttaaaaatagaacaaagcgaaaagtctgagattaaaatagctacagatgcgtatgcacaacctcaaaaggtagtagttgtatcaggaccaaatgacagcaaaattattgaggttttaaagtctaataaagataaaattttagatacgtttaaaaaccaagaaattgaagcacgtcaaacgttgacaaacaactcactgcatacaaataataacatagaanaaaaaataggaatctcgattaagtttccatctatctatagaatagctaaagaggatggtgattttttctgggttagaaaaaatttaacaacaggaactaataattttatggtgtaccaagtaccattagatgctatagataaagaaggagatattacacagcaaattataactattagagatagtgttggtaaaaagtatattcctggaccaataggtggctcatacatgaaaaccgaaagagccttaacaaccctttttatt

SEQ ID NO: 23632 - protein, 254 aa, Unknown
  Obtained from environmental sample
  SIGNAL (1)...(18)
  misc_feature (1)..(254): Xaa is any amino acid
MKKLAVLIVLVCTILSCNEGTKQNQRMVPKSSGNLYNVSVVVDNELWKGNVGDAIRDVLTTVVPGLPQPEPMFDINQIPPQVFSGFAAKNRIVLKIEQSEKSEIKIATDAYAQPQKVVVVSGPNDSKIIEVLKSNKDKILDTFKNQEIEARQTLTNNSLHTNNNIEXKIGISIKFPSIYRIAKEDGDFFWVRKNLTTGTNNFMVYQVPLDAIDKEGDITQQIITIRDSVGKKYIPGPIGGSYMKTERALTTLFI

SEQ ID NO: 23633 - DNA, 399 bp, Unknown
  Obtained from environmental sample
  misc_feature (1)..(399): n is a, c, g, or t
atgaccgaaatagacaaaattgcatttattgaaatccaagggcgaaaaatattgagcacgaaatctaaaggcaagttcaaatattacataccaggaggaaaaagagaaatgggcgagtctgatgaacaaactttggttcgcgaagtatctgaagagcttacagttaatattatccctggtactattgaatatgttggaacatttatggcgcagtctgatggtgccaaagaaggtgtaatggttaaaatgtcttgttataaagcgcagtataatggaacgtatcatcctaatatggaaattgaggaaatcaggtggttggattcaaatgatacagatagaatatcagaggtggataaacttatatttcgacatctagtaagtattggggagttaaattga

SEQ ID NO: 23634 - protein, 132 aa, Unknown
  Obtained from environmental sample
  DOMAIN (2)...(128): NUDIX domain
  misc_feature (1)..(132): Xaa is any amino acid
MTEIDKIAFIEIQGRKILSTKSKGKFKYYIPGGKREMGESDEQTLVREVSEELTVNIIPGTIEYVGTFMAQSDGAKEGVMVKMSCYKAQYNGTYHPNMEIEEIRWLDSNDTDRISEVDKLIFRHLVSIGELN

SEQ ID NO: 23635 - DNA, 618 bp, Unknown
  Obtained from environmental sample
  misc_feature (1)..(618): n is a, c, g, or t
atgaaaaaaattgctgttgtttttcttttattgatagttgttatctcatgttcacaaaagaaaataaagttcaacaattatatagcatccattaagaattttcaatacgagatgaatgttgaatttgctaatgaagaagaatcccctttaaccgaagaaggcattaatgattttacagaattagatttttttactatcgattctacctatatagtggttgctaaatttgagttggaaaaaaattcacgattatttgaaatgccaacaactactgaaagaaaacctatttataaaacatttggtatggcaatctttgaattaggaggtaaggagttaaaacttcatatctatcaaaatcaagatctcataaaaaacccagattatacaaatcatttgttcataccttttacagatcaaacaaatggcaatgagagctacggaggtggaagatatatagatgtagaaattccagaaggggatactattgtaattgattttaacagatcttataatccatattgtgcctataatgataaatactcttgtcctatccctcctaaagaaaatgatttagccatcgaaataaaagctggagttaaaacctacggaaaacattaa

SEQ ID NO: 23636 - protein, 205 aa, Unknown
  Obtained from environmental sample
  SIGNAL (1)...(16)
  misc_feature (1)..(205): Xaa is any amino acid
MKKIAVVFLLLIVVISCSQKKIKFNNYIASIKNFQYEMNVEFANEEESPLTEEGINDFTELDFFTIDSTYIVVAKFELEKNSRLFEMPTTTERKPIYKTFGMAIFELGGKELKLHIYQNQDLIKNPDYTNHLFIPFTDQTNGNESYGGGRYIDVEIPEGDTIVIDFNRSYNPYCAYNDKYSCPIPPKENDLAIEIKAGVKTYGKH

SEQ ID NO: 23637 - DNA, 555 bp, Unknown
  Obtained from environmental sample
  misc_feature (1)..(555): n is a, c, g, or t
ttgatatctactgagtacaaagacaaacatcaaataaaccgccaatctctagatggcacttatgttacgaacaaagaaaaggacattcccatgactaccaatcaatcattacttgagcgccgcaaagctgttttaccaacaggacttggggttgcctttcctatttttgcagaaaaagcaaagaactcagaaatctgggacatcgaaggcaagcgctatatcgactttgtcggtggtatctcagtattgaacacgggtcacagccatccaaaaatcactcaacgtgtccatgagcagctagacaagtttacgcacactgcggcgcanatgattaattacgaatgctatgtggatctggctgaaaagctatgcgaaaaagcgcctatcagcggcgatactaaagcgttctttttgaccactggcgcagaagcggttgaaaactgcatcaagattgctcgtgctaaaacccgtcgtcccagcgtaatctcttttgttggtggctggcatggtcgtaccatgatgtgtatgagcctgacaggcaaagtattaccataa

SEQ ID NO: 23638 - protein, 184 aa, Unknown
  Obtained from environmental sample
  misc_feature (1)..(184): Xaa is any amino acid
MISTEYKDKHQINRQSLDGTYVTNKEKDIPMTTNQSLLERRKAVLPTGLGVAFPIFAEKAKNSEIWDIEGKRYIDFVGGISVLNTGHSHPKITQRVHEQLDKFTHTAAXMINYECYVDLAEKLCEKAPISGDTKAFFLTTGAEAVENCIKIARAKTRRPSVISFVGGWHGRTMMCMSLTGKVLP

SEQ ID NO: 23639 - DNA, 930 bp, Unknown
  Obtained from environmental sample
  misc_feature (1)..(930): n is a, c, g, or t
ttgaaaattttacttcgtgggtataatattagaaacttctctgaaagacaaattgagtttgaaaaagaaatagaagaaactcgaaaaatcaaacttcaacttcaacaagaacttgttgaagtaaaaaaaataaaagaagaaatagaagaaaataattcagcaattgaagaaaaaactgaggagagtacaaataaattaacgaaaatagaaactcaattagatgatgttattaagaagaaagatgaacttatcgaacaatctgaatctttagaggaaataaatactgaccttactacaataaaagaaaaagcagatgaaaatttggatgagattcttacatcaatgacagaaagtaaatctaatgaaaaattgattacatcatttgctaacaaagtccaagaaagagataaaagacttcttgaattagaacaaaatactaaagataataacgaagaacttgttgaatataaaaaggaaagaattaaaattttaaaagattctaatgaattaattgagtctgctaaaaaagcattgaactataagactgccgaaggaattagtgcttcttttcaaactcaatatgaaagcgcaaaggataaatcaaattcgggttggtggatttttggagcaattgtatgtttaatttcaaccgtatttttaggtttatggattttagaatctacaataactaatgttggtttaataattggaagaatatcattattgcctttaccaattattggggcaatattctgcgctaatcaatatacgaaacaaaaaaatattattgaagactatgcttataaaatggttttatcaaaatcaattgtaggggtttctgaaccaataaagaaaaatggctctgaaaataatgaagagtatatacattatataaaaaccgcactaaaggaaattataaagacccactag

SEQ ID NO: 23640 - protein, 309 aa, Unknown
  Obtained from environmental sample
  misc_feature (1)..(309): Xaa is any amino acid
MKILLRGYNIRNFSERQIEFEKEIEETRKIKLQLQQELVEVKKIKEEIEENNSAIEEKTEESTNKLTKIETQLDDVIKKKDELIEQSESLEEINTDLTTIKEKADENLDEILTSMTESKSNEKLITSFANKVQERDKRLLELEQNTKDNNEELVEYKKERIKILKDSNELIESAKKALNYKTAEGISASFQTQYESAKDKSNSGWWIFGAIVCLISTVFLGLWILESTITNVGLIIGRISLLPLPIIGAIFCANQYTKQKNIIEDYAYKMVLSKSIVGVSEPIKKNGSENNEEYIHYIKTALKEIIKTH

SEQ ID NO: 23641 - DNA, 831 bp, Unknown
  Obtained from environmental sample
  misc_feature (1)..(831): n is a, c, g, or t
ttgatggtactattgaggattgcagattattttcaaattgattcttcaagaacaccagatataactgtcaagttgaagtcctttaattctcctgtttctcaaattgaacactacaagcatttagacataaagtatgttcaaccttacaacaaagatccagaaactttgatcttacagtgtactccaaggaatagttacatttttataaagttacaagatttatttaaagatattcaaaaagaattagatacaagttgggctattttaggagaagtctatggcaaagagccaaaagaaaaacaaccaaaaatctcatataggcgtctaaaatcaaatattgataatgttaatgagtattccaaaaaggttagctatatacccgaaaaaatagtttttaatgtttcaaatgaactaccaaaattattaattggtccattgtatgggaatgacccaacatttggagttagagaactactccaaaatgcagttgattcatgtcgtgagcgtgagtttcttgaaaaatccgaatacgcaggcttagtaaaaataagtttctattctatagaagaagattacttcttcaaaatagaagataatggcttaggaatgaatcttaatgttattaaaaattattttctagaagtaggatcatcattaagaaaaagttcaatttggaaaaaaaatttttctgacaaaggagggcaatctaaggttcaaagaagcgggaaatttggaataggtgttttagcatcatttttaattggaaataaactacatctagaaactaaagattctaactctggacatggactatcattcagcacagattaa

SEQ ID NO: 23642 - protein, 276 aa, Unknown
  Obtained from environmental sample
  misc_feature (1)..(276): Xaa is any amino acid
MMVLLRIADYFQIDSSRTPDITVKLKSFNSPVSQIEHYKHLDIKYVQPYNKDPETLILQCTPRNSYIFIKLQDLFKDIQKELDTSWAILGEVYGKEPKEKQPKISYRRLKSNIDNVNEYSKKVSYIPEKIVFNVSNELPKLLIGPLYGNDPTFGVRELLQNAVDSCREREFLEKSEYAGLVKISFYSIEEDYFFKIEDNGLGMNLNVIKNYFLEVGSSLRKSSIWKKNFSDKGGQSKVQRSGKFGIGVLASFLIGNKLHLETKDSNSGHGLSFSTD

SEQ ID NO: 23643 - DNA, 519 bp, Unknown
  Obtained from environmental sample
  misc_feature (1)..(519): n is a, c, g, or t
atgaatattattaatttaaataaaaccgttacaattccaaaaggagatattttattaaaacaaggggatattgccaaatatggttattttgttaaaagtggctgtcttaaaagctacactattgatcatttagggaaggaacacataatgcaatttgcgccagaaacatggatgataacagacttggatagtttttctaaccaagttccgtctttagtatatattgaagcaattgaagcgtctgaagtatccataatatcaaatgcagatgtaaaggatatcaatcaatttgaaaaagcagatttagtagaaatgaacactaaatttagaaataatttaattgcaactaacaaacgtataataggtcttttaagtgctacagcagagcaacgttatacaaactttacagatacctatccttctttagtacaacgattacctttaaaacttatagcttcatatattggtgtcacaccagaatacttaagtgatattagacgtaagattgctaaaaactaa

SEQ ID NO: 23644 - protein, 172 aa, Unknown
  Obtained from environmental sample
  DOMAIN (6)...(100): Cyclic nucleotide-binding domain
  misc_feature (1)..(172): Xaa is any amino acid
MNIINLNKTVTIPKGDILLKQGDIAKYGYFVKSGCLKSYTIDHLGKEHIMQFAPETWMITDLDSFSNQVPSLVYIEAIEASEVSIISNADVKDINQFEKADLVEMNTKFRNNLIATNKRIIGLLSATAEQRYTNFTDTYPSLVQRLPLKLIASYIGVTPEYLSDIRRKIAKN

SEQ ID NO: 23645 - DNA, 522 bp, Unknown
  Obtained from environmental sample
  misc_feature (1)..(522): n is a, c, g, or t
gtgaaaaacatacttattccaggtattggtatgggaagaaatgcacagatttttagaaaacacggaatgtctgttacaggtattgaaatctctaaaacagctattgaaatgctaaaaaaaaattatggcccgaatatgaaaatctatcacggttctgtaaaagatatgccatttgaccacaccctttacgatggtatattttgctatgctttaattcatttattgggacgtaatgaaagacaaaagctaatccaagattgttataatcaattatctgataatggctatatgttatttacagctatctcaaaaaaagcccctacatacaggaaaggtaaatttattagtaaagaccgttatgaaataaatgaaggtgctaagatctatttctatgatagagcatctattcaaacagaatttgataatgctggactatttgaaatagttgaaatcaatgaaaaccaaccattctatttaattaaatgcaaaagacaaaaccttagcactaatacaaatggctaa

SEQ ID NO: 23646 - protein, 173 aa, Unknown
  Obtained from environmental sample
  misc_feature (1)..(173): Xaa is any amino acid
MKNILIPGIGMGRNAQIFRKHGMSVTGIEISKTAIEMLKKNYGPNMKIYHGSVKDMPFDHTLYDGIFCYALIHLLGRNERQKLIQDCYNQLSDNGYMLFTAISKKAPTYRKGKFISKDRYEINEGAKIYFYDRASIQTEFDNAGLFEIVEINENQPFYLIKCKRQNLSTNTNG

SEQ ID NO: 23647 - DNA, 399 bp, Unknown
  Obtained from environmental sample
  misc_feature (1)..(399): n is a, c, g, or t
ttggctattagtggaagcagaattgcagaaggcttcgaaatcactacctcaaaaggagacattttcacagcaaataaattaatttttgccacaggaattaaagatataatgtctgaaataaaaggcttctctgattgttggggaatttcagtagtacattgcccctactgtcacggatatgaatttaaaaatcaaaaaacgggaatattagcaaatggtgagcgtgcctttcacttagcttcattgatttataatttatcaaaaaagcttactgttttcacctctggtaaacccaatttttatacggaacaactagcaaaactaaataaaccccacatacaatttattgaaacccaaattactgaaatagagcataaaaatggttatatgaaaagataa

SEQ ID NO: 23648 - protein, 132 aa, Unknown
  Obtained from environmental sample
  misc_feature (1)..(132): Xaa is any amino acid
MAISGSRIAEGFEITTSKGDIFTANKLIFATGIKDIMSEIKGFSDCWGISVVHCPYCHGYEFKNQKTGILANGERAFHLASLIYNLSKKLTVFTSGKPNFYTEQLAKLNKPHIQFIETQITEIEHKNGYMKR

SEQ ID NO: 23649 - DNA, 315 bp, Unknown
  Obtained from environmental sample
  misc_feature (1)..(315): n is a, c, g, or t
atgaaaaaaattcttacctcactattttttctgcttgtgttaactgcatgcacagattcaccagaagaaagagccaagacagtctattcaaaaacaattttgatgctcaatcagtttaacgacggcactctggactcaaaaaaccaaacaatacttggcgataaaataaagtctaatattgatacattaaataacgattatgttgagacaaatattgtatttgaaatgcttaattctggtttcataggccagcacaacttaaagcaatttagagcgagactaaaagaattagaatttgtcgaatctgtaaagtaa

SEQ ID NO: 23650 - protein, 104 aa, Unknown
  Obtained from environmental sample
  SIGNAL (1)...(16)
  misc_feature (1)..(104): Xaa is any amino acid
MKKILTSLFFLLVLTACTDSPEERAKTVYSKTILMLNQFNDGTLDSKNQTILGDKIKSNIDTLNNDYVETNIVFEMLNSGFIGQHNLKQFRARLKELEFVESVK

SEQ ID NO: 23651 - DNA, 714 bp, Unknown
  Obtained from environmental sample
  misc_feature (1)..(714): n is a, c, g, or t
ttgttaccccctttaaaatgtcattctttcaccattaatgatactagtaaatttgtattcttaaaatttacagattcattttttagaggtgtaaataaaatacagattgatagaaatgagtggtttaaagaagcttcgtatatattatctaactacaatcaattacctggcgacattttaaaatctgaaactgatagattacatattggtaatttattagagatgattttattggaaacaagaaattatggagaagagtccgttacgcttattaccagcttaatgaccagtattttagaaatactaattaggaatattaaaaagagtaattattttgatactgatgcaaaagtatctgaagaaagaatcacaaaaatgctaacctatatcaatgagaatatagataagaccgacttgttaaaagtggaaaatttagcagatgtttttatgatgtctcctacgtatgtgagtgagtattttaaaaaacaggtacaaatgccgttgcgggaatatataataaaagcaaaattgaaattagttgaaattagactacttaattctgattttaccttaacccaaatagcagacgatttagggtttacagacgtcagtcatttatcaaagacctttaagcgttatgtgggcatatctattaaagaatttaaaactaatggaaactacatgttattaaccagaaatgcatgtacaggatga

SEQ ID NO: 23652 - protein, 237 aa, Unknown
  Obtained from environmental sample
  DOMAIN (183)...(223): Bacterial regulatory helix-turn-helix proteins, AraC family
  misc_feature (1)..(237): Xaa is any amino acid
MLPPLKCHSFTINDTSKFVFLKFTDSFFRGVNKIQIDRNEWFKEASYILSNYNQLPGDILKSETDRLHIGNLLEMILLETRNYGEESVTLITSLMTSILEILIRNIKKSNYFDTDAKVSEERITKMLTYINENIDKTDLLKVENLADVFMMSPTYVSEYFKKQVQMPLREYIIKAKLKLVEIRLLNSDFTLTQIADDLGFTDVSHLSKTFKRYVGISIKEFKTNGNYMLLTRNACTG

SEQ ID NO: 23653 - DNA, 480 bp, Unknown
  Obtained from environmental sample
  misc_feature (1)..(480): n is a, c, g, or t
atgtcagttatactttattatttaaaaattaaaaaaatgagtagttatttccttgagcttgccccagtaccttttttggcatttttcatgattttttatataagttgcaaggaacccactgaagattctgccgaagccatgaactggaaaaccgttaatgttacggccagtgcatataattcagtagccagccaaagtgaaggcaatccaaaaataactgcctggggtgatactttaaaaccaggaatgaatgttattgccatttctcgtgatcttatgagagatggtctagattataatacgccagtaaaaatagacggtctttcaggaattttctttgtgaaagataagatgcatcatcgttggagaaataaaattgatatttatatgggtgaagacgtgcagaaagcaagaaattggggacgcaagaaaattagtattcagtatttagttcaaaaagattctctagttgaaaattaa

SEQ ID NO: 23654 - protein, 159 aa, Unknown
  Obtained from environmental sample
  misc_feature (1)..(159): Xaa is any amino acid
MSVILYYLKIKKMSSYFLELAPVPFLAFFMIFYISCKEPTEDSAEAMNWKTVNVTASAYNSVASQSEGNPKITAWGDTLKPGMNVIAISRDLMRDGLDYNTPVKIDGLSGIFFVKDKMHHRWRNKIDIYMGEDVQKARNWGRKKISIQYLVQKDSLVEN

SEQ ID NO: 23655 - DNA, 750 bp, Unknown
  Obtained from environmental sample
  misc_feature (1)..(750): n is a, c, g, or t
atggggaatacttttttagaaaaagctagaagtatatatggagagaagtacgattactctaaagtagaatatgttaatagtaagactaaagtgctacttatttgtaaattacatggtaaattttataagcctcctgataaatttataaatagaaatcaagggtgcccaagatgtagtatagaagctcaagccaaaaaatatagaacagatggtataaaaatactggcacaatttagaaaagtacacggcaataagtatggttattcattagtagattataaaaatgcaaaaactaaagtaaaaataatttgctccacgcatggaatatttgagcagatacctactaaccacttaagacacggctgctgtaagtgcggtaaagaaggtcaagtaaaacttgagcctaagttaaaggttatggcaaaaagggtaagagcgggtatacattcagcaatgtctaaagggggggtttttaaaaagtcaaggactaaagagattttagggggctcctgggtggagtttaaatcccatttagaaaataacccgtatgagtttaaattatcagatacagaaattgatttagaccatatagtacctatatcctctgcaaatacagaggaagatatattaaaattaaattattataccaatttccaactgcttccagcctattataatagatggattaaagttgataaacagtttaatagagaacagtttgaagtttggtataaaaacaaatataaataa

SEQ ID NO: 23656 - protein, 249 aa, Unknown
  Obtained from environmental sample
  misc_feature (1)..(249): Xaa is any amino acid
MGNTFLEKARSIYGEKYDYSKVEYVNSKTKVLLICKLHGKFYKPPDKFINRNQGCPRCSIEAQAKKYRTDGIKILAQFRKVHGNKYGYSLVDYKNAKTKVKIICSTHGIFEQIPTNHLRHGCCKCGKEGQVKLEPKLKVMAKRVRAGIHSAMSKGGVFKKSRTKEILGGSWVEFKSHLENNPYEFKLSDTEIDLDHIVPISSANTEEDILKLNYYTNFQLLPAYYNRWIKVDKQFNREQFEVWYKNKYK

SEQ ID NO: 23657 - DNA, 507 bp, Unknown
  Obtained from environmental sample
  misc_feature (1)..(507): n is a, c, g, or t
atgtatatcacaatcacaccacagaaattaggaacaaattactcacaaagttcagccgattttgtaggctatttagagaaagaaaatgaagggataaaggaagcagatatggaacattttttcaatcaatatggcgacgagatttccgcagaagaagtggtaaaggaaattgatggaaacaccgcanaattgaaaaagaaagaacctaaattttattccataacggtcagtccttccnagtatgaattgaacagattacagaacagtcgtgaagaatttaaaacctacactcgtgagctaatgaaagattatgttgcccagctcaatcgggaaatcaatggacgacctatattcatagacgacatanaatattacgctaaaattgaacatccaagaacctttcagggtacggactttccgataaaagaaaacaacctttcgccacaaaaatacttcagctcaaaacggatttccaaatattcagaaggccagcttgaagaaatttag

SEQ ID NO: 23658 - protein, 168 aa, Unknown
  Obtained from environmental sample
  misc_feature (1)..(168): Xaa is any amino acid
MYITITPQKLGTNYSQSSADFVGYLEKENEGIKEADMEHFFNQYGDEISAEEVVKEIDGNTAXLKKKEPKFYSITVSPSXYELNRLQNSREEFKTYTRELMKDYVAQLNREINGRPIFIDDIXYYAKIEHPRTFQGTDFPIKENNLSPQKYFSSKRISKYSEGQLEEI

SEQ ID NO: 23659 - DNA, 591 bp, Unknown
  Obtained from environmental sample
  misc_feature (1)..(591): n is a, c, g, or t
atggtagctgaaaagccaatgtattacaatgaaattaaatcttatataacatcattttatccaatatccgaagcgtcttttaatttggtttatgaaattgctcatattaagcaagttaaatcaggaactgttttagtaaatataggagacgttcctaataaaatatatatgataaataaaggggttatgcgctcctatgttagattagaaaatgggaaagaggtaacaaaatcaatttttgtacctagaatcattttagcgtcatttcgtgcgttaataaatcaaacgccttctgagtgtatttatgagtctttaaccgactgcgaaatttacgaggttgactactttaagtataaaacactttgtgaaactaatgcagaggtacttggttttcatgctaagtttttagaacaattattgtgtcagaatgatgctaaacatattgagctgctaacaatgaatgcgaagcagcgttatttaaaattaagaaaagttataccaaatatagataatttaatacctcaatatcaaattgcaaaatttttaagtatcactccagtgcaattaagtaggattagagcaaaactatag

SEQ ID NO: 23660 - protein, 196 aa, Unknown
  Obtained from environmental sample
  DOMAIN (33)...(127): Cyclic nucleotide-binding domain
  misc_feature (1)..(196): Xaa is any amino acid
MVAEKPMYYNEIKSYITSFYPISEASFNLVYEIAHIKQVKSGTVLVNIGDVPNKIYMINKGVMRSYVRLENGKEVTKSIFVPRIILASFRALINQTPSECIYESLTDCEIYEVDYFKYKTLCETNAEVLGFHAKFLEQLLCQNDAKHIELLTMNAKQRYLKLRKVIPNIDNLIPQYQIAKFLSITPVQLSRIRAKL

SEQ ID NO: 23661 - DNA, 765 bp, Unknown
  Obtained from environmental sample
  misc_feature (1)..(765): n is a, c, g, or t
atggttcgcggtgttggaaatccagagtttaaaaatgaaaacccctatgctaacatgccatatccagatgatggttttagattattatcggtttataaatactggaatatgattaattatttttttccttataaacatataatggataaagactggaatgaaagtttaaaagaaaatattccaccatttattaatgctaaaaacgaattagaatatgaattagcagctttaaagatgattgcagacattaaagacactcatgctaatctttggggaggaaaagataaaattaacgaaatacttggtgacaactatccaaatttccatgtttcatttattgaaaacaagctggttatagacaacttttataatgaagacagtcctagaaacggtttaaaaataggagatattattacgcgtattaacggaaaaaaagttgaagacatcgttacagataatcaagatttttatccagcgtcaaaccagccaactcgtttaagagatattagttttaatttattacgtactacaagcaatagcttagatattgagatagaagacaatggtatcaaattaattaaaacaatacctgtatacaacaaaaaagacattaaggacttttacaaatggtacacaaaagaagaaaacattagtagttatagactacttaaaaataacattggatatgtttcacttaaaaacattaaagatgaggacgtgaataaaataaaaaaagaattaaaaaaccccaagggattattgtag

SEQ ID NO: 23662 - protein, 254 aa, Unknown
  Obtained from environmental sample
  misc_feature (1)..(254): Xaa is any amino acid
MVRGVGNPEFKNENPYANMPYPDDGFRLLSVYKYWNMINYFFPYKHIMDKDWNESLKENIPPFINAKNELEYELAALKMIADIKDTHANLWGGKDKINEILGDNYPNFHVSFIENKLVIDNFYNEDSPRNGLKIGDIITRINGKKVEDIVTDNQDFYPASNQPTRLRDISFNLLRTTSNSLDIEIEDNGIKLIKTIPVYNKKDIKDFYKWYTKEENISSYRLLKNNIGYVSLKNIKDEDVNKIKKELKNPKGLL

SEQ ID NO: 23663 - DNA, 483 bp, Unknown
  Obtained from environmental sample
  misc_feature (1)..(483): n is a, c, g, or t
ttgtcaattgatggtttatacagtcatattgcttggttaagaaccattaaagataaaattgaatttaacggaatgaaaaacattgaagttaagtttcctttaatagaagacatctccatggaagttgctaaaaaatacggaatgattcaaccaggagaaagtaaaacgcaagcggttagagcagtcttttttgtagatccaaatgaaactgttagagctatcatttattatccattaagcttaggacgtaactttgatgagctttacagagcattaatagctatgcaaacctcagacaagtttaatgtagctactcctgcagattggaatcctggagatgatgttattgtatcaccagcaggttcttgtggtgttgctgaagaaagaatgacttcaacagaagatctagattgtaaagactggtttttctgtactaaaaaattagataaagatttagtattggattcaatcttaaaaaagtaa

SEQ ID NO: 23664 - protein, 160 aa, Unknown
  Obtained from environmental sample
  misc_feature (1)..(160): Xaa is any amino acid
MSIDGLYSHIAWLRTIKDKIEFNGMKNIEVKFPLIEDISMEVAKKYGMIQPGESKTQAVRAVFFVDPNETVRAIIYYPLSLGRNFDELYRALIAMQTSDKFNVATPADWNPGDDVIVSPAGSCGVAEERMTSTEDLDCKDWFFCTKKLDKDLVLDSILKK

SEQ ID NO: 23665 - DNA, 465 bp, Unknown
  Obtained from environmental sample
  misc_feature (1)..(465): n is a, c, g, or t
ttggcttttaatatagcattacctcccaggcttgtggctgtttcagctatctcctcggtacagccaatatctctcaggcttaacaccttaatggtatcaggaagtaattgttttacctctcttaatttgttaaggttattcgttgcaaatacaagttctaacataatgacaaaaataacaaaagcatctcaaaaaagagatgctcttgaaaattgctataaaaaatattttgaactaaattttttggaaaaatttagttcctcatgttatcataaaaacaacatagttttaaaaaatactgataaagtttattttattagatcgattatttatctttttgtcatatttcttttatgttgtaaattattcataaaagctgaatctaagccttttattagaatactttttatagtacattgcaatgaaaacatcctatttttttatcaactatctaaaaagcattaa

SEQ ID NO: 23666 - protein, 154 aa, Unknown
  Obtained from environmental sample
  misc_feature (1)..(154): Xaa is any amino acid
MAFNIALPPRLVAVSAISSVQPISLRLNTLMVSGSNCFTSLNLLRLFVANTSSNIMTKITKASQKRDALENCYKKYFELNFLEKFSSSCYHKNNIVLKNTDKVYFIRSIIYLFVIFLLCCKLFIKAESKPFIRILFIVHCNENILFFYQLSKKH

SEQ ID NO: 23667 - DNA, 831 bp, Unknown
  Obtained from environmental sample
  misc_feature (1)..(831): n is a, c, g, or t
gtgtttcggggagatattggaagaacagatgactacttactaaaagatccaaataaaccagaatgggcagattttttatttatagaaagtacttacggaaataaattacatcctaaagaagatgtcgaagagaaattaacggaaattatccttgaaacattacataaaaaaggcactttagtaattccgagttttgctgtggaacgcttacaaaccttaatgtatattttatggaatctttataaaaagaataaaatcccaaacattcctatttttatagacagtcctatgggaaacaatgtgttggacgtatttaatcgtttcccaaaatggcacaaattatctgatgcagattataacacgatgtgtagacatatgaatattatcgaatcctataaagaaacatgggaaacgattgatgataaacggtctaaaattgttattgctggtagcggaatggttactggaggtcgcgtacttacatatttgcagcaacttatagacgaatcttctacaactgttttattagtggggtatcaagctgaaggcacgcgtggcagacaattaaaagatggagcgcacgaaattcgtttttttggtaaatattaccctataaaagcgacgataaaaagtattgatagtttatcggcgcatgccgatcaaggtgatttaattaattggatgagcgctattaaaaacataccagaacacgtgtatttaattcatggtgaatcttcagctttagattcctttagagtgaaaataaaaaacacttacggttggaacgttagcattcctaagttaaatgatgtggagaaagttatgctttaa

SEQ ID NO: 23668 - protein, 276 aa, Unknown
  Obtained from environmental sample
  DOMAIN (201)...(246): RNA-metabolising metallo-beta-lactamase
  misc_feature (1)..(276): Xaa is any amino acid
MFRGDIGRTDDYLLKDPNKPEWADFLFIESTYGNKLHPKEDVEEKLTEIILETLHKKGTLVIPSFAVERLQTLMYILWNLYKKNKIPNIPIFIDSPMGNNVLDVFNRFPKWHKLSDADYNTMCRHMNIIESYKETWETIDDKRSKIVIAGSGMVTGGRVLTYLQQLIDESSTTVLLVGYQAEGTRGRQLKDGAHEIRFFGKYYPIKATIKSIDSLSAHADQGDLINWMSAIKNIPEHVYLIHGESSALDSFRVKIKNTYGWNVSIPKLNDVEKVML

SEQ ID NO: 23669 - DNA, 630 bp, Unknown
  Obtained from environmental sample
  misc_feature (1)..(630): n is a, c, g, or t
atgatgcagaattttgcaaaaattaattttttaggagcctcaggcgtggttacaggctctaagtttcttattgaaacttcagagaaaaacatcttgatagattgtggtatgtttcaaggtttaaaagagctgcgagaactcaattggcgtgacttgcctatagatgtgaaagctatagatgtggtgttgttaacacatgggcatttagatcatgttggctatttgccacgattagtaaagcaaggtttttcaggaaaaataaaaggaactgaaccaacgctagctattgctgagattattttaagagatagtgctaaaattcaggaggaagaagccgagaaagccaataaagagaagtatagtaaacaccaacctgcactgccattttatactagtaaagatgctgaaaccactataaaacagtttcaggttgaaattgacaataaatggatttctttatcggagcatatagcgtatcgttttaaatataatgggcatataattggggctactttcatagaattagatataaacggtaagcgatttgtgttttcgggagatattggaagaacagatgactacttactanaagatccaataaaacagaatgggcagattttttatttatag

SEQ ID NO: 23670 - protein, 209 aa, Unknown
  Obtained from environmental sample
  DOMAIN (18)...(201): Metallo-beta-lactamase superfamily
  misc_feature (1)..(209): Xaa is any amino acid
MMQNFAKINFLGASGVVTGSKFLIETSEKNILIDCGMFQGLKELRELNWRDLPIDVKAIDVVLLTHGHLDHVGYLPRLVKQGFSGKIKGTEPTLAIAEIILRDSAKIQEEEAEKANKEKYSKHQPALPFYTSKDAETTIKQFQVEIDNKWISLSEHIAYRFKYNGHIIGATFIELDINGKRFVFSGDIGRTDDYLLXDPIKQNGQIFYL

SEQ ID NO: 23671 - DNA, 873 bp, Unknown
  Obtained from environmental sample
  misc_feature (1)..(873): n is a, c, g, or t
ttgacagggccagaagaacatcaaaaagcatttaaaaatgtagaccctgacttttttgaccttattgttattgacgagtgccatcgaggtagcgcaagcgaagaaagtgcctggcgtgaaatacttacttattttaaaagtgctgctcaaattggcttaaccgctacaccaaaagaaactgaggaagtatcaaactctgactattttggcgaccctgcctatacctattctcttaaagagggcatagaagacggctttttatccccatacaaagtggtacgtgtcgatctcgatgtagacctacaaggctggcgacccactaagggccaggttgatagtaacggtgaagtaatacaagaccgcatatacaaccaaaaagactttgatcgcacaatggtgattgatgagcggaccatgcttgtggcagaaaccattactaactatttaaagcgtacagatcctatggctaaaaccattgtattttgtaacgacatagatcacgccgagcgtatgcgttgtgccattgccaacttaaatccagagcaaatggctaaaaacgataaatatgtgatgaagatcactggcgatgatgaattaggtaaagctcaactttataatttttgtagtcctaagcgtgcttatccagttattgctaccacctcagagcttatgaccacaggggtagacgctaaaacctgtaagctagtagtgcttgatcaaaacatccaatcaatgaccaagtttaaacaaatcattggccgtggtacccgtattgacgaccgctacggcaagctatggtttaccatactcgacttaaaaaagccactgagttatttgccgatgaacgttttgatggcccgccagaaaaagtaa

SEQ ID NO: 23672 - protein, 290 aa, Unknown
  Obtained from environmental sample
  DOMAIN (1)...(59): Type III restriction enzyme, res subunit
  misc_feature (1)..(290): Xaa is any amino acid
MTGPEEHQKAFKNVDPDFFDLIVIDECHRGSASEESAWREILTYFKSAAQIGLTATPKETEEVSNSDYFGDPAYTYSLKEGIEDGFLSPYKVVRVDLDVDLQGWRPTKGQVDSNGEVIQDRIYNQKDFDRTMVIDERTMLVAETITNYLKRTDPMAKTIVFCNDIDHAERMRCAIANLNPEQMAKNDKYVMKITGDDELGKAQLYNFCSPKRAYPVIATTSELMTTGVDAKTCKLVVLDQNIQSMTKFKQIIGRGTRIDDRYGKLWFTILDLKKPLSYLPMNVLMARQKK

SEQ ID NO: 23673 - DNA, 630 bp, Unknown
  Obtained from environmental sample
  misc_feature (1)..(630): n is a, c, g, or t
ttggctgataaagaaaatggaaaccatgcatatatcgatattatgcaggaggcacaaaaagtattcggaaaggaatttggaggtacgttatttacaattgctaaagatgtgaaaattcaagtagaatttaatcctaaaaaagtacaagcttaccgattaataggctacgaaaacagattattagcagatgaggattttgtagatgatacaaaggatgcaggtgaattaggaagtggccatacagttacagcgttgtatgagattattccgaccggaataagaagtgattatctgaaaacaatacctgatttaaaatatacaaagtctgatgttacttctaactatgagaatgaattatttaccgtaaaatttagatataaaagaccgaatgaagataaaagtattgaaatgatacacgttcaaaatacaatgctaactacagcatctgatgatatgaattttgcttctgctgtggcattatttggtatgcagttgaggcaatctaaatattataataatgcgacattatcaaaagtaattgaattagcagaacgaggaaggggagaggataatgaagggtatagagcagagtttattagactagtaaaatcttatgataatctaaactaa

SEQ ID NO: 23674 - protein, 209 aa, Unknown
  Obtained from environmental sample
  misc_feature (1)..(209): Xaa is any amino acid
MADKENGNHAYIDIMQEAQKVFGKEFGGTLFTIAKDVKIQVEFNPKKVQAYRLIGYENRLLADEDFVDDTKDAGELGSGHTVTALYEIIPTGIRSDYLKTIPDLKYTKSDVTSNYENELFTVKFRYKRPNEDKSIEMIHVQNTMLTTASDDMNFASAVALFGMQLRQSKYYNNATLSKVIELAERGRGEDNEGYRAEFIRLVKSYDNLN

SEQ ID NO: 23675 - DNA, 879 bp, Unknown
  Obtained from environmental sample
  misc_feature (1)..(879): n is a, c, g, or t
ttgaatgctctccaaggacatgcggtgtatggttataatggtacaaaaggtgttattattttaagaacaaaaggtcataaaaacaaagtcaattttgatgatattgataattttttgaatgaatcttatactcaaatcgaagagaacatatttaagcgcactaaccttgctgctctttcgacgttttcaatagatgtagataaagcgggttatagtaatataagacgcatgattaataacggagaaacgattccaccaaatgctgtaaagcttgaagaaatggttaattactttaattataattatcaacaacctaaagatgaacatccattttctattaacacagaagtagttgcaacaccttggcacaaaaagacgcaattggttagaataggattgcaaggcaaaacgtacgataatgataaattaccagcgtcaaacttaacatttctaattgatgtttctggctcaatgagttcacaaaataaattaccgttgttaaagagtgcatttaaactgttagtaaatcaactccgtgaaaaagataaagtctctattgtggtatattctggtgcagcaggagttgtgttagaaccaacatcagggcataaaaaggaagtcataatttcagcattagataatttaaatgctggagggtccacagctggtggtgaaggtattgaattagcatataaattagcggaaaaaaatttcaagaaaaccggaaataatcgcgttattctagcaaccgacggtgattttaatgtaggagctacaagtgacgacaacatgcaaaatcttattgaagaaaagcgaaagtcaggtgtggttttatctgttttaggtttggatatggaaactataaagattcaaagttag

SEQ ID NO: 23676 - protein, 292 aa, Unknown
  Obtained from environmental sample
  DOMAIN (147)...(291): von Willebrand factor type A domain
  misc_feature (1)..(292): Xaa is any amino acid
MNALQGHAVYGYNGTKGVIILRTKGHKNKVNFDDIDNFLNESYTQIEENIFKRTNLAALSTFSIDVDKAGYSNIRRMINNGETIPPNAVKLEEMVNYFNYNYQQPKDEHPFSINTEVVATPWHKKTQLVRIGLQGKTYDNDKLPASNLTFLIDVSGSMSSQNKLPLLKSAFKLLVNQLREKDKVSIVVYSGAAGVVLEPTSGHKKEVIISALDNLNAGGSTAGGEGIELAYKLAEKNFKKTGNNRVILATDGDFNVGATSDDNMQNLIEEKRKSGVVLSVLGLDMETIKIQS

SEQ ID NO: 23677 - DNA, 639 bp, Unknown
  Obtained from environmental sample
  misc_feature (1)..(639): n is a, c, g, or t
ttgcgccctcttgaggagggggggatatttttttgtgggggtggggggaaaaaaaaacgctttgttttgccaaaatttttttttttttccaaagaggagttttatatcgcgaaaattggtttttttgaaacggttttggcggaaaagaccctttttttccaaaaatttttacgaaggataaggaggggtttgcgttttcctttagaaatgaggtttctagcagatcgttatcaacaattgtctgatgatttagcacaattagatttgtttaaaaattttgtatttcctgattattatatttttaattcatnaatttttgctcaaattacacttcaaaaagaggaatataaattgtacagaaaaatgttcgatttgatgtataaagagattacaaaaccagatttatatgtgtatttgtatcaaaatacagatcgtcttttagagaatattaaaaaacgtggtagagattatgagcaaaacattcaaccagattatttgcaaaaaatccatgatggttataagagttttattagtacacaacaaaacttaaacgccttaattattgatgtttcagaaattgattttgttcacaatacaggagattatgaagatgtaatcaatcaaataaaaaaggcgtaa

SEQ ID NO: 23678 - protein, 212 aa, Unknown
  Obtained from environmental sample
  DOMAIN (68)...(211): Deoxynucleoside kinase
  misc_feature (1)..(212): Xaa is any amino acid
MRPLEEGGIFFCGGGGKKKRFVLPKFFFFSKEEFYIAKIGFFETVLAEKTLFFQKFLRRIRRGLRFPLEMRFLADRYQQLSDDLAQLDLFKNFVFPDYYIFNSXIFAQITLQKEEYKLYRKMFDLMYKEITKPDLYVYLYQNTDRLLENIKKRGRDYEQNIQPDYLQKIHDGYKSFISTQQNLNALIIDVSEIDFVHNTGDYEDVINQIKKA

SEQ ID NO: 23679 - DNA, 567 bp, Unknown
  Obtained from environmental sample
  misc_feature (1)..(567): n is a, c, g, or t
gtggccttactggaaatagcagaagccttcaaaaaagctgccgatgcgggtaatgggccaaagcgttccattgtctttttacatgtgacgggagaggaaaaagggttattggggtcccagtattataccgatgtacaaccgatatttccattaagccagacagtggccaatttaaatatcgatatgataggtagaatagaccctaaacgtgaaggtaatctcaactacgtttatttaatcggctccgataaattaagcacggaattgcataacctctcagaagcggtgaacaaaaaatacatgaatattgaattggattataaatataatgatgagaacgaccccaaccgtttttattatcgaagcgatcattacaattttgccaaaaacaacattcctataatcttttattttaatggtacccatgctgattaccatcgaccctccgacaccccggataaaataaattatgacctattggagaacaggacacggttagtattccatacagcctgggaaattgccaatcgtgaccaaaaaatagtagtggacaaaggcgtaaagtaa

SEQ ID NO: 23680 - protein, 188 aa, Unknown
  Obtained from environmental sample
  DOMAIN (1)...(161): Peptidase family M28
  misc_feature (1)..(188): Xaa is any amino acid
MALLEIAEAFKKAADAGNGPKRSIVFLHVTGEEKGLLGSQYYTDVQPIFPLSQTVANLNIDMIGRIDPKREGNLNYVYLIGSDKLSTELHNLSEAVNKKYMNIELDYKYNDENDPNRFYYRSDHYNFAKNNIPIIFYFNGTHADYHRPSDTPDKINYDLLENRTRLVFHTAWEIANRDQKIVVDKGVK

SEQ ID NO: 23681 - DNA, 552 bp, Unknown
  Obtained from environmental sample
  misc_feature (1)..(552): n is a, c, g, or t
ttggatattaaaaatggtatcaggaaaataataggatttcttaggggtattaatgttggcggacatcataaagtgccaatggcagatctacgcgacaaattgattgaattgggatgtcataaggtaagaacattaatgaatacaggaaattttgtatttgaaacaaagcagtcgaatattaaaaatctggaaaacagtatagaaagttctctttctcaatcgttcggatttccaattcccgtgattttaagacaccaaaaggaaatctctgacttagttgccgccagtccctttgccacaataaatatccacaaagacatccgtctatatgtctcttttttaaaaagcagaagtaaaattgagttgaccgcaccttatcattcagatgacaaagcttataacatcctttccgtccaaaataacacaattttcagcgttttggacctttcgacaacaaccaccacaaaagggatgaatgagttagaaaaactatttggaaaaaacattacgacaagaaattggaatacaatcaaaaaaatagttaatatctaa

SEQ ID NO: 23682 - protein, 183 aa, Unknown
  Obtained from environmental sample
  misc_feature (1)..(183): Xaa is any amino acid
MDIKNGIRKIIGFLRGINVGGHHKVPMADLRDKLIELGCHKVRTLMNTGNFVFETKQSNIKNLENSIESSLSQSFGFPIPVILRHQKEISDLVAASPFATINIHKDIRLYVSFLKSRSKIELTAPYHSDDKAYNILSVQNNTIFSVLDLSTTTTTKGMNELEKLFGKNITTRNWNTIKKIVNI

SEQ ID NO: 23683 - DNA, 336 bp, Unknown
  Obtained from environmental sample
  misc_feature (1)..(336): n is a, c, g, or t
atgagcaaaataattacatttgacgattttacaaaaatagatttacgcgtaggcaccattatacaggtagaagatttccctgaagcacgtcgcccagcttataaactaactatagattttggagatttgggcattaaaaaatcttcagcacaaattactgcgttatattctaaaaccgatttacaaaaccgacaaattatagcagttgttaattttgaacgcaaacaaataggaaagtttatgagtgagtgcctagtaatgngagctgttaatgctaacgaagtgctattattacatcctgaaaataaagtgccaaatggaagcgtagtgagctag

SEQ ID NO: 23684 - protein, 111 aa, Unknown
  Obtained from environmental sample
  DOMAIN (15)...(109): Putative tRNA binding domain
  misc_feature (1)..(111): Xaa is any amino acid
MSKIITFDDFTKIDLRVGTIIQVEDFPEARRPAYKLTIDFGDLGIKKSSAQITALYSKTDLQNRQIIAVVNFERKQIGKFMSECLVMXAVNANEVLLLHPENKVPNGSVVS

SEQ ID NO: 23685 - DNA, 855 bp, Unknown
  Obtained from environmental sample
  misc_feature (1)..(855): n is a, c, g, or t
atgatggctcggagattatttanaaaggatgccgaaaacgtgtgtatgctttttaagcgtaaaatgggaactcaagaaacttactttataccttccattaataaagaagttagtccaatcgagttgtcttcgttattattaaaagaacttagaaactttgttttggatgatgtacaactgcaatctgcagtaatcacaattcctgcttcttttgatacaatacaatctaatgcaactaaaaaagctggatatttggctggatttaaagaagttgttttattgcaagaacctattgctgcgtgcttagcgtttgcaaatcaatccaatttagatattcaaacgtctaaaaattggatagtttatgattttggaggaggtacgtttgatgtggctttagttgaagtcaatgacagagaattaaaggtgattgataatgaaggtgataattttttaggtggagcagattttgataatcttattgtcgaaaaaattattattcctaaaatagaaggtaaaacaaatattacaaatctgtttaaagcaattaaatccaagtcaagtcaatacaaagggctatattttgaattacttaaaaaagcagaagaagctaaaaaagaactatcggtttatcctgaaacagaaatcgaattagatatagatataaataatgataatttatttgaacaaataattattacaagagcagaatttgaagctgttatcctgccaaaaattgagcaaaccatagcgtttattaaaaaagtgatttctcaaaatcaacttttaaattctcaaatagatcgcctaattttaattggaggtagtacttatgtgccattaataaacagcgtataa

SEQ ID NO: 23686 - protein, 284 aa, Unknown
  Obtained from environmental sample
  misc_feature (1)..(284): Xaa is any amino acid
MMARRLFXKDAENVCMLFKRKMGTQETYFIPSINKEVSPIELSSLLLKELRNFVLDDVQLQSAVITIPASFDTIQSNATKKAGYLAGFKEVVLLQEPIAACLAFANQSNLDIQTSKNWIVYDFGGGTFDVALVEVNDRELKVIDNEGDNFLGGADFDNLIVEKIIIPKIEGKTNITNLFKAIKSKSSQYKGLYFELLKKAEEAKKELSVYPETEIELDIDINNDNLFEQIIITRAEFEAVILPKIEQTIAFIKKVISQNQLLNSQIDRLILIGGSTYVPLINSV

SEQ ID NO: 23687 - DNA, 813 bp, Unknown
  Obtained from environmental sample
  misc_feature (1)..(813): n is a, c, g, or t
ttggtgtcgggggcggtatataaatatgtttatcagatgagtttatctagaagtctattcaaactagaggatttcaaaaccaacatcatagataagatagagcttcaggatatcaatgatatacaggttgaactgaaagctttttcaacagacagttttagctatgtgctaaatggtgcagggtttagtgaaggtgcattagccgtatcacatgaggacttaactatcgatgagggtgtggattttttaaacaaactactaccactttctgagtcgatacaaggctctgatggtacgactgaattaactaagaaggttactataaatactcttgtagcaaatgctaacaagcatatcgaagtgacagagttagaaaataagtttcaaataaagtctagtttgccagataagcagcatcgttatataaatgttttagacaagttagcattggcaagtgcatctaaagtacatacttatcttgatatccaagctaatcatagtatggaactagtatttgaatactttgatagtacaggtcaaagaactcgctttgaaatcaaggaatatgcaccacctgttgttattgataatactatcaactctgcatttatgagtatcagtattcgagtaaatggcagtagtaatgtagttttgggtaataagattaaactgaagcttattaataatacaaaaagcactgagagtcagtatcaagagccaaatacttttacttttagcgcagcagagataaacaaacaacttgtcagaccaaaaagtctcagccgaattctgtccctgccnnnnnnnnnataa

SEQ ID NO: 23688 - protein, 270 aa, Unknown
  Obtained from environmental sample
  misc_feature (1)..(270): Xaa is any amino acid
MVSGAVYKYVYQMSLSRSLFKLEDFKTNIIDKIELQDINDIQVELKAFSTDSFSYVLNGAGFSEGALAVSHEDLTIDEGVDFLNKLLPLSESIQGSDGTTELTKKVTINTLVANANKHIEVTELENKFQIKSSLPDKQHRYINVLDKLALASASKVHTYLDIQANHSMELVFEYFDSTGQRTRFEIKEYAPPVVIDNTINSAFMSISIRVNGSSNVVLGNKIKLKLINNTKSTESQYQEPNTFTFSAAEINKQLVRPKSLSRILSLPXXX

SEQ ID NO: 23689 - DNA, 513 bp, Unknown
  Obtained from environmental sample
  misc_feature (1)..(513): n is a, c, g, or t
ttgatgaagtactatcttaaaatttattttttactcgttatttttataattattggatgtaaatctaatcaagaagaaaaaccaattgatattcgaggtaattggtatagctataattttccttcagaaccaatagatggctttgatgaatatcttcaatttaattatgaggaggtttttattaattcaaatataatttttaactgtatccttaacgtaggttttgtgtcaccatcgggttataaattgaaaggagattctttatttgtttcttttggaatatatgatcgtaaggatgcattaacttataaaggaaaaattattcaaaagacacctgatagttttataatatataataataatgattctcttttttattacagcctgaaaaacatttctgaaaccttagacaggtatattatagatgacaaaactgaagtaaaaaaatataaagattcaattaatatttttaatcgagcattcttcaaaagaagtcaagaatgctatttataa

SEQ ID NO: 23690 - protein, 170 aa, Unknown
  Obtained from environmental sample
  misc_feature (1)..(170): Xaa is any amino acid
MMKYYLKIYFLLVIFIIIGCKSNQEEKPIDIRGNWYSYNFPSEPIDGFDEYLQFNYEEVFINSNIIFNCILNVGFVSPSGYKLKGDSLFVSFGIYDRKDALTYKGKIIQKTPDSFIIYNNNDSLFYYSLKNISETLDRYIIDDKTEVKKYKDSINIFNRAFFKRSQECYL

SEQ ID NO: 23691 - DNA, 402 bp, Unknown
  Obtained from environmental sample
  misc_feature (1)..(402): n is a, c, g, or t
atgagtgtcatcaattttcttaaaagtaaagtgttttttaagcaattagcaatagcagtagtcgctgtggttgttttagtgtttttaatgcttaagtggttaaacattactacaaataataacgagtttgaaacggttccggatttgacaggaaaatcgatagaagttgcaaaaatagagttagaaaaaaacaacttggtaatgcaaattcaggactcggctaattttaatcccgattacccaaagttttctgtaatagagcaggacccaaaagcaagcgctaaagttaaagaaaaccgcanaatatacattacattaaatccgtcaggataccgtaaaatagcagtgcctgatttaagtcataaaagttttagacaagcaaaacaacaattgaagcattag

SEQ ID NO: 23692 - protein, 133 aa, Unknown
  Obtained from environmental sample
  DOMAIN (42)...(108): PASTA domain
  misc_feature (1)..(133): Xaa is any amino acid
MSVINFLKSKVFFKQLAIAVVAVVVLVFLMLKWLNITTNNNEFETVPDLTGKSIEVAKIELEKNNLVMQIQDSANFNPDYPKFSVIEQDPKASAKVKENRXIYITLNPSGYRKIAVPDLSHKSFRQAKQQLKH

SEQ ID NO: 23693 - DNA, 846 bp, Unknown
  Obtained from environmental sample
  misc_feature (1)..(846): n is a, c, g, or t
ttggaaactggcctaaaacttatggctcaaacgaataaggaatataatcatttaaccaacctagaactgtccattcaaattagtttgagtggactttctttttgtgttttaaacccagatactaaaaccattatcgagttaaaatctcaggtctttagtataaaaaaaacaccaacagaacttctagacgcagtaatacacctttttaatacagaagaaattttaaatcaaaacttctcctctatcaacataatccatgttaatgattggtccaccttagtaccaaaagcattgtttaaagaagattatttagcagattatttaaaatttaataccaagattttaaaaactgactttattacttttgacgagattattaccaatgaaagcattaatatttatgttccgtttactaatataaacaactatatatttgataaatatggtagttttacatacaagcacttctctactatactaatagaacaattattagttaaagaaaagcattctagtaacactaaagtttacgtaaatatagatactaataactttgaaataatagctattaaagaaggtggattactactttataacacctttgaatatcatacaaaagaagattacatttattaccttttatttactttagaacaattacagcttaatccagaaacgctacaattagttttactaggattaattaataaagaagatgatgtatataacatcacttataaatacatccgaaacgtatcttttgaaaacagatggatacctataattttacaaagacaccaacaacaaattactcatatttcacctactaaaaagcttataatgcgc

SEQ ID NO: 23694 - protein, 282 aa, Unknown
  Obtained from environmental sample
  misc_feature (1)..(282): Xaa is any amino acid
METGLKLMAQTNKEYNHLTNLELSIQISLSGLSFCVLNPDTKTIIELKSQVFSIKKTPTELLDAVIHLFNTEEILNQNFSSINIIHVNDWSTLVPKALFKEDYLADYLKFNTKILKTDFITFDEIITNESINIYVPFTNINNYIFDKYGSFTYKHFSTILIEQLLVKEKHSSNTKVYVNIDTNNFEIIAIKEGGLLLYNTFEYHTKEDYIYYLLFTLEQLQLNPETLQLVLLGLINKEDDVYNITYKYIRNVSFENRWIPIILQRHQQQITHISPTKKLIMR

SEQ ID NO: 23695 - DNA, 354 bp, Unknown
  Obtained from environmental sample
  misc_feature (1)..(354): n is a, c, g, or t
ttgatgaaagacttcataaacaccttttataaaaatcactctcttttatataagattattctatttatagccacgacttttttaatcgtgtatttatttccgaaaagcggacgttttaaatacaatttcgaaaaaggaaagccttggcagtctgaaacgttatacgcgccttttaattttgctattcaaaacacaccagaagaactttctaaagaaaaagaggaaattgagtctaatgcggttaaatatttctcgatagatactaaagtgcttcctattgtaaaaaaagaatatcaaaataatttttacaagtttttccagattccattaccgcgaggaaagtcctctttaaaa

SEQ ID NO: 23696 - protein, 118 aa, Unknown
  Obtained from environmental sample
  misc_feature (1)..(118): Xaa is any amino acid
MMKDFINTFYKNHSLLYKIILFIATTFLIVYLFPKSGRFKYNFEKGKPWQSETLYAPFNFAIQNTPEELSKEKEEIESNAVKYFSIDTKVLPIVKKEYQNNFYKFFQIPLPRGKSSLK

SEQ ID NO: 23697 - DNA, 774 bp, Unknown
  Obtained from environmental sample
  misc_feature (1)..(774): n is a, c, g, or t
gtgcttcctattgtaaaaaaagattatcaaaataatttttacaaggtttttccagattccatttaccgcgaggaaagttcttctttaaagaaacaaggggaacaaattattaatgagctctataaatatggcgttttagaagataatttatctagtgctaaaactagcgatgtcaccattttagaagatagagtagaacgctataaaactcagttttctaatatttatcaacttgaaaatataaaaaatgatgttttagaaaaacttaaaaaagcaaatttagaagcctatcaaagtgaatatattgccttatttttcgatattataaaacccaatttaacgtataataaaacgtttacagagaatgttttaaatgaagctttacaatctatttccttcacaagaggaagtattgaaaaagaaaccttaatcatttcaaaaggtgaaattgttgaaggtaataagtttctcattttaaaatcgttagaatcggaatatgaatctcaagtttggaatgaatctaactataatttaattgtatttgcctacacgttgttggtggctttagctttaataattctattactttttttacgtaaataccgcttagacgtttttaaaaacgacaccaaagtaacctttatattttttaatatattattaatggtgtttttaaccagcttaatggttaattacaactcacaatacatttatattataccgctagctatgttgccattggttttaaaagccntttttcgacgcccnggttag

SEQ ID NO: 23698 - protein, 257 aa, Unknown
  Obtained from environmental sample
  misc_feature (1)..(257): Xaa is any amino acid
MLPIVKKDYQNNFYKVFPDSIYREESSSLKKQGEQIINELYKYGVLEDNLSSAKTSDVTILEDRVERYKTQFSNIYQLENIKNDVLEKLKKANLEAYQSEYIALFFDIIKPNLTYNKTFTENVLNEALQSISFTRGSIEKETLIISKGEIVEGNKFLILKSLESEYESQVWNESNYNLIVFAYTLLVALALIILLLFLRKYRLDVFKNDTKVTFIFFNILLMVFLTSLMVNYNSQYIYIIPLAMLPLVLKAXFRRPG

SEQ ID NO: 23699 - DNA, 615 bp, Unknown
  Obtained from environmental sample
  misc_feature (1)..(615): n is a, c, g, or t
ttggttgctttattaaaagaaagcgaagaaataaaacgaaataaacccatttttaatagagcgctacgccgaaacatttttacacatgctttgtattcttttaaagatgctaatggctatattaatttaatgatagataaggctgatggccgtaaaaaaccaatcacaacctttacaaatagacaaagtgcaaaaagtttcttatttaatgcagtagaagaatttcaattgtgtcagaaattaacgggactttatccaacaaaaaacagttgctttaattatgacatcaaacaatgtttaggtgcgtgcattcaagaagaatctccggaggattataataaacgtgttttgcagttaattactaaaaatagctataataatcaaaatatggttattattgatcgtgcgcgtgaggtagatgaacgtagtgctattcttatagaaaatggcctttttaaaggtatcgggtatttcaatttaaattatcaaataaccaatatggatgttttacaatctgtaattacacctatggaaaacaatcgtgacgcccaacatattattaagagttacttaaggaaaaacaaaaaactgaaaattataaaactgaataactaa

SEQ ID NO: 23700 - protein, 204 aa, Unknown
  Obtained from environmental sample
  misc_feature (1)..(204): Xaa is any amino acid
MVALLKESEEIKRNKPIFNRALRRNIFTHALYSFKDANGYINLMIDKADGRKKPITTFTNRQSAKSFLFNAVEEFQLCQKLTGLYPTKNSCFNYDIKQCLGACIQEESPEDYNKRVLQLITKNSYNNQNMVIIDRAREVDERSAILIENGLFKGIGYFNLNYQITNMDVLQSVITPMENNRDAQHIIKSYLRKNKKLKIIKLNN

SEQ ID NO: 23701 - DNA, 582 bp, Unknown
  Obtained from environmental sample
  misc_feature (1)..(582): n is a, c, g, or t
ttgtctaatccaacattcccaattaaaccagatttatcttctgaagttttgaaaattacctctttagatcattgtcaatggattggaatagccccttttgcccaatatcaatctaaaatgtacccattagatttaattgaacaagttatttcggaactaaataactcaaataagtataaaatttttctttttggtggaggaaatcatgaagtaaaaattttaaatgaaattgaaactgaatttaaaaatgttatttctgttgcaggaaaattaaaacttattgatgaattaaatcttatttctaacttagattgtatggtaagtatggattcggcaaattcacatttggcagccatgcaaggtgttaaaacaataactatttggggaattacgcatccctttgcaggttttgcgccattcaaccagcctatggaacatttattgttaccagatttagataaatatccaaatataccttgttcggtttatggcaataaagtttgcaaaggttacgaagatgcgatgaggagtatactacccagtaacgttgttgaaaagatcacaaacataataaaaaaataa

SEQ ID NO: 23702 - protein, 193 aa, Unknown
  Obtained from environmental sample
  misc_feature (1)..(193): Xaa is any amino acid
MSNPTFPIKPDLSSEVLKITSLDHCQWIGIAPFAQYQSKMYPLDLIEQVISELNNSNKYKIFLFGGGNHEVKILNEIETEFKNVISVAGKLKLIDELNLISNLDCMVSMDSANSHLAAMQGVKTITIWGITHPFAGFAPFNQPMEHLLLPDLDKYPNIPCSVYGNKVCKGYEDAMRSILPSNVVEKITNIIKK

SEQ ID NO: 23703 - DNA, 369 bp, Unknown
  Obtained from environmental sample
  misc_feature (1)..(369): n is a, c, g, or t
atgtttgaaatgacaaaggaagaattagaagtttggaggtcgcaatttgcgacatccaatcaagataagaaaggtttacgttacgctcctttttgttttacagaacaaggagttacaatgttgtcttgtgttttaaatagtgaaagagcaatagaagttaatatcagaattattagagtgtttactaaaatacgtgaagtacttacagataatttaagtttaaaacttgatattgaagaaatcaaaaagaaactaacaaatcactctaaaaatattgaattggtttttaattatttagatgaattaatcgacaagaaagataacgaaaagccaagaactcaaataggttacaaaaaagaaagaaagtaa

SEQ ID NO: 23704 - protein, 122 aa, Unknown
  Obtained from environmental sample
  misc_feature (1)..(122): Xaa is any amino acid
MFEMTKEELEVWRSQFATSNQDKKGLRYAPFCFTEQGVTMLSCVLNSERAIEVNIRIIRVFTKIREVLTDNLSLKLDIEEIKKKLTNHSKNIELVFNYLDELIDKKDNEKPRTQIGYKKERK

SEQ ID NO: 23705 - DNA, 591 bp, Unknown
  Obtained from environmental sample
  misc_feature (1)..(591): n is a, c, g, or t
gtggttacagatagtgaaattatttataatgagattgtaaataacggcggaaaagccattatgagcaaaaaggaacacgaatgtggaagcgacagaattgcggaagctatcgagtttatggacgatgtagatattgtggttaatgtgcaaggtgatgagccttttaccgaagtcgcttcgcttaaaaaactaattgctgtctttaacgatgatccactaaaagaaattgatttagcatctttaatggttcatattcatgaatgggaggagattactaaccccaataccgttaaagttattgttgataataataattttgctttatacttttctagaagccccattccgtttccaagagacaaggatgtagccgttaaatactacaaacataaaggagtgtatgcgtttaggcgtcaagcacttttagatttttaccgtttacccattttgccgttggaagcgtctgaaaaaattgagtgcatccgatatttagaatatagtaaaaaaataaaaatggtagaaaccgatgttcaaggtgttgaaattgatacacctgaagatttgaaattagccaacaagctgtggaaataa

SEQ ID NO: 23706 - protein, 196 aa, Unknown
  Obtained from environmental sample
  DOMAIN (3)...(170): Cytidylyltransferase
  misc_feature (1)..(196): Xaa is any amino acid
MVTDSEIIYNEIVNNGGKAIMSKKEHECGSDRIAEAIEFMDDVDIVVNVQGDEPFTEVASLKKLIAVFNDDPLKEIDLASLMVHIHEWEEITNPNTVKVIVDNNNFALYFSRSPIPFPRDKDVAVKYYKHKGVYAFRRQALLDFYRLPILPLEASEKIECIRYLEYSKKIKMVETDVQGVEIDTPEDLKLANKLWK

SEQ ID NO: 23707 - DNA, 891 bp, Unknown
  Obtained from environmental sample
  misc_feature (1)..(891): n is a, c, g, or t
ttgaannnnnnnncccaggtacagaatcggctcnaaacacttactggtcatgtgatcgatactaaaaaagcattattaaccagtaaagcaatccaaaaaaattcagttggtaagaaaaccataataggaattggccctgagtctaaatgctggctaggtgtgccaattttagttgataatattgctattggcgctatggttgtacaaagctataccgacgtgtatgcatattctcaagatgacgttgcgttattagaattgattgcttccaatattggccaaatcactaaaaagactgaagatctagaacaaatacgacttttaaataaagccttaattcaaagtccgcaaggtgtaataattaccaatttgaagggtgaaattgaatataccaacccagcatttaccaaattaagtggttatacagaagctgaagcactgggtttaaatccacgcatattaaattcaggtgaccaaacacctgaatattatgaaaaaatatggaaaacaattactaatggaaatacgtgggaaggtgagtttattaatcagcgtaaagatggaagtaaatatttagttgaagtaaatatttcttcagtaaaaaataaaaaaggtaaaattacacactatattggtgtgcaagaagatattactgagaaacgaaagttagaacgtcaatttattaatgcatttattgatgcccaagaagttgagaaacaaaactttggagaagaactgcatgatggtataagccaaatattatctgcagaagggatgtatataaatttattaattgaacaaaatcaagaccgaaataatgataaggcaaaattcttaactaaaattaaagagcttaataatagagctgtaaatgaaacaagaaatatagca

SEQ ID NO: 23708 - protein, 297 aa, Unknown
  Obtained from environmental sample
  DOMAIN (107)...(169): PAS domain
  misc_feature (1)..(297): Xaa is any amino acid
MXXXXQVQNRLXTLTGHVIDTKKALLTSKAIQKNSVGKKTIIGIGPESKCWLGVPILVDNIAIGAMVVQSYTDVYAYSQDDVALLELIASNIGQITKKTEDLEQIRLLNKALIQSPQGVIITNLKGEIEYTNPAFTKLSGYTEAEALGLNPRILNSGDQTPEYYEKIWKTITNGNTWEGEFINQRKDGSKYLVEVNISSVKNKKGKITHYIGVQEDITEKRKLERQFINAFIDAQEVEKQNFGEELHDGISQILSAEGMYINLLIEQNQDRNNDKAKFLTKIKELNNRAVNETRNIA

SEQ ID NO: 23709 - DNA, 678 bp, Unknown
  Obtained from environmental sample
  misc_feature (1)..(678): n is a, c, g, or t
atgaatagaaacttccctgatggacgcgatttaaaccgtgtctttccaggtgttaaatcaggatcgctagcaagtcgcgtagctaacgaattgattacagaaattattccccacgtcgattttgtgatcgattttcataccggaggtgccttgcgttttaatgcacctcaaattcgtattgaagaaggaaatccagagtatgatgctatggcccaattatttggtgcgccttttatagtgtattcaaaaaacttaggtcgttcgtttagaaatacctgtaatcatatgggaaaacctatattactttacgaaggtggaaaatcgttacatattgacgcgaatgttactaatacgggcgtaaatggtgcaaaacgtattttacatcattttggaatgcttagaagcaattttaaagtttctaaacctaaaaaagaatcattgtatgtcactgaaagtaaatggattcgcgctaaattctcaggaatgtttaaatctacaactcgcattgaaaaactagttgaaaaaggcgaagttttaggccatattaccgatccttatgggaaatttaatcactttgtaaaagctccaaattcaggttatattattaatataaacgatgcacctttaatttatcaaggtgatgcattatttcatatttctatacaacatgataaataa

SEQ ID NO: 23710 - protein, 225 aa, Unknown
  Obtained from environmental sample
  DOMAIN (1)...(222): Succinylglutamate desuccinylase / Aspartoacylase family
  misc_feature (1)..(225): Xaa is any amino acid
MNRNFPDGRDLNRVFPGVKSGSLASRVANELITEIIPHVDFVIDFHTGGALRFNAPQIRIEEGNPEYDAMAQLFGAPFIVYSKNLGRSFRNTCNHMGKPILLYEGGKSLHIDANVTNTGVNGAKRILHHFGMLRSNFKVSKPKKESLYVTESKWIRAKFSGMFKSTTRIEKLVEKGEVLGHITDPYGKFNHFVKAPNSGYIININDAPLIYQGDALFHISIQHDK

SEQ ID NO: 23711 - DNA, 366 bp, Unknown
  Obtained from environmental sample
  misc_feature (1)..(366): n is a, c, g, or t
atgctgggagaagccattgaaggtactgttgccattttgaaaaaattgatagacaacaaagattacaaagtggtggcattgaccaactggagtcatgaaaccttccctatcgctcttgagagatttgactttttacattggtttgacggcattttagtttctggcgaagaaaagaccagaaaacccttcaaagacatttacgaattgaccttgagtcgttttgatatagaagcgaaacgttccgtttttatagatgacaatcttcgcaatatcattgctgccaaagacatgggcatcaataccattctttttaaaaatccagaaaaattggaagaagaattgaaggcgctcaatattatcctctaa

SEQ ID NO: 23712 - protein, 121 aa, Unknown
  Obtained from environmental sample
  misc_feature (1)..(121): Xaa is any amino acid
MLGEAIEGTVAILKKLIDNKDYKVVALTNWSHETFPIALERFDFLHWFDGILVSGEEKTRKPFKDIYELTLSRFDIEAKRSVFIDDNLRNIIAAKDMGINTILFKNPEKLEEELKALNIIL

SEQ ID NO: 23713 - DNA, 519 bp, Unknown
  Obtained from environmental sample
  misc_feature (1)..(519): n is a, c, g, or t
atgcaaaaacaacttttagacttacttatgtactcgattccagctataattactggagttatcgcttatttcttttttaaagaacatattaaaaatgaaaataatagacgtcattttttaatgcacaaggattttaaaaaagaatttttacctatgcgtttacaagcttacgaacgtatgacgttgtttttagaacgcattgtaccgtctaaattactcattagagttgcaccacattctagtgataaaaacgattatgaaaaattattaattgatagtatcgaacaagagtttgagcacaatttatcgcagcaaatatatttaactagcgattgctggagtattattgtcgcagcaaaaaacacaaccattcaattaataataaaagcaaatatgtctgaaaaaacagatactgctaataaacttcgtgaagtaatattaacagaaatgatggagaaacaagctccaagtagcaccgctctctcttatattaaagaagaaataagtgctatctggtaa

SEQ ID NO: 23714 - protein, 172 aa, Unknown
  Obtained from environmental sample
  misc_feature (1)..(172): Xaa is any amino acid
MQKQLLDLLMYSIPAIITGVIAYFFFKEHIKNENNRRHFLMHKDFKKEFLPMRLQAYERMTLFLERIVPSKLLIRVAPHSSDKNDYEKLLIDSIEQEFEHNLSQQIYLTSDCWSIIVAAKNTTIQLIIKANMSEKTDTANKLREVILTEMMEKQAPSSTALSYIKEEISAIW

SEQ ID NO: 23715 - DNA, 405 bp, Unknown
  Obtained from environmental sample
  misc_feature (1)..(405): n is a, c, g, or t
atggctttgatacgccgatggcggttgggttgtgtaattcctatcggggaagccatacgtcgtggggccaccgaagtagatgccatggtattagaaagtgaggaactagaatataataaagtattaggaaacaatccgttttctttaatgtttagtttatttggtcatttattagatcaagtagaaaaaggagatatcgctattggtaaactagcagcacaatacaaaaatgtaaaactcaatctgtattacacgcccacccaactaacagagaactccttaatcttcaataaaagattaatggaaaaatggtggttagaagggtatgcccacgcccaaagtaaacacggcaaagggcaatctatggacgatagcacttctttagaaaaagaaattaccagatag

SEQ ID NO: 23716 - protein, 134 aa, Unknown
  Obtained from environmental sample
  misc_feature (1)..(134): Xaa is any amino acid
MALIRRWRLGCVIPIGEAIRRGATEVDAMVLESEELEYNKVLGNNPFSLMFSLFGHLLDQVEKGDIAIGKLAAQYKNVKLNLYYTPTQLTENSLIFNKRLMEKWWLEGYAHAQSKHGKGQSMDDSTSLEKEITR

SEQ ID NO: 23717 - DNA, 885 bp, Unknown
  Obtained from environmental sample
  misc_feature (1)..(885): n is a, c, g, or t
atgacagatcggctgagacagtcggttaacggaggtataatctattcgtttaaggtgttacaaacaattgattcgttttatttaaatacaaaaaacacttctttttctaaggtgatggttaataatatggtgacgaattatcatattaaagacaataaattatggattgtaaagactttaaaaccttcagtagataatacattagaattttcttttacttctaaacctagaaaagcactttattttattgatgctgaagatgaagaacatcatcaaatttggacgcagggccaagggcaatacacgagtaattggttaccgagtatagatgatacgaatgataaaatagaatttgatttaaacatcacttataaaaatgattttgaagttatagccaatggaaaattgattcataaggaaataagtgccacacataccacgtggcaatataatatggagcatcctatggctagttatttagtggctttagctattggaaagtataataaaatagaagagctgtctgcgagtaaaataccgttaaactattattactacccgaaagattctttaaaagtagagcctacgtatcgctattcgaaagagatgttcgatttcttagaaacagagataggtgttgcttttccgtggcaaaattataagcaaatcccggttaaagattttttgtatgccggaatggaaaacactggtactaccatttttagtgatacttttgtagtggatagtattgcgtttgtagataagaattatgtgaatgtaaatgcacatgaattggcccaccaatgggttggaaatttagttacagcaaccgaagtaaacatcattggcttcaagaaggctttgcgacctattacgcgctattag

SEQ ID NO: 23718 - protein, 294 aa, Unknown
  Obtained from environmental sample
  DOMAIN (3)...(293): Peptidase family M1
  misc_feature (1)..(294): Xaa is any amino acid
MTDRLRQSVNGGIIYSFKVLQTIDSFYLNTKNTSFSKVMVNNMVTNYHIKDNKLWIVKTLKPSVDNTLEFSFTSKPRKALYFIDAEDEEHHQIWTQGQGQYTSNWLPSIDDTNDKIEFDLNITYKNDFEVIANGKLIHKEISATHTTWQYNMEHPMASYLVALAIGKYNKIEELSASKIPLNYYYYPKDSLKVEPTYRYSKEMFDFLETEIGVAFPWQNYKQIPVKDFLYAGMENTGTTIFSDTFVVDSIAFVDKNYVNVNAHELAHQWVGNLVTATEVNIIGFKKALRPITRY

SEQ ID NO: 23719 - DNA, 945 bp, Unknown
  Obtained from environmental sample
  misc_feature (1)..(945): n is a, c, g, or t
atggattgggaagcagattggggtgatgaagaaaatgtaattggtaaaaaagtaaaagttcatattgcggatatggatggtagaaaatggaaagaagatttaagtgctgatgtagaaatattagaagagcttttatcagaaatttctatggtaaaagataatttagattttaagttaaatgatataaaagatcttgtaaaacaaaaaattgagaatcctaaaaaccctgacaacaaaaaggtaattatatttaccgcttttgctgatacggctaattatttatatgataatttaaaatcagaatttaaaaccctttatggattaaatacagctttaattacaggtagtaaacgtaaatgtaccacaaaagaaataccaacagacttaaatacattgttaacgtgtttttcgccacgttctaaaagcaaagagcaattgcatcctggtataaaagatactatagatattttaattgcaacagattgtatttcagaaggtcaaaacttacaagattgtgattttttagtcaattacgatattcattggaatcctgtacgtatcattcaacgttttggtagaatagatagaataggttctataaatacaaatatcacaatggtaaacttttggccagatattactttagataattatatcaatctaaaatctagagttgaaaacaaaatgcttattagcaatatggcaagtactggtgatgataatattttaaatactgaagacaaagatttagaatatagaaaaatacaattaaagaaactgcaagaagaagtagtcgatttagaagatttaagagaaggtgttagtattacagatttaggtttaaacgactttagaattgacctatcccattatataaagaaatatggagagttaaaaaatattcctgagggtttacacgctattgcagaagctaatgactatttt

SEQ ID NO: 23720 - protein, 315 aa, Unknown
  Obtained from environmental sample
  DOMAIN (102)...(198): Helicase conserved C-terminal domain
  misc_feature (1)..(315): Xaa is any amino acid
MDWEADWGDEENVIGKKVKVHIADMDGRKWKEDLSADVEILEELLSEISMVKDNLDFKLNDIKDLVKQKIENPKNPDNKKVIIFTAFADTANYLYDNLKSEFKTLYGLNTALITGSKRKCTTKEIPTDLNTLLTCFSPRSKSKEQLHPGIKDTIDILIATDCISEGQNLQDCDFLVNYDIHWNPVRIIQRFGRIDRIGSINTNITMVNFWPDITLDNYINLKSRVENKMLISNMASTGDDNILNTEDKDLEYRKIQLKKLQEEVVDLEDLREGVSITDLGLNDFRIDLSHYIKKYGELKNIPEGLHAIAEANDYF

SEQ ID NO: 23721 - DNA, 675 bp, Unknown
  Obtained from environmental sample
  misc_feature (1)..(675): n is a, c, g, or t
atgagtattttaaaacaaataggtaacacaccattagtagaagccaccaatttagtatcaaaacctaacgttaagttgcttttaaaactagaaggtgataatccaggaggaagtgtaaaagatagacctgcttataatatgattgccgaagctgtaaaacgtggcgacataaaaaaaggaggacatatagtagaagctacaagtggtaacactggtatagctttggcttatgtagccagtttatttgggattaatatttctttagtaatgccagaaaactccactatcgagcgtgtcaaaacaatgcgagcttatggagcagaggttgttttaacagatgcccaacgtggtattgaaggctcaagagatgttgcttttaaaatgagagatgaaaaaggttatttattgttaaatcaatttgaaaataacgacaactggaaagcgcattataaaaccacaggtccagaaatttggaaagatacaaaaggagaagtgacgcactttgtatctgcaatgggtactacaggaaccattatggggacttcaacatttttaaaagaacaaaataaagacattcaaataataggtgcgcaaccagccgatggatctagtataccaggcatccgtaaatggtctccagattacgtaccaagtatttttaatccatcaaagtga

SEQ ID NO: 23722 - protein, 224 aa, Unknown
  Obtained from environmental sample
  DOMAIN (3)...(224): Pyridoxal-phosphate dependent enzyme
  misc_feature (1)..(224): Xaa is any amino acid
MSILKQIGNTPLVEATNLVSKPNVKLLLKLEGDNPGGSVKDRPAYNMIAEAVKRGDIKKGGHIVEATSGNTGIALAYVASLFGINISLVMPENSTIERVKTMRAYGAEVVLTDAQRGIEGSRDVAFKMRDEKGYLLLNQFENNDNWKAHYKTTGPEIWKDTKGEVTHFVSAMGTTGTIMGTSTFLKEQNKDIQIIGAQPADGSSIPGIRKWSPDYVPSIFNPSK

SEQ ID NO: 23723 - DNA, 420 bp, Unknown
  Obtained from environmental sample
  misc_feature (1)..(420): n is a, c, g, or t
atgaaactcttaaaaaaaatactattcgctttagttattttattagctatagctcagtttttcggaccagaaaaaaatttaggcaacttagaatcggttaacgcttttttagcagaaaccaatccgccagaaaacgttaaagcgattttgaaggaatcgtgttttgattgccatacaaacacaacaagatatccgtggtatagtaacataacgccaattaattattggttggcagagcatattaaagacggaaaaaaagatttagatttctctacttgngatgataattcagtaaaacgaaaagatcacaagtttgaagaaattatagaaatggttgagcaaagagaaatgcctttaccaagttatacgtacacgcacagtgaggcaaaattaagcgattctcaaattcaagaaatatag

SEQ ID NO: 23724 - protein, 139 aa, Unknown
  Obtained from environmental sample
  SIGNAL (1)...(18)
  misc_feature (1)..(139): Xaa is any amino acid
MKLLKKILFALVILLAIAQFFGPEKNLGNLESVNAFLAETNPPENVKAILKESCFDCHTNTTRYPWYSNITPINYWLAEHIKDGKKDLDFSTXDDNSVKRKDHKFEEIIEMVEQREMPLPSYTYTHSEAKLSDSQIQEI

SEQ ID NO: 23725 - DNA, 591 bp, Unknown
  Obtained from environmental sample
  misc_feature (1)..(591): n is a, c, g, or t
atgaaatactacatcatagcaggagaagcatctggagatttacacgcatctaatctcatgaaagcattacaagaacaagatgccaattctgattttagattttggggaggtgatttgatgcaagccgttgggggcactttggtaaagcattataaagaacgcgcttttatggggtttggagaagtgattatgaacttaccaacaatattaggcttgtttaaattttgcaaacaggatataacaaaatacaatccagatcaattaatttttattgataattctggatttaatttaagaattgcaaagtgggcaaaacaacataattttaaaaccaattactatattgctcctcaagtttgggcgagtagagcaggtagagttaaagatattaaaagagatatcgatagcatgtttgtgacactgccatttgaaaaagaattttataaaaaatataattataaagtgaattttgttggacacccttttgtagatgaaattgaaggtagaaagcaggttgatgatactacatttagaaaccaacacaatttatctgataaaaaaaattattgcattattggcctgggagtcgaa

SEQ ID NO: 23726 - protein, 197 aa, Unknown
  Obtained from environmental sample
  DOMAIN (3)...(196): Lipid-A-disaccharide synthetase
  misc_feature (1)..(197): Xaa is any amino acid
MKYYIIAGEASGDLHASNLMKALQEQDANSDFRFWGGDLMQAVGGTLVKHYKERAFMGFGEVIMNLPTILGLFKFCKQDITKYNPDQLIFIDNSGFNLRIAKWAKQHNFKTNYYIAPQVWASRAGRVKDIKRDIDSMFVTLPFEKEFYKKYNYKVNFVGHPFVDEIEGRKQVDDTTFRNQHNLSDKKNYCIIGLGVE

SEQ ID NO: 23727 - DNA, 909 bp, Unknown
  Obtained from environmental sample
  misc_feature (1)..(909): n is a, c, g, or t
ttggcaattgacttgtctgaattaaataatattgatttagatgaaaaaaatgtagaaaacaaatatacgatgcttaacgtatcagagttaaattacaccatagactcgcttaaaacagaacgtaatggcgtggttagtgagttttccaaaaccatatataataggactaatttaccaactttaaatttgaccatcaaatccataaaagatagtatttatggtggagatattttagacatatttaataccaaacgtaaaatacaagtattagattatgcggttaatagcgtatctagtactcaacaaatattaaaatctaagaccacagctttacaaataaaaaattccaatatttataaacatggtatacaattacacaaaaaatttgcgttaggtatagcctgcattattctattttttgttggagctccattaggtgccttaatacgtaaaggaggtttaggattaccaatggttattgctatagtcttgtttttaagttatcactttataggtttatttgccgaaaacagtgctaaaaacggaaaactaaaccctgtactctctgcttggttttcaacgttaatcatgttaccattaagtatatttttgactaaacgcgctactcaggatagaggtatttttgaattcgatcatattacagttcctattaaaaattggtacaatgccaaatttggtaaaactaaaattacagctgatacattaagctctgatacaatctatctaccagaaactgaaaaagctagctataaaacattatcaacacttagtattactttttacataattagtgttgctctatttattttatactttgtatttaaaaacaacaaattaccagttggtagcttagctggaatacagaaaagtttaggttcatttattgaa

SEQ ID NO: 23728 - protein, 303 aa, Unknown
  Obtained from environmental sample
  misc_feature (1)..(303): Xaa is any amino acid
MAIDLSELNNIDLDEKNVENKYTMLNVSELNYTIDSLKTERNGVVSEFSKTIYNRTNLPTLNLTIKSIKDSIYGGDILDIFNTKRKIQVLDYAVNSVSSTQQILKSKTTALQIKNSNIYKHGIQLHKKFALGIACIILFFVGAPLGALIRKGGLGLPMVIAIVLFLSYHFIGLFAENSAKNGKLNPVLSAWFSTLIMLPLSIFLTKRATQDRGIFEFDHITVPIKNWYNAKFGKTKITADTLSSDTIYLPETEKASYKTLSTLSITFYIISVALFILYFVFKNNKLPVGSLAGIQKSLGSFIE

SEQ ID NO: 23729 - DNA, 423 bp, Unknown
  Obtained from environmental sample
  misc_feature (1)..(423): n is a, c, g, or t
atgaaaacaaatgcaatttactgcatcttaacttgtactatcattttactaagtactagttgtaaaaaagatgctacaaccaacaacaattataaacctatgagtgataacctattacttaaagactttacaggaccttatggtggtgttcctgcttttgacaaaatgaaagttgaccaaatccaacctgctgttttagaaggcattgaagaaggtctaattgatattgagactattgcaaataataaggaagcaccatcttttaaaaatactattgaagctatggaacgtgcaggtcatagcctagataatgtatttacgtattatggtatttttagtagcaatatgagtagtccagaatttagagatgtgcaaagtgctttagctcctaaattatctgattatactctaaaatatcactga

SEQ ID NO: 23730 - protein, 140 aa, Unknown
  Obtained from environmental sample
  misc_feature (1)..(140): Xaa is any amino acid
MKTNAIYCILTCTIILLSTSCKKDATTNNNYKPMSDNLLLKDFTGPYGGVPAFDKMKVDQIQPAVLEGIEEGLIDIETIANNKEAPSFKNTIEAMERAGHSLDNVFTYYGIFSSNMSSPEFRDVQSALAPKLSDYTLKYH

SEQ ID NO: 23731 - DNA, 510 bp, Unknown
  Obtained from environmental sample
  misc_feature (1)..(510): n is a, c, g, or t
ttggaatacgagactaaaaacaagaaaaccaagtggcggtgggtaacaagcatgggtaatatggatattttattacatgacattacaaagtttcatcgtgccaattttatttttctgactaaacaaggtgcgtttgacaatacgcaatttcatcgtgtggtcaaaaactttatcattcaaggtggtaatacagacaatgtaaaagttgctgccaaacgtggtaaaattggtcactatctattaccaacagataccaaacgtggatttacacataaaagaggtgtaatctctatgcctagtagtgatattgaaaatccacataaattagcctctccttacgagttttttattactcaacaagatgcgtttcatttagatggtgactttactatttttggagaagtcatcaatggtttggatgttgttgataagattaatgcagtaactgttgacgagtctgattggccacttaccaatatctatattaaaacagtcaaaattctagaatag

SEQ ID NO: 23732 - protein, 169 aa, Unknown
  Obtained from environmental sample
  DOMAIN (18)...(168): Cyclophilin type peptidyl-prolyl cis-trans isomerase
  misc_feature (1)..(169): Xaa is any amino acid
MEYETKNKKTKWRWVTSMGNMDILLHDITKFHRANFIFLTKQGAFDNTQFHRVVKNFIIQGGNTDNVKVAAKRGKIGHYLLPTDTKRGFTHKRGVISMPSSDIENPHKLASPYEFFITQQDAFHLDGDFTIFGEVINGLDVVDKINAVTVDESDWPLTNIYIKTVKILE

SEQ ID NO: 23733 - DNA, 639 bp, Unknown
  Obtained from environmental sample
  misc_feature (1)..(639): n is a, c, g, or t
gtggtgtctttctttatagtatcaatagttgttttagataagtttgttgtcgatttagatttggattgtttatcttcacaattaagaaaaattaaacaaaaaccaaccaataataatacgcgcatttttaaaatgaattttaatgaatttgtcatagcgttaccaaaaataaaaaatataccattgccagccgaagcatcacagcttaaaatggtgccaccatacaggcaagatttagtcaagcaacaaggtgataatatcaaaaatgccagacaaagtgcagttttagccttgttttatccggatttggaagcgcaaactaaacttattttaattttaagaaaaacgtataaaggagttcactcaggacaagttggttttccgggtggaaaagtagagttagaggataaggatttgatgcatacagcattacgcgaaacgcatgaagaagttggtgtacatccagaattagttacggtctataaaaaactaacacaagtttacattccgccaagtaatttttatgttcaaccgtttattggattggcttctcaaacaccaatatttactaaacaagatacagaagtagaggatttgttagaggtttatctaacggatttgttaagcgatggaatttaa

SEQ ID NO: 23734 - protein, 212 aa, Unknown
  Obtained from environmental sample
  DOMAIN (90)...(210): NUDIX domain
  misc_feature (1)..(212): Xaa is any amino acid
MVSFFIVSIVVLDKFVVDLDLDCLSSQLRKIKQKPTNNNTRIFKMNFNEFVIALPKIKNIPLPAEASQLKMVPPYRQDLVKQQGDNIKNARQSAVLALFYPDLEAQTKLILILRKTYKGVHSGQVGFPGGKVELEDKDLMHTALRETHEEVGVHPELVTVYKKLTQVYIPPSNFYVQPFIGLASQTPIFTKQDTEVEDLLEVYLTDLLSDGI

SEQ ID NO: 23735 - DNA, 897 bp, Unknown
  Obtained from environmental sample
  misc_feature (1)..(897): n is a, c, g, or t
gtggatactgaaaaaggtagatataaggtgtacgatagaaccgtaagagacacacataaaggagggtatggaaaaatatctgccgccaaagcattagaagtatcctcaaacattggtattgttaaaattatcgaagaccactatggtaataatcctcaaaagtttattgatggtttgaagcgaatggaaataggcaacgtactaaatcttccaataaagggtgaaggcgtcccaagtttaccaaatcctaaagataaaaaaaaatggtatggtacttcgttggcttggatgacccacggttatggtgtttcattaaccccgatgcaaacgctgactttttataatgcccttgctaataatggtgaaatggttaagcctaggtttattaaagaaattagaacgcaagatcgtgttgttgagaggtttgataaagaggtgataaatcctaagatctgctcacaatcaactattaataaagtaagagaaataatgaaaaatgtggtaaaaaggggaacagccacaaacatttataataaaaattatgaattagccggtaaaacaggtacttgtcagacagaatattggacaggtaaaactcaatatatttcatcatttgtggggtattttcctgctgataacccgcaatattcctgtatagtagtcattcataaaccaaataagaaaataggctattatggcgctgatgtagcagggcctgtttttaagcaaattgcgcataaaatctatacagaaactccattgttagatgaagtcaatggattgcatcaaaaccctgcaagcatcaattcagattttgattcttattacgatatcactaggaaacaaacccaaaagatgcctaatttaagaatagacaggaatgacgctgagccataa

SEQ ID NO: 23736 - protein, 298 aa, Unknown
  Obtained from environmental sample
  DOMAIN (1)...(246): Penicillin binding protein transpeptidase domain
  misc_feature (1)..(298): Xaa is any amino acid
MDTEKGRYKVYDRTVRDTHKGGYGKISAAKALEVSSNIGIVKIIEDHYGNNPQKFIDGLKRMEIGNVLNLPIKGEGVPSLPNPKDKKKWYGTSLAWMTHGYGVSLTPMQTLTFYNALANNGEMVKPRFIKEIRTQDRVVERFDKEVINPKICSQSTINKVREIMKNVVKRGTATNIYNKNYELAGKTGTCQTEYWTGKTQYISSFVGYFPADNPQYSCIVVIHKPNKKIGYYGADVAGPVFKQIAHKIYTETPLLDEVNGLHQNPASINSDFDSYYDITRKQTQKMPNLRIDRNDAEP

SEQ ID NO: 23737 - DNA, 396 bp, Unknown
  Obtained from environmental sample
  misc_feature (1)..(396): n is a, c, g, or t
ttggaaacaccaatgaaaaactattcattgacgccatatattagagtggatgtgtcttgtggggtaggttatgaatcggatctggaatttgtagaaacactaaccaagagaacgctagaacagacgtttaaaaaaattgacgacatgaaacctgttgaattctttttcaccgaatttggagacagttctatcaactttaaatgtcgtttctggattgaaggcaccaaaaatgtccataaactcaatgccaccaataaagcgataatcgccattaaaaaagcgtttgatgctgaaggcatcaatataccattccctattagaacgctgcagtttaacaatcaattgacggtgaacaaaaaccctgataaaagcgaggaagaatccaccaacgagtaa

SEQ ID NO: 23738 - protein, 131 aa, Unknown
  Obtained from environmental sample
  misc_feature (1)..(131): Xaa is any amino acid
METPMKNYSLTPYIRVDVSCGVGYESDLEFVETLTKRTLEQTFKKIDDMKPVEFFFTEFGDSSINFKCRFWIEGTKNVHKLNATNKAIIAIKKAFDAEGINIPFPIRTLQFNNQLTVNKNPDKSEEESTNE

SEQ ID NO: 23739 - DNA, 723 bp, Unknown
  Obtained from environmental sample
  misc_feature (1)..(723): n is a, c, g, or t
gtgcatacttcagatgcctttatttcggtagctaatgctgccagaaaaaacaatcttacgtttccggtttatgttgatacaaaaacactggaattgcaggttactggactttttcatcctttattaaaaaaagcaaaatcttacgattttaaaattaagaaaaaatcaaatatggtgtttttaacaggcccaaatatggcaggaaaatcaacctttcttaaatccattgggctgtccgtttttatatcgcatttagggtttcctgtacctgctacttccatgacaacttctgtttataatggcgttgtgtctaccataaatttgtccgataatttaaataagggattaagtcttttttacacggaagtcaaacgtgctaaagaaacagcgcttaaattaaaagaaaacaaaaatttacttgttatttttgacgagctgtttagaggaacaaatgtaaaagatgcagcagatgcctctttgttaattattaactcgttttctaaaattaaaaaaagtacgttttttgtatcaacacatattacagaggtagcatcggaattatctgatgcggatagtattcagtttaaatgttttaactcgcaattagttaataacacaccagtttatgattataagttaaaagatggtatttctcatgagcgtttaggactgcttattgtaaaaaacgaaaagattgttgagattttagaatccataaaataa

SEQ ID NO: 23740 - protein, 240 aa, Unknown
  Obtained from environmental sample
  DOMAIN (19)...(239): MutS domain V
  misc_feature (1)..(240): Xaa is any amino acid
MHTSDAFISVANAARKNNLTFPVYVDTKTLELQVTGLFHPLLKKAKSYDFKIKKKSNMVFLTGPNMAGKSTFLKSIGLSVFISHLGFPVPATSMTTSVYNGVVSTINLSDNLNKGLSLFYTEVKRAKETALKLKENKNLLVIFDELFRGTNVKDAADASLLIINSFSKIKKSTFFVSTHITEVASELSDADSIQFKCFNSQLVNNTPVYDYKLKDGISHERLGLLIVKNEKIVEILESIK

SEQ ID NO: 23741 - DNA, 507 bp, Unknown
  Obtained from environmental sample
  misc_feature (1)..(507): n is a, c, g, or t
atggaaaatgtgattgaacaaattgattctagatttttctacgacttatattggttgtattggaatttcattacaattcgaatatgcgcaataatggaacgaaaagaaactatgggtaaaaaaaacctttctattccacttttgattagcattgctgaaaataaaaaacttaattgccttaaaaaattaattatcaagaaagataatattgagaaaaaattaaaaccttttaaggatgcaagaaataaagcttttggtcattacgatttaaaaagtaatattgagaaatcagtatttgaaagacttgaattagataatctaaaaattatatgcagtgaaattgaagatattttaaatttaattgaacttgaattaggaggcacacaaacattatatggagcgcgaatttcacatggagctttgaaagtaaataaagtattgaaattaggaataaaaaaaagaaacgagtntaaaaagntaaagtacagtttaccacaccttgtataa

SEQ ID NO: 23742 - protein, 168 aa, Unknown
  Obtained from environmental sample
  misc_feature (1)..(168): Xaa is any amino acid
MENVIEQIDSRFFYDLYWLYWNFITIRICAIMERKETMGKKNLSIPLLISIAENKKLNCLKKLIIKKDNIEKKLKPFKDARNKAFGHYDLKSNIEKSVFERLELDNLKIICSEIEDILNLIELELGGTQTLYGARISHGALKVNKVLKLGIKKRNEXKKXKYSLPHLV

SEQ ID NO: 23743 - DNA, 696 bp, Unknown
  Obtained from environmental sample
  misc_feature (1)..(696): n is a, c, g, or t
atggatacaagtaccgtcaagattatattagaaatttttcattatcttttttttacatgctctttgttggcggtactttcctatatcatattgtcaataatttcagccaaggagaccattcagtatgttaaaaaaaatagttttgtaaactataagcacattctatcttctcctatatccccttcaataaccatcattgctccagcctataatgagagtcttaatgtggttgaaaatgtaaggtcacttttgtcgaatcattaccctaattataacgtgattattgtaaatgatggaagttctgatgatagtctggaaaaacttattgaagcttatgatttagtacatatggactatgttgttgacgagaaaattgaaacacaaccgtttagaaaaggtgtttttaaatctaataatccagctttcgaaaaattaattgttgttgataaagaaaatggagggaaagctgatgcattaaatatgggcttaaacataagcgaaagtaaatatgttgcctgtattgatgtagactgtttgctattggaagacgcgcttcaaaaaatgattaagccctttcttgaagctacagattataaggtaattgctgctggtggagttataagaatagccaactcttgtgttattaaaggagggaagctcatagaggttaattgcccaagaatctttgtcagctga

SEQ ID NO: 23744 - protein, 231 aa, Unknown
  Obtained from environmental sample
  DOMAIN (64)...(231): Glycosyl transferase
  misc_feature (1)..(231): Xaa is any amino acid
MDTSTVKIILEIFHYLFFTCSLLAVLSYIILSIISAKETIQYVKKNSFVNYKHILSSPISPSITIIAPAYNESLNVVENVRSLLSNHYPNYNVIIVNDGSSDDSLEKLIEAYDLVHMDYVVDEKIETQPFRKGVFKSNNPAFEKLIVVDKENGGKADALNMGLNISESKYVACIDVDCLLLEDALQKMIKPFLEATDYKVIAAGGVIRIANSCVIKGGKLIEVNCPRIFVS

SEQ ID NO: 23745 - DNA, 936 bp, Unknown
  Obtained from environmental sample
  misc_feature (1)..(936): n is a, c, g, or t
atggagcaaattgaactctnncaattgtcaaataacctctttancttcagtagatcattgaattttcaaaagccattcataatgatggctcatcacaaattcatatatcaaaactccgtttattgggacacatttgctcgacaatcaatattattttttgagttaaaaaacaaatatgacataaataaatctnttaaagatttaacgaaaattgacttgaatatatttattaatatttcatttgtcatttggctatttacgtttaaaagtcaagaacctggatacgattgtaaaataagatttataagtgatggatatttatctcaagatgattataaacatctaattgaattatttgataaagacgatattaataattacatcaatcttctaagtttctcaagagataatattaataatatattagaaaaagatgagagaattttaaaaaactataatctgcaaccatttgaacaatcgatatttactagaagaccatttctagtatttcaaaataaatttatagttcctcataaaaatgtactgaaacataactttacacattttatatacgaatacttgaaaaccaatgatgataagtttactacagaatttggtgcgcgaatggaaaagtacgtaaaactaggacttgatgaagttaattttaaatacataacagaaaatcaattagagaaaaaaattggactaaaaaataacctagtagattttgtaattgacaacaatattctagtagaggttaaagcaatagaaattaaaccatatgctagtgtaaatcctgatgacaaaatattagcgaatgaatttagaaaaaatttagtaaaagcttatgctaagcaaatggttaatgtagctaataaactatcaaaaaaagatgtgttttacggaattataataacatacaaaaagtttttttag

SEQ ID NO: 23746 - protein, 311 aa, Unknown
  Obtained from environmental sample
  misc_feature (1)..(311): Xaa is any amino acid
MEQIELXQLSNNLFXFSRSLNFQKPFIMMAHHKFIYQNSVYWDTFARQSILFFELKNKYDINKSXKDLTKIDLNIFINISFVIWLFTFKSQEPGYDCKIRFISDGYLSQDDYKHLIELFDKDDINNYINLLSFSRDNINNILEKDERILKNYNLQPFEQSIFTRRPFLVFQNKFIVPHKNVLKHNFTHFIYEYLKTNDDKFTTEFGARMEKYVKLGLDEVNFKYITENQLEKKIGLKNNLVDFVIDNNILVEVKAIEIKPYASVNPDDKILANEFRKNLVKAYAKQMVNVANKLSKKDVFYGIIITYKKFF

SEQ ID NO: 23747 - DNA, 390 bp, Unknown
  Obtained from environmental sample
  misc_feature (1)..(390): n is a, c, g, or t
gtgttatttttcgttgctgtatttgctgttggctggcccttattacaattacttgaaaatgacaactttaaatctattacttctctaaaagaagataacgataaacgtggaattactttatattattttaaatacgttgctcctgaaaccatttggcaatatggagataagattccccaaatacaatatcataacaacgagtttcagtttccgttagagcctaaatttggagtgcttaccaatcgtatttcacccgaagatttaaaatttttaaaagctaattttaatgtaaaagaaataggcacttacgatttaaatcaagcaaaagagggctctaaacaatacaacgaccgtttaacaaataccttttatatattaagtaggaattag

SEQ ID NO: 23748 - protein, 129 aa, Unknown
  Obtained from environmental sample
  misc_feature (1)..(129): Xaa is any amino acid
MLFFVAVFAVGWPLLQLLENDNFKSITSLKEDNDKRGITLYYFKYVAPETIWQYGDKIPQIQYHNNEFQFPLEPKFGVLTNRISPEDLKFLKANFNVKEIGTYDLNQAKEGSKQYNDRLTNTFYILSRN

SEQ ID NO: 23749 - DNA, 444 bp, Unknown
  Obtained from environmental sample
  misc_feature (1)..(444): n is a, c, g, or t
ttgccaaaaggatcaggattatggcctgcattttggatgttaggtaatgatattgatactaatacttggccagcttgcggtgaaattgatattttagaatatgtaggtaaggcaccacatcaaattcatacgacgttacatacgcctgacagttatggtaaatctgttaatacaaaaattacaacaataaaagatattgaggaaggatttcataattataaaacaaagtggactaaagactctatttcattttatatagatgataatttagtgtacaccttttcaccagaaattaaaaacgaaaaaacttggccttttgataaacctttttacttaataataaaccttgcaattggaggtaactttggaggtccagaagtggatgattctatttttccgcaagattttattattgattatgtaaaggtttcaggtttaaattaa

SEQ ID NO: 23750 - protein, 147 aa, Unknown
  Obtained from environmental sample
  DOMAIN (1)...(142): Glycosyl hydrolases family 16
  misc_feature (1)..(147): Xaa is any amino acid
MPKGSGLWPAFWMLGNDIDTNTWPACGEIDILEYVGKAPHQIHTTLHTPDSYGKSVNTKITTIKDIEEGFHNYKTKWTKDSISFYIDDNLVYTFSPEIKNEKTWPFDKPFYLIINLAIGGNFGGPEVDDSIFPQDFIIDYVKVSGLN

SEQ ID NO: 23751 - DNA, 624 bp, Unknown
  Obtained from environmental sample
  misc_feature (1)..(624): n is a, c, g, or t
ttggatagcccaactctaaagtttgcacagtcttgtggtatgcaatttaaatttataagtcgtgaagcatttagactaaaaggaacacagtcgttttacgaaaaaattaaaaaagaatttggtgacttttatttaattcctgaaggcggaaccaatgatttggctgtaaaaggatgcgaagaaattttgacggaaacagaccgtaaatttaattacatatgtgcttccgtaggaacaggaggtaccttatcaggcttgattaataattcaaacacagcacaaaaagttttaggtttttcagctttaaaaggtgactttttaaaagaagatattagtaaatttgcaaaacaagataattggcaattaatgacagattaccattttggtggttatgctaaaataaacacagaattagtaacgtttattaatagctttaaaaagcaaaataatattgcattagatcctgtttacaccggaaaaatgatgtttggtatttacgatttaattaaacgtgattattttaagccaaattctgaaatattagtgattcatactggaggtttgcaaggtattgtaggtatgaataanagattaaaacaaaaacaacaacagttaattttataa

SEQ ID NO: 23752 - protein, 207 aa, Unknown
  Obtained from environmental sample
  misc_feature (1)..(207): Xaa is any amino acid
MDSPTLKFAQSCGMQFKFISREAFRLKGTQSFYEKIKKEFGDFYLIPEGGTNDLAVKGCEEILTETDRKFNYICASVGTGGTLSGLINNSNTAQKVLGFSALKGDFLKEDISKFAKQDNWQLMTDYHFGGYAKINTELVTFINSFKKQNNIALDPVYTGKMMFGIYDLIKRDYFKPNSEILVIHTGGLQGIVGMNXRLKQKQQQLIL

SEQ ID NO: 23753 - DNA, 978 bp, Unknown
  Obtained from environmental sample
  misc_feature (1)..(978): n is a, c, g, or t
atgtattgctcagtctttgagacttttattcaaagtgtgaccttaaacattcataaaatgttagacaagaaaacagataatttaaattcggaaaatcatacagaaaaatccacttcaaatcctgaaattgacaaatctgaattagccgatagtattgctgaaaataatcaattagaaaatcaaaaatcagaaaatttggtaggttccgatggagctgaacaggaacaagatagtataatagatgattctgaaaaaaaagcagtaattgttagtgctgatgatatcgaagaagttacagatgaagaagttagagttaaagaattgtccaataataaaacctcggatataggagaagttacgaatgtagatcatgaaagtgacaaagtagcaaaagatgaaatttcagatgaaataattgttagtaataaagaaaatacagaagagcatgtagttcacaaaattgactttgacagtttagatctggaacaattggttaaagaattacaaaaactattgaaacaagattcgataccgtccattaaaggaaaaatagaaaagatcaagcataattttaaccttaagtatggagaattattacaagaaaaaaaagaggtattcatagcagatggtggaaacgaaattgattttcattattctcatccgataaaatcagtttataacgacttactttttgaattcaaaacaaagcgccaacgttattataaacaaatagaggaagagcaaaaaggaaacttagagaaaaagttgttactcattgaagaattaaagcatttaattgacaatgccgagtcggcaacaatgtatcanaatttcaaaggaatacaggaaaaatggagtgtcattggtaatattccacggactaagtacaatgatacatggcgcacttatcatcaccatgttgagcgattttatgatttattgcaccctaataatgatttacgtgatttagacttcaaa

SEQ ID NO: 23754 - protein, 326 aa, Unknown
  Obtained from environmental sample
  misc_feature (1)..(326): Xaa is any amino acid
MYCSVFETFIQSVTLNIHKMLDKKTDNLNSENHTEKSTSNPEIDKSELADSIAENNQLENQKSENLVGSDGAEQEQDSIIDDSEKKAVIVSADDIEEVTDEEVRVKELSNNKTSDIGEVTNVDHESDKVAKDEISDEIIVSNKENTEEHVVHKIDFDSLDLEQLVKELQKLLKQDSIPSIKGKIEKIKHNFNLKYGELLQEKKEVFIADGGNEIDFHYSHPIKSVYNDLLFEFKTKRQRYYKQIEEEQKGNLEKKLLLIEELKHLIDNAESATMYXNFKGIQEKWSVIGNIPRTKYNDTWRTYHHHVERFYDLLHPNNDLRDLDFK

SEQ ID NO: 23755 - DNA, 333 bp, Unknown
  Obtained from environmental sample
  misc_feature (1)..(333): n is a, c, g, or t
gtgatccaaactgtcttactaaacatgaaagaaggttatgtatatattttaagtaattccaaaaggacagttttatataccggagtaaccagtgatttaatacaccgagtgaataatcacaaaatgggtgaaggctctttattcagtgaaaaatatcgaacgcattatcttatgtattatgaagcccaccaatctatataccaagcaataaaacgagaaaaacagattaagaagtggaacagggaatggaagctgaatttaattaaatcagtaaatcctaatatgaaagatttatggaaagaaattttacctgagggaaggttttacttttag

SEQ ID NO: 23756 - protein, 110 aa, Unknown
  Obtained from environmental sample
  DOMAIN (11)...(92): GIY-YIG catalytic domain
  misc_feature (1)..(110): Xaa is any amino acid
MIQTVLLNMKEGYVYILSNSKRTVLYTGVTSDLIHRVNNHKMGEGSLFSEKYRTHYLMYYEAHQSIYQAIKREKQIKKWNREWKLNLIKSVNPNMKDLWKEILPEGRFYF

SEQ ID NO: 23757 - DNA, 531 bp, Unknown
  Obtained from environmental sample
  misc_feature (1)..(531): n is a, c, g, or t
gtgagatttgaaataccttttgacagtaagatttataaaaagcaaatagagcttttatttaaaattgaatgggaagatattgcgaaagaaaatagaaaaactcttttatatggaataggatctttattattttctctatttattttatacaatgaaaagtatttaggttttgtattatttttttcaatttcactatattttttaatcaactattacatattttttaaactttacacaaaaactaaagatttaatttttaaaaatatggaagaaataattatagaaaataaagaaattgaaaataactctgtttggatatttgaaaatgactatttttttaattcttttgatggaattgaatcaaaatataattggaataagtttgatagatttgaaataattgaagatacgctgataacctattttagtaaatcatcagctcatggttttgtaatatcacttgaggaaatagataaagaaaaatttgatgaaataatttattttatcaaaacaaaattgaaaaaattatga

SEQ ID NO: 23758 - protein, 176 aa, Unknown
  Obtained from environmental sample
  misc_feature (1)..(176): Xaa is any amino acid
MRFEIPFDSKIYKKQIELLFKIEWEDIAKENRKTLLYGIGSLLFSLFILYNEKYLGFVLFFSISLYFLINYYIFFKLYTKTKDLIFKNMEEIIIENKEIENNSVWIFENDYFFNSFDGIESKYNWNKFDRFEIIEDTLITYFSKSSAHGFVISLEEIDKEKFDEIIYFIKTKLKKL

SEQ ID NO: 23759 - DNA, 510 bp, Unknown
  Obtained from environmental sample
  misc_feature (1)..(510): n is a, c, g, or t
ttgatcagatcggctcgagaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgaaacaggtggcgcaatttactatgaattagcaggaacaagaccagatttggttttaaaagatttgattaaaattacaaatcctgaagtattaccaaattatgagtttaccttttttgaaaaaatgaaataa

SEQ ID NO: 23760 - protein, 169 aa, Unknown
  Obtained from environmental sample
  misc_feature (1)..(169): Xaa is any amino acid
MIRSAREVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGETGGAIYYELAGTRPDLVLKDLIKITNPEVLPNYEFTFFEKMK

SEQ ID NO: 23761 - DNA, 717 bp, Unknown
  Obtained from environmental sample
  misc_feature (1)..(717): n is a, c, g, or t
ttggcagatttaaaaacttcagaacctattatcggaaaagaattatatggatatcaacaagatgctcttacagagatttttcaacgttttgattccactccacaagattatcacttgttatatcaactaccaactggtggtggaaaaacagttatattctctgaaatagtaagacgttatattcaaaagtttaataaaaaagtacttgttttaacacacagaattgaattaagtaaacaaacttctagaatgttgaaggagtttggtgtgaaaaataaaataattaattctactgcaaaattagacgatcaagatgattttaattgttttgtagccatggttgaaaccttgaaaaataggctaaatgatgataaacttgatatttctgatattggtttagtaattgttgatgaggctcattacaactcttttacaaaaatttttaaattctttcacgactcttttatattaggagttactgcaacacctttaagttctaacattaaattaccaatgtatgagaactaccaagagttgtttgtaggtgaatctattcaagatttaataaatagtaactatttagcanaagcaaatttatactcttacaatgttggattaacttcattagaagttggtgcaaatggagattatactgtaaaatcttctggagatttatatacaaattcagacatgctttctaaattagtttcggcttac

SEQ ID NO: 23762 - protein, 239 aa, Unknown
  Obtained from environmental sample
  DOMAIN (15)...(170): DEAD/DEAH box helicase
  misc_feature (1)..(239): Xaa is any amino acid
MADLKTSEPIIGKELYGYQQDALTEIFQRFDSTPQDYHLLYQLPTGGGKTVIFSEIVRRYIQKFNKKVLVLTHRIELSKQTSRMLKEFGVKNKIINSTAKLDDQDDFNCFVAMVETLKNRLNDDKLDISDIGLVIVDEAHYNSFTKIFKFFHDSFILGVTATPLSSNIKLPMYENYQELFVGESIQDLINSNYLAXANLYSYNVGLTSLEVGANGDYTVKSSGDLYTNSDMLSKLVSAY

SEQ ID NO: 23763 - DNA, 546 bp, Unknown
  Obtained from environmental sample
  misc_feature (1)..(546): n is a, c, g, or t
ttgggactggaaaaaattggttctgtattggtaaaaatactacacggtttgggttgtaaaatacttgtcaaagatgtcattgtggatgaaaatttaatcaattcttataacgtaagctataccaattgtgaaactatttgtaagcagtccgatatcataagcttgcacgtaccactaacgtcttcaacgaaacactttattgatgcaaaacatatttcattaatgaagcaaggcgtaatgcttatcaatacaagtcgtggaggattggtcgataccaaagctgttatcgaaggattgaaaactaaaaaaattgggtatttcggaatagatgtgtatgaggaagaagaaggattgttctttgaagaccattccgatgacattttgcaagacgatgtgattgcccgattaatgaccttcaacaatgttttgataaccagtcatcaggcctttttaaccgaaactgcattgacaaatattgctgaaaccacaatatataatctggattgttttgaaaaaggcaaagtttcaggaaacgaagtttcttga

SEQ ID NO: 23764 - protein, 181 aa, Unknown
  Obtained from environmental sample
  DOMAIN (1)...(147): D-isomer specific 2-hydroxyacid dehydrogenase, NAD binding domain
  misc_feature (1)..(181): Xaa is any amino acid
MGLEKIGSVLVKILHGLGCKILVKDVIVDENLINSYNVSYTNCETICKQSDIISLHVPLTSSTKHFIDAKHISLMKQGVMLINTSRGGLVDTKAVIEGLKTKKIGYFGIDVYEEEEGLFFEDHSDDILQDDVIARLMTFNNVLITSHQAFLTETALTNIAETTIYNLDCFEKGKVSGNEVS

SEQ ID NO: 23765 - DNA, 954 bp, Unknown
  Obtained from environmental sample
  misc_feature (1)..(954): n is a, c, g, or t
ttgatggccggtgagagggtcttttttaacccccgggtttatcctgtttcaattgtaaaagcattttggaaaaatataaaatcgaattccattaaacgaggaggcagtactttaacacaacaagttatacgactatctcgtaaaggaaaacaaagaacttattttgaaaaagctattgaaattatattggctacacgactggaggttagacatagcaagcaagaaatattagctttgtatagttctaatgctcctttcgggggaaatgttgttggattagatatagcttcttggcgttattttggcagaactccaatcgaactctcttgggcggaaagtgcaactttagcggtattacccaatgcgccaagtttgatatatccaggtaaaaatcagcaacgactatttagaaaacgaaatagattgctaaaaaagatgcttgacaataataagattgatgagtttacgtatcaattagctattcaagaactattacctcaaaaaccttttacattgcctcaaattgcaccacatttactgcaaagggtaagtaaaacatctcaaggtgaacgaataaaaaccagcattaaaattggcttgcaacaacgagcaaatgacattgtgaaaacccattataatagtttacaacaaaatcaaatatacaatatttcggtgttggttttagatgttaaatctagaaaagtattagcatatgttggtaattcaccaacagataaaacacaccaaanagatgttgatataattgacaaaccaagaagtacaggcagtattttaaagccatttttatatgcagggatgctggacgcgggcgaaattttaccccatactcttgtagcggatgtgcccaactcaattgcgaactataatcctaaaaactttgatttagatatgatggaggctgtccctgcagtatcgctttatcacgttctttaa

SEQ ID NO: 23766 - protein, 317 aa, Unknown
  Obtained from environmental sample
  DOMAIN (2)...(132): Transglycosylase
  misc_feature (1)..(317): Xaa is any amino acid
MMAGERVFFNPRVYPVSIVKAFWKNIKSNSIKRGGSTLTQQVIRLSRKGKQRTYFEKAIEIILATRLEVRHSKQEILALYSSNAPFGGNVVGLDIASWRYFGRTPIELSWAESATLAVLPNAPSLIYPGKNQQRLFRKRNRLLKKMLDNNKIDEFTYQLAIQELLPQKPFTLPQIAPHLLQRVSKTSQGERIKTSIKIGLQQRANDIVKTHYNSLQQNQIYNISVLVLDVKSRKVLAYVGNSPTDKTHQXDVDIIDKPRSTGSILKPFLYAGMLDAGEILPHTLVADVPNSIANYNPKNFDLDMMEAVPAVSLYHVL

SEQ ID NO: 23767 - DNA, 594 bp, Unknown
  Obtained from environmental sample
  misc_feature (1)..(594): n is a, c, g, or t
atgaattttaaggttgatgaatatattgctaaaaaagaaaattggagtaaagaattaaaacttttacgtactgtttttactgatttacctgtagaagaaaccataaaatggggagctccagtgtatgtttttcagggtaaaaatattgtaggattatcagcttttaaaaattattgtggtttatggttttttcaaggagctttattaaaagacaaaaaaaaggtttttacaaatgcgcaagaaggaaaaacaaaagcaatgttgcaatggagatttaatgctattgatgaaattaatacagcacaaattaaagaatatgttttagaagctatagaaaacgtaaaattaggaaaggaaattaaacctacaagaacttcaaaacctgtaaatattcctgaagaattacagcaagaattaaatacaaataaagaactatcaacaagttttaatacattttctttaagtaaacaaagagaatatgcaggttatattgctgaagccaaaagagcatcaacaaaaacaaaaagactcgaaaaaataatatccatgattattagtggagtaggattgcatgatcaatacaagaattgttaa

SEQ ID NO: 23768 - protein, 197 aa, Unknown
  Obtained from environmental sample
  misc_feature (1)..(197): Xaa is any amino acid
MNFKVDEYIAKKENWSKELKLLRTVFTDLPVEETIKWGAPVYVFQGKNIVGLSAFKNYCGLWFFQGALLKDKKKVFTNAQEGKTKAMLQWRFNAIDEINTAQIKEYVLEAIENVKLGKEIKPTRTSKPVNIPEELQQELNTNKELSTSFNTFSLSKQREYAGYIAEAKRASTKTKRLEKIISMIISGVGLHDQYKNC

SEQ ID NO: 23769 - DNA, 705 bp, Unknown
  Obtained from environmental sample
  misc_feature (1)..(705): n is a, c, g, or t
atgatgttaagtataattattcctgtttataatgaacaagaaaacctttctaagagattgtcgtttttatctgaacaagctaacaaatttcctatagaaattattgtttctaattcgccagaatcttcagacgatagtaatttgatttgtgaacattatagtaaagttactcattttgtggccaataaaaaaggaagagcatcgcaaatgaattttggagcatcaaaagcaaatggtgctatatttttatttttacatgcagatgtaattttaccaaacgacttttatcaacaaataattgtagttataaaaaaaggcaataaagcaggtttttttgcttataagtttgataaaaaatctgcattattaaactttaacagcaagtttaccacaaaagacggcttattttctggaggtggagatcaatgtcaattttttacaaaagagacttttactacgcttaatggttttaatgaagagttttgtattatggaagattttgaaatgatagacaaagtaagaaagcaaaaaattccttttaaaattatacaatctaaagctattgtaagtgctagaaaatacgataaaaactcctggttgaaagtaaatttaattaatggttatgtttttttacagtacaaatttggtgtgcacccaacaaagttgagaaaaacatacaaatcactattaagagaatgtgtataa

SEQ ID NO: 23770 - protein, 234 aa, Unknown
  Obtained from environmental sample
  DOMAIN (4)...(174): Glycosyl transferase
  misc_feature (1)..(234): Xaa is any amino acid
MMLSIIIPVYNEQENLSKRLSFLSEQANKFPIEIIVSNSPESSDDSNLICEHYSKVTHFVANKKGRASQMNFGASKANGAIFLFLHADVILPNDFYQQIIVVIKKGNKAGFFAYKFDKKSALLNFNSKFTTKDGLFSGGGDQCQFFTKETFTTLNGFNEEFCIMEDFEMIDKVRKQKIPFKIIQSKAIVSARKYDKNSWLKVNLINGYVFLQYKFGVHPTKLRKTYKSLLRECV

SEQ ID NO: 23771 - DNA, 564 bp, Unknown
  Obtained from environmental sample
  misc_feature (1)..(564): n is a, c, g, or t
ttggaaatagacaacaccaaaattgaatcacatattttaaaagcgaaagaaggcaatcaatcttcttttcgttttttgttgaatactttttggggtgatgtttataattatcagctaaaaaaaacaagaagtgaaaatgaagctgaagatattgccatccaaactttttctaaagcttttgataaaatacatacgtttgatgataattatgtttttaaaacatggttaattgccatttctaaaaatgtttatatcgatattttacgaaagaaaaaaacttccatttttacagaaaccaccaaagaacaagaagaaaaaatttatttggttgttgatgaaaatcccacaccagaagataaaattattggagaacaaaatttagcaaaattgttacgagatattaaacaattaanacctaaataccaagaagtaatacagttacgttattttcaagaattgagttacaaagaaatttctacacaaattaatgaacctatgaataacgtaaaagtaaaattattacgtgctaaaaagttgttggcagccattattaagaagggttaa

SEQ ID NO: 23772 - protein, 187 aa, Unknown
  Obtained from environmental sample
  DOMAIN (26)...(93): Sigma-70 region 2
  misc_feature (1)..(187): Xaa is any amino acid
MEIDNTKIESHILKAKEGNQSSFRFLLNTFWGDVYNYQLKKTRSENEAEDIAIQTFSKAFDKIHTFDDNYVFKTWLIAISKNVYIDILRKKKTSIFTETTKEQEEKIYLVVDENPTPEDKIIGEQNLAKLLRDIKQLXPKYQEVIQLRYFQELSYKEISTQINEPMNNVKVKLLRAKKLLAAIIKKG

SEQ ID NO: 23773 - DNA, 510 bp, Unknown
  Obtained from environmental sample
  misc_feature (1)..(510): n is a, c, g, or t
atgcgaataatctcaggagaatttaaaggaagaagaataactgcaccaaaaaaattacctgtgcgtcctacgacagatatggctaaggaagcactatttaatattttaaataatttatattatttagatgatatttcggtattagatttatttgcaggcacaggaaatataagttatgaatttgcatcgcgtggtaccgaaaatattttagctgtagatcaagattttggatgtattaagtttattaatcaaacttcggagactttcgaaatgccgattaaaaccattaaagctgatgtgtttaaatttttagaaaacacaaaacaaaaagcaaatgttatttttgccgatcctccttacgattttccagtagaagaatttgttaaaatcccaacacttgttttcgaaaacaatttgttagaaactggcggtattttaattgtagaacattctaaacacacaccattatccccattacacaatttagttactctaaaaatatgggggtaa

SEQ ID NO: 23774 - protein, 169 aa, Unknown
  Obtained from environmental sample
  DOMAIN (1)...(169): Conserved hypothetical protein 95
  misc_feature (1)..(169): Xaa is any amino acid
MRIISGEFKGRRITAPKKLPVRPTTDMAKEALFNILNNLYYLDDISVLDLFAGTGNISYEFASRGTENILAVDQDFGCIKFINQTSETFEMPIKTIKADVFKFLENTKQKANVIFADPPYDFPVEEFVKIPTLVFENNLLETGGILIVEHSKHTPLSPLHNLVTLKIWG

SEQ ID NO: 23775 - DNA, 363 bp, Unknown
  Obtained from environmental sample
  misc_feature (1)..(363): n is a, c, g, or t
atgtgggggttttggctaaatgattataggggggggccgaaacggggaaaaagattcgcccttaaattttttgaattggagggtgcttcaaataactctgtgggaggtttttggaaagtttacctgatccagtacgtatttccgcccaagttgggaaaatccaaaagtttttttttggatgaggtccatttgttatttcaagccgcctttaattgctttttaaagactttagaagaaccacctaaacattgtgtatttattctagccactaccgaaaaacacaaaattataccaaccattttatcacgatgtcagatttttgatttcaaacgtattacggtaaagatgctaaatcgtatttaa

SEQ ID NO: 23776 - protein, 120 aa, Unknown
  Obtained from environmental sample
  misc_feature (1)..(120): Xaa is any amino acid
MWGFWLNDYRGGPKRGKRFALKFFELEGASNNSVGGFWKVYLIQYVFPPKLGKSKSFFLDEVHLLFQAAFNCFLKTLEEPPKHCVFILATTEKHKIIPTILSRCQIFDFKRITVKMLNRI

SEQ ID NO: 23777 - DNA, 780 bp, Unknown
  Obtained from environmental sample
  misc_feature (1)..(780): n is a, c, g, or t
atgccttaccttaaagcggttttaaaagaattgtctttatacaaaactcttttaggtgaaaaacctattataaaacaaattcatttaggtggaggaacaccaacatttttcacccctgaaaatctaaattttttaataactggtatttttaaaattgcaaaaaaagcagaacattacgattttagttttgaaggtcaccccaacaacacaacaaagacgcatttaaaaacactagccgaaaatggctttacacggatatgttatggtgttcaagattataacgatacggtacaaagagcaattaatcgtattcagcctttcgagaatgtgctcaatgccacacaaaacgctagagatgctggttacacttctgtgggtcacgatattatttacggcttaccgtttcaaacagaagctcacgtaattaatactatagaaaaaacgattgcacttaaacccaatcgtattgctttttacagctatgcacacgtgccgtggataaaaggaaatggccaacgtggctataaggaagaaaacttaccgaatgccgaattaaagcgtctgcaatacgaaactggaaaacaactattattagatgcgggttatgtggagattggaatggatcattttgccttaaaaagcgatagtttatacaaggctgttgaagaacaaaccctccaccgtaattttatggggtatagcgatagcaaaactcaggttatgattggtttaggcgtgtcagccattagtgatagctggtacggattgcacaaaacgtaa

SEQ ID NO: 23778 - protein, 259 aa, Unknown
  Obtained from environmental sample
  misc_feature (1)..(259): Xaa is any amino acid
MPYLKAVLKELSLYKTLLGEKPIIKQIHLGGGTPTFFTPENLNFLITGIFKIAKKAEHYDFSFEGHPNNTTKTHLKTLAENGFTRICYGVQDYNDTVQRAINRIQPFENVLNATQNARDAGYTSVGHDIIYGLPFQTEAHVINTIEKTIALKPNRIAFYSYAHVPWIKGNGQRGYKEENLPNAELKRLQYETGKQLLLDAGYVEIGMDHFALKSDSLYKAVEEQTLHRNFMGYSDSKTQVMIGLGVSAISDSWYGLHKT

SEQ ID NO: 23779 - DNA, 819 bp, Unknown
  Obtained from environmental sample
  misc_feature (1)..(819): n is a, c, g, or t
ttgcgagttttacgagtattatctaataaaattcaaattcccctaaagactaggatatttaaaactatgactactgataaatcctctaaggatagagatgaacttagtgaaggacaagatactgatatagttgctatggaagaaactatcactagcttgaaaattaggaataatagtttaactattgcaatcgagaaagtccttagtgtacctactaattttaatattgctgagagtatgttacaacatagcaaatgctcagttttagagaaagaaaataatattatttttttagctaatatcgaacaaaaaactatttcgtattgtaagaaaaacttcaatttcaagttcggtttagacgattttaaaaattaccccttatctaatgaacacgtagatgagtgcagagctactggagaaattgagcttaactatcgacgacatcgttatatagaaaacgctttatccaaattgttttcagattttattaataatcctgaaaactatgtaccttttagagccaaaacctctttatttcaagagtcagagatagacaggctgaactctaatgtagagtctatagttgaagtatatttgtataagaccatttcaattctggcttatcgtttaaatgcttatgatatagcgctgatgtatcatgattttgcaatgactacctacagtggaggtattattgaagtttcctacgatagtggaaaatactttaaaagtgtaatatcagcaaagaataccaaaaacatcaacaaacgatgggacgaaaacaatcagaatagaccagatagaaagaagaaatactga

SEQ ID NO: 23780 - protein, 272 aa, Unknown
  Obtained from environmental sample
  misc_feature (1)..(272): Xaa is any amino acid
MRVLRVLSNKIQIPLKTRIFKTMTTDKSSKDRDELSEGQDTDIVAMEETITSLKIRNNSLTIAIEKVLSVPTNFNIAESMLQHSKCSVLEKENNIIFLANIEQKTISYCKKNFNFKFGLDDFKNYPLSNEHVDECRATGEIELNYRRHRYIENALSKLFSDFINNPENYVPFRAKTSLFQESEIDRLNSNVESIVEVYLYKTISILAYRLNAYDIALMYHDFAMTTYSGGIIEVSYDSGKYFKSVISAKNTKNINKRWDENNQNRPDRKKKY

SEQ ID NO: 23781 - DNA, 699 bp, Unknown
  Obtained from environmental sample
  misc_feature (1)..(699): n is a, c, g, or t
ttgacttacgaagatgcggttttccatcgatggaccgaaatatttctccccaaatacggatggacaccctttgatgcttccagaggcagtggatctatcaagcgttttgacaattattttaactacattgcccgcattccttccggtaccctccagacttaccggggagatggcggaaagggaagtcatatcaattgggactacgtagcctatgccaaaggggaaaaagaaaactccatccgggatatttcggttttttattatttaaatacaccccccaaacgattacgtccggaactgaaaaacgtcacttcagctttaaagaccagtctcaccggaaaaaatctggcttccattacctccgatcctttaaagcgggaaattctcttctcccaaagaaatttctggggaaaagagatgattccccttctaatccctgctctgattaaagcgaaacatccttcggctgtttattattcgatccttgcgatacacaaaaaaattgatatccccaatttcattagatttccttttttatgtgatcaatacctccaggatcaaatactcgccgcactggataaggacagctggaactggcaaaaatttgaatactggtggcggaaggctcggaaggatatctcctacgattccgaaaccaaaaaattcgttttgcataacaaaaatataaatatctattaa

SEQ ID NO: 23782 - protein, 232 aa, Unknown
  Obtained from environmental sample
  misc_feature (1)..(232): Xaa is any amino acid
MTYEDAVFHRWTEIFLPKYGWTPFDASRGSGSIKRFDNYFNYIARIPSGTLQTYRGDGGKGSHINWDYVAYAKGEKENSIRDISVFYYLNTPPKRLRPELKNVTSALKTSLTGKNLASITSDPLKREILFSQRNFWGKEMIPLLIPALIKAKHPSAVYYSILAIHKKIDIPNFIRFPFLCDQYLQDQILAALDKDSWNWQKFEYWWRKARKDISYDSETKKFVLHNKNINIY

SEQ ID NO: 23783 - DNA, 621 bp, Unknown
  Obtained from environmental sample
  misc_feature (1)..(621): n is a, c, g, or t
gtgcctactattattctgactaattttgctgttcataattatgtagaatcggaaactgtattaaaaggagaatttggtaagcgcgtacttcatttggctaatttaagacctcaaaaggatcacattaccttgttaaaagcatttaaacttgttttgaaagagtttcctgattggacattacatttggtggggaaagattttaatgattcctattctacttccattaagagtaaaataaaggaattaaaattggaccaatctgtttttatttatggtagtcgaaatgatacggattccattctcgaacaatgtaatatgggcgtgctgtcttctgtgtcagaagggttacccctagcgatattagaatatggtttatacggtttacctgttgttgctactaaagtaggagattgtgagcgtgttataaaaaataaagacacaggcattttagtgccttcagaaaatgagcatactttagctgaagcaattgttttaatgataaagaatgaagcgctacgattaaattattctaaacggttacaagatcatattaaaacacagttctcagcagaatcagtgattacacaattgttgtccatttataaacgtactttgtcttaa

SEQ ID NO: 23784 - protein, 206 aa, Unknown
  Obtained from environmental sample
  DOMAIN (13)...(183): Glycosyl transferases group 1
  misc_feature (1)..(206): Xaa is any amino acid
MPTIILTNFAVHNYVESETVLKGEFGKRVLHLANLRPQKDHITLLKAFKLVLKEFPDWTLHLVGKDFNDSYSTSIKSKIKELKLDQSVFIYGSRNDTDSILEQCNMGVLSSVSEGLPLAILEYGLYGLPVVATKVGDCERVIKNKDTGILVPSENEHTLAEAIVLMIKNEALRLNYSKRLQDHIKTQFSAESVITQLLSIYKRTLS

SEQ ID NO: 23785 - DNA, 744 bp, Unknown
  Obtained from environmental sample
  misc_feature (1)..(744): n is a, c, g, or t
ttgttggaaaatgataatggaatatttaaaataaaacccaataaagatttagaggagattggaatggtcactgatgcgatctgggaggattttgatcaagatggtattaaagacttaatcgttgttggtgagtggatgcctcctgtcttccttaaaaaccaaaaaggcaatcttaccaaatcaaataatagcgaatctgacctgaatggtctttggcaaagcatcataccttttgatattgatgctgacggagatacagattatcttttgggcaattgggggactaactccaaattcattgcatccaaagaatttccaatgaaaatgtactatggcgattttgacaataacggacaaacggaaacaatcaccactaccgctaagaaaggaaagtattatcctttagagggattgaatgaattgggtgggcaaatggtgagtcttcgtaaaaaatataatagctataaagcatttggcggaaagaccatagaagaggtattggatggttacaccatatcaaaaaaccagataagaatcgttcataatttgaaatcagggtatttaaagaatgataacgggtattttgagttcattccttttgataatacgttacaagtatcgcctatcttagcattcctcaaattcgattttaactcagacggtaaagaagaagtactagcaggagggaactattttggggtcaaaccatttatgggtagaatggatccctcgagccgaatctga

SEQ ID NO: 23786 - protein, 247 aa, Unknown
  Obtained from environmental sample
  misc_feature (1)..(247): Xaa is any amino acid
MLENDNGIFKIKPNKDLEEIGMVTDAIWEDFDQDGIKDLIVVGEWMPPVFLKNQKGNLTKSNNSESDLNGLWQSIIPFDIDADGDTDYLLGNWGTNSKFIASKEFPMKMYYGDFDNNGQTETITTTAKKGKYYPLEGLNELGGQMVSLRKKYNSYKAFGGKTIEEVLDGYTISKNQIRIVHNLKSGYLKNDNGYFEFIPFDNTLQVSPILAFLKFDFNSDGKEEVLAGGNYFGVKPFMGRMDPSSRI

SEQ ID NO: 23787 - DNA, 474 bp, Unknown
  Obtained from environmental sample
  misc_feature (1)..(474): n is a, c, g, or t
ttgaaatatagcatctgttttatgaaaaaaataatagtatttattgttgtgagcatgtttgtcttttcgtgtaaagaaaaaaaagaaaacacgatgtgggtacaaggtgaaattaaaaatcttaaaaaaggtgtcgtttacttgcaaaagatgaaagataccgtgcttatttccgtagattcaatttctttagatggtgtaaatacatataccttattcgatgaagtcgatagccctgaaatttactatctttccttagacggatcacctaataagaggatctcctttttcggagaaaaaggcacgattactattgacactaaactcgataaatttgtttttggagcttcagttaagggtctggcaaatcaacaattgcttgaccagtatactgaaatgaaaaataagtttagtggcaagcgcctagatttgatcaagtcagattttgatgccaaaaaatcgaagattctttag

SEQ ID NO: 23788 - protein, 157 aa, Unknown
  Obtained from environmental sample
  misc_feature (1)..(157): Xaa is any amino acid
MKYSICFMKKIIVFIVVSMFVFSCKEKKENTMWVQGEIKNLKKGVVYLQKMKDTVLISVDSISLDGVNTYTLFDEVDSPEIYYLSLDGSPNKRISFFGEKGTITIDTKLDKFVFGASVKGLANQQLLDQYTEMKNKFSGKRLDLIKSDFDAKKSKIL

SEQ ID NO: 23789 - DNA, 522 bp, Unknown
  Obtained from environmental sample
  misc_feature (1)..(522): n is a, c, g, or t
atgaataaaatacttgaaacagaaagattgatcttacgggaatttgaagtaaccgatgccagaaaaatgtgggaattgaatgctgaccctgatgttcttaagtatactggcgacaaatcatttgaatcaattcatcgggcaaaaatatttttagaaaattatagtgattataaaaggaatggttatggactatgggcggttatactaaaagaatgcaatgaatttattgggtggtgtggtttgaaattgaacgaagagaatttcactgacatagggtttagattttataaaaaaaactggaataatggatttgcaactgaatcttccaaatctgttttggcatacggattcaacaaacttgggcttgacgaaataataggtcgttcagcaattcaaaacaaagcttccatatatgttttgaaaaaattaaacatggattattggaaaaatgatacttgtgagggaattgaaaactcggtttattacagaataaataaaaagcaattcatcatcggtttataa

SEQ ID NO: 23790 - protein, 173 aa, Unknown
  Obtained from environmental sample
  misc_feature (1)..(173): Xaa is any amino acid
MNKILETERLILREFEVTDARKMWELNADPDVLKYTGDKSFESIHRAKIFLENYSDYKRNGYGLWAVILKECNEFIGWCGLKLNEENFTDIGFRFYKKNWNNGFATESSKSVLAYGFNKLGLDEIIGRSAIQNKASIYVLKKLNMDYWKNDTCEGIENSVYYRINKKQFIIGL

SEQ ID NO: 23791 - DNA, 894 bp, Unknown
  Obtained from environmental sample
  misc_feature (1)..(894): n is a, c, g, or t
ttggggaaattagacaaaccaaaagtagattatattaaaggtattgctcctgcaattgctattgagcaaaaagtaaattctacaaatccaagatctacagtgggtacatccacagaaatttacgattatataaaattattatatgccaggattggaaagacctactctcctatttctggaaatgaagtaaaaaaagatacagtttctgatgtggtaaaatttgttcagaaatttgaagaaagaacaaaacttttattatttgctcctgttactattgatgaaaaccgagaacttaaaacagttttacaagttttagaacaacaaggctatgcaaggttaaaatggaatgaccaagtatatagaattgcagaatttccaaaaaaggattataaaaacgaacctttatatttagtggtagatcgagttgtaaccaaagatgatgaagatttttacaacagattagcagatgctgtgcaaactgctttttttgaaggaaaaggtatttgttttatcgaaaatttggcagataataaggtgactgaatttagtaataagttcgatttagatgggatgacatttttagaaccgaacacacatttgtttagttttaataatccttatggagcttgcccaacatgtgagggttatggaaatgttatcggaattgatgaagatttagtaattccaaatacgggtttgtctatttttgatgatgctatttttcctttcagaactccatcttatattcattataaagaagaattaatttcagtagcttataattttgatgtccctgtacacaaaccttggtttcaacttacggatgcacaaaaaaaattatttgaaatggaaacaaaaaatttaatggaattaatcacttttttgcagctttag

SEQ ID NO: 23792 - protein, 297 aa, Unknown
  Obtained from environmental sample
  misc_feature (1)..(297): Xaa is any amino acid
MGKLDKPKVDYIKGIAPAIAIEQKVNSTNPRSTVGTSTEIYDYIKLLYARIGKTYSPISGNEVKKDTVSDVVKFVQKFEERTKLLLFAPVTIDENRELKTVLQVLEQQGYARLKWNDQVYRIAEFPKKDYKNEPLYLVVDRVVTKDDEDFYNRLADAVQTAFFEGKGICFIENLADNKVTEFSNKFDLDGMTFLEPNTHLFSFNNPYGACPTCEGYGNVIGIDEDLVIPNTGLSIFDDAIFPFRTPSYIHYKEELISVAYNFDVPVHKPWFQLTDAQKKLFEMETKNLMELITFLQL

SEQ ID NO: 23793 - DNA, 567 bp, Unknown
  Obtained from environmental sample
  misc_feature (1)..(567): n is a, c, g, or t
atggcagacgtacatttggaatgtgatgtttgtaatggaaaacgtttcaaaaaagaagttttagaagtaaagtttgatggaaaatcaatcgatgatattttaaacctaactatagatgatgctgtagcttttttctctgaaaatttagtgactaaaatcgctaaaaaactaaaaccattgcaagatgttggtttgggttatgttactttggggcaatcttcttccacactttctggtggagaagctcaacgtataaaactcgcatcttttttagtaaaaggaaccacaaaagacaaagccttatttatttttgatgaacccacaactggtttacattttcacgatattcaaaaattactaaaatcttttaatgaattaatcaaaaaaggtcattccattattgttattgagcataatattgaactcattaaatgtgcagattatattatcgatttaggtttagaaggtggtaaaaatggtggaaaccttatttttcaaggaactccagaagaattagctaaaaataaagaatcttatacagctaaatatttggctgagaaattatag

SEQ ID NO: 23794 - protein, 188 aa, Unknown
  Obtained from environmental sample
  DOMAIN (13)...(153): ABC transporter
  misc_feature (1)..(188): Xaa is any amino acid
MADVHLECDVCNGKRFKKEVLEVKFDGKSIDDILNLTIDDAVAFFSENLVTKIAKKLKPLQDVGLGYVTLGQSSSTLSGGEAQRIKLASFLVKGTTKDKALFIFDEPTTGLHFHDIQKLLKSFNELIKKGHSIIVIEHNIELIKCADYIIDLGLEGGKNGGNLIFQGTPEELAKNKESYTAKYLAEKL

SEQ ID NO: 23795 - DNA, 972 bp, Unknown
  Obtained from environmental sample
  misc_feature (1)..(972): n is a, c, g, or t
atggattttgctgcaattccaccttttcatatggaggatggatttgtgggggcaattcaatacagagaatcttcattatttttagacgaaaatgccacacaaacacaaaaattaagcagagcaaagttaattgcacacgaaacttctcacatgtggtttggagatttggtaactatgaaatggtttaatgatgtttggatgaaggaagtttttgccaattttatggcagataaaattgtgaatcctgtatacccagaaattaatcataggttgagttttatgatggcacattacccaagtgcgtattcagaagacaggacaaaaggcacgaatccaattcgtcaaaaattagataatttaaaagatgcaggttctttatatggtagaattatctataacaaagcacctattatgatgcgtcagttggaatacttattaggagaagaagcgtttcaaaaagggattcaagaatatattaaaacctatcaaaattcaaatgcagattggacagagttagtttcaatattagataaaaattcatcagaggatattaaaaaatggtcggaagtttgggtaaattcatctggaagaccaatttttacccaagaaattaagtatgatgaaaaaggaaatgttatgaagtttatccttcatcaaaaagcagaagatggttcagataaaatttggacacaatcttttaatattcaattgatagataaaaaaggaaactcaaaggaagttgaaattaaaaatatgggcaagacttttgatgttttaccttttgtaaaagattttaaaccagttcaagttttatacaatacaaacggatttggttatggtgtttttcctatcgataataataaaattgatgcgtataaaaatagtaaagatgaagtttcaagaggatatccatttatcaatttgtatgaaaatatgttaaattggaaaaattacaccttcagaaacctataa

SEQ ID NO: 23796 - protein, 323 aa, Unknown
  Obtained from environmental sample
  misc_feature (1)..(323): Xaa is any amino acid
MDFAAIPPFHMEDGFVGAIQYRESSLFLDENATQTQKLSRAKLIAHETSHMWFGDLVTMKWFNDVWMKEVFANFMADKIVNPVYPEINHRLSFMMAHYPSAYSEDRTKGTNPIRQKLDNLKDAGSLYGRIIYNKAPIMMRQLEYLLGEEAFQKGIQEYIKTYQNSNADWTELVSILDKNSSEDIKKWSEVWVNSSGRPIFTQEIKYDEKGNVMKFILHQKAEDGSDKIWTQSFNIQLIDKKGNSKEVEIKNMGKTFDVLPFVKDFKPVQVLYNTNGFGYGVFPIDNNKIDAYKNSKDEVSRGYPFINLYENMLNWKNYTFRNL

SEQ ID NO: 23797 - DNA, 447 bp, Unknown
  Obtained from environmental sample
  misc_feature (1)..(447): n is a, c, g, or t
atgaatgtagctgaagtaaaatcatcagaaataaagaatttagacattcttgctaaacaagtggtagaaggttttattacagggattcataaaagtccctttcacggattttcggtagagttttctgaacataaactttacaacaaaggcgaaagtacgagacatatagattggaagctatttgcaaaaacagaaaaactttacacaaaaaagtacgaagaagaaaccaatttacgctgtcacattattattgataattctgcttcaatgaattatccaatattaaaaacgcaatctatagataacttaaacaaagttggtttttcagcaattgcagcagcttctttaatggaaatcttaaaaagacaaagagatgctgtgggtttaagtatttattcagattcatacgaatattatgcaccagaaaagggctcgagccgattctga

SEQ ID NO: 23798 - protein, 148 aa, Unknown
  Obtained from environmental sample
  misc_feature (1)..(148): Xaa is any amino acid
MNVAEVKSSEIKNLDILAKQVVEGFITGIHKSPFHGFSVEFSEHKLYNKGESTRHIDWKLFAKTEKLYTKKYEEETNLRCHIIIDNSASMNYPILKTQSIDNLNKVGFSAIAAASLMEILKRQRDAVGLSIYSDSYEYYAPEKGSSRF

SEQ ID NO: 23799 - DNA, 624 bp, Unknown
  Obtained from environmental sample
  misc_feature (1)..(624): n is a, c, g, or t
atgaagattttcctcaaacataaaaaaacgcttttaattttattacatcgtaggcttttattcattggtaatgggaatctttatcaaattgggacagaaggtaagaaaataaaaaatcttttcttaacgaaaacgattatactctttagcgatgaaattgtaaattataagcatcntaagcaanaagaaattttagaggaacacagggcaagaatttcaaacccagatcaattagaacgttttaaatggttattgccttcgctttcttcggatgaaaatgtgagagatcgttttatgacatcgcttttacaaaaagaaaaccgagaaaaagagtcttgggtgcaaacagctttaaataatatgcatcatcctttaaggcaagattcatctgtaaaacatttaaaatctattttatcagcattagaagaggtgcaattaacgggagatattttctttccaaaaggatggttagcaagttctattggtcattattcatctgaagaagccaatcttattttagaagaatttttagctgaaaatcctacctataatcctgttttattaaagaaattacatcaaaccacagacgatttattaagagcgcaaaaaattaagaaacaatga

SEQ ID NO: 23800 - protein, 207 aa, Unknown
  Obtained from environmental sample
  misc_feature (1)..(207): Xaa is any amino acid
MKIFLKHKKTLLILLHRRLLFIGNGNLYQIGTEGKKIKNLFLTKTIILFSDEIVNYKHXKQXEILEEHRARISNPDQLERFKWLLPSLSSDENVRDRFMTSLLQKENREKESWVQTALNNMHHPLRQDSSVKHLKSILSALEEVQLTGDIFFPKGWLASSIGHYSSEEANLILEEFLAENPTYNPVLLKKLHQTTDDLLRAQKIKKQ

SEQ ID NO: 23801 - DNA, 441 bp, Unknown
  Obtained from environmental sample
  misc_feature (1)..(441): n is a, c, g, or t
ttgaagtattatgaagataccaatgaatttgaaaaggttaaggagttatttaaaacatcagatttctttaaaacccttattgaaaatagtatgatgtctttgtctaaatccttctttgatttaacaaggtacatggcagaagatgctgagtatggtgaattttggaaagtaatttacaatgagtacgaaactacgaagcgattaatattaaaattaactggttataaagaattgatgcaagaagagccagcaggtagagcatctattgcggttagagaatctatagtgctaccattgttgactattcagcaatatgcgttaaagaaaattcaagagcttgaaaaggcagatgtgaaagatgaagagttaataaaagtttttgaaaaaatggtaaccagatcgttatttggtaatattaatgcgagtcgtaattcggcataa

SEQ ID NO: 23802 - protein, 146 aa, Unknown
  Obtained from environmental sample
  misc_feature (1)..(146): Xaa is any amino acid
MKYYEDTNEFEKVKELFKTSDFFKTLIENSMMSLSKSFFDLTRYMAEDAEYGEFWKVIYNEYETTKRLILKLTGYKELMQEEPAGRASIAVRESIVLPLLTIQQYALKKIQELEKADVKDEELIKVFEKMVTRSLFGNINASRNSA

SEQ ID NO: 23803 - DNA, 366 bp, Unknown
  Obtained from environmental sample
  misc_feature (1)..(366): n is a, c, g, or t
atgtatggtcgtaaaatttacgaattcgctttaaccaacgtgcctttagctttaaaatcatgtttagaaaaaagtggctacaacataaatgatgttaaaaaaatattgatacatcaagctaacgaaaaaatggacgaagctatcgtaaaacgtttttacaagctacacgacatgaaaatgccagaaggcattatgccaatgagtattaatactttaggtaattctagcgtagcaactgtacctactttatacgatttaattttaaaaggtaaactaaaagaccaagagattaataaaggtgatgttatactttttgctagtgttggtgctggtatgaatattaatgctatagtttacaaacaataa

SEQ ID NO: 23804 - protein, 121 aa, Unknown
  Obtained from environmental sample
  misc_feature (1)..(121): Xaa is any amino acid
MYGRKIYEFALTNVPLALKSCLEKSGYNINDVKKILIHQANEKMDEAIVKRFYKLHDMKMPEGIMPMSINTLGNSSVATVPTLYDLILKGKLKDQEINKGDVILFASVGAGMNINAIVYKQ

SEQ ID NO: 23805 - DNA, 507 bp, Unknown
  Obtained from environmental sample
  misc_feature (1)..(507): n is a, c, g, or t
gtgtacgaacaaacttttccgcataaacgctttaaactaacgtatcaatttttagaaaaacatatttctaaatctgaaacaattttagacttaggagtagaaaacccatttactaaaatattaaaagacaatagttacaatgttgaaaacactaaaggcgaagatttagactttgatgtttcaagtatcaaaaactctcaagccacagtcgttacagcttttgaaatttttgaacatttattaaacccctttactgttttacaaagtataaaagcggacaaattagtaattagcgtaccccttaaattatggttttcttcggcttaccgaagcaaaacagatccttgggataggcattatcaccagtttgaagattggccattagattggttattaaaaaaaacaggttggaaaattattgacagaccaaaatggactaatccccccaaaaaaattggaatcgaaccaattttaaaatggtttacccctaaatatttaattatttaa

SEQ ID NO: 23806 - protein, 168 aa, Unknown
  Obtained from environmental sample
  misc_feature (1)..(168): Xaa is any amino acid
MYEQTFPHKRFKLTYQFLEKHISKSETILDLGVENPFTKILKDNSYNVENTKGEDLDFDVSSIKNSQATVVTAFEIFEHLLNPFTVLQSIKADKLVISVPLKLWFSSAYRSKTDPWDRHYHQFEDWPLDWLLKKTGWKIIDRPKWTNPPKKIGIEPILKWFTPKYLII

SEQ ID NO: 23807 - DNA, 828 bp, Unknown
  Obtained from environmental sample
  misc_feature (1)..(828): n is a, c, g, or t
ttgaatttattacctagttttattcgtccatttcccgacacctttcaatacgagttaaaaatattaaaaacaggtttacgtaattttttagaaaacaccgttttaataaatcctcgagaagaccaatgggttgtagatggtatccaaacgtatctacttataaaatatatagacacctattatcctgaaattaaacttactggaactttaggtaatatttggggtctgaaagcattttatgcagccgatttaaaatttaacgatcaatataacttaggttatattcatatggcgagaacccatttagatcagccactaagtatggctaaagattcgttacttaagtttaacgaaaacatagccaataaatataaagcaggtgctggtttgcgttatttagacgattacaccaatagtacacttagcgaagaggctattaaacaatttttaaaagacaaagctttaaaacctacgcaagcagaagactttattagctacttaaaagcgaatacagataagaatatcgattggttttataacgattatgtaaagaccagcgaaaaaatagatttcaaaattagtcgtgttaaaaaagtaggcgattcgttacgcgtaacgttgcataaccgtaccaataacgaaatgccggtgtctttatacactattaaaaacgactcggtaattgctcaacaatggatttcgggttttagaaacacaaaaaccataactatcgcaaatgcagatgccgatcgtttagcaataaattacaataaaataatacccgaagttaatacccgaaacaactggaaagccgttaataaatcctaa

SEQ ID NO: 23808 - protein, 275 aa, Unknown
  Obtained from environmental sample
  misc_feature (1)..(275): Xaa is any amino acid
MNLLPSFIRPFPDTFQYELKILKTGLRNFLENTVLINPREDQWVVDGIQTYLLIKYIDTYYPEIKLTGTLGNIWGLKAFYAADLKFNDQYNLGYIHMARTHLDQPLSMAKDSLLKFNENIANKYKAGAGLRYLDDYTNSTLSEEAIKQFLKDKALKPTQAEDFISYLKANTDKNIDWFYNDYVKTSEKIDFKISRVKKVGDSLRVTLHNRTNNEMPVSLYTIKNDSVIAQQWISGFRNTKTITIANADADRLAINYNKIIPEVNTRNNWKAVNKS

SEQ ID NO: 23809 - DNA, 852 bp, Unknown
  Obtained from environmental sample
  misc_feature (1)..(852): n is a, c, g, or t
gtgggcttaattttcgtatttatgaaaactaagaaaatgtcccttttgatagccattcttctttctgtggtttcctttgcccaaattcccgacgctacaaaaattgatgaaagcgttgattcattaagatcaactgaacgaacaagttttatcaaaaaaataagtaattcaaccgacactataattccggtccaatccatagattcggtcagcatcataaaactaaatgatactatcaatgtaattatgcggtttgattcccagggaatcttaaaagctgttgattcagtacgaatacctactaaagcagatttactcaaaataaaaatggattctttattaagacctttttatactattcaatttgattcggtaaaaaataaagatctctatacacctcgttttaggatggttctcaatcaacttacaaacgacacaacctatgtgcctgttcctaaaataaatgaatttttgacaatacaaccaaagttgctcattgatactttgaaaattataaatcctatcaggcaagtgcacattgatacaacaaaatttgctgaagacccaatatggtggaataataagaatagctttggtttagatatcagcgaagcggcatttgtaaattggaattccggtggtaataactctgtttcaggattggtgaaggttttcatggtcagatcttataaaaaacttcatttattatggcataatgaaatttttgcccgttatggaatgaatcaacaagaagagcagggcttaagaaaactgatgataagctccagatcaattctacttttgcctatcgaaaagaccccatttccaactggttataattcggaaaactta

SEQ ID NO: 23810 - protein, 284 aa, Unknown
  Obtained from environmental sample
  misc_feature (1)..(284): Xaa is any amino acid
MGLIFVFMKTKKMSLLIAILLSVVSFAQIPDATKIDESVDSLRSTERTSFIKKISNSTDTIIPVQSIDSVSIIKLNDTINVIMRFDSQGILKAVDSVRIPTKADLLKIKMDSLLRPFYTIQFDSVKNKDLYTPRFRMVLNQLTNDTTYVPVPKINEFLTIQPKLLIDTLKIINPIRQVHIDTTKFAEDPIWWNNKNSFGLDISEAAFVNWNSGGNNSVSGLVKVFMVRSYKKLHLLWHNEIFARYGMNQQEEQGLRKLMISSRSILLLPIEKTPFPTGYNSENL

SEQ ID NO: 23811 - DNA, 975 bp, Unknown
  Obtained from environmental sample
  misc_feature (1)..(975): n is a, c, g, or t
ttgtgcatacccgctttaactcatagtttagaggtatctgttgttggccgttccttaggtaggattgttggaaaacaactattggataaatatccggaattacaacaattaggatatcaggcaaatgattttggagctattgtggccagtgcttgtttggcacatgatattggcaatccaccttttggccatagtggggaaaaggcaatcggcgaatattttaaatcaggtaacggcgtaaaatataaaaaagaactaaccgataaacaatggcaagaccttatagattttgaagggaatgctaacggatttaagatcttaacagaaaacagagaaggtattgaaggaggtttaagattatcttatgccaccttaggcgcttttataaaataccccaaggaatcacttcccaaaaagccgacgaataatattattgataaaaagtacggattttttcaatctgaaaaagaggtttttatagatgtggttaatgatcttggcttaaagaatgtaagaaaaaaagatattacgtatgtccgccatccgttagcttttttagtagaagcagctgatgatatttgctatacaattattgattttgaagatggcatcaatcttggattaattgaagaggaattcgcgctagaatatttaataaatttggttagggatactattaatacagaaaagtattatcaattaaaaacgaaacaagacagattaagctatttaagagcactctccataggaaatttgatcaacgaagcagccaaagtatttgttgaaaacgaagctgccattttaagaggagattaccatatatctttgctggacaaatgtagatatgaagctcagatcaatgatattattaaaataagtattgataaaatataccggagtaaagaagtagttgaaaagaaatttcaggctatagggtccttgctgatctgtgggaagtattattgccgcaattaa

SEQ ID NO: 23812 - protein, 324 aa, Unknown
  Obtained from environmental sample
  misc_feature (1)..(324): Xaa is any amino acid
MCIPALTHSLEVSVVGRSLGRIVGKQLLDKYPELQQLGYQANDFGAIVASACLAHDIGNPPFGHSGEKAIGEYFKSGNGVKYKKELTDKQWQDLIDFEGNANGFKILTENREGIEGGLRLSYATLGAFIKYPKESLPKKPTNNIIDKKYGFFQSEKEVFIDVVNDLGLKNVRKKDITYVRHPLAFLVEAADDICYTIIDFEDGINLGLIEEEFALEYLINLVRDTINTEKYYQLKTKQDRLSYLRALSIGNLINEAAKVFVENEAAILRGDYHISLLDKCRYEAQINDIIKISIDKIYRSKEVVEKKFQAIGSLLICGKYYCRN

SEQ ID NO: 23813 - DNA, 375 bp, Unknown
  Obtained from environmental sample
  misc_feature (1)..(375): n is a, c, g, or t
gtgaaatccgatgtaaataaaacgttgttattgcaattggatagtttaaataaaaatattaaaaccaatataacacaagctaagttgatggttaatgtttctaaattctctgaaggcgttttagacattccaattcaaataattaatattccggaaggagtaaaagttaactattttccaaagcaagtgtcattaagttttaccacaagcttggaaaaatttaatacaataaagtcagaagattttaatatcgtttgcgattacaacgatgcttctggaaatacaactttagcaccaaaattaatcaaacagccaaatgatgttaaaaacattaggttattgcaacaaaaaattgaatttataattacagaatga

SEQ ID NO: 23814 - protein, 124 aa, Unknown
  Obtained from environmental sample
  misc_feature (1)..(124): Xaa is any amino acid
MKSDVNKTLLLQLDSLNKNIKTNITQAKLMVNVSKFSEGVLDIPIQIINIPEGVKVNYFPKQVSLSFTTSLEKFNTIKSEDFNIVCDYNDASGNTTLAPKLIKQPNDVKNIRLLQQKIEFIITE

SEQ ID NO: 23815 - DNA, 462 bp, Unknown
  Obtained from environmental sample
  misc_feature (1)..(462): n is a, c, g, or t
atggcaacggcgttatttaagacgttaaaagccaagcgtttgatcagccgtagtatcaatccactacacgaaaaagtcctccaagctatcggtgtggacgatttgatccatcctgaaaaagaagcggccaatcgctgggccaagcgtctgtcactacgctattttgtcgattcgtttgaattgagcgataatttcagcatggtagagattaagattccaaatgtattgatcggtaagactgtcgacgacttacagttagagcaaaaattcaatatccgattgcttagtacgttgcgctatgagtattatgaagacagttttggacgtacgcagagcaagcctagtatccaaggtttggcaacgtctgagcaagtattgcaagagcgcgatgtattagtgatttatggtgccaacaaacacatcaatcagttcttacgtagtgtgggtgtgaaaatcaaatag

SEQ ID NO: 23816 - protein, 153 aa, Unknown
  Obtained from environmental sample
  DOMAIN (65)...(149): TrkA-C domain
  misc_feature (1)..(153): Xaa is any amino acid
MATALFKTLKAKRLISRSINPLHEKVLQAIGVDDLIHPEKEAANRWAKRLSLRYFVDSFELSDNFSMVEIKIPNVLIGKTVDDLQLEQKFNIRLLSTLRYEYYEDSFGRTQSKPSIQGLATSEQVLQERDVLVIYGANKHINQFLRSVGVKIK

SEQ ID NO: 23817 - DNA, 456 bp, Unknown
  Obtained from environmental sample
  misc_feature (1)..(456): n is a, c, g, or t
atgattatgaataagcgaagtatatctgtcctactgatcgctatgatggcactactgtcaggttgtgatcagtccgcgcaaaatccgaacgttcttctgtccgagcatcaaaaagacccgattaaagagttggcgattacctcagacgtggatcacagtcagtttggttacaagcaaaccttttatgtgccgatttattctgatatctataccgatagagacgctcgcaaagtgctgctatcggcgacgctgagtgtacgtaacaccacgctcaaaaaatcactgtatatcaataaaattggatattacgatacagatggagcattggtcaaatcatatctagataagcctatcgagctaccagcgatggcgacgcttaactatatcgtcgaaaaagaagaggataaaaggggatctggcgccaatttttacatccaaatcgaaggtggtgaatga

SEQ ID NO: 23818 - protein, 151 aa, Unknown
  Obtained from environmental sample
  SIGNAL (1)...(19)
  misc_feature (1)..(151): Xaa is any amino acid
MIMNKRSISVLLIAMMALLSGCDQSAQNPNVLLSEHQKDPIKELAITSDVDHSQFGYKQTFYVPIYSDIYTDRDARKVLLSATLSVRNTTLKKSLYINKIGYYDTDGALVKSYLDKPIELPAMATLNYIVEKEEDKRGSGANFYIQIEGGE

SEQ ID NO: 23819 - DNA, 858 bp, Unknown
  Obtained from environmental sample
  misc_feature (1)..(858): n is a, c, g, or t
atggctggccgtatgagatttcctagaaatttatttgtaggaactaatcaccagtacatgttattctttacacaaaaagggaaatgtttctggatgcgtgtttatgaaattccagaaggatcaaaaacgtcgaaaggtagagcaattcaaaaccttataaatattgaacaagacgataaagtaatggcttttatctgtactcaagatttaaaagatgaagaatacataaatagtcattatgttattatggcgactaaaaagggtcaagttaagaagacgtctttagaacagtattctcgtccaagaactaatggtattaatgccattactattaaggaggatgatgttttattggaagctaagttaacaacaggagaaagtcaagtaatgttggcgcttaagtctggtaaagcaattcgttttgaggaagctaagacgagaccaatgggtagaaatgcttcaggtgttcgtggtattcgtcttcaagatgaaaaaacagatgaagttataggtatgattgctgtagatgatatggagagcaatatcttagttgtatctgagaatggttatggtaaacgttcaagtttagatgcttacagaattaccaatagaggagggaaaggcgtaaaaaccatttctattacagaaaaaacaggtaacttagtttctatcaagaacgttacagatgaagatgatttaatgattatcaataaatctggaatagcaattcgtatggcagttgcagatttaagagttatgggtagagcaacacaaggagtgaaactcattaacttaaaaggtaatgattctattgcagccgttgctaaagttatgaaagatgatgaagaagacatttga

SEQ ID NO: 23820 - protein, 285 aa, Unknown
  Obtained from environmental sample
  DOMAIN (126)...(177): DNA gyrase C-terminal domain, beta-propeller
  misc_feature (1)..(285): Xaa is any amino acid
MAGRMRFPRNLFVGTNHQYMLFFTQKGKCFWMRVYEIPEGSKTSKGRAIQNLINIEQDDKVMAFICTQDLKDEEYINSHYVIMATKKGQVKKTSLEQYSRPRTNGINAITIKEDDVLLEAKLTTGESQVMLALKSGKAIRFEEAKTRPMGRNASGVRGIRLQDEKTDEVIGMIAVDDMESNILVVSENGYGKRSSLDAYRITNRGGKGVKTISITEKTGNLVSIKNVTDEDDLMIINKSGIAIRMAVADLRVMGRATQGVKLINLKGNDSIAAVAKVMKDDEEDI

SEQ ID NO: 23821 - DNA, 672 bp, Unknown
  Obtained from environmental sample
  misc_feature (1)..(672): n is a, c, g, or t
gtgcagacgatgatcagatcggctcgagattataattacccaaccatcacaacagatcaaattactattgatgctaaaaatttggggcacccacttttagatgcaaaaaaacgtgtaaatagtgatgtgttaattgatgcgcaacaattttgtattgtaaccggagcaaatatggctggaaaaagcacatttttgcgtacaatatctcttcatatcgtaatggctaatgtaggtttacctgtatgtgcaacatcaagtaaatacaaccctgtaaaactaatcacaagcatgcgtacaagcgattctcttacagatgacagtagttacttctttagcgaattaaagcgtcttaaatttattgtagatgaagtacaaaaagaaccgtactttattattttagatgaaattttaaaaggcacaaacagtacagataaagctattggatcaaagaagtttgttgaaaaactagtagctactcatgctacaggaattatcgctactcacgatttaagtttatgtactattgaagacgaattaagcgaagtaaaaaactacttttttgatgcgcagattatagacaacgaattacattttgactacaaatttaaagtaggggtttgtcaaaatatgaatgcgagcttcctattaaagaaaatggaaattatagactag

SEQ ID NO: 23822 - protein, 223 aa, Unknown
  Obtained from environmental sample
  DOMAIN (11)...(222): MutS domain V
  misc_feature (1)..(223): Xaa is any amino acid
MQTMIRSARDYNYPTITTDQITIDAKNLGHPLLDAKKRVNSDVLIDAQQFCIVTGANMAGKSTFLRTISLHIVMANVGLPVCATSSKYNPVKLITSMRTSDSLTDDSSYFFSELKRLKFIVDEVQKEPYFIILDEILKGTNSTDKAIGSKKFVEKLVATHATGIIATHDLSLCTIEDELSEVKNYFFDAQIIDNELHFDYKFKVGVCQNMNASFLLKKMEIID

SEQ ID NO: 23823 - DNA, 459 bp, Unknown
  Obtained from environmental sample
  misc_feature (1)..(459): n is a, c, g, or t
atgctagaagttggaaagcttaaaataaaagctaaaaaactagatcaaaaaattgatatggttattggtgattccgaaaacatgccttttgacgacaatacctttgatgccattactgttgcttttggtgtgcgtaactttgaaactttagaaaatggtctaaaagacattttacgtgtattaaaaccaggtggtatttttgttattttagaaacctctgtaccaactaagtttccttttaaacaagggtatcaattccattctaaagttattttacctaccgtcggaaaattattttccaaggacaaaacagcttacaaatatttaagcgaaagcgctaatgcgtttccatatggagaggctttaaacaatattttacgtaaaattgggtttagtaatgttacagacatgcctcagacatttggtgttgctacaatttacaaagcatttaaaaaataa

SEQ ID NO: 23824 - protein, 152 aa, Unknown
  Obtained from environmental sample
  DOMAIN (1)...(151): ubiE/COQ5 methyltransferase family
  misc_feature (1)..(152): Xaa is any amino acid
MLEVGKLKIKAKKLDQKIDMVIGDSENMPFDDNTFDAITVAFGVRNFETLENGLKDILRVLKPGGIFVILETSVPTKFPFKQGYQFHSKVILPTVGKLFSKDKTAYKYLSESANAFPYGEALNNILRKIGFSNVTDMPQTFGVATIYKAFKK

SEQ ID NO: 23825 - DNA, 750 bp, Unknown
  Obtained from environmental sample
  misc_feature (1)..(750): n is a, c, g, or t
atggcacgtaaatctaaattattgtcaagaaaacaattggataagtatttagactctaaaaaaagttttaacagttggttaaaacgtactggagaggcaccagttattattgacacagcattaactaataaatccttagtaaggatagaaaactattacaaaaccaacggttggtttaatgccacagcagactacaagattaataaaggtgacaacaaaaaagcgacaattgattatactatcgaaacaaaaaacgcttataagtttgacacagttgcttccaatattaaatctcccgtagtcgaaaaaatctacaaccagtttaaagaccaatcactaattaaatctggttcacaataccgtattaacaacgtttataatgaagcagaccgtattgtagaactaatgcgtgataatggtgtttatcactttagtcaagattatatagagtttgaaggcgataccatttttggcaccaacaaaatgaatattgaaaccattattgaaaaccgattaattagagaagaagacgtttctagacgagagccttttaaaattttcaaggtaaaggatgtcaatatttataccaatagctcatttaaaaacagaaaccaatctacaaacgataccacttattacgatggttataatatctatagtattggtaaattaaagtataaaccaagagcattaacaaactcggtatttataacaccaaacactgtttttaaagataaaaacagaccgtaa

SEQ ID NO: 23826 - protein, 249 aa, Unknown
  Obtained from environmental sample
  misc_feature (1)..(249): Xaa is any amino acid
MARKSKLLSRKQLDKYLDSKKSFNSWLKRTGEAPVIIDTALTNKSLVRIENYYKTNGWFNATADYKINKGDNKKATIDYTIETKNAYKFDTVASNIKSPVVEKIYNQFKDQSLIKSGSQYRINNVYNEADRIVELMRDNGVYHFSQDYIEFEGDTIFGTNKMNIETIIENRLIREEDVSRREPFKIFKVKDVNIYTNSSFKNRNQSTNDTTYYDGYNIYSIGKLKYKPRALTNSVFITPNTVFKDKNRP

SEQ ID NO: 23827 - DNA, 903 bp, Unknown
  Obtained from environmental sample
  misc_feature (1)..(903): n is a, c, g, or t
atgaaaaattatattttaaccacggctgctctacttgcatttcttttcacctgtgcacaaacagaggaaaagctggatactatttttgccaatgaactaaagaatgttgctttattctttccgagtccaattagccagggaattaccgggaacgaccatgttgttttcacttacaatagggaaaaacaacagcattttgggctattgcaggcaagacccggagaagcaagtaatttgctcgttatagatgcagctggctcggtttattgctatattataaaatataaaaaaacactgagcaggttaaattattttatcagggaatcagaaagcataggacccgaaaagaccatagcaattgattccacaaagactattgaaccaaaaaaacaattaagaaatagtagtcattattatcaacgctatagtagttatttattaagcaaaaaagagcggattggtaggattagtaaaaagcagcaggggatcgagctaagccttgagaacattgtatttaatagaaaggaattgtatttcgtaatcctaattgaaaacaaatccagcctggattatgatttgaattacctaaacctatcgatccaaaccaggaaaaggggaaaagaaaaaatcttcacagcgaattttgaaaaaaccctatatttcaattttgaagtcccggtaaaaataagaaaaaggacgggccaccaaattggtttatgttatcccgaaattttccttatccagggatccaagggcccgaattggagccaaaggaaaaggatgggaaaacgtgatttaaaaactgaaaatatcgccccccaatttattaaaacccctaatggaaagaaaaaggtttcccatgtaacaagaaaaggtaccccttattatttttcacaattttcc

SEQ ID NO: 23828 - protein, 301 aa, Unknown
  Obtained from environmental sample
  SIGNAL (1)...(17)
  misc_feature (1)..(301): Xaa is any amino acid
MKNYILTTAALLAFLFTCAQTEEKLDTIFANELKNVALFFPSPISQGITGNDHVVFTYNREKQQHFGLLQARPGEASNLLVIDAAGSVYCYIIKYKKTLSRLNYFIRESESIGPEKTIAIDSTKTIEPKKQLRNSSHYYQRYSSYLLSKKERIGRISKKQQGIELSLENIVFNRKELYFVILIENKSSLDYDLNYLNLSIQTRKRGKEKIFTANFEKTLYFNFEVPVKIRKRTGHQIGLCYPEIFLIQGSKGPNWSQRKRMGKRDLKTENIAPQFIKTPNGKKKVSHVTRKGTPYYFSQFS

SEQ ID NO: 23829 - DNA, 426 bp, Unknown
  Obtained from environmental sample
  misc_feature (1)..(426): n is a, c, g, or t
gtgagcagaaagtatgccaatcaatgttggtttcttcaatgctatccagtctgcaaatacatatatatcaaatttttctcctgccatagcacttataataaatctaaatcttgcaattttcttccgaactcatcatctactgcgagttttaaaaaatcatcttgcaaattaaacactctaaacacattaaaatacaagcctatggcaactcccggatcccctttttcaatgcggtatagggttgccctatggattcctgcccgctcagatacttgctctgtagtaagttttcgtctctttctggcaagctttatgttttctccaatttgctcaaatatttttcgatgtttagggaggagaatagttttttttgaaatcataatgtcgctcatttacaacaaatttatattttttgttgtaaattag

SEQ ID NO: 23830 - protein, 141 aa, Unknown
  Obtained from environmental sample
  misc_feature (1)..(141): Xaa is any amino acid
MSRKYANQCWFLQCYPVCKYIYIKFFSCHSTYNKSKSCNFLPNSSSTASFKKSSCKLNTLNTLKYKPMATPGSPFSMRYRVALWIPARSDTCSVVSFRLFLASFMFSPICSNIFRCLGRRIVFFEIIMSLIYNKFIFFVVN

SEQ ID NO: 23831 - DNA, 405 bp, Unknown
  Obtained from environmental sample
  misc_feature (1)..(405): n is a, c, g, or t
gtggctttttttaccaaggacagcagtgaattattgccacagtatcatgatgagcttgatagagtagcagaacagatgaataactatgatacagctactataaaaattgaagctcatgtttcagaggatgaggtcagtaaagcttctacctcaattttgcaatcgaactcgctggctaagagtcgagcgctcgttgttaaaaattacctaattttaaatcacaaaattgaacctagtcgtctgactactctcgattgcggtattaaaggttctattgcaccttctgatactgaggaaaacagatctatgaatcgtagagtttatagcttagtaaccgattcaaaaaaccacaaagctgattattatcaaaatgacctaggctcaaacagatgtatcaagttttaa

SEQ ID NO: 23832 - protein, 134 aa, Unknown
  Obtained from environmental sample
  DOMAIN (3)...(105): OmpA family
  misc_feature (1)..(134): Xaa is any amino acid
MAFFTKDSSELLPQYHDELDRVAEQMNNYDTATIKIEAHVSEDEVSKASTSILQSNSLAKSRALVVKNYLILNHKIEPSRLTTLDCGIKGSIAPSDTEENRSMNRRVYSLVTDSKNHKADYYQNDLGSNRCIKF

SEQ ID NO: 23833 - DNA, 426 bp, Unknown
  Obtained from environmental sample
  misc_feature (1)..(426): n is a, c, g, or t
gtgctgggtaagcatagtcttaaaaagtataatattaatttaaaatgtaacaagatgaaaaaaatactgattccaacagattttactttaaatagttttcaaactatagactatgtactcaagctttttaaacatgagacctgtgagttttattttttaaatacgtattcatatgatgctaatggattagatgctatacaattgttgcaagcagatgaagattggtttgataagcctaaacaaaatgcacaaaagcaattaggtaaattggtagaacgctatacgttaaattgtaaggcattaaatcatcaattttttgcagtatcagattgttcagaattattacctaattttccaaaaaatataaaagatttaaacattgaccttattattcttactagcaaaaaggagaaaaatctagggtaa

SEQ ID NO: 23834 - protein, 141 aa, Unknown
  Obtained from environmental sample
  misc_feature (1)..(141): Xaa is any amino acid
MLGKHSLKKYNINLKCNKMKKILIPTDFTLNSFQTIDYVLKLFKHETCEFYFLNTYSYDANGLDAIQLLQADEDWFDKPKQNAQKQLGKLVERYTLNCKALNHQFFAVSDCSELLPNFPKNIKDLNIDLIILTSKKEKNLG

SEQ ID NO: 23835 - DNA, 312 bp, Unknown
  Obtained from environmental sample
  misc_feature (1)..(312): n is a, c, g, or t
atggattttttataccctagcctaaataataaattaattttagtaacaggagctacttctggaataggtaatgcattatgtaagcagctattaaatcaaaaagctaatgttgtaggtattggtagagatgttagcaagctagatcaggatattaaaaataacaaaaactttactttcaaagcattcgatttgattcaaattaataatttagaggacgttttaaaagatgttgtccataaatttgggaaactggatggattagtacattgtgctggaaaagagaaaccgtaccctttagtatttataaagtga

SEQ ID NO: 23836 - protein, 103 aa, Unknown
  Obtained from environmental sample
  misc_feature (1)..(103): Xaa is any amino acid
MDFLYPSLNNKLILVTGATSGIGNALCKQLLNQKANVVGIGRDVSKLDQDIKNNKNFTFKAFDLIQINNLEDVLKDVVHKFGKLDGLVHCAGKEKPYPLVFIK

SEQ ID NO: 23837 - DNA, 756 bp, Unknown
  Obtained from environmental sample
  misc_feature (1)..(756): n is a, c, g, or t
atggattttttataccctagcctaaataataaattaattttagtaacaggagctacttctggaataggtaatgcattatgtaagcagctattaaatcaaaaagctaatgttgtaggtattggtagagatgttagcaagctagatcaggatattaaaaataacaaaaactttactttcaaagcattcgatttgattcaaattaataatttagaggacgttttaaaagatgttgtccataaatttgggaaactggatggattagtacattgtgctggaaaagaagaaaccgtacctttaagtatttataaaagtgaaaaaataaaatctatttttgaaattaatgtaatgtcagggatagaactattaagaattttttctaagaaaaaatttagtaacgacaactcaagtgtaatcttattatcttctgtaatgggagagctaggacaacccggtaaagtgggttattgtgcttcaaaagcagcagtattaggagttgttaaagcagcctcgttggagttagcaaaaagaagtattagggttaatgcagtgtcaccaggcgtagtaaaaacacctatgacactaaatctttttaatcaactttctgaagaaaacatcaaagaaattgaaaacatgcatcctttaggtacaggtaatgttgaagatataacacctttaatgctttttttattatctaatcaatcaaaatggattactggtcaaaacataaaaatagatggaggatactcaattcaataa

SEQ ID NO: 23838 - protein, 251 aa, Unknown
  Obtained from environmental sample
  DOMAIN (13)...(248): short chain dehydrogenase
  misc_feature (1)..(251): Xaa is any amino acid
MDFLYPSLNNKLILVTGATSGIGNALCKQLLNQKANVVGIGRDVSKLDQDIKNNKNFTFKAFDLIQINNLEDVLKDVVHKFGKLDGLVHCAGKEETVPLSIYKSEKIKSIFEINVMSGIELLRIFSKKKFSNDNSSVILLSSVMGELGQPGKVGYCASKAAVLGVVKAASLELAKRSIRVNAVSPGVVKTPMTLNLFNQLSEENIKEIENMHPLGTGNVEDITPLMLFLLSNQSKWITGQNIKIDGGYSIQ

SEQ ID NO: 23839 - DNA, 339 bp, Unknown
  Obtained from environmental sample
  misc_feature (1)..(339): n is a, c, g, or t
atgaaaggtataaacaagaaagaacaggagcttgatgagaaagagttcgaaagcgatatagagaagaacctaagagttcaggaactagaacgtgagcaaagagaaaaattcgataaggaatatcatcctgttgtgttgatggcaataaatctaattggtaatctgatcattggttatatattttttttcgtcacaaagatgtttttaagtcgaatattccatttttttccagatagtatcaatgatgtatatttcctgttgtttcatttgataatttgggtgttagctattattggagtaatcacaaagaaatctccatgggagaaatttcttaagtga

SEQ ID NO: 23840 - protein, 112 aa, Unknown
  Obtained from environmental sample
  misc_feature (1)..(112): Xaa is any amino acid
MKGINKKEQELDEKEFESDIEKNLRVQELEREQREKFDKEYHPVVLMAINLIGNLIIGYIFFFVTKMFLSRIFHFFPDSINDVYFLLFHLIIWVLAIIGVITKKSPWEKFLK

SEQ ID NO: 23841 - DNA, 606 bp, Unknown
  Obtained from environmental sample
  misc_feature (1)..(606): n is a, c, g, or t
gtgaaaaaatatttcctgattttcatgatatctgcactttactcgtgtggaagtgctaaatacaattatttttttgatactgggaagcaactcgacttcagccatggaaagtggatattgaacagtacccaatcaaattcaagaatattcgatactgaactctatgatacttcacttgaaggatttaaaaaaattctgggcgactccttaatagaaatgaacgatttaaggagtaccaaactggttgctccaaaaattaagttccagttgtcggaatcggatttaaaagagttgaaaagagatacggactgtgactacatcatcaatattggaggaaatgcgattagtgacggcttgggtacattgtcatttcccgatcaaaatgaaaattcgagcaatagtgcagctgtgtcgataaccatttatgatttaaatgccgaggcattgatctcttcatcacaggtttatggaaaaacggaacaacaggatgcggtttttccagataacaaacaacgtccttctattaatcccagttcccatatgataatgttgaaaggtgcaaagaaactaattgggaaatatgaaaagtaccaactggatcattga

SEQ ID NO: 23842 - protein, 201 aa, Unknown
  Obtained from environmental sample
  SIGNAL (1)...(19)
  misc_feature (1)..(201): Xaa is any amino acid
MKKYFLIFMISALYSCGSAKYNYFFDTGKQLDFSHGKWILNSTQSNSRIFDTELYDTSLEGFKKILGDSLIEMNDLRSTKLVAPKIKFQLSESDLKELKRDTDCDYIINIGGNAISDGLGTLSFPDQNENSSNSAAVSITIYDLNAEALISSSQVYGKTEQQDAVFPDNKQRPSINPSSHMIMLKGAKKLIGKYEKYQLDH

SEQ ID NO: 23843 - DNA, 1044 bp, Unknown
  Obtained from environmental sample
  misc_feature (1)..(1044): n is a, c, g, or t
ttgatggctgagatcaaatctgctattaccggaaatacaccatccttaaaagaaacgaaacattggtttttaccacttgatcaatatcaggattggttaaaagaatggatcgttgaaggacatgccaatgattggaaaccgaatgtattgggccaggtaaaatcatggttagatgatggtttgcgtccaagagctgtaacacgcgatctggattgggggattcctgttccacttaaaggagctgagggtaaagtactctatgtttggtttgatgccccgataggatatatttcatcgaccaaagaatgggctgaacgagaagggaaagattgggagccttactggaaagatgcagataccaaattggttcactttattggaaaagataatattgtttttcactgtattatttttccaagtatgctaaaagctgaaggcagttatatattgcctgaaaatgtaccggccaatgaattcttaaatttagaagggaataaaatatccacttctaaaaactgggcggtttggctacatgaatatttagaagattttcctgataaacaagatgtgcttcgttatgccctaactgcgaatgctccggaaactaaagataatgatttcacctggaaagattttcaggcaagaaataataacgagctagtcgccattttaggaaactttatcaaccgtgtattagtgctcacacacaaatattatgatggaaaggtaccaagtgcaggaaatctctctgatcttgatgaaaatacgttagctcttatcaaaaaatatccccaaattatcgccaagtctattcaacgttataggtttagggaggctttaatggaactgatgaatttagcgcgtttaggccataaatatttagctgatgaggagccctgggaaaagatcaaagaagaccctgaacgtgtacaaactattatgtttatcgcattacagattgctacggggttagcattttatctgaggcgtttttacttttacctcaaaaaatttaaaaaaattcttccttattcggaacttaag

SEQ ID NO: 23844 - protein, 348 aa, Unknown
  Obtained from environmental sample
  misc_feature (1)..(348): Xaa is any amino acid
MMAEIKSAITGNTPSLKETKHWFLPLDQYQDWLKEWIVEGHANDWKPNVLGQVKSWLDDGLRPRAVTRDLDWGIPVPLKGAEGKVLYVWFDAPIGYISSTKEWAEREGKDWEPYWKDADTKLVHFIGKDNIVFHCIIFPSMLKAEGSYILPENVPANEFLNLEGNKISTSKNWAVWLHEYLEDFPDKQDVLRYALTANAPETKDNDFTWKDFQARNNNELVAILGNFINRVLVLTHKYYDGKVPSAGNLSDLDENTLALIKKYPQIIAKSIQRYRFREALMELMNLARLGHKYLADEEPWEKIKEDPERVQTIMFIALQIATGLAFYLRRFYFYLKKFKKILPYSELK

SEQ ID NO: 23845 - DNA, 651 bp, Unknown
  Obtained from environmental sample
  misc_feature (1)..(651): n is a, c, g, or t
ttgaggcttttttttttatgtttatatttactaaaaatattaaaaatgagaatcaccaaagttttattattattcttaattatagtttcctgtgctccagataaaattgaagtcgatactatcattaccaacggaacggtttatactgttgatgcagattttaacactacagaagcgtttgccattaaagatggtaaatttgtagcagttggtgcaactaatgatattaataaaaaatacaaagctaccaatacaattgatgctaaaggacaaaccattttgcctggatttatcgatgcacattgtcacttttacggtttaggtttaaaccaattacaagtaaatcttagggatactaaaagttttgatgaggtaatgaaacgtgttatcgattttcataataaccgaccatctaattttattattggtagaggttgggatcaaaatgattgggacgacaaaacttacccaaataaagcattattggataaattatatccagatacacctgtggctctaactagaatagatggtcatgctatgttgtgtaatcaagcagctttagatttagctaaaatagatattaatacaaaaattgaagggaggcgaaattttaaagaaagatggcaaacttacaggagtattaattga

SEQ ID NO: 23846 - protein, 216 aa, Unknown
  Obtained from environmental sample
  misc_feature (1)..(216): Xaa is any amino acid
MRLFFLCLYLLKILKMRITKVLLLFLIIVSCAPDKIEVDTIITNGTVYTVDADFNTTEAFAIKDGKFVAVGATNDINKKYKATNTIDAKGQTILPGFIDAHCHFYGLGLNQLQVNLRDTKSFDEVMKRVIDFHNNRPSNFIIGRGWDQNDWDDKTYPNKALLDKLYPDTPVALTRIDGHAMLCNQAALDLAKIDINTKIEGRRNFKERWQTYRSIN

SEQ ID NO: 23847 - DNA, 918 bp, Unknown
  Obtained from environmental sample
  misc_feature (1)..(918): n is a, c, g, or t
gtggtttgtttaagtgaacaaggagatttattacataatgagaatatgtatcctcatcaaccacaaaatcaagctaatgaagccataaaaaaattaggttctttggttgatacttataaaattgatgcgattgcaatcggaaatggaacagcttccagagaaacagaagaattggtgaaaaaagttttctttaaagataaaattgatgtttttgtggtgagtgaagctggagcctctatttattctgcatcaaaaattgcaagagacgaattcccaaattacgatgttacagttcgtggttctgtttctattggacgtagattgcaagatcctttggctgagttggttaagattgatgcaaaatcgattggagttgggcaatatcagcatgatgttgatcaaacaaaattgaagaaatctttagatacaactgtagaaagttgtgtaaatacagttggtgtaaatattaatactgcaagtgaatctttattgagttacgtttctggaattggaccaaaattggcggaaaatattgtaaattatagaaatgaaaacggctctttttcatcaagaaaagaaattaaaaaagtaccaagattaggaggaaaagcttttgaacaagctgcaggttttttaagaattaagaacggaaaaaatcctttagataattctggagtacatccagaaagttatgttttagtcgataaaatagccaaagatttaaaaattaatattgctgatttaattggaaataaagacattcttcaaaaaataaagttacaaaaatatatttctgaaaccattggtttgctaacgttacaagaacatgtaaagggtttagaaaaaccgggtttagatccaagagaaaaagctaaagtgttttctttggatgaaatatcaaaacaatttccgatttaa

SEQ ID NO: 23848 - protein, 305 aa, Unknown
  Obtained from environmental sample
  misc_feature (1)..(305): Xaa is any amino acid
MVCLSEQGDLLHNENMYPHQPQNQANEAIKKLGSLVDTYKIDAIAIGNGTASRETEELVKKVFFKDKIDVFVVSEAGASIYSASKIARDEFPNYDVTVRGSVSIGRRLQDPLAELVKIDAKSIGVGQYQHDVDQTKLKKSLDTTVESCVNTVGVNINTASESLLSYVSGIGPKLAENIVNYRNENGSFSSRKEIKKVPRLGGKAFEQAAGFLRIKNGKNPLDNSGVHPESYVLVDKIAKDLKINIADLIGNKDILQKIKLQKYISETIGLLTLQEHVKGLEKPGLDPREKAKVFSLDEISKQFPI

SEQ ID NO: 23849 - DNA, 342 bp, Unknown
  Obtained from environmental sample
  misc_feature (1)..(342): n is a, c, g, or t
atgatgggctgttcttctaccttaaaattatcttgtatttttgaatattcaatanaaaaacacatcatgaaatatctaccaattgaccataatttattcataaaaaatcgtaaaaactttactgctcagatgaagccaagtagtttggcagtttttaactctaacgatatttaccctataagtgctgatagtacattgccttttcagcagcatcgcgatattttttatttaagtggtgtagatcaaagagaagagtgtattggtgttggttcccgaatgcccaaatcccgcgcaataagagatttttattttaaaaaaaaccaaccagcattttggctgttt

SEQ ID NO: 23850 - protein, 114 aa, Unknown
  Obtained from environmental sample
  misc_feature (1)..(114): Xaa is any amino acid
MMGCSSTLKLSCIFEYSIXKHIMKYLPIDHNLFIKNRKNFTAQMKPSSLAVFNSNDIYPISADSTLPFQQHRDIFYLSGVDQREECIGVGSRMPKSRAIRDFYFKKNQPAFWLF

SEQ ID NO: 23851 - DNA, 576 bp, Unknown
  Obtained from environmental sample
  misc_feature (1)..(576): n is a, c, g, or t
atgaaaaaaataataacatttttactacttaccatagtattagtctcctgcggaaacacagaaatttctaataatattaaggtgaattctattgaagaattgcaaaatgcaattaaggatagtaaagctggagataacattgtattagcagatggtatatataaagatgttgaaattgaattttatggcaaaggaacttcaaataagccaatcacgctaaaagcggaaactccaggaaaagtaagtatagaagggatttcaaacttaaaaattggtggagactatttagtagcagaagggctacattttaaaaacggttatacgccttcagaaaatgttattcaatttaaaattaatgatactttaattgctaaccatagtatagtaactaattgtgtaattgatgcttttacacaaccagatagagatgttagtgaccatttggtaaaattttggggaagacataatcagttaagtaataattatataaaccggaaaatcaaattttggtccaacgggtatggtaagaataaatggaacccacatgtaaaaaactcccatcaaataaaaaacatc

SEQ ID NO: 23852 - protein, 192 aa, Unknown
  Obtained from environmental sample
  SIGNAL (1)...(18)
  misc_feature (1)..(192): Xaa is any amino acid
MKKIITFLLLTIVLVSCGNTEISNNIKVNSIEELQNAIKDSKAGDNIVLADGIYKDVEIEFYGKGTSNKPITLKAETPGKVSIEGISNLKIGGDYLVAEGLHFKNGYTPSENVIQFKINDTLIANHSIVTNCVIDAFTQPDRDVSDHLVKFWGRHNQLSNNYINRKIKFWSNGYGKNKWNPHVKNSHQIKNI

SEQ ID NO: 23853 - DNA, 990 bp, Unknown
  Obtained from environmental sample
  misc_feature (1)..(990): n is a, c, g, or t
atgcacagattcagcatagatgcaggtacagggaatactattgttaacaacaatagtttagttttaaaaatgttaaaaagtaccgttaccagtgttcaagaacctatttgggacttgatgatgaaaaatatctataatacaggggcttttcaattagacaaagaagactttaaattaaatatattttataccgaaagttcacctttaaattatatcactccagtagatgggacatcgtttccagcacctgggccaaacgagagccctttgcaagaaacgccattattacgggtttttaatctggataaattaaatttcaacaatgaccctcaatttaatggtgatgggttcttcgattttgtaccagggattacggtaatacaacaaaacggaaaaataatattcaccaatgccgaaccttttggtaaatatttatttgatgtgttagcagacggaggtgaagattatgaaaacacgacaacttataaccccaatcaggctaagtatgtatacgataagctttataaatcgaccaagacagatgctttaaatgatggtgaaaagaataagtttcaaataaaaggacgttataaatctggaggaggatcaggaatccctattggtgcgtttaatgtgccacgaggatcggtaaaagttactgcaggcggtagagtgcttgttgaaggtgtagattatactgtgaattatcaaattggtacggttcaaattttagatccagcattgcaagcatctaatacaccaatacaagtttcggtagaaaataatgcagtattcgggccaacaaaccaagcgttttacaggattaaatatagaaacaccattcagccaaaaattttgtttttaggggcaaccctaattaaacccttaatgaaacgccccaataaccacaaaagggccaattatgggtacagaaaccataaaaaaaaactatttttgggagttaacgggaattttctcaacggaaggtgc

SEQ ID NO: 23854 - protein, 330 aa, Unknown
  Obtained from environmental sample
  misc_feature (1)..(330): Xaa is any amino acid
MHRFSIDAGTGNTIVNNNSLVLKMLKSTVTSVQEPIWDLMMKNIYNTGAFQLDKEDFKLNIFYTESSPLNYITPVDGTSFPAPGPNESPLQETPLLRVFNLDKLNFNNDPQFNGDGFFDFVPGITVIQQNGKIIFTNAEPFGKYLFDVLADGGEDYENTTTYNPNQAKYVYDKLYKSTKTDALNDGEKNKFQIKGRYKSGGGSGIPIGAFNVPRGSVKVTAGGRVLVEGVDYTVNYQIGTVQILDPALQASNTPIQVSVENNAVFGPTNQAFYRIKYRNTIQPKILFLGATLIKPLMKRPNNHKRANYGYRNHKKKLFLGVNGNFLNGRC

SEQ ID NO: 23855 - DNA, 366 bp, Unknown
  Obtained from environmental sample
  misc_feature (1)..(366): n is a, c, g, or t
ttgaaatcccagccgggaaaacgtggtaaaaatgcagatataaaacgcattttacatattgaaggtgaaaaaaccttagcagctattcctaaaggcaaccgtattgttactctagaagtaacaggtaaaccacttgatacccacgaacttgctaaaaacatggaaaaatggcaactcgatggccgcgatgtaagtttacttattggcggtcctgaaggacttgcaccagagtgtattgctgcctctgagcaaaaatggtcgttatctaacttaactttaccgcaccctttggtgcgtattattgttgctgaaagcctatacagaggctggagcttaaataacaaccatccttatcatcgcgagtaa

SEQ ID NO: 23856 - protein, 121 aa, Unknown
  Obtained from environmental sample
  DOMAIN (1)...(119): Uncharacterized ACR, COG1576
  misc_feature (1)..(121): Xaa is any amino acid
MKSQPGKRGKNADIKRILHIEGEKTLAAIPKGNRIVTLEVTGKPLDTHELAKNMEKWQLDGRDVSLLIGGPEGLAPECIAASEQKWSLSNLTLPHPLVRIIVAESLYRGWSLNNNHPYHRE

SEQ ID NO: 23857 - DNA, 579 bp, Unknown
  Obtained from environmental sample
  misc_feature (1)..(579): n is a, c, g, or t
ttgcctcattacgctctctatattgaatggaaaccaaacaaaactattcatattatgagttatttaaatatacaagacgaaaaattattacccgtagtaatggagttaaacaatttattagcagattaccatatatactaccagaaattaagaacctttcattggaatgtactcggaaaaaacttcttcgatttacacgtgcagtttgaagaaatgtataacgatgcgaaagttaagatagatgaagttgccgaacgcatcttaacgttaagacatcatcctgtaagtaaatttagcgattatttaaaaatatcttctttagaagaaggtaatgctttagtatcggatcaagatatggtaactgaattaattggtgaccataaaaaaatacttgggcaaatgtctgaggttattgaaaaagccgataaagcaggcgacgaaggaacaattgatttaattggagcttacattcgtgagttagaaaaatcgagttggatgttaaatgcttggtcaaaaaaagcaaaagaacatttaaaagtaaacgagttagaatctgttaaaagtaattatttaccttag

SEQ ID NO: 23858 - protein, 192 aa, Unknown
  Obtained from environmental sample
  DOMAIN (33)...(174): Ferritin-like domain
  misc_feature (1)..(192): Xaa is any amino acid
MPHYALYIEWKPNKTIHIMSYLNIQDEKLLPVVMELNNLLADYHIYYQKLRTFHWNVLGKNFFDLHVQFEEMYNDAKVKIDEVAERILTLRHHPVSKFSDYLKISSLEEGNALVSDQDMVTELIGDHKKILGQMSEVIEKADKAGDEGTIDLIGAYIRELEKSSWMLNAWSKKAKEHLKVNELESVKSNYLP

SEQ ID NO: 23859 - DNA, 405 bp, Unknown
  Obtained from environmental sample
  misc_feature (1)..(405): n is a, c, g, or t
ttgaacatttattntggcagcagccagaaaaggattataaaccaggcaaaaaaaagctatacattaacagtttttgaagccaaatacaaagacgaattatttagatttgcagaatcctataacacacataacttgtggacaatcttcaaaagtttaccacaagatgttaaagaagataaagatttaatcaaagcaatgcgtcattacgattacacagtaaatattacttgggtaatggctcattataacactgcaaatcactatttaaatattggtggaaaaactgcagaagcaacaggaggaagtgaatgggtaaaatatatgcatccaaagtatcaaagacgaatattttttccggatttatggagcaaacaagaattacaagattggggcaaaaatgtttaa

SEQ ID NO: 23860 - protein, 134 aa, Unknown
  Obtained from environmental sample
  misc_feature (1)..(134): Xaa is any amino acid
MNIYXGSSQKRIINQAKKSYTLTVFEAKYKDELFRFAESYNTHNLWTIFKSLPQDVKEDKDLIKAMRHYDYTVNITWVMAHYNTANHYLNIGGKTAEATGGSEWVKYMHPKYQRRIFFPDLWSKQELQDWGKNV

SEQ ID NO: 23861 - DNA, 612 bp, Unknown
  Obtained from environmental sample
  misc_feature (1)..(612): n is a, c, g, or t
atgattaaaaccctaatatttgattttggagatgtctttattaatttagataaagaaggtgcaatgaccaacgctttagagctgtttgacgttgatgagttatccgaagaaatcgtcgcttttaatagtttttacgaacaaggtctgatagacactaacgagtttatagatttttacatgggtaattttccaaaattatccaaacaacaaatcgttgaagcttggaactacattatttgtgattttcccgttaaacgattagaatttatacaacaattagcaaaagacaaaaagtacaatctaatattactaagtaatactaatgagttacatattgattgtattaaaaatcaggtatcgttttatgacgaatttaaaaatgcgtttgataaattttacctttcacacgaaatacaattgcgtaaaccaaacaaagatatttttcagtttgtactaaatgaaaacaacctaaaaccagaggaatgcctgtttatagatgatacttctgaaaacacagaaactgctagtaatttaggtattaacgtatggaataacaatccaaaaacagaagatattatagatttatttaccattaaaaaagacttgttttaa

SEQ ID NO: 23862 - protein, 203 aa, Unknown
  Obtained from environmental sample
  DOMAIN (2)...(188): haloacid dehalogenase-like hydrolase
  misc_feature (1)..(203): Xaa is any amino acid
MIKTLIFDFGDVFINLDKEGAMTNALELFDVDELSEEIVAFNSFYEQGLIDTNEFIDFYMGNFPKLSKQQIVEAWNYIICDFPVKRLEFIQQLAKDKKYNLILLSNTNELHIDCIKNQVSFYDEFKNAFDKFYLSHEIQLRKPNKDIFQFVLNENNLKPEECLFIDDTSENTETASNLGINVWNNNPKTEDIIDLFTIKKDLF

SEQ ID NO: 23863 - DNA, 879 bp, Unknown
  Obtained from environmental sample
  misc_feature (1)..(879): n is a, c, g, or t
ttgcaaatagccaaaagtggattgggacaaacacgtccaaatccaatggttggttgcgttattgtcgtaaacaatcgtataattggcgaaggatacactagtaaatatggtggcaatcatgcagaagtaaatgctataaatagtgtaaaaaaccagtcccttttaaaagatgctactatttacgtaacactagaaccatgtagtcattatggtaaaacaccaccttgtagcgacttaattatccaccatcaaataccaaatatagttattggatgtattgatgataatcctgacgttgctggtaagggtatcaaaaaattattagaagctggtcgtaatgtaaaagttggcgttttggaagccgaatgcaaagcacaccacaaacgcttttttacttttcataataaaaaacgaccatatattatattaaaatgggcagaatctaacgatggatttattgcaccaaaatctaaaaatgaacaaaaacctgtttggattaccaacacttattctagacaattagtccataaatggagagctgaagagcaagctatattagtaggtactaatacggttttacaagacaatccaactctagatgttagggattggactggcaataatcctttacgcgtcgtactagataaaaataaactcttaaaagcagactgcaatgtttttaacgctaaatcggaaagcttattaatttacaataacgacaacacaactcaacaggctttacaaaacacaacttggtctatccatccgccaaacaatacaatggttggagattttaattcaagagtagattttagtcaaaaaagatctccaagcacacaatttgtgatactttatttaaacccaacatcaactctgtaa

SEQ ID NO: 23864 - protein, 292 aa, Unknown
  Obtained from environmental sample
  DOMAIN (139)...(281): RibD C-terminal domain
  misc_feature (1)..(292): Xaa is any amino acid
MQIAKSGLGQTRPNPMVGCVIVVNNRIIGEGYTSKYGGNHAEVNAINSVKNQSLLKDATIYVTLEPCSHYGKTPPCSDLIIHHQIPNIVIGCIDDNPDVAGKGIKKLLEAGRNVKVGVLEAECKAHHKRFFTFHNKKRPYIILKWAESNDGFIAPKSKNEQKPVWITNTYSRQLVHKWRAEEQAILVGTNTVLQDNPTLDVRDWTGNNPLRVVLDKNKLLKADCNVFNAKSESLLIYNNDNTTQQALQNTTWSIHPPNNTMVGDFNSRVDFSQKRSPSTQFVILYLNPTSTL

SEQ ID NO: 23865 - DNA, 519 bp, Unknown
  Obtained from environmental sample
  misc_feature (1)..(519): n is a, c, g, or t
atgtcagatcacacaattaatcctaataaatggatagatttatacagcgactacctctttaattacaccattacacgtgtaaatgacagagcaatagcgcaagacttagtttctgacacttttctagctggtctaaaaagtatgaaaaactttaaaggagaagctagtgagcgtacttggctagtatctattttaaaaagaaaagtcattgaccattaccgtaaatctaattctaataaaggtaaagctgaagttagaatgtcttacaattctgatagcgaaacagaaggtgattggttagaagagcgcgttgcagatccttttgataaaactgcagaagaccaaattgaaaatactgaattagccagcgcaattgatgattgcctgtctaaattaccaaaaaaacaagctcaaatatttgaaatgaaaaccattttaaattatgaaaccgaaacaatttgtaatgaattaaaaataactgcgtctaatctttgggtaataatccacagagcaagctga

SEQ ID NO: 23866 - protein, 172 aa, Unknown
  Obtained from environmental sample
  DOMAIN (11)...(79): Sigma-70 region 2
  misc_feature (1)..(172): Xaa is any amino acid
MSDHTINPNKWIDLYSDYLFNYTITRVNDRAIAQDLVSDTFLAGLKSMKNFKGEASERTWLVSILKRKVIDHYRKSNSNKGKAEVRMSYNSDSETEGDWLEERVADPFDKTAEDQIENTELASAIDDCLSKLPKKQAQIFEMKTILNYETETICNELKITASNLWVIIHRAS

SEQ ID NO: 23867 - DNA, 846 bp, Unknown
  Obtained from environmental sample
  misc_feature (1)..(846): n is a, c, g, or t
atgttggcttctattttacaggaagcaggctataaagtaggtttgtatacatcaccacatttaaaaagttttacagaaagaattcgtttaaatggtgttgaaattccgaaagagaaattaacgtcttttatacatacgcataaaaatttcttagaggcacaaaaactctcttttttcgaaatgacagtagggttagcgttcgattattttgtggatgaaaaagtagacattgccatcatagaggttggtttaggaggtagattagactctacaaatattattacaccacaagtgtcagtaattaccaacatagggttggatcacacgcagtttttaggagaaaccttgccagaaattgccttcgaaaaagcgggcatcatcaaaaataatattccagtaattataggggagcagcaagccgaggttgttgctgtttttaaaaagaaagcagaagagcatcattcagaaatcttttttgcttcggttgatcagcatccttataaaacagatttgttgggcgattatcaaaaatcaaatacaaaaacagcggttgctgcaattcagcaattgaaaggatttcaagtttctcaagaagacattgtaaatggcttgctcaatgtggtaaagaataccaacctaaaagggagatggcagattctgcaagagcatccaaaagtaattgcagatacagctcataataaagagggattggaaattgtattacaacagttaaaaaaaggtaagtacaatcaacttcatattgttttaggtgtcgtttcagataaaaaatttagaggaagtcttcccctctttttcccaaaatcagcaacatattattttttgtaa

SEQ ID NO: 23868 - protein, 281 aa, Unknown
  Obtained from environmental sample
  DOMAIN (1)...(201): Mur ligase family, catalytic domain
  misc_feature (1)..(281): Xaa is any amino acid
MLASILQEAGYKVGLYTSPHLKSFTERIRLNGVEIPKEKLTSFIHTHKNFLEAQKLSFFEMTVGLAFDYFVDEKVDIAIIEVGLGGRLDSTNIITPQVSVITNIGLDHTQFLGETLPEIAFEKAGIIKNNIPVIIGEQQAEVVAVFKKKAEEHHSEIFFASVDQHPYKTDLLGDYQKSNTKTAVAAIQQLKGFQVSQEDIVNGLLNVVKNTNLKGRWQILQEHPKVIADTAHNKEGLEIVLQQLKKGKYNQLHIVLGVVSDKKFRGSLPLFFPKSATYYFL

SEQ ID NO: 23869 - DNA, 387 bp, Unknown
  Obtained from environmental sample
  misc_feature (1)..(387): n is a, c, g, or t
ttggacggtacagaagtttctgtgggagtcatcacttataaaggtgacaccaaagtactacccattaccgaaatagtaaccgacaacgatttttttgattataaagcgaaatacctaggccagtcgcaagaaataacaccggcacgattaacaccggccgaagaagaaaaagtaaatgtggttgctaaaaaagtttacgaggttttaaaaatgaaaggctattcgcgcagtgaatttatttttaaaaatggcgaaccacatttattggaagtaaatactgttcctggattaaccaacgaaagcattttaccccaacaggctgctaaagctggcatttctatgttagatttatttagtagtgctattgaagaagcgctaaaaaaataa

SEQ ID NO: 23870 - protein, 128 aa, Unknown
  Obtained from environmental sample
  DOMAIN (1)...(123): D-ala D-ala ligase C-terminus
  misc_feature (1)..(128): Xaa is any amino acid
MDGTEVSVGVITYKGDTKVLPITEIVTDNDFFDYKAKYLGQSQEITPARLTPAEEEKVNVVAKKVYEVLKMKGYSRSEFIFKNGEPHLLEVNTVPGLTNESILPQQAAKAGISMLDLFSSAIEEALKK

SEQ ID NO: 23871 - DNA, 495 bp, Unknown
  Obtained from environmental sample
  misc_feature (1)..(495): n is a, c, g, or t
ttgtatttttacagtaaagtaattaatatgcctttaatacaacttaaaacagttatccatgcgagtttgaaaacatgttttgatttgtccagagatatagattttcataaggattcattaaaacactcaaatgagaaggctattgcaggtaaaacctctggtttaataggtttaggagaatcggtaacatgggaagctacccattttggaatccgtcagcaactaacctccaaaataacacattttgaatcgcctaaatactttgttgatcagatggtttcaggagcatttaaaagttttaagcacgaacatatttttagtacaaaaggagaagatatcataatgattgatatgttttattttcagtcgccttttggcattttaggtagattggctaacgtgttatttttaactagttatatgaaaaatttgcttgaaactagaaatcattttctaaaaattaaggccgaaatcatacaaaatcaacaatcttaa

SEQ ID NO: 23872 - protein, 164 aa, Unknown
  Obtained from environmental sample
  misc_feature (1)..(164): Xaa is any amino acid
MYFYSKVINMPLIQLKTVIHASLKTCFDLSRDIDFHKDSLKHSNEKAIAGKTSGLIGLGESVTWEATHFGIRQQLTSKITHFESPKYFVDQMVSGAFKSFKHEHIFSTKGEDIIMIDMFYFQSPFGILGRLANVLFLTSYMKNLLETRNHFLKIKAEIIQNQQS

SEQ ID NO: 23873 - DNA, 369 bp, Unknown
  Obtained from environmental sample
  misc_feature (1)..(369): n is a, c, g, or t
gtgcctatggagtttagtcaagaagaaccaaataaagtatcgcttagcagatttgaatcgatgttaaaaacaaacaatgtgttgttttttgactcggacgaatttgaaaatataatacaccattaccttaaccaaggtaaagtatctttagcaaaaaaagctattaagttaggcttagagcaacatcctacatctactaatcttaaattatttaaggtagaaatttatgtgtttgaaaataagctaaaagaagcaaatcagttactagatgccttgtatgtattagagccatcaaacgaagaaatatacattcaaaaagctaatatattatctaaagatgataagcatcaagacgcgattaaagtttaa

SEQ ID NO: 23874 - protein, 122 aa, Unknown
  Obtained from environmental sample
  misc_feature (1)..(122): Xaa is any amino acid
MPMEFSQEEPNKVSLSRFESMLKTNNVLFFDSDEFENIIHHYLNQGKVSLAKKAIKLGLEQHPTSTNLKLFKVEIYVFENKLKEANQLLDALYVLEPSNEEIYIQKANILSKDDKHQDAIKV

SEQ ID NO: 23875 - DNA, 369 bp, Unknown
  Obtained from environmental sample
  misc_feature (1)..(369): n is a, c, g, or t
ttggaaatgatccaaaaagcccaagaatttggattaaaattaatcattactactgatcatggtactataaacacgaaaacaccaactaaagtaattggagaaaaaaatattagttctaatttgaggtataaaacaggaagaagtttatcatataataataaagatgtttttgcaataaaaaacccaaaagacattgagctgccttctattcatatgacaagctcttttatttttgcaaaggaagacttattttttgcctatccaaacaactataaccattttgttaagtattataaaaacacttatcaacatgggggtatttctcttgaagaaatgattataccatgtataataatgaagcccaaataa

SEQ ID NO: 23876 - protein, 122 aa, Unknown
  Obtained from environmental sample
  misc_feature (1)..(122): Xaa is any amino acid
MEMIQKAQEFGLKLIITTDHGTINTKTPTKVIGEKNISSNLRYKTGRSLSYNNKDVFAIKNPKDIELPSIHMTSSFIFAKEDLFFAYPNNYNHFVKYYKNTYQHGGISLEEMIIPCIIMKPK

SEQ ID NO: 23877 - DNA, 660 bp, Unknown
  Obtained from environmental sample
  misc_feature (1)..(660): n is a, c, g, or t
gtgctaattttagatttgcgtggtcatggaaatagcaaaccaagtttaaaagacacctttaattctaaatacaccttcgattctattacagaagatattgttgaagttattgattttttaaaaattgaaaaatctcattttattggtatttctttgggtacaattttaataagaaatttagctgaaaaaagacctgagttagtacaaagtatgattatgggtggtgctattattaaaatgaatttccgttctcaagttttaatgaaagttggtaatatttttaaatctgtggtgccttatatgctactttacaggttatttgcttttattattatgcccaataaaagtcataaaaaatcacgttctttatttgtaaacgaagctaaaaaactatatcaaaaagaatttattcgttggtttaaattaacgtcagaaatcaatccacttttacgtttttttagaacaaaagatataaaaatcccaacattatatattatgggagcagaagatcatttgtttttaccatccataaaaaacattgtttctaaacacaaaacctcttctttagtagtggttgataaatgtggccatgttgtaaatgtcgatcaaccagccatttttaacaaccaaacaattcaatttatatctgcactcgcataa

SEQ ID NO: 23878 - protein, 219 aa, Unknown
  Obtained from environmental sample
  DOMAIN (2)...(213): alpha/beta hydrolase fold
  misc_feature (1)..(219): Xaa is any amino acid
MLILDLRGHGNSKPSLKDTFNSKYTFDSITEDIVEVIDFLKIEKSHFIGISLGTILIRNLAEKRPELVQSMIMGGAIIKMNFRSQVLMKVGNIFKSVVPYMLLYRLFAFIIMPNKSHKKSRSLFVNEAKKLYQKEFIRWFKLTSEINPLLRFFRTKDIKIPTLYIMGAEDHLFLPSIKNIVSKHKTSSLVVVDKCGHVVNVDQPAIFNNQTIQFISALA

SEQ ID NO: 23879 - DNA, 471 bp, Unknown
  Obtained from environmental sample
  misc_feature (1)..(471): n is a, c, g, or t
atgaaagaaattctatcctttatattatttacttcggtggctataaatattatagctcaggaaagagatttggattggaatatgattttagaaattgacgatgaaattgagctctcttacttaattaaggaaatcaaaatagttcaggaaagggagaatggagaaacaaaagaatatgaagcaaagtactttccaggtagtctgaagatccaaaattatgatccgcaattttttaatgagggtaaattacatttagtctttagttactttaggagcaattctcgtggaaattattatgtaaatgaatacaaaattaacttctataaatcatggttaaattttgattacgtaatatttgatatccacaatatggataaagaagaaaacagaaaaaggttccctaaacagcgtgataaagattacatatatggatacaaaatacctggtactatcttcacatgggaagagtaa

SEQ ID NO: 23880 - protein, 156 aa, Unknown
  Obtained from environmental sample
  SIGNAL (1)...(19)
  misc_feature (1)..(156): Xaa is any amino acid
MKEILSFILFTSVAINIIAQERDLDWNMILEIDDEIELSYLIKEIKIVQERENGETKEYEAKYFPGSLKIQNYDPQFFNEGKLHLVFSYFRSNSRGNYYVNEYKINFYKSWLNFDYVIFDIHNMDKEENRKRFPKQRDKDYIYGYKIPGTIFTWEE

SEQ ID NO: 23881 - DNA, 471 bp, Unknown
  Obtained from environmental sample
  misc_feature (1)..(471): n is a, c, g, or t
atgaaagaaattctatcctttatatattttacttcggtggctataaatattatagctcaggaaagagatttggattggaatatgattttagaaattgacgatgaaattgagctctcttacttaattaaggaaatcaaaatagttcaggaaagggagaatggagaaacaaaagaatatgaagcaaagtactttccaggtagtctgaagatccaaaattatgatccgcaattttttaatgagggtaaattacatttagtctttagttactttaggagcaattctcgtggaaattattatgtaaatgaatacaaaattaacttctataaatcatggttaaattttgattacgtaatatttgatatccacaatatggataaagaagaaaacagaaaaaggttccctaaacagcgtgataaagattacatatatggatacaaaatacctggtactatcttcacatgggaagagtaa

SEQ ID NO: 23882 - protein, 156 aa, Unknown
  Obtained from environmental sample
  misc_feature (1)..(156): Xaa is any amino acid
MKEILSFIYFTSVAINIIAQERDLDWNMILEIDDEIELSYLIKEIKIVQERENGETKEYEAKYFPGSLKIQNYDPQFFNEGKLHLVFSYFRSNSRGNYYVNEYKINFYKSWLNFDYVIFDIHNMDKEENRKRFPKQRDKDYIYGYKIPGTIFTWEE

SEQ ID NO: 23883 - DNA, 753 bp, Unknown
  Obtained from environmental sample
  misc_feature (1)..(753): n is a, c, g, or t
gtgcttttaaaaaaccgaaatctctacaagtatttaatgaagtatttaattaatagtacccaaaaagggattctaagtgctttgtttcttatgtttctctcttttgggtcgcaagcacaaattattcacattttagataaagattccaacgaacctgttgttggagttgctgtgtttaataaagataaaaccgtaaatgagattagcgattttaacgggaaagttactcttgatggcttttctacgggcgataaaatatactttaaacacttagcttatcagcttaaaaaaatagaaaaatcagcaattaaaaatgctattgttattcttgaaggaaataatgaggctttagacgaaattgttatttcggcgtctcggtttaagcagagcaaaaaggacatccccaataaaattataagctttaatgcgaaatctatagctttaagtaatccgcaaactagcgcagatgccttagaaaatacaggacaagtttatattcagaaaagtcagttaggcggaggaagcccgttaataagagggttttcaaccaatagattattaattactgtagatggtgtacgaatgaataacgctatctttagaggaggaaatcttcaaaatgtaattgcaatcgatcctttttcaattcaaaaaacagaagttattttaggagcagggtctattatttatggaagcgatgctattggcggcgttatgagtttttataccaaaaacgcaactctcttattctaa

SEQ ID NO: 23884 - protein, 250 aa, Unknown
  Obtained from environmental sample
  misc_feature (1)..(250): Xaa is any amino acid
MLLKNRNLYKYLMKYLINSTQKGILSALFLMFLSFGSQAQIIHILDKDSNEPVVGVAVFNKDKTVNEISDFNGKVTLDGFSTGDKIYFKHLAYQLKKIEKSAIKNAIVILEGNNEALDEIVISASRFKQSKKDIPNKIISFNAKSIALSNPQTSADALENTGQVYIQKSQLGGGSPLIRGFSTNRLLITVDGVRMNNAIFRGGNLQNVIAIDPFSIQKTEVILGAGSIIYGSDAIGGVMSFYTKNATLLF

SEQ ID NO: 23885 - DNA, 546 bp, Unknown
  Obtained from environmental sample
  misc_feature (1)..(546): n is a, c, g, or t
atgtttacaatttttataaataataatcctatttatttaacagatagtttagcattcaccaacagaaagaatttttttaagtttgatgaagttgatttgcagacgtttattaaaaaattggaaagagaagaaatcaattatctttatctttatgatgataatattcaactgctttttgaaaaattttgtagcagttttagaattatagaggcagctggaggcgtagtaaagaattcaaaaggagaaatattattcatttttcgaaatggtatctgggatttacccaaagggaaaattgaaaagaatgaaagtataaaagatgctgcattaagagaagtagaagaagagtgtggcattaaacaattaaaaatggataaattgattgatagaacataccatatctataaaatcaataatctacatattttaaaaattacgcattggtttttaatgcattctgattttcgaggtgaattttttccacaattagaagaaggaattaccagggttcaatgggtctctaggggaaacttaacaaaggtgtag

SEQ ID NO: 23886 - protein, 181 aa, Unknown
  Obtained from environmental sample
  DOMAIN (68)...(180): NUDIX domain
  misc_feature (1)..(181): Xaa is any amino acid
MFTIFINNNPIYLTDSLAFTNRKNFFKFDEVDLQTFIKKLEREEINYLYLYDDNIQLLFEKFCSSFRIIEAAGGVVKNSKGEILFIFRNGIWDLPKGKIEKNESIKDAALREVEEECGIKQLKMDKLIDRTYHIYKINNLHILKITHWFLMHSDFRGEFFPQLEEGITRVQWVSRGNLTKV

SEQ ID NO: 23887 - DNA, 780 bp, Unknown
  Obtained from environmental sample
  misc_feature (1)..(780): n is a, c, g, or t
ttgtttcgccatcaaatacctttaagttttggtgcaaatgtattactttttatcattattgaagtgctatatttgcaattatatatgaagatactcaaacttgatgccatagattctacaaattcttatttaaaggatttgataaaagatagtgatgtaaaaaactggactgtagttgtagctgaataccagacaaatggtaaagggcaattagataatagctggttttcagataaaggtaagaatctaacattcagtattttagttaaatttgatcatctaaaagttaaacatcaatgttatttaaattacagtatttcaatagccttatttaatgttttaaaatattatattcctaaaaaattatcggtcaaatggccgaacgacattttgtcagctaacaaaaaagttagtggaattttgattgaaaattccattaaaaatgatacagttaattatgccatcattggaataggtttaaacataaatcaagtaaattttcctaaagatgttttaaatgctacatctctaaaaaatgttttaaaaaagacagttgataaagatgagttgtttgacaaaatattattagagatccaatatcaattcgttttgatcaaacaaaagaagtttcttgaaattaaacagatgtatgaagaagtattgtataaaaaatctatcccatcaatgtttattgatagtgagaacaatacttttttaggaaaaattattggggttgggattgatggcaaattgcagattgaacttgaaaacgatctgtaa

SEQ ID NO: 23888 - protein, 259 aa, Unknown
  Obtained from environmental sample
  DOMAIN (33)...(168): Biotin/lipoate A/B protein ligase family
  misc_feature (1)..(259): Xaa is any amino acid
MFRHQIPLSFGANVLLFIIIEVLYLQLYMKILKLDAIDSTNSYLKDLIKDSDVKNWTVVVAEYQTNGKGQLDNSWFSDKGKNLTFSILVKFDHLKVKHQCYLNYSISIALFNVLKYYIPKKLSVKWPNDILSANKKVSGILIENSIKNDTVNYAIIGIGLNINQVNFPKDVLNATSLKNVLKKTVDKDELFDKILLEIQYQFVLIKQKKFLEIKQMYEEVLYKKSIPSMFIDSENNTFLGKIIGVGIDGKLQIELENDL

SEQ ID NO: 23889 - DNA, 333 bp, Unknown
  Obtained from environmental sample
  misc_feature (1)..(333): n is a, c, g, or t
ttgttggcttttgtttaccatcataaatatcatctacagttggtgcatacacattattttgtcagaaacgtctttaaaagagcaatatcgtcctctaaagttcgtggatattttgctaaatcgtcagcattatcaaatgnagtagggttaacaaaaatactaacaactaaccttgagttattagccaatccttcctttaccaatgacaaatgtccttggtgtaaagctcccatagtaggcacaaaaccaatagtttctccctcttgttttaaagaagaaatatgggcaccaattttagatttattagtaaatacaagcatttttaatatttaa

SEQ ID NO: 23890 - protein, 110 aa, Unknown
  Obtained from environmental sample
  misc_feature (1)..(110): Xaa is any amino acid
MLAFVYHHKYHLQLVHTHYFVRNVFKRAISSSKVRGYFAKSSALSNXVGLTKILTTNLELLANPSFTNDKCPWCKAPIVGTKPIVSPSCFKEEIWAPILDLLVNTSIFNI

SEQ ID NO: 23891 - DNA, 981 bp, Unknown
  Obtained from environmental sample
  misc_feature (1)..(981): n is a, c, g, or t
ttggatgagtataaagttcaaaatagaggaggacgaggtcaaaaaggtgtctctacaagaactgaagatttcttagagcatttatatgtggctacaaatcatcaatatatgttgttcttcacccaaaaaggtaaagttttctggatgcgcgtttatgaaataccagaaggtggtaaaacctcaaaaggtagagccattcaaaatttggtaaatattgaacctgatgataaggtgaaagcatttatttgcacgcaagatcttaaagatgaggactatgtaaataataattatgtgttaatggtaactaaaaaaggtcaaactaaaaagacttcattagaacaatactccagaccacgtactaacggtatcaatgcaattaccattaaagatgatgatgaattattggaagccaaattaactgacggaaatagccaaattatgataggcctaaaatcaggtaaggcaattcgttttgaagaggctaaaacaagacctatgggtagaaatgcttctggtgtacgaggaatttctttggcaaacgaaaatgatgaagtaatagggatgatttctgttaatgatatggaggatgatattttagttgtttctgagaaaggttatggtaaaagatcgagcttagacgcatatagaattactaatcgtggcggaaaaggtgtcaaaacaattaacgttactgagaaaactggtaatttagtgtctataaaaaatgtaactgacgaagatgacttaatgattatcaataaatcangaaatacaattagaatggcagttgcagatttacgtgtaatgggtagagctacacaaggagtaaagctttataatattaaagataatgattcaattgcagcggtagcggaagtaatggccgaaagagatgttgatgaaaacgaagttggcacggaaattggaaataatgatttccgaagaaacaacaaccatccaggaatatttatttatacctaa

SEQ ID NO: 23892 - protein, 326 aa, Unknown
  Obtained from environmental sample
  DOMAIN (143)...(193): DNA gyrase C-terminal domain, beta-propeller
  misc_feature (1)..(326): Xaa is any amino acid
MDEYKVQNRGGRGQKGVSTRTEDFLEHLYVATNHQYMLFFTQKGKVFWMRVYEIPEGGKTSKGRAIQNLVNIEPDDKVKAFICTQDLKDEDYVNNNYVLMVTKKGQTKKTSLEQYSRPRTNGINAITIKDDDELLEAKLTDGNSQIMIGLKSGKAIRFEEAKTRPMGRNASGVRGISLANENDEVIGMISVNDMEDDILVVSEKGYGKRSSLDAYRITNRGGKGVKTINVTEKTGNLVSIKNVTDEDDLMIINKSXNTIRMAVADLRVMGRATQGVKLYNIKDNDSIAAVAEVMAERDVDENEVGTEIGNNDFRRNNNHPGIFIYT

SEQ ID NO: 23893 - DNA, 669 bp, Unknown
  Obtained from environmental sample
  misc_feature (1)..(669): n is a, c, g, or t
atgagtttcatcaaaattaaaaatatgaaaaaaatagtaggtatttgtttgttacttagttcgtttataggacaatcgcaaacaacagtaactaaaaatttaggcgattataacgttttaaaagtttataatggtattgaattagagttgataaaatcttcagaagctaaacttgtaattacaggaaagaaatctgaaatggttaaaattaaaaatgtagataacactttaaaattatctttacctttctctttaaatcctgaagataatgcagcaaatggagaagttttagtaaaattatattacaatgctaatattgatgttattgatgctaatgaaaatgcaaccattacaggaaaagaaatagatcaagaaaaattagaggtaaattcgcaagaaagagcttttataaacctagttttaaaagttaaacatttagaagttagagcatcttctggaggaattattaaattatcaggtagtacaaaaaaccaaaatgtagatgtagatttatatggtatttataatggttttggtttaaaggcagattcaaattctactgtaaaagcaggtacaggagcaagagcagaagttttagcagaagaaactttagatgcaaaagttagttttggaggttctattttttataaaggaaacccagaagtgtaa

SEQ ID NO: 23894 - protein, 222 aa, Unknown
  Obtained from environmental sample
  misc_feature (1)..(222): Xaa is any amino acid
MSFIKIKNMKKIVGICLLLSSFIGQSQTTVTKNLGDYNVLKVYNGIELELIKSSEAKLVITGKKSEMVKIKNVDNTLKLSLPFSLNPEDNAANGEVLVKLYYNANIDVIDANENATITGKEIDQEKLEVNSQERAFINLVLKVKHLEVRASSGGIIKLSGSTKNQNVDVDLYGIYNGFGLKADSNSTVKAGTGARAEVLAEETLDAKVSFGGSIFYKGNPEV

SEQ ID NO: 23895 - DNA, 318 bp, Unknown
  Obtained from environmental sample
  misc_feature (1)..(318): n is a, c, g, or t
atgaaaaagaaaatccgcatctatctccttcctaaaaaagggttcttaactttattaaaagagcacttaaaactctccaaacttatttgccgacgcataataattcacaaagctaaaataatgaatgaaaagctttctatatttccgccagatcaccgtattttaaagctattaaatcattttaaaactgcggataataatcaaaataccacctacgaagtaaaacttaaccaacaacaaatttcagaattaaacagtctgcgcgttaaaactttaattagagctataaaaaaattagaaaagtctgataaaaattaa

SEQ ID NO: 23896 - protein, 105 aa, Unknown
  Obtained from environmental sample
  misc_feature (1)..(105): Xaa is any amino acid
MKKKIRIYLLPKKGFLTLLKEHLKLSKLICRRIIIHKAKIMNEKLSIFPPDHRILKLLNHFKTADNNQNTTYEVKLNQQQISELNSLRVKTLIRAIKKLEKSDKN

SEQ ID NO: 23897 - DNA, 471 bp, Unknown
  Obtained from environmental sample
  misc_feature (1)..(471): n is a, c, g, or t
atgaaaactcaaatcactttaattagcattttatttttatcaatctttaatgttttagcacaagaacaacaacaagaaattttaattgttggcaccatgcatactgttcctaaaattgtaaagaagagttacaaaccaatgttgcgttttgcaaaaaaatacaatcctgaagcaatttatgtggaatcgccaatggcaaatgatactatctcttgggaatatttaaaagaaggttggtctaaaaattatcaacgattttataagttatcagattctttgcagaaaaactttaattttaatcaaactaagtttaatgttttatcaaccaaaaatttaaaagatttaaatgctgatgagattgattatcttatcaatagttatggttacaaaagagataatggaaattttgaattgttatcttatattaaaaaacatgngcataaaaggagcaaaaaaaccaacaagacatga

SEQ ID NO: 23898 - protein, 156 aa, Unknown
  Obtained from environmental sample
  misc_feature (1)..(156): Xaa is any amino acid
MKTQITLISILFLSIFNVLAQEQQQEILIVGTMHTVPKIVKKSYKPMLRFAKKYNPEAIYVESPMANDTISWEYLKEGWSKNYQRFYKLSDSLQKNFNFNQTKFNVLSTKNLKDLNADEIDYLINSYGYKRDNGNFELLSYIKKHXHKRSKKTNKT

SEQ ID NO: 23899 - DNA, 447 bp, Unknown
  Obtained from environmental sample
  misc_feature (1)..(447): n is a, c, g, or t
ttggtgattactttatactggattaatcacatgagaattttcaaatacgttacaacagtagataccaaacttctatggtacaccatttttatgttgttctttattattttacttcctttttctactggtttttatgtaacaggatttaattatgtaggtccttttgtcttttactgttttaatctttctgcaattggtttatttaatttattgatcaatatatatgtacctaaaaaagaaaaaggcttaacaggaattagcccaactttagcaaaatattttaaatttagagctttaaatgcgttattagtttgggtaattgcaggtttattagcttttgtatttccttatacttctcgctttttattcattctattatttgtttttgaagttctattgacacgttattacaagaagaaattaaaaaaagaagaagcaattgcataa

SEQ ID NO: 23900 - protein, 148 aa, Unknown
  Obtained from environmental sample
  misc_feature (1)..(148): Xaa is any amino acid
MVITLYWINHMRIFKYVTTVDTKLLWYTIFMLFFIILLPFSTGFYVTGFNYVGPFVFYCFNLSAIGLFNLLINIYVPKKEKGLTGISPTLAKYFKFRALNALLVWVIAGLLAFVFPYTSRFLFILLFVFEVLLTRYYKKKLKKEEAIA

SEQ ID NO: 23901 - DNA, 861 bp, Unknown
  Obtained from environmental sample
  misc_feature (1)..(861): n is a, c, g, or t
ttggacacgtgttgcgggacagaatttgcaaaatatcgtgtgccattgaatgtgataacgatgaaaaaaattaggcttggaatctttgtagaagatgaaacattagaatggcacaagtttatgccattaaaatctctagtagatgaaggtatggttgaggtttgtattgctatccaacgaagtgcagaacaccaagctaatccctctcatatatctaaagttataccgtctatcaatcaaaagttattttctattctttctcgagctaaaaagactaccaagcgttattctattcatgatttagtccctaatggcaaaatgcctgtcattacatcaataccaagacagaataaatccactgatgaaattgaagactcagtgattaagagactgcaggcaacagatttagattacctgctgagtatggatttccaaaccttaatagggaaagcgctaggtgttacgaagcatggcattctcttacttcattatggtgatgaaaggatacagcgaggtgagcctgcgttgtattggcagtttgctgaacaatgggagaacagcgtcgtgacactgcaactattgagtaatgaccatgatgtacacaaagtggtaggtagaggttatggcactttgttttactgggactataatttgactgaggacaagttaaaaggggttgcagcatcagtactgtattggtacttccgtaaaaatgaaattggcgtcgaaagtgggaaatttattaatttaattaacgatcacacactttataaaacgcctccccagttaacagcagtacgacttttgcgaaattttctcaaaaactactggataaaaagttttataaaaatctttatctaa

SEQ ID NO: 23902 - protein, 286 aa, Unknown
  Obtained from environmental sample
  misc_feature (1)..(286): Xaa is any amino acid
MDTCCGTEFAKYRVPLNVITMKKIRLGIFVEDETLEWHKFMPLKSLVDEGMVEVCIAIQRSAEHQANPSHISKVIPSINQKLFSILSRAKKTTKRYSIHDLVPNGKMPVITSIPRQNKSTDEIEDSVIKRLQATDLDYLLSMDFQTLIGKALGVTKHGILLLHYGDERIQRGEPALYWQFAEQWENSVVTLQLLSNDHDVHKVVGRGYGTLFYWDYNLTEDKLKGVAASVLYWYFRKNEIGVESGKFINLINDHTLYKTPPQLTAVRLLRNFLKNYWIKSFIKIFI

SEQ ID NO: 23903 - DNA, 804 bp, Unknown
  Obtained from environmental sample
  misc_feature (1)..(804): n is a, c, g, or t
atgtctgtaaaagcaaaaaaacatttaggtcagcattttttaacagatgaaaccattgcaaaagatattgcagatgctttaacagaagttggttataaccatgtgttagaaattggtcctggaatgggtgttttaacaaaatacatcttacagaaaaaaccaaaagttactgtttttgaacttgatagagaatcagtagcgtatttaaaagatgtgtttccaattgaaaacatcaatctaaatacaaccaaagaaaaatttgaaattattgaaggcgattttttaaagaaagatattcaagaaatttttaataaagagcaagtagctattattggtaattttccctataatatttctacacaaattgtttttaaagcgatagaaaacagagaatttgttcctgaatttgcaggcatgtttcaaaaagaagttgctatgcgaattgcagaaaaagaaggttctaaagtgtatggaattctttctgttttaacacaagctttttttgatgttgaatatctttttacagtaccaccaactgtttttaatccaccacctaaagtagattctggtgtaattcgtttcatcagaaaaaaagattattcattacctgttgatgaaaaactattttttagagttgtaaaaacggcctttaatcaacgtagaaaaatgttacgttctagtttaaaatctttcaatctttcggattctttaaaagaagaacctatctttgcgaaacgaccagaacaactatcagttcaagagtttatttcactcacgcaaaaactagcaaataatgccatttga

SEQ ID NO: 23904 - protein, 267 aa, Unknown
  Obtained from environmental sample
  DOMAIN (2)...(260): Ribosomal RNA adenine dimethylase
  misc_feature (1)..(267): Xaa is any amino acid
MSVKAKKHLGQHFLTDETIAKDIADALTEVGYNHVLEIGPGMGVLTKYILQKKPKVTVFELDRESVAYLKDVFPIENINLNTTKEKFEIIEGDFLKKDIQEIFNKEQVAIIGNFPYNISTQIVFKAIENREFVPEFAGMFQKEVAMRIAEKEGSKVYGILSVLTQAFFDVEYLFTVPPTVFNPPPKVDSGVIRFIRKKDYSLPVDEKLFFRVVKTAFNQRRKMLRSSLKSFNLSDSLKEEPIFAKRPEQLSVQEFISLTQKLANNAI

SEQ ID NO: 23905 - DNA, 621 bp, Unknown
  Obtained from environmental sample
  misc_feature (1)..(621): n is a, c, g, or t
ttgaacccagatatggtaatttgtaatatggatcctaaagttaaccttaatttcgaaattactatcgaaaagggtagaggatatgttccagctgaagaaaataaaaaaccaggagctccttttggaaccatatttatagattcaatttacacacctattaaaaatgttaagtatagcattgaaaattttcgtgtagaacaaaaaactgattatgaaaaattagttttcgaaattgtaacagacggttcaatcaaccctaaagatgcgttaacagaagctgcaaaaacgctaatccatcactttatgttatttagtgatgaacgtattacgttagaagcagatgaaatagcgcaaacagaaacgtatgatgaagaatctcttcatatgcgtcaattgttaaaaactaaattgatcgatatggatctatcagttagagctttaaattgtttaaaggctgctgaagttgataccttaggtgatttggtttcgtttaacaaaaacgatttaatgaaatttagaaacttcggaaaaaaatcacttacagaactagaagaattagttgatgttaaggggttaaacttcggaatggatcttgcgaaatataagttagataaagattaa

SEQ ID NO: 23906 - protein, 206 aa, Unknown
  Obtained from environmental sample
  DOMAIN (14)...(106): RNA polymerase Rpb3/Rpb11 dimerisation domain
  misc_feature (1)..(206): Xaa is any amino acid
MNPDMVICNMDPKVNLNFEITIEKGRGYVPAEENKKPGAPFGTIFIDSIYTPIKNVKYSIENFRVEQKTDYEKLVFEIVTDGSINPKDALTEAAKTLIHHFMLFSDERITLEADEIAQTETYDEESLHMRQLLKTKLIDMDLSVRALNCLKAAEVDTLGDLVSFNKNDLMKFRNFGKKSLTELEELVDVKGLNFGMDLAKYKLDKD

SEQ ID NO: 23907 - DNA, 660 bp, Unknown
  Obtained from environmental sample
  misc_feature (1)..(660): n is a, c, g, or t
atgaaagtatatccaataaaattcaatccaatattaaaagaaaaaatttggggaggaaacaaactaggaactttattaggtaaaaacactgctaaagataatgttggcgaaagttgggagatttctgatgtaaatggaaatatttctgaagttagtaatggtgtatacaaagggtctagtttaaaacaactaattgcaacacatcaagcagatttgttaggtgcaaataactttgcaaattttggatttgattttccattgctaattaaatttttagatgccaaaacagatttgtctgtacaagtgcatcctgataataaaatggctaaaaagcatcataatagttttggtaaaactgaaatgtggtacataatggatagtgatgaaaatgcagatattgtattaggattaaaagataaaacaataaacccagaggtattaaaccatataaatgcaaataatgtggatgctatttttaacagagaacaagttaaaaaaggcgatagtttttttataccagcaggaaaaatacatgctattggagcaggtgttttagctgcagagatacaacaaacttcagatgttacatatcgcgtatatgattgggatagagtagatgataatggtccaaaaagagaggtgcatactaagttaggctga

SEQ ID NO: 23908 - protein, 219 aa, Unknown
  Obtained from environmental sample
  DOMAIN (7)...(219): Phosphomannose isomerase type I
  misc_feature (1)..(219): Xaa is any amino acid
MKVYPIKFNPILKEKIWGGNKLGTLLGKNTAKDNVGESWEISDVNGNISEVSNGVYKGSSLKQLIATHQADLLGANNFANFGFDFPLLIKFLDAKTDLSVQVHPDNKMAKKHHNSFGKTEMWYIMDSDENADIVLGLKDKTINPEVLNHINANNVDAIFNREQVKKGDSFFIPAGKIHAIGAGVLAAEIQQTSDVTYRVYDWDRVDDNGPKREVHTKLG

SEQ ID NO: 23909 - DNA, 471 bp, Unknown
  Obtained from environmental sample
  misc_feature (1)..(471): n is a, c, g, or t
atgaaaataatctgtattgggcgcaattacgcaaagcatattgaagaattagcgaatgaaaaaccagaaaatcctgttgtttttttgaagccagattctgcaattttaccgagaaaaaatccattttttattccgcctttttctgatgatgttcattatgaagtagaggttttaataaaaattaataaagtgggtaaacatattgatgtcaagtttgcacataaatattatgatgaaattggtttaggaatcgattttactgcaagagatgtacaacagcaatgtaaagaaaaaggtttgccttgggaaaaagctaaagcttttgatggtagtgcagttgttggtgaattttatccgaaggaaaactttgatttggatactttaaagtttcaactgtttaagaatgatgaattagttcaggatggaaatacgaatgctatgttgtggaaaacagatctcgagccgatctga

SEQ ID NO: 23910 - protein, 156 aa, Unknown
  Obtained from environmental sample
  DOMAIN (18)...(155): Fumarylacetoacetate (FAA) hydrolase family
  misc_feature (1)..(156): Xaa is any amino acid
MKIICIGRNYAKHIEELANEKPENPVVFLKPDSAILPRKNPFFIPPFSDDVHYEVEVLIKINKVGKHIDVKFAHKYYDEIGLGIDFTARDVQQQCKEKGLPWEKAKAFDGSAVVGEFYPKENFDLDTLKFQLFKNDELVQDGNTNAMLWKTDLEPI

SEQ ID NO: 23911 - DNA, 504 bp, Unknown
  Obtained from environmental sample
  misc_feature (1)..(504): n is a, c, g, or t
atgccaagcaatcaagacgtagcatctaaactcagagaagtttttcaactgatgcaattagccggggaaaaccggttcaaagccatcgcttttgataaagcggcgctaaccgtagatggaatgagtgatgatattaacgagtatatcagcaataaaaacctcattgatatcaagggtatagggaaatctattgcagaagatatctacgtttatgctgaaacaggaaaaatgccagtgctcgaagcctttcgcgaaaaaattccacccggattattaaagtggacagagatctcaggcttgggaccgaagaacattctgaaaattcatgagacttttagtatcacagaaattgaagagcttaaggtattaattgaaaacggagaacttgcgaaacttccaggacttggcgggaagtcagcagaaaaaatcaaaaaatcccttgagtggatggagaaatataatgaacgatgcccattggacgaagcacaaaaaaacccccgatga

SEQ ID NO: 23912 - protein, 167 aa, Unknown
  Obtained from environmental sample
  misc_feature (1)..(167): Xaa is any amino acid
MPSNQDVASKLREVFQLMQLAGENRFKAIAFDKAALTVDGMSDDINEYISNKNLIDIKGIGKSIAEDIYVYAETGKMPVLEAFREKIPPGLLKWTEISGLGPKNILKIHETFSITEIEELKVLIENGELAKLPGLGGKSAEKIKKSLEWMEKYNERCPLDEAQKNPR

SEQ ID NO: 23913 - DNA, 420 bp, Unknown
  Obtained from environmental sample
  misc_feature (1)..(420): n is a, c, g, or t
atgaaaaagagtatcattattgtaatcgtattaatctttggtttttcagtaaacgcacaagatattttaggaaaatggaaaaccattgatgacgaaactggagaggctaagtccattgttcagatttacaaaaaagacggaaaggtttttggtaaaattatcgagatttttaataaagaaagacgtgacttaccttgcgtaaagtgtaaaggtgacgattataataaaccaattttaggtttagatattattaaaagtatgaccaaagatggtaaatactttaaaaacggaactatcgtagatccgcaaaatggtaaagagtacgatttaagactaatcgtaacagatgaaggtaaacttcaggttagaggctatattggttttttctactcgacacaatattgggaaagaatacaataa

SEQ ID NO: 23914 - protein, 139 aa, Unknown
  Obtained from environmental sample
  SIGNAL (1)...(19)
  misc_feature (1)..(139): Xaa is any amino acid
MKKSIIIVIVLIFGFSVNAQDILGKWKTIDDETGEAKSIVQIYKKDGKVFGKIIEIFNKERRDLPCVKCKGDDYNKPILGLDIIKSMTKDGKYFKNGTIVDPQNGKEYDLRLIVTDEGKLQVRGYIGFFYSTQYWERIQ

SEQ ID NO: 23915 - DNA, 771 bp, Unknown
  Obtained from environmental sample
  misc_feature (1)..(771): n is a, c, g, or t
atgaaaaatttaaaagcagaaattccacattgggattttgaaaaaaccaaagccgaaacgcagcaaaaatggaataaagaactttcaaaaattgaagtgaaatccatcaccccagaagataaaatcactttttacaccgcgctttatcacaccatgctcagcccaattatgtatgaagatgtggatgggcaataccgcggtttggaccaaaacattcatacatcggatggatttacgaattataccattttttcgctttgggatacgtatcgcgcattgcatccgcttttcaacataatacatccgcagcgaaataacgatatgataaaaagtatgctcgcccatcacgaccaaagtgtgcataaaatgctgcccatttggagccattatgccaacgaaaactggtgtatgattggttatcacgccacatcggtaattgcagatgcagtggcgaaaaacgtgggcgatttcgataaaaaccacgctttggaagcttccataaacaccgctaatgttgattattttgacggcattggcgattataaaaaaatgggtttcgttccggaagacaaaagcaattcttcagtttcaaaaactttggaatatgcttatgacgattggtgcattgcgcagattgcgaaaaatgttgataatgccgaaactgaaaaggaatttttggaacgttcggaatatttcaaaaatgtttacgatcccaaaattggttatatgcgaccaanacttttccgatggaaaaatcagaaaggaatttga

SEQ ID NO: 23916 - protein, 256 aa, Unknown
  Obtained from environmental sample
  misc_feature (1)..(256): Xaa is any amino acid
MKNLKAEIPHWDFEKTKAETQQKWNKELSKIEVKSITPEDKITFYTALYHTMLSPIMYEDVDGQYRGLDQNIHTSDGFTNYTIFSLWDTYRALHPLFNIIHPQRNNDMIKSMLAHHDQSVHKMLPIWSHYANENWCMIGYHATSVIADAVAKNVGDFDKNHALEASINTANVDYFDGIGDYKKMGFVPEDKSNSSVSKTLEYAYDDWCIAQIAKNVDNAETEKEFLERSEYFKNVYDPKIGYMRPXLFRWKNQKGI

SEQ ID NO: 23917 - DNA, 672 bp, Unknown
  Obtained from environmental sample
  misc_feature (1)..(672): n is a, c, g, or t
atgatacataaagctggttttgtaaatattataggaaatcctaatgtaggtaaatctactttgatgaatgctttggtgggggaaaagctctccataataacgccaaaagcacaaacaacaagacatcgaattcttggaattgttaatgaagacaactatcaagtggtgttttctgatactccaggaattataaaacctgcctatgaattgcaatcttctatgatggattttgtgaaatctgcttttgaagatgctgatattcttatttatatggttgaaataggggaggtggagttaaaaaacgaagctttttttaaaagaattatccatagtgaaatccctattattcttttattgaacaaaattgataaatcttctcaagaagaagttgagcaaaaaattgaatattggagaactaaagtgccgaatgcagaagtttttgttatttctgctttagaaggttttggagtttctgctgtttttgaaaaaataaaagaacttttacctgaaggacctgcattttatcctaaagatcaattaacagataaacccgaacgtttctttgttaatgaaaaaattagagaaaaaattctaatgcattataaaaaagaaattccgtattctgtagaagttgaaaacggaggagtttgtagaagaagaaaatattgntag

SEQ ID NO: 23918 - protein, 223 aa, Unknown
  Obtained from environmental sample
  misc_feature (1)..(223): Xaa is any amino acid
MIHKAGFVNIIGNPNVGKSTLMNALVGEKLSIITPKAQTTRHRILGIVNEDNYQVVFSDTPGIIKPAYELQSSMMDFVKSAFEDADILIYMVEIGEVELKNEAFFKRIIHSEIPIILLLNKIDKSSQEEVEQKIEYWRTKVPNAEVFVISALEGFGVSAVFEKIKELLPEGPAFYPKDQLTDKPERFFVNEKIREKILMHYKKEIPYSVEVENGGVCRRRKYX

SEQ ID NO: 23919 - DNA, 801 bp, Unknown
  Obtained from environmental sample
  misc_feature (1)..(801): n is a, c, g, or t
atgaaagcatttaaatacatcttattcttactacttatcggttttattggcgcgtccatatatattgcagttcagcccaatgaatttaaatttagtagaagtaaaattataaaagcaccaactccagtagtatttgatatcgtaaacgattataaacaatggcctcgattttcaccttggatagagcaagataccgctgcaacgttaacatataacgaaaaaacggtaggtatagatgccggttacgcgtggaatggtgagattttaggtgttggaaatgcaaaaactttaagcctaacggaaaataaaaccattactcaagacatagaatttatagaaccttttaaatctacttctgaaattaattgggattttgaaactacagaagaaggtacaaaagtaacttggaccatgtctggaattcaagatttcaaaacaaaagcttacaccatttttggaggatcaattgaagcacaaactgcctcagattttgaaagaggtttatataaattagatagtattgcggttactgatattcaaaaatataatgtaaaagtaaatggtgttacaaaacgtagcggcggattttacttatacaaaacggtttcttgtanaatgaacgagctaagtagcaaaatggcaaccttactacccgaagtaggaagttatgccatttcaaaacatgtgacatttgctggacctccatttgtgtattatcataaatgggatgagaaaattatgccgggatattttccgcatggtatcctaacacttcctcaatttttactggcgaaaataacc

SEQ ID NO: 23920 - protein, 267 aa, Unknown
  Obtained from environmental sample
  misc_feature (1)..(267): Xaa is any amino acid
MKAFKYILFLLLIGFIGASIYIAVQPNEFKFSRSKIIKAPTPVVFDIVNDYKQWPRFSPWIEQDTAATLTYNEKTVGIDAGYAWNGEILGVGNAKTLSLTENKTITQDIEFIEPFKSTSEINWDFETTEEGTKVTWTMSGIQDFKTKAYTIFGGSIEAQTASDFERGLYKLDSIAVTDIQKYNVKVNGVTKRSGGFYLYKTVSCXMNELSSKMATLLPEVGSYAISKHVTFAGPPFVYYHKWDEKIMPGYFPHGILTLPQFLLAKIT

SEQ ID NO: 23921 - DNA, 846 bp, Unknown
  Obtained from environmental sample
  misc_feature (1)..(846): n is a, c, g, or t
gtggtggttgcaaccattgtttttggtatgggaattgacaaaccagatgtgcgttttgtaattcatcatgacattcctaaaagtttagaaagttattatcaagaaactggtagagcaggtagagatgatggagaaggatattgtttagctttttatgcctataaagacatagaaaagttagagaaatttatggcaagcaaaccaattgctgaacaagaaattgggcatgcattgttgcaagaagttgttggttatgcagaaacttctatgaacagacgtaaatatttactgcattattttggtgaagattttgatgaagtaaatggccttggagcagatatggatgataactccagaaatccgaagaaaaaacatgaagctaaagacaatgttgtagttttattaaaagtagtaagagacacacttcaaaaatataaagcgaaagaagttgtaaatactattataggtaaagaaaatgccttattaacatctcataaaactcatttacaaccttattttggtattggtaaagataagaatgctggttattggatggcgttaattcgtcaggttttggtcgtaaattttatcaaaaaagaaatagaacaatatggagttataaaattaacgaaagaaggagaaaattttattaaaaaccctacttctttcttaatgacagaagatcatatatataatgaagaaaatgatcaagctattgttaccaatgcaaaatcgtctggtggagttgctgatgagaaattagtgagtttattaaaaggtttacgtaaaaaagtagcaattaaacaaggagtgccaccatttgccgtttttcaagatccgtcttag

SEQ ID NO: 23922 - protein, 281 aa, Unknown
  Obtained from environmental sample
  DOMAIN (1)...(43): Helicase conserved C-terminal domain
  misc_feature (1)..(281): Xaa is any amino acid
MVVATIVFGMGIDKPDVRFVIHHDIPKSLESYYQETGRAGRDDGEGYCLAFYAYKDIEKLEKFMASKPIAEQEIGHALLQEVVGYAETSMNRRKYLLHYFGEDFDEVNGLGADMDDNSRNPKKKHEAKDNVVVLLKVVRDTLQKYKAKEVVNTIIGKENALLTSHKTHLQPYFGIGKDKNAGYWMALIRQVLVVNFIKKEIEQYGVIKLTKEGENFIKNPTSFLMTEDHIYNEENDQAIVTNAKSSGGVADEKLVSLLKGLRKKVAIKQGVPPFAVFQDPS

SEQ ID NO: 23923 - DNA, 729 bp, Unknown
  Obtained from environmental sample
  misc_feature (1)..(729): n is a, c, g, or t
gtgaagtttacatcaaaagaagggaaacaggattatgtatgggcaacatcttggggagtgtctactagattaatgggagcattaataatgacgcatagtgatgatcatggtttagtcttacctccaaatttagcgcctaatcaagtagttattgttcctatatataagactgacgaacaattagaagctattaccgaagtggtaaatggcataatgaaagacctaaggagtaaaaacatttctgttaagtttgataatagagacacgcatagacctggagctaagtttgcacagcatgaattacaaggtgtgcctttaagaatagcaataggatcaagagatctagaaaatggaacagtggagcttgctagacgtgatacattaactaaagaggttgttgcattggatggtttaatttataaggttgaaggattaatgatagaaatacaagacactttatttaataaagctaaaacttacagagataatcacatcacagaagtagatacttttgaggaatttaaaaaagttttagaagaaaagggtggatttatctctgcgcattgggatggaactgcagaaactgaagataaaattaaagaaattaccaaagctacgattagatgtatgcctttagaaggaaaaattgaaaaaggaatttgtgtgcttactggcagagaatcagcacgtcgcgtattgtttgcaaaaggcgtattaatttttttttaa

SEQ ID NO: 23924 - protein, 242 aa, Unknown
  Obtained from environmental sample
  DOMAIN (48)...(145): Anticodon binding domain
  misc_feature (1)..(242): Xaa is any amino acid
MKFTSKEGKQDYVWATSWGVSTRLMGALIMTHSDDHGLVLPPNLAPNQVVIVPIYKTDEQLEAITEVVNGIMKDLRSKNISVKFDNRDTHRPGAKFAQHELQGVPLRIAIGSRDLENGTVELARRDTLTKEVVALDGLIYKVEGLMIEIQDTLFNKAKTYRDNHITEVDTFEEFKKVLEEKGGFISAHWDGTAETEDKIKEITKATIRCMPLEGKIEKGICVLTGRESARRVLFAKGVLIFF

SEQ ID NO: 23925 - DNA, 366 bp, Unknown
  Obtained from environmental sample
  misc_feature (1)..(366): n is a, c, g, or t
atgatagttactgctaaacaagatgaaagaattgctaaaatgacttttgcttccgtatatccacattatgtaactaaagtagaaaaaaaaggacgtaaaattgaggaattacatcaagtcatccagtggttgacaggctacaattttaaaacaattgaaaccttaattgacaaaaaagtatcatttaaaaccttttttgaagaggcgacacttaacccaaatgctaaccttattaaaggtgtaatttgtggttatcgtattgaggacataacgtttcctttaacacagcaagtaaggtacttagataaattggtcgatgaattggctagaggtcgtaaaatggataaaattttaagacagaattga

SEQ ID NO: 23926 - protein, 121 aa, Unknown
  Obtained from environmental sample
  misc_feature (1)..(121): Xaa is any amino acid
MIVTAKQDERIAKMTFASVYPHYVTKVEKKGRKIEELHQVIQWLTGYNFKTIETLIDKKVSFKTFFEEATLNPNANLIKGVICGYRIEDITFPLTQQVRYLDKLVDELARGRKMDKILRQN

SEQ ID NO: 23927 - DNA, 309 bp, Unknown
  Obtained from environmental sample
  misc_feature (1)..(309): n is a, c, g, or t
gtgaatatatcagctacatacttaattgagttgggctataagtcaatgaaatttctacttaaaaaagctaaaccacaaacaagaattacaataattcaggagcaatcaaatcttacagatgcttttggaagaacattagcatatatcattttgcctaatggcaaaacgcttaatgaaataatggtcagaagaggttatgcaaagccatacaacaaggtattttgtgaagagttaccaaagtaccaatcacttaatttgaaggctaaaacaaagaaaaaaggtttatattcgcttatcaattcgttctaa

SEQ ID NO: 23928 - protein, 102 aa, Unknown
  Obtained from environmental sample
  DOMAIN (3)...(98): Staphylococcal nuclease homologue
  misc_feature (1)..(102): Xaa is any amino acid
MNISATYLIELGYKSMKFLLKKAKPQTRITIIQEQSNLTDAFGRTLAYIILPNGKTLNEIMVRRGYAKPYNKVFCEELPKYQSLNLKAKTKKKGLYSLINSF

SEQ ID NO: 23929 - DNA, 357 bp, Unknown
  Obtained from environmental sample
  misc_feature (1)..(357): n is a, c, g, or t
atgacaaaattcactctcaaaacttacagaccatcagccgaaactgaaaagccacatttctacattctgaacaaagggatgaacagcggaaaaccactaaaacaaccttgtccgaattgcttcattttgatagcacccacagaagaagccaaagagcagttatactggctatgttttgggctatggcgtgcaaaatcctttcattactatttaaaaggttcagttataccattcatcacaaaaaacgaccttaaacaaggcattttaaacggatttgaacagcaaatagtgatattcctattttcaaaagtcagtcaaagccttacagcttttagaagaacaagaaaaggtttataa

SEQ ID NO: 23930 - protein, 118 aa, Unknown
  Obtained from environmental sample
  misc_feature (1)..(118): Xaa is any amino acid
MTKFTLKTYRPSAETEKPHFYILNKGMNSGKPLKQPCPNCFILIAPTEEAKEQLYWLCFGLWRAKSFHYYLKGSVIPFITKNDLKQGILNGFEQQIVIFLFSKVSQSLTAFRRTRKGL

SEQ ID NO: 23931 - DNA, 312 bp, Unknown
  Obtained from environmental sample
  misc_feature (1)..(312): n is a, c, g, or t
atgcccgtttttaaagaagaaacgtttggccctgttgctgctatcattaaagtaaaatcagaagacgaagcctataaaacagcttcaaattcaaaattcggattaggtacaatggtttttacttcagattatgaggaggcatcaagatggatctcagaaattgaagatggtggattttttattaatgacatggtaaaatctgatcctagattaccttttggtggtacaaaaatttcaggttttggtcgtgaattatctaaagaaggtatgctagcttttgtaaatagaaaaaccgtatatattaacaagtaa

SEQ ID NO: 23932 - protein, 103 aa, Unknown
  Obtained from environmental sample
  misc_feature (1)..(103): Xaa is any amino acid
MPVFKEETFGPVAAIIKVKSEDEAYKTASNSKFGLGTMVFTSDYEEASRWISEIEDGGFFINDMVKSDPRLPFGGTKISGFGRELSKEGMLAFVNRKTVYINK

SEQ ID NO: 23933 - DNA, 831 bp, Unknown
  Obtained from environmental sample
  misc_feature (1)..(831): n is a, c, g, or t
ttgaacaatacaaactacattatgaaaacgagcattaaaacatacaatccatttagtggaaatcaactagaaacttacgaactagacactaaattaaagttaaacaagaaattagaactagcggatgaaactttcaaaacttggaaacagtttgaaatcgatgaacgcgtagaattattacagaatcttgccaacgagttattcaataataaacataaacttagtaagcttgtaactgaagaaatgggtaagcctattcttgaaagtaaagctgaaattgaaaaatgtatttatcttattgacttctacacaaaaaatgcagaacaatttcttcaagacgacctcattgaaaccgaagcacacgaaagttttattagttatgatccattaggttgcattcttgcaattatgccttggaactatccattctggcaagtatttagatttgcaataccaactttaacttctggaaatgtcgcacttttaaaacacgcctctaatgttacaggctgtgccgttgcaatagagaaactatttatagacgcaggctttcctaaaggttgttttcaaacactcatcacagaccatgagaatgttgaaaatattataagtaacgatattattaaagcggtatcattaacaggaagcgaaaaagcaggacgaaaaatagctgaactcgctggcaaaaacttaaaactttctcttttagaattaggtggaaataacgcaggtattattttaaatgatgccgatttagacccacccataaataccctttgtaaaagccggaatgcaaaactctggtccaaagttgtttgccgcctaaaccat

SEQ ID NO: 23934 - protein, 277 aa, Unknown
  Obtained from environmental sample
  DOMAIN (7)...(275): Aldehyde dehydrogenase family
  misc_feature (1)..(277): Xaa is any amino acid
MNNTNYIMKTSIKTYNPFSGNQLETYELDTKLKLNKKLELADETFKTWKQFEIDERVELLQNLANELFNNKHKLSKLVTEEMGKPILESKAEIEKCIYLIDFYTKNAEQFLQDDLIETEAHESFISYDPLGCILAIMPWNYPFWQVFRFAIPTLTSGNVALLKHASNVTGCAVAIEKLFIDAGFPKGCFQTLITDHENVENIISNDIIKAVSLTGSEKAGRKIAELAGKNLKLSLLELGGNNAGIILNDADLDPPINTLCKSRNAKLWSKVVCRLNH

SEQ ID NO: 23935 - DNA, 525 bp, Unknown
  Obtained from environmental sample
  misc_feature (1)..(525): n is a, c, g, or t
ttgtttaacttaggggcaaatgaatttaccattaaaactgaagatgatggcaatagttacacataccttaaaacgccagaatcatataattttcacttaggttatattaaaaattactttcaaactttgaataataaattaactgacaatgaaagtttaaaaataagagatgaaattaaaaataaggacaagttaaaagagttaaaatcaaaaacactttatgtcccaaattggttattaaaagattatagtgcttttaaattaaaagtaactaaagtcctaaaacctgaagaattatttgaagattataaatatgactttaaagttctttcaaatgaagaattaaattcaaaaattttaaacaaagatgaattctattatttaatgcacactacatataatggagaaaaagtcatatcaattattaacagtctgacaggtgtaataatttattcaatagttgataattccagtaatcttatcgaaaaatctgatttgaaggatattaataagttaattaagtaa

SEQ ID NO: 23936 - protein, 174 aa, Unknown
  Obtained from environmental sample
  misc_feature (1)..(174): Xaa is any amino acid
MFNLGANEFTIKTEDDGNSYTYLKTPESYNFHLGYIKNYFQTLNNKLTDNESLKIRDEIKNKDKLKELKSKTLYVPNWLLKDYSAFKLKVTKVLKPEELFEDYKYDFKVLSNEELNSKILNKDEFYYLMHTTYNGEKVISIINSLTGVIIYSIVDNSSNLIEKSDLKDINKLIK

SEQ ID NO: 23937 - DNA, 345 bp, Unknown
  Obtained from environmental sample
  misc_feature (1)..(345): n is a, c, g, or t
atgaaaaaaacaattttactcatcacttgcctattatctatttttagtatttattcccaagtcaatattggaagaaaaagaggacttggaaatttatatgttgtggaacataatgacaaactttatgatattataaaaaaaacgacgactcactttgttgttcctgatggtttagatttcaatgagacaaaaaaaaccattgaagaaatttggacatttaatagtatccagtttatatctgaagttgattatcaaaaaaacgaattaatttcaacagacaattctataatcaaatttcaggacaagaattacctcaaaactaaagaaacaattgggagccaatga

SEQ ID NO: 23938 - protein, 114 aa, Unknown
  Obtained from environmental sample
  SIGNAL (1)...(19)
  misc_feature (1)..(114): Xaa is any amino acid
MKKTILLITCLLSIFSIYSQVNIGRKRGLGNLYVVEHNDKLYDIIKKTTTHFVVPDGLDFNETKKTIEEIWTFNSIQFISEVDYQKNELISTDNSIIKFQDKNYLKTKETIGSQ

SEQ ID NO: 23939 - DNA, 708 bp, Unknown
  Obtained from environmental sample
  misc_feature (1)..(708): n is a, c, g, or t
atggcttggttatttatctttttataccatgtatttaatgtgtttgtaacctctaaatttatgggtaaagaatgggaagatcaacagttagccaaacttgtaaataaacaaaacgttagaatagaaaaacttaaactacaagttgaaaaagaagatctaaccattgctaaaagtgaagtttttaataaacaacaaactaaagctataaacaatctaaccatgattgttgctgctggcgaaaataatgaaattggtaaaaacaacgaccttatatggcatttacgcgacgatttaaaacgttttaaggccttaacttctagtcactacattattatgggtcgcaaaacgtttgagagctttccaaagccactaccaaatcgtactcatatagtaatatctaggcaatctaattataaagcacctgaaggtattatagttgttggtagtatagaagaagctattaacttagctaaaaatgattcgcaaccctttgtaattggtggaggagaaatttataaactagccatgccttatgcatccaaaattgaattaactcgtgtacattctaattttgatgcagacaccttttttcctgaaattgataggacacaatggaaagaaaccgcaaacacctttcataaaaaagatgaaaatcatgaatttgaattttcctttttaactttccaagagagtgtaatcaacttttaa

SEQ ID NO: 23940 - protein, 235 aa, Unknown
  Obtained from environmental sample
  DOMAIN (71)...(230): Dihydrofolate reductase
  misc_feature (1)..(235): Xaa is any amino acid
MAWLFIFLYHVFNVFVTSKFMGKEWEDQQLAKLVNKQNVRIEKLKLQVEKEDLTIAKSEVFNKQQTKAINNLTMIVAAGENNEIGKNNDLIWHLRDDLKRFKALTSSHYIIMGRKTFESFPKPLPNRTHIVISRQSNYKAPEGIIVVGSIEEAINLAKNDSQPFVIGGGEIYKLAMPYASKIELTRVHSNFDADTFFPEIDRTQWKETANTFHKKDENHEFEFSFLTFQESVINF

SEQ ID NO: 23941 - DNA, 726 bp, Unknown
  Obtained from environmental sample
  misc_feature (1)..(726): n is a, c, g, or t
atgaagtatatttatttatgtttatttttattttcaagttttacatttagccaatctaaacctgaatataatcgcgaaaaagcaatatttcctggttgccagagtgcagaggatttagagttatgttttgaagataaggttttacaattcatagattcttcattaacaaaaagtataaaaactaaaataatccgttattcaaaaaaagatacactagacctatctgccaatttattttttaacgaagaaggagatttaataaaaaaaatgtctggatttcatatttatatggacagtttaaaaaatgaattaaattatcttgaggatagttttcccaaagtattacctatattagacaaatatgataatggagttgccgattataaaaacctactcttaggttttaaaattaatagagcagatagtaccattataccaataaaaaactacatacctaaagatgttccgttttctctagtagaacaagtacctgtatatccaggttgcgctccaagtttaccccaagaagcagcaagaaaatgtatgagcaatgctattggcagacatgtgctacaaaattttaatactaacttagcatctacacttaatttgccttctggagttatcagaatatatgttggttttaagatagacaaagacgccaaagttgtaaacatcctaactagagcgccccatcctgctttagaaaaagagccaaaagagtaa

SEQ ID NO: 23942 - protein, 241 aa, Unknown
  Obtained from environmental sample
  SIGNAL (1)...(17)
  misc_feature (1)..(241): Xaa is any amino acid
MKYIYLCLFLFSSFTFSQSKPEYNREKAIFPGCQSAEDLELCFEDKVLQFIDSSLTKSIKTKIIRYSKKDTLDLSANLFFNEEGDLIKKMSGFHIYMDSLKNELNYLEDSFPKVLPILDKYDNGVADYKNLLLGFKINRADSTIIPIKNYIPKDVPFSLVEQVPVYPGCAPSLPQEAARKCMSNAIGRHVLQNFNTNLASTLNLPSGVIRIYVGFKIDKDAKVVNILTRAPHPALEKEPKE

SEQ ID NO: 23943 - DNA, 672 bp, Unknown
  Obtained from environmental sample
  misc_feature (1)..(672): n is a, c, g, or t
atgttaccattaagtatatttttgactaaacgcgctactcaggatagaggtatttttgaattcgatcatattacagttcctattaaaaattggtacaatgccaaatttggtaaaactaaaattacagctgatacattaagctctgatacaatctatctaccagaaactgaaaaagctagctataaaacattatcaacacttagtattactttttacataattagtgttgctctatttattttatactttgtatttaaaaacaacaaattaccagttgtagctttagctggaatacagataagtttagtttcatttattgtatttttatttaattatataaaatcaactttaagctttaataagttacacagcctaatttctgataaaaaagaacctctaatacaaaccattataggtatagttatttatcctttaatatatatattaagagttcaaaaacttactattggaacagattataatatcttaccaaatagcacaacagaagacatagcaaccactactccaattaccttggaagctagtgatattaaaaattataaaatattatctaaattaagttacgtgttttttacaatcgcgttagtattatttattttgttttttgtgtttaaaaacaacaagctcctgtatctcncagctcagcgataa

SEQ ID NO: 23944 - protein, 223 aa, Unknown
  Obtained from environmental sample
  misc_feature (1)..(223): Xaa is any amino acid
MLPLSIFLTKRATQDRGIFEFDHITVPIKNWYNAKFGKTKITADTLSSDTIYLPETEKASYKTLSTLSITFYIISVALFILYFVFKNNKLPVVALAGIQISLVSFIVFLFNYIKSTLSFNKLHSLISDKKEPLIQTIIGIVIYPLIYILRVQKLTIGTDYNILPNSTTEDIATTTPITLEASDIKNYKILSKLSYVFFTIALVLFILFFVFKNNKLLYLXAQR

SEQ ID NO: 23945 - DNA, 366 bp, Unknown
  Obtained from environmental sample
  misc_feature (1)..(366): n is a, c, g, or t
gtgatggatcaaacgttcgatggaaaaaatggaaagacagaatcgctcgttcaaattcaagccaggagaagtctaatgaattttagtctgattgcacagcatctaaacacatatttgttacaaatatttgggtcttacatcgggccactaggtactgcaaaggagagaacatcgaccaagatacaattttttgaactagatcttgatatctctactggccaacctgttttagcatatactggctggagtcgtataggaaatgaaaccgatttgaaagatctggattccctgttggccaaatgcataaaaaaggaaaagctcggcgatcacgatggttatgacccccaaccaggatcgaccgggtaa

SEQ ID NO: 23946 - protein, 121 aa, Unknown
  Obtained from environmental sample
  misc_feature (1)..(121): Xaa is any amino acid
MMDQTFDGKNGKTESLVQIQARRSLMNFSLIAQHLNTYLLQIFGSYIGPLGTAKERTSTKIQFFELDLDISTGQPVLAYTGWSRIGNETDLKDLDSLLAKCIKKEKLGDHDGYDPQPGSTG

SEQ ID NO: 23947 - DNA, 423 bp, Unknown
  Obtained from environmental sample
  misc_feature (1)..(423): n is a, c, g, or t
ttggtttttataatgaataaagcagaggaaatattaaacatcaaaactgtaaaacctacagcaataagattaattgttttaagacacctattagaacaaaaaaaagcccaatccctaaaagatattgaagataaattaattcatacagatagaagttcaatttttagaacacttaaaacatttttagaaaataaattaattcatagtattgaggatggttctggtatggttaaatatgcagtatgtgctgatgggtgtaactgcgacccaatagacctgcattatcatttttattgttcaaaatgcggcctaacttattgcttgttagaaatacctataccaagtattcagttacctaataattttaaaatgcaacaagccaatatggtaataaaaggactttgtgacaattgtaaccactaa

SEQ ID NO: 23948 - protein, 140 aa, Unknown
  Obtained from environmental sample
  DOMAIN (14)...(132): Ferric uptake regulator family
  misc_feature (1)..(140): Xaa is any amino acid
MVFIMNKAEEILNIKTVKPTAIRLIVLRHLLEQKKAQSLKDIEDKLIHTDRSSIFRTLKTFLENKLIHSIEDGSGMVKYAVCADGCNCDPIDLHYHFYCSKCGLTYCLLEIPIPSIQLPNNFKMQQANMVIKGLCDNCNH

SEQ ID NO: 23949 - DNA, 825 bp, Unknown
  Obtained from environmental sample
  misc_feature (1)..(825): n is a, c, g, or t
atgaaaggtagttatgttgtgaaagtcatagtgaaagatgcctccaacaatataattacaagtaatgagcattcttttgatgtttttaccgaaacccaattgacaaaaccaaccaaggaagttgcagtgttggatggaggctcagttcttacttctttcttagagaaacaagggattgtatatgttccatttatggcagatctggatatttcaattcctgtagttgtaggaaaaggaaaacgaggagacaaaaactttcagcagcgagtagatgaagttaaagagtttgtaaaaagaggtggctatgccatcttccttgaagtatccggaactccactcacttggggtgctcccaacccagaaaaaaaacccaaagatggtcatggcgactggcaaagaagtattccacgagtactggaagatatgcccatggaaaaattgccttataaagctaatatgtatgttaccagtggtaattacatttcacgaaatcacatcgtaacagataattttgtattcaaaggcttaccagtgaacaccttgatgagcggcgtttatgaaaatatttgtcctaccttgtctatttgtagacctgccgaaggaaagtatttagctggtgtaattacatacgaccaaaataaaaacatggacattatggagcgtcactacaatggcattggagatgtgctgtgggcttctgatgtactgttagtagaaaagggcaaaggaaaaatgatctattctactttgaatattattggcaatttggggcaagatccagtagcagagaaaatcctgtttaatatgattaaatacttaaaataa

SEQ ID NO: 23950 - protein, 274 aa, Unknown
  Obtained from environmental sample
  misc_feature (1)..(274): Xaa is any amino acid
MKGSYVVKVIVKDASNNIITSNEHSFDVFTETQLTKPTKEVAVLDGGSVLTSFLEKQGIVYVPFMADLDISIPVVVGKGKRGDKNFQQRVDEVKEFVKRGGYAIFLEVSGTPLTWGAPNPEKKPKDGHGDWQRSIPRVLEDMPMEKLPYKANMYVTSGNYISRNHIVTDNFVFKGLPVNTLMSGVYENICPTLSICRPAEGKYLAGVITYDQNKNMDIMERHYNGIGDVLWASDVLLVEKGKGKMIYSTLNIIGNLGQDPVAEKILFNMIKYLK

SEQ ID NO: 23951 - DNA, 369 bp, Unknown
  Obtained from environmental sample
  misc_feature (1)..(369): n is a, c, g, or t
ttgacctaccttttgtacgaggccgactatgaagaaggatttattgaaggtgttcgaagtgaagttgaagaacaatttacgctgattaacaccaaaagttatttctatatcaaaaaaagtgtgcgaaaaatattacgtatggttaaaaagtatatcagatattcaaaaaagaaagaaacggaagtagaattactgctacatttttgttcagagttaaaaaaaatgaaaccatctatgcaaaacaatgtttcgttgctcaatatctttaatcgtcaaatagacctgatcaaaaaaactgtagccagcatgcatgaagatctacaatatgattatgaaatggagttaaatgaattagtattaaattgctaa

SEQ ID NO: 23952 - protein, 122 aa, Unknown
  Obtained from environmental sample
  misc_feature (1)..(122): Xaa is any amino acid
MTYLLYEADYEEGFIEGVRSEVEEQFTLINTKSYFYIKKSVRKILRMVKKYIRYSKKKETEVELLLHFCSELKKMKPSMQNNVSLLNIFNRQIDLIKKTVASMHEDLQYDYEMELNELVLNC

SEQ ID NO: 23953 - DNA, 471 bp, Unknown
  Obtained from environmental sample
  misc_feature (1)..(471): n is a, c, g, or t
atgaacgataaaagtgtaattttatattcaacggtagatggacaaaccttaaaaatttgtaataaactcgttgaagtatttaagcaaaataaccaatccgttgcgctattttctattgacgattttactgaagatataagtaattatgataagatcattattggagcaagcattcgatatggtgtgcataataagtccatcattgaatttatcaataataataaagagctattaaatactaagaaaactgttttcttttctgtaaatctggtagctagaaagccagagaaaaatgcgccggacaccaacccttacgtcataaaattctttaaaacaattgattggaaacccactataatagaagtatttgcccggaatttagattatcagaaatatccgttttttgatagaaccatgatccgatttataatgtggatgaccaaagccccacagatcctaagccaaaggtga

SEQ ID NO: 23954 - protein, 156 aa, Unknown
  Obtained from environmental sample
  misc_feature (1)..(156): Xaa is any amino acid
MNDKSVILYSTVDGQTLKICNKLVEVFKQNNQSVALFSIDDFTEDISNYDKIIIGASIRYGVHNKSIIEFINNNKELLNTKKTVFFSVNLVARKPEKNAPDTNPYVIKFFKTIDWKPTIIEVFARNLDYQKYPFFDRTMIRFIMWMTKAPQILSQR

SEQ ID NO: 23955 - DNA, 324 bp, Unknown
  Obtained from environmental sample
  misc_feature (1)..(324): n is a, c, g, or t
atgaaatttttaatggatgccaaccttccttttaaactttcaaaaaacttaaaatcaaaaggtatagacattattcatactgacgatttaataaataaagaacatacaactgaccaagaaatacgaagaatttccatagtacaaaacagaataattataactaaggattctgattttctagattcacatattgttcgaggtattccctcaagacttttatttataggaacaggtaatattaccaatgccgaactattcggtttattcgataaatatttcgatcaaataacaatactttttgagagttataaattggtcgaatga

SEQ ID NO: 23956 - protein, 107 aa, Unknown
  Obtained from environmental sample
  misc_feature (1)..(107): Xaa is any amino acid
MKFLMDANLPFKLSKNLKSKGIDIIHTDDLINKEHTTDQEIRRISIVQNRIIITKDSDFLDSHIVRGIPSRLLFIGTGNITNAELFGLFDKYFDQITILFESYKLVE

SEQ ID NO: 23957 - DNA, 543 bp, Unknown
  Obtained from environmental sample
  misc_feature (1)..(543): n is a, c, g, or t
atgaagctaaaagccgaaaatctagtaaaatcctataaaggccgaaaggttgtaaagggcattaccgtggaagtaaatcaaggagaaatagtaggtttactagggccaaatggtgcgggtaaaactacttctttttatatgattgttgggttgataaaaccaaacggcggtaaaatattcttggaaggtaccgaaatcaccaattaccctatgtacaaacgcgctcagaacggtattggctatttggcacaagaagcctcagtatttagaaaactaagcgttgaggacaatattttgagtgttttacagcttacgaagctttccaaaaagaacaacgtgcccaaactgatttgcttattgaggaatttggtttggggcatattcgtaaagtcgcggcgatcttttagcggtggggaacgacgtagaacccgagatagcagagctttggctaccgatccacattttattcttttagatgagccttttgcaggggttgacctntgtgcagntgaagatattcagcgaattgtggcacaagcttaa

SEQ ID NO: 23958 - protein, 180 aa, Unknown
  Obtained from environmental sample
  DOMAIN (28)...(180): ABC transporter
  misc_feature (1)..(180): Xaa is any amino acid
MKLKAENLVKSYKGRKVVKGITVEVNQGEIVGLLGPNGAGKTTSFYMIVGLIKPNGGKIFLEGTEITNYPMYKRAQNGIGYLAQEASVFRKLSVEDNILSVLQLTKLSKKNNVPKLICLLRNLVWGIFVKSRRSFSGGERRRTRDSRALATDPHFILLDEPFAGVDLCAXEDIQRIVAQA

SEQ ID NO: 23959 - DNA, 732 bp, Unknown
  Obtained from environmental sample
  misc_feature (1)..(732): n is a, c, g, or t
ttgacctggataaatttgccaaagataccatcatttattttgtgggataacaaagagaatatgtgggttggtgcgtacagaatgggcttaggtgtagatatttttaagaagtatggcatagaggggttttatgtacaaactctttttaaatttgatgaagagttacataaaatgatgagtcagaccatagatattggtcgtgcttttataattaatgaatatcagcaaaaaccaatgcctctcttttttctgtggaaaggaatcattcatgttacgcttagatatccaaagcataaatacttaactggaggtgtaagtatctctaatcagttttcgaatttttcaaaatctttgatgattgaatttatgaaatctcattattacgacccatatattgcacagtatattcaccctaaaaaagaatataaagtaaagctcaaagatgctgatcgcgattttgtttttgacgctacacaagcagatttaaaaaagtttgacaaagtaattgacgagctagaaccgggtaatttaagaatgcctgtattaataaaaaaatacattaaacaaaatgcaaaattggttgcttttaatgtagatcctaaatttaacaacgccatagatggattaatcttcttgagaattgcagatattcctgaaagcaccgttgggccagttatggaagagtttcaagctgaattagagcgcaaaataactgaagaaaataataaataa

SEQ ID NO: 23960 - protein, 243 aa, Unknown
  Obtained from environmental sample
  misc_feature (1)..(243): Xaa is any amino acid
MTWINLPKIPSFILWDNKENMWVGAYRMGLGVDIFKKYGIEGFYVQTLFKFDEELHKMMSQTIDIGRAFIINEYQQKPMPLFFLWKGIIHVTLRYPKHKYLTGGVSISNQFSNFSKSLMIEFMKSHYYDPYIAQYIHPKKEYKVKLKDADRDFVFDATQADLKKFDKVIDELEPGNLRMPVLIKKYIKQNAKLVAFNVDPKFNNAIDGLIFLRIADIPESTVGPVMEEFQAELERKITEENNK

SEQ ID NO: 23961 - DNA, 816 bp, Unknown
  Obtained from environmental sample
  misc_feature (1)..(816): n is a, c, g, or t
atgggcttagtaaccgcaaaggaagtagcaaaggcagtaaatcttgataaatatggatttgttggtacttttttcggatggttattgatgaaaatcttacgcatttctacactcaataagatttacaataaacacaaacatctctctgaattagaattctttgatgctttgttagatgaccttcaaattcaatttgaaatccccgaagaagaccttgatagaattccaaaagacggagcttttatcaccatttctaatcacccattagggggtattgatggaattttactcttaaaattactcgttaaaaaaagaccagattatcgtatcatcgcgaattttttattgcatagaatagagccgatgaaaccttatataatgcctgttaacccatttgaagaaagaaaagatgttaaatctagtttagctggagtaaaagaagcattgctacatttaaaagaagataagcctttgggtatttttcctgcaggagaagtgtcgacttatagagacggaaaattagtaattgataagccctgggaagaaggtgctgttaagttgattaaaaaagcaggagtgccaataatacctatatactttcatgcaaaaaatagcaagttattttacatcctatcaaaaattagcgacacgtnaagaactgccaaattaccttctgaattattatcacaaagagggcggataattaaagtaagagttgggaacccgattagtgttaaggatccgaaccaatatgaaagtgctgaagattttcatgaatttatcgcaagaaaacatacatgttgccaacccttttga

SEQ ID NO: 23962 - protein, 271 aa, Unknown
  Obtained from environmental sample
  DOMAIN (66)...(201): Acyltransferase
  misc_feature (1)..(271): Xaa is any amino acid
MGLVTAKEVAKAVNLDKYGFVGTFFGWLLMKILRISTLNKIYNKHKHLSELEFFDALLDDLQIQFEIPEEDLDRIPKDGAFITISNHPLGGIDGILLLKLLVKKRPDYRIIANFLLHRIEPMKPYIMPVNPFEERKDVKSSLAGVKEALLHLKEDKPLGIFPAGEVSTYRDGKLVIDKPWEEGAVKLIKKAGVPIIPIYFHAKNSKLFYILSKISDTXRTAKLPSELLSQRGRIIKVRVGNPISVKDPNQYESAEDFHEFIARKHTCCQPF

SEQ ID NO: 23963 - DNA, 768 bp, Unknown
  Obtained from environmental sample
  misc_feature (1)..(768): n is a, c, g, or t
atgcaaaagatcatttcttataacgtaaatggtattcgtgctgccataaataaaggcctgctggattggatgaaaacagtaaaaccgggaattctgtgcatacaggaaacaaaagcacagcctgatcaggttgacatggacgcttttaaaaaactcgggtatattgatcgctggcattcagctgaaaaaaaaggttattccggtgttctgattttggcagagcgggaaccggataatgtcgtaattggtatgaattcatcagattatgattcggagggaagagttatcaggtttgattatggggatatatcctttctcactgtctacatcccatctggcaccaccggggatgtcaggcaggatttcaagatgaagttccttgacgactttctcagttttctgaacaatctcaggaaagaaaggcccaatctgctggtctgcggggatttcaatatagcacaccgggaaattgatatacacaacccggtaagtaataaaaaaacttccggcttccttcctgaagaaagagcatgggtagataaattcctggagagtgggtttgtggatactttcaggcataaacacccggacgttgttaaatacagctggtggagttttcgttcaaacgccaggtcgaaaaacctgggatggcggctggattataatatggtcaccgaaccactggctgcccgtataaaagatgccggcatcatgaacgatgctactcattctgatcactgtccggtctgggtggacctggatatatga

SEQ ID NO: 23964 - protein, 255 aa, Unknown
  Obtained from environmental sample
  DOMAIN (2)...(253): Endonuclease/Exonuclease/phosphatase family
  misc_feature (1)..(255): Xaa is any amino acid
MQKIISYNVNGIRAAINKGLLDWMKTVKPGILCIQETKAQPDQVDMDAFKKLGYIDRWHSAEKKGYSGVLILAEREPDNVVIGMNSSDYDSEGRVIRFDYGDISFLTVYIPSGTTGDVRQDFKMKFLDDFLSFLNNLRKERPNLLVCGDFNIAHREIDIHNPVSNKKTSGFLPEERAWVDKFLESGFVDTFRHKHPDVVKYSWWSFRSNARSKNLGWRLDYNMVTEPLAARIKDAGIMNDATHSDHCPVWVDLDI

SEQ ID NO: 23965 - DNA, 363 bp, Unknown
  Obtained from environmental sample
  misc_feature (1)..(363): n is a, c, g, or t
atgcttgtagagagaatcaagattattctaattgaacaattgcaagacttgccattacatataaagttaaaaacatccgaactattagcatccagtcttcataaggattataaacaattgagcaagcttttttctaccaatgaaaaaaccaccatcgagaaatactttataaaactaaagattgaaaaggtaaaagaactcattcagcttaaacagtattccttttctgatataggctacattttggattatagtagtgtcaaccatttgtccagacagtttaaagaagtagtgggtctgagtatgaccgattataaaaacgctgaaaattggaaacggaatttttatgatgaaattatataa

SEQ ID NO: 23966 - protein, 120 aa, Unknown
  Obtained from environmental sample
  DOMAIN (63)...(107): Bacterial regulatory helix-turn-helix proteins, AraC family
  misc_feature (1)..(120): Xaa is any amino acid
MLVERIKIILIEQLQDLPLHIKLKTSELLASSLHKDYKQLSKLFSTNEKTTIEKYFIKLKIEKVKELIQLKQYSFSDIGYILDYSSVNHLSRQFKEVVGLSMTDYKNAENWKRNFYDEII

SEQ ID NO: 23967 - DNA, 465 bp, Unknown
  Obtained from environmental sample
  misc_feature (1)..(465): n is a, c, g, or t
atgaaaaaatttctcatcacattagtattaattccttttttcggaattgcacaaacattggaaggtttagaatatatctccccttttaacaatgacgtagctgccattaaaaaagacaacgaatggggttttattgaccaaaatggcaaaataatagttgattttcgaaacgatttgatactcaccaaaacaaacaatgccagttacccgatttttagtaatgaaagaagtctcatcagtaacaaaaaagacggtattgcatattttggatacatagataaaacggggaaaacagttattgagccccagtttctgaatgctaccaattttaatggaaatgcggcgattgtattaaaattagtcaaagaacaacgcagtggtatgaatgaactgatgaagaacgtggtgagctatcattactacgaagtaatttatgataaggatgggaaacaggacaatatttaa

SEQ ID NO: 23968 - protein, 154 aa, Unknown
  Obtained from environmental sample
  SIGNAL (1)...(19)
  DOMAIN (88)...(104): KWG Leptospira
  misc_feature (1)..(154): Xaa is any amino acid
MKKFLITLVLIPFFGIAQTLEGLEYISPFNNDVAAIKKDNEWGFIDQNGKIIVDFRNDLILTKTNNASYPIFSNERSLISNKKDGIAYFGYIDKTGKTVIEPQFLNATNFNGNAAIVLKLVKEQRSGMNELMKNVVSYHYYEVIYDKDGKQDNI

SEQ ID NO: 23969 - DNA, 825 bp, Unknown
  Obtained from environmental sample
  misc_feature (1)..(825): n is a, c, g, or t
atgttaagcaaagccaaagaaattcatcaaaacgttataactctagatacacatgtagatattaatgtagcgaattttacagatgataaaaattatactcaaaaattgaataaccaagtaaatcttccaaatatggaagaaggtggtttggatgttgccttttttattgtgtatacaggtcaaggagaattaactgatgaagggtatgataaagcttacaaaaatgcaatcagtaagtttaacgctattcataaacttaccaaagaaattgcacctaaaagaattggtttagcaacaacatctaatgaagttagagagatttacaaatctgggaaaaaggttgcaatgattggtgtagaaaacgcttatcctgttggaacagatattagtagggtaaaagaattttatgatttaggtgcaagatatatgagcctttctcataatggacatagtcagttatgtgattcgaatacaggtgaatcagatgatgtttggttacataatggcgtaagcgatttaggaaaagaagttattaaagaaatgaataaatggggaatgatgattgatgtttctcatccttctaaaaaagcaatgaaagatatgattgagctatcaaaagcaccaattatagcttcacattcatctgcaagagccctgtgtaatcatagtagaaatttagatgatgaacaattacagtggttaaaagaaaatggtggtgttgtgcaaactgtggcttttagtgcttatgtaaataccgaaaaagataaagattttaaagaagctttaatagatgaaatgggacgtttagcaaaagagcaaatttag

SEQ ID NO: 23970 - protein, 274 aa, Unknown
  Obtained from environmental sample
  DOMAIN (13)...(272): Membrane dipeptidase (Peptidase family M19)
  misc_feature (1)..(274): Xaa is any amino acid
MLSKAKEIHQNVITLDTHVDINVANFTDDKNYTQKLNNQVNLPNMEEGGLDVAFFIVYTGQGELTDEGYDKAYKNAISKFNAIHKLTKEIAPKRIGLATTSNEVREIYKSGKKVAMIGVENAYPVGTDISRVKEFYDLGARYMSLSHNGHSQLCDSNTGESDDVWLHNGVSDLGKEVIKEMNKWGMMIDVSHPSKKAMKDMIELSKAPIIASHSSARALCNHSRNLDDEQLQWLKENGGVVQTVAFSAYVNTEKDKDFKEALIDEMGRLAKEQI

SEQ ID NO: 23971 - DNA, 522 bp, Unknown
  Obtained from environmental sample
  misc_feature (1)..(522): n is a, c, g, or t
ttgcctcaaaaaacgcattcgttttattctttatgcctttataatttagttccttcatgttattcttgtaattcgaaatttaaaggtgctctaaattttaatattaataagcaacttaaaaatataagtccaacgtcaaatagttattctttatctaaagattttagatttcgaatattttatcctaatataaaactcaataatataaaagatgtttctgaatttattttggataggaaaatattaaggaataaagcgcatttagatagatattttgaaatgtttaaaattggaggtagatatacatatcagaaaagccaagtattgcaattaatagagaataaaattaattatcctccttcaagaattaaagaaatatcgaagcagacaggtatatctataaaagagttaaataataatatttttggaaaggaactttttgagagtaaactatctaattcaccaatgataaaacttaaacgagatattgctaaaaaacttaatataaagggtgttatttaa

SEQ ID NO: 23972 - protein, 173 aa, Unknown
  Obtained from environmental sample
  misc_feature (1)..(173): Xaa is any amino acid
MPQKTHSFYSLCLYNLVPSCYSCNSKFKGALNFNINKQLKNISPTSNSYSLSKDFRFRIFYPNIKLNNIKDVSEFILDRKILRNKAHLDRYFEMFKIGGRYTYQKSQVLQLIENKINYPPSRIKEISKQTGISIKELNNNIFGKELFESKLSNSPMIKLKRDIAKKLNIKGVI

SEQ ID NO: 23973 - DNA, 780 bp, Unknown
  Obtained from environmental sample
  misc_feature (1)..(780): n is a, c, g, or t
atgaatcgctattcagtactttataatcaatacgaattaaccgagcaaatagaattactaagaggcgcatttttaatattactatgcgtattaattttagttataataagaaattggtacaatctttataagaagcgttcttttagaaaaaacaatagattattaaaagaaaaactagatgctcagcaattaaacatctcgaaatttgatcaacaactcagaaaaacagaatctttagaaagaaaactgaataaaaaggttactgaaatttttcagttagaaaaagaaatggaagattacaagcaaaaattctattcttatttaagtgaaaaagaaaaagagatagcacaacataaagaaacaaataactatcaaaaaagagcttacgagcgttttgtcgactataaaaacgttgaagctaacaatacacgacttggtgctcattttattaaaaatgtaattagccagatttacaaagacattgaggaaacagacaatagctacaaatcctttttaggtataaattataaaagaggtgcgaaaaaaagtaaagtaccaccaataaaagcactaaaaaatatttttaaattattagattataatgtgtcggctttaaataaagaacacactacccttgaagaagaactggcacatattaatatgtttttagatcttattaaataccttaaaccaaataccaatatcaattttagtaacaagttaaactccgaacaaatagtagtatcaagattaacccacgcttttccttccggttgttga

SEQ ID NO: 23974 - protein, 259 aa, Unknown
  Obtained from environmental sample
  misc_feature (1)..(259): Xaa is any amino acid
MNRYSVLYNQYELTEQIELLRGAFLILLCVLILVIIRNWYNLYKKRSFRKNNRLLKEKLDAQQLNISKFDQQLRKTESLERKLNKKVTEIFQLEKEMEDYKQKFYSYLSEKEKEIAQHKETNNYQKRAYERFVDYKNVEANNTRLGAHFIKNVISQIYKDIEETDNSYKSFLGINYKRGAKKSKVPPIKALKNIFKLLDYNVSALNKEHTTLEEELAHINMFLDLIKYLKPNTNINFSNKLNSEQIVVSRLTHAFPSGC

SEQ ID NO: 23975 - DNA, 510 bp, Unknown
  Obtained from environmental sample
  misc_feature (1)..(510): n is a, c, g, or t
atgagggttacaagtaaagatttgtcttcagaatcgaaggttattatttatccagggagtcgtaaatttttcgcgaatgaattgcctattcttcgagagaaactggattctttttgtgatgattttaaaggtgtaagcctttgctgcgagattgaatacgacaggtttttaatatttatgatctctgaagaaacagttttggatcttgacaatcaaaatttacttgttgactttatcctagggcttgagaaaacttttgaaatttcattgttagacaaggtcaatgtctgctttaagcaaggaccttatgttcaattaaaagaaactccggattttaaattattgattaaaaacaaaggtgtttcaaagaaaaccattgtttttgacaatatgattaatacaaagttagaatacgaagaatcatgggaatcaccagctggagaaagcgtggttgtcacattttttctaatttatagtctcttgccccaggccggtaagaaaagtttctaa

SEQ ID NO: 23976 - protein, 169 aa, Unknown
  Obtained from environmental sample
  misc_feature (1)..(169): Xaa is any amino acid
MRVTSKDLSSESKVIIYPGSRKFFANELPILREKLDSFCDDFKGVSLCCEIEYDRFLIFMISEETVLDLDNQNLLVDFILGLEKTFEISLLDKVNVCFKQGPYVQLKETPDFKLLIKNKGVSKKTIVFDNMINTKLEYEESWESPAGESVVVTFFLIYSLLPQAGKKSF

SEQ ID NO: 23977 - DNA, 375 bp, Unknown
  Obtained from environmental sample
  misc_feature (1)..(375): n is a, c, g, or t
atgtttttaactaagagttgtggtggtgatgccgctcaaactttaccagtaattaataagtttgcagaagcaaatgataaaattgatcttaaagtagttttaagagatgaaaatgaagatttgatgaatcaattccttaccaatggaaacaaatctattccaaagttgattgtagttgataatcagtcaaaggaagtagtgggttcatggggtccccgttcagctaaagcggcaagaattgtaagcgattacaaagcggagcatgggaaaatagattcaaaattgaagatggatctgcaaaattggtataatgaagataagggtgtccatattgaaaaggaaatggtagatcttattgaagatatgataagttaa

SEQ ID NO: 23978 - protein, 124 aa, Unknown
  Obtained from environmental sample
  misc_feature (1)..(124): Xaa is any amino acid
MFLTKSCGGDAAQTLPVINKFAEANDKIDLKVVLRDENEDLMNQFLTNGNKSIPKLIVVDNQSKEVVGSWGPRSAKAARIVSDYKAEHGKIDSKLKMDLQNWYNEDKGVHIEKEMVDLIEDMIS

SEQ ID NO: 23979 - DNA, 318 bp, Unknown
  Obtained from environmental sample
  misc_feature (1)..(318): n is a, c, g, or t
ttgttacttttacaatccgtttttcaaaatcgcgaaaatccatttatgatgaagttgtttatttattgcctgggaattgttctgttcttcggaagttgtgaagataagaaaaaggcttcccaaaatgaaaacgaaatcgaaaacgaagttaaaatcgatacttcggcggagtctatcctgagcggagtcgaaggactcagtaaccaaaaaattgaaattgaaaagaaagattctatagcatatccggaaatcacgaacgataatgtggtttcgtttttaaccgaatacggaaaaataatcccgaaactaaagttctaa

SEQ ID NO: 23980 - protein, 105 aa, Unknown
  Obtained from environmental sample
  misc_feature (1)..(105): Xaa is any amino acid
MLLLQSVFQNRENPFMMKLFIYCLGIVLFFGSCEDKKKASQNENEIENEVKIDTSAESILSGVEGLSNQKIEIEKKDSIAYPEITNDNVVSFLTEYGKIIPKLKF

SEQ ID NO: 23981 - DNA, 831 bp, Unknown
  Obtained from environmental sample
  misc_feature (1)..(831): n is a, c, g, or t
gtgaaaaaatatcttgaagccattacccaaaaaaataaatatgttagaaaatattttcaccctattaatgttagtttttttacaagctgttcttgttttgataacttactgtacatatccttagaatcaaaaaaagcaccagaaattaaacaaaaaagagttcgtaaagtaggtattttagttgccattgttttaagaattattttattgtttttattagtttctattatcgattattttaaagaacctttttcatttttaactggtggctttgatgatattgtaaagttcgcttttaacggtcatagtataattgtacttttaggaggtggatttataatttacacagccattaaagaaatttggcacatgattggaactccagatttagagcaatctgaattgattgaagcaagacataaaaaaactgcaaatgctgctattgtaagtattgtaatcatgaatttggttttttctttcgattctattttagctgcaattggcttaacaagtgaaattgaaaactctataaccgcttttattattatggcaattgcgattgttgtaagtggtttattaatgctgtttttagctgatagagtttctgcatttttagcaaaaaataaaatgtacgaggttttaggtttatttattctttttatagtgggtattatgttagttacagaaggtggccatttagcacacattaaaatatttggaaatgaaattgtaccaatgagtaaaacaacgttctactttgtaattgttattttaattataacagatattgtgcaaggaaaatatcagaaaaaattattagccaaaaaataa

SEQ ID NO: 23982 - protein, 276 aa, Unknown
  Obtained from environmental sample
  DOMAIN (25)...(262): Integral membrane protein TerC family
  misc_feature (1)..(276): Xaa is any amino acid
MKKYLEAITQKNKYVRKYFHPINVSFFTSCSCFDNLLYISLESKKAPEIKQKRVRKVGILVAIVLRIILLFLLVSIIDYFKEPFSFLTGGFDDIVKFAFNGHSIIVLLGGGFIIYTAIKEIWHMIGTPDLEQSELIEARHKKTANAAIVSIVIMNLVFSFDSILAAIGLTSEIENSITAFIIMAIAIVVSGLLMLFLADRVSAFLAKNKMYEVLGLFILFIVGIMLVTEGGHLAHIKIFGNEIVPMSKTTFYFVIVILIITDIVQGKYQKKLLAKK

SEQ ID NO: 23983 - DNA, 723 bp, Unknown
  Obtained from environmental sample
  misc_feature (1)..(723): n is a, c, g, or t
atggatttgttaaaatctgtttttaagattgatgaaaatattctttattacttaccttttttattggataagatcgatgaaaatcactctaaaaaatggaaaacttttgaggaaagagaacattttgtttttattggtaactttttccataaaccaaatgtagatgctgttattaccctaaagaaatcaatttggagtgaaattagagaatatcttccaacagcagaagttcatatttatggagcgtatgtaaatcagcaaatacaagaattacacaataaaaaggaaggttttatcatcaaaggttttgcagaaaattcgaaaaaagttattgaaaattccagagttcttttagcgcctttaagttttggagcaggcattaaaggcaagttaacagaagcaatgctttgtggaaccccaagtgtaacaactacaattggtgcagaaggcatgtgtgatcgatttccttggccaggttttgtaaatgataatttttctgattttgcattgatggcagctgaattgtatagaaataaagaaatgtggcaagtttcgcaagaaacaggaataaatattatcaattatgtatttgataaagaaaagttaagtccgatttttatcaatagaattatagaaattcaacagaatttagaaaaccatagaacacaaaactttttgggaagtttattgcaacatcaaactttacaagcgactaagttttga

SEQ ID NO: 23984 - protein, 240 aa, Unknown
  Obtained from environmental sample
  DOMAIN (26)...(195): Glycosyl transferases group 1
  misc_feature (1)..(240): Xaa is any amino acid
MDLLKSVFKIDENILYYLPFLLDKIDENHSKKWKTFEEREHFVFIGNFFHKPNVDAVITLKKSIWSEIREYLPTAEVHIYGAYVNQQIQELHNKKEGFIIKGFAENSKKVIENSRVLLAPLSFGAGIKGKLTEAMLCGTPSVTTTIGAEGMCDRFPWPGFVNDNFSDFALMAAELYRNKEMWQVSQETGINIINYVFDKEKLSPIFINRIIEIQQNLENHRTQNFLGSLLQHQTLQATKF

SEQ ID NO: 23985 - DNA, 498 bp, Unknown
  Obtained from environmental sample
  misc_feature (1)..(498): n is a, c, g, or t
ttgttaatctataaattttatctcatgaaaattttaaagaaaataggatttgcattattgttgatattaatagttgctcaattttttgggcctgaaaaaaatgatggaaatattgatactgtaaatgcatttgtggcagaaacaaatcctacagaagaagtgttgtctattatgaaaacaagctgtttcgattgccattctgcaaaaacaaattatccttggtataactcaattacgccagttaattattggttggatgatcatataaaagacggaaaaaaacatcttgatttttctaaatggagtgaatattctttaaagaagaaagaacacaaaatggacgaattgcatgaagaagtagaaaaaggcgaaatgccattagattcttatacttggactcatgatgaggcaaatttaacacaagaaacagtggatgctattgtaacttgnggcaaaaaagtacaagcagagtataagcaacaaatgagcgcagaataa

SEQ ID NO: 23986 - protein, 165 aa, Unknown
  Obtained from environmental sample
  misc_feature (1)..(165): Xaa is any amino acid
MLIYKFYLMKILKKIGFALLLILIVAQFFGPEKNDGNIDTVNAFVAETNPTEEVLSIMKTSCFDCHSAKTNYPWYNSITPVNYWLDDHIKDGKKHLDFSKWSEYSLKKKEHKMDELHEEVEKGEMPLDSYTWTHDEANLTQETVDAIVTXGKKVQAEYKQQMSAE

SEQ ID NO: 23987 - DNA, 441 bp, Unknown
  Obtained from environmental sample
  misc_feature (1)..(441): n is a, c, g, or t
atgacgaaagaaaaaatcatattactattaccatatcaagagccatttctatttgtggatgaattagatacgatttccaatgaaggcgtaacgggaagttatacgtttaaaaaagatgcgtatttctacaaaggacattttaaagacaatccaattacaccaggcgttatcttaacggaatgtatggcacaaataggagtagtatgtttgggtatttatatgttgaaggatgaaatttcagaacattataaacctcaaatagctttaacatcaagtcaagtagatttctttttacctgtttttccaggtgaaacagtgactgtagtttcagaaaaggaagtctttcgtttcaataaattgaaatgtaaagtgaaaatgtttaatcataaaaatgaattggtttgtcgaggacagatttcaggaatgctgaaagcagaataa

SEQ ID NO: 23988 - protein, 146 aa, Unknown
  Obtained from environmental sample
  misc_feature (1)..(146): Xaa is any amino acid
MTKEKIILLLPYQEPFLFVDELDTISNEGVTGSYTFKKDAYFYKGHFKDNPITPGVILTECMAQIGVVCLGIYMLKDEISEHYKPQIALTSSQVDFFLPVFPGETVTVVSEKEVFRFNKLKCKVKMFNHKNELVCRGQISGMLKAE

SEQ ID NO: 23989 - DNA, 849 bp, Unknown
  Obtained from environmental sample
  misc_feature (1)..(849): n is a, c, g, or t
ttgcagggcttacttgaagggatagtctccaaattgcagttaccccactttgataagttattggacaaagcgattgccacgggcaagatcaaacctgtaatagtggtaatgccaaatcaatattccctatatcggggaagttggtataacaattcaacactaactggaaaatgggccgattttacgggtattgatctggtagcctttgtagataaaaaatatagaacacttccaaactcgggaagtcgcggagttgcgggccattcaatgggcggacaaggagccatcaaaatgggaatgttattccctgaagttttttcctctgtatatgctatgtctcctgcacatatgggaacactgacggaaggatttggaattaggggaaatgtgcacaaccgaataaatgaaattacatctcgagaacaattgacaacaggttatgccgaatttttacctaatgtgttggtttccatgggcagggcatattcaccaaaccttgataatccaccttattatatggatttcccatacgaatacattgatgatagtttaattatcaattatgatgttataaagaaatggaaaaagaaatcagctgtaggaatggttgacgatcacattgaggatcttaaaaaactaaaagctttaaaactcgagtggggaagaaatgaagataataacctaattccaaacacctgtttggaatttagcaaaaagcttgaaaacctcggaattaaacattatgccgaaatttatattggtgatcataccaatagcctttggaccgaagatgggcgggcattaaacgatatgcttccgttttttgattcatacctcgaatttgaatag

SEQ ID NO: 23990 - protein, 282 aa, Unknown
  Obtained from environmental sample
  misc_feature (1)..(282): Xaa is any amino acid
MQGLLEGIVSKLQLPHFDKLLDKAIATGKIKPVIVVMPNQYSLYRGSWYNNSTLTGKWADFTGIDLVAFVDKKYRTLPNSGSRGVAGHSMGGQGAIKMGMLFPEVFSSVYAMSPAHMGTLTEGFGIRGNVHNRINEITSREQLTTGYAEFLPNVLVSMGRAYSPNLDNPPYYMDFPYEYIDDSLIINYDVIKKWKKKSAVGMVDDHIEDLKKLKALKLEWGRNEDNNLIPNTCLEFSKKLENLGIKHYAEIYIGDHTNSLWTEDGRALNDMLPFFDSYLEFE

SEQ ID NO: 23991 - DNA, 333 bp, Unknown
  Obtained from environmental sample
  misc_feature (1)..(333): n is a, c, g, or t
ttgtgtgctacttttggcaagttgattcttgtaattccgctaaaatttctcttgattactctttcagactttactttcttgaaagaaataacaaccgcattttggttgaatttaaaatacttaaaaaccaatccgaaaattaaagaagatattcccaaccaaaacaatctattatacaaaatcaattcttttattgggatttgcatttcattttgttcggacatggtccaatattttgtatatgtgcttaaagctgctgagccaaaaggatctaaaattgccaaccaagtttcttggtctggttcagatagaattccactaattgcaccttga

SEQ ID NO: 23992 - protein, 110 aa, Unknown
  Obtained from environmental sample
  misc_feature (1)..(110): Xaa is any amino acid
MCATFGKLILVIPLKFLLITLSDFTFLKEITTAFWLNLKYLKTNPKIKEDIPNQNNLLYKINSFIGICISFCSDMVQYFVYVLKAAEPKGSKIANQVSWSGSDRIPLIAP

SEQ ID NO: 23993 - DNA, 699 bp, Unknown
  Obtained from environmental sample
  misc_feature (1)..(699): n is a, c, g, or t
atgattgaaactaattttcttgtaataggttcaggagtagcgggattgacgtttgccgttaaagtggctgaaaaatttcctgacaaaaatgttatcatcgttactaaaggtgatgaagaagaatctaacactaagtacgctcaaggaggggttgccattgtactagattcagaaaaagattcttttgataagcatattcaagataccttaacagctggcgatggtttatgcgataaggcaattgttgaaatggtaattaaagaaggccccaaacgacttaaagaattaatagaatggggagccaattttgattttgacactaatggaaatcttgatttaggaaaagagggagggcattctgaatacagagttgtacatcataaagatataaccggatatgaagtcgaaagaaccttattacaacgagttcatcaacttcctaatattaaggttttatcgcatcattttgccatagatttattaacggaacaccatttagaacaattaccttctaataagataacttgttttggcgcttatgttttagatcaaaaatcgaggcaaatacttaccataaaatctgatagtactttattggcttcagggggtatcggacaagtatacggacataccacaaacccaattattgncactggagatggaatagccatggcttatagagcgaaagccnaagattaa

SEQ ID NO: 23994 - protein, 232 aa, Unknown
  Obtained from environmental sample
  DOMAIN (107)...(231): FAD binding domain
  misc_feature (1)..(232): Xaa is any amino acid
MIETNFLVIGSGVAGLTFAVKVAEKFPDKNVIIVTKGDEEESNTKYAQGGVAIVLDSEKDSFDKHIQDTLTAGDGLCDKAIVEMVIKEGPKRLKELIEWGANFDFDTNGNLDLGKEGGHSEYRVVHHKDITGYEVERTLLQRVHQLPNIKVLSHHFAIDLLTEHHLEQLPSNKITCFGAYVLDQKSRQILTIKSDSTLLASGGIGQVYGHTTNPIIXTGDGIAMAYRAKAXD

SEQ ID NO: 23995 - DNA, 849 bp, Unknown
  Obtained from environmental sample
  misc_feature (1)..(849): n is a, c, g, or t
atggctgagacattaggagacatatatggtcaaaagacaagaaaagtttttaaaataaaaacgacttctaattattatattaatcttggtaaaacagtattaagaccattaaaatataaatttttattaaagagattatattttgacaatttaaatgctataaaaagggtaaattatgttagcactcaatttaaagaagattttaataatttactttcgaaaaatcttatcaggaaggatgccgtgaacgtgaaattcacgtattatccgttagaaattatcttcaaaaatgaagtagatcaaatagtcaataataataatattttattaggtaattctgcatcagaaacaaataatcatcttgaagcatttgatttacttaaagatcttaatttaaagaatcgaaaaattattacgccgctaagttatgggaatatgaactatgccggagagataattaacactggaaatagaatgttttctaataattttaaaccgttaactgagtttctaaaattaaatgaatacaatactattattcaacaatgtggtataactattatgaataattataggcaacaagctattggtaacattatggctatgatttggatgggttcaaaagtgtatttagacgagagaaatacagtctatagatatttgaaaaggttaggtgtcatcgttttttcaataaataaggaccttattcgtgaaaataaggacgtttttaaattattaactcaatctgaaatagaaaataatagaaatattttaaagattgaaattggtgaaagcaatttgctaaaaactcttaaaaatcaaattaatagtatttttgaacatgaataa

SEQ ID NO: 23996 - protein, 282 aa, Unknown
  Obtained from environmental sample
  misc_feature (1)..(282): Xaa is any amino acid
MAETLGDIYGQKTRKVFKIKTTSNYYINLGKTVLRPLKYKFLLKRLYFDNLNAIKRVNYVSTQFKEDFNNLLSKNLIRKDAVNVKFTYYPLEIIFKNEVDQIVNNNNILLGNSASETNNHLEAFDLLKDLNLKNRKIITPLSYGNMNYAGEIINTGNRMFSNNFKPLTEFLKLNEYNTIIQQCGITIMNNYRQQAIGNIMAMIWMGSKVYLDERNTVYRYLKRLGVIVFSINKDLIRENKDVFKLLTQSEIENNRNILKIEIGESNLLKTLKNQINSIFEHE

SEQ ID NO: 23997 - DNA, 639 bp, Unknown
  Obtained from environmental sample
  misc_feature (1)..(639): n is a, c, g, or t
gtgaatatgaaactggtgtcaaaggcactgaaagatgaagataattatgatctgcttatttcaattgcggtacctcatactatacattggggagttgctaaagcacgaaaaatcaatccccatttaactaaaatatgggtagcagactgtggcgatccttatctcaaagtacaaagcgatacctttcaaaaaatgccatattttaagtatgtagaactgtggtggggaaaaaaagcagattttttaagtgtacctatacaggatgccataaaagcatatcatcccgcaattagatctaaaataaaaattatcccgcaaggatttaaattttctgatttaaagcccataaaaatacataaaaataagataccaacttttgcctatggagggggctttatacctaataaaagagatccaagaaattttttggaatacctgattgagctcgatcaggattatttattttatatttttacatctagcaaggaaatggtgcgttcctatgcagaaagatccaataataaaataattgtaaaagacccgattccaagaaatgaatttcttggatttttaagttcaatggattttgtgataaatttgaaaattcaggcacccagcaactcctcgagccgattctga

SEQ ID NO: 23998 - protein, 212 aa, Unknown
  Obtained from environmental sample
  misc_feature (1)..(212): Xaa is any amino acid
MNMKLVSKALKDEDNYDLLISIAVPHTIHWGVAKARKINPHLTKIWVADCGDPYLKVQSDTFQKMPYFKYVELWWGKKADFLSVPIQDAIKAYHPAIRSKIKIIPQGFKFSDLKPIKIHKNKIPTFAYGGGFIPNKRDPRNFLEYLIELDQDYLFYIFTSSKEMVRSYAERSNNKIIVKDPIPRNEFLGFLSSMDFVINLKIQAPSNSSSRF

SEQ ID NO: 23999 - DNA, 837 bp, Unknown
  Obtained from environmental sample
  misc_feature (1)..(837): n is a, c, g, or t
atgggattagtaacagcaaaggaggtatcaaaaacgatacaccttgataaatatggggttttgggtacatttgttggctgggcgctaatgaaggttctcaaaatttcaacacttaataaagtctacgatcgtaataaacatttatcggatattgagtttttggatgctattttgaatgagtttcaaattaaatttgaaattcctgaagaagacttaaaacgattaccaaaagatggtgcttatattacagtttctaatcatccattagggggaatagatggtattttattattaaaattgatgcttgaacagcgttctgattttaagattatagctaattttttgttgcaccgtattaaaccaatggcgccttatattatgccagttaatccttttgaagacagaaaggatgttaaatcaagcattacaggttttaaaaatgccattgctcatttacgcaacggtcatccgttagggatatttcctgctggagaagtctcaacatatagagatggtaaattggtggtagataaaccttgggaagaagccgcaatgaaattagcacaaaaagctaaggtgcctattgttcctatttattttcacgcaaaaaacagttcgctgttttataggctatctaaaattagtgacacgtttaggacggcaaaattaccatctgaattactaacccaaaaacgcagaaccattaaagtgcgtgtggggaaacctatttcggtaaacgcacaagatgaatataaagatttatctangtttactgattttattagacgtaaaacctatatgttatcgaatactttcgagcccgaagataaattataa

SEQ ID NO: 24000 - protein, 278 aa, Unknown
  Obtained from environmental sample
  DOMAIN (64)...(201): Acyltransferase
  misc_feature (1)..(278): Xaa is any amino acid
MGLVTAKEVSKTIHLDKYGVLGTFVGWALMKVLKISTLNKVYDRNKHLSDIEFLDAILNEFQIKFEIPEEDLKRLPKDGAYITVSNHPLGGIDGILLLKLMLEQRSDFKIIANFLLHRIKPMAPYIMPVNPFEDRKDVKSSITGFKNAIAHLRNGHPLGIFPAGEVSTYRDGKLVVDKPWEEAAMKLAQKAKVPIVPIYFHAKNSSLFYRLSKISDTFRTAKLPSELLTQKRRTIKVRVGKPISVNAQDEYKDLSXFTDFIRRKTYMLSNTFEPEDKL

SEQ ID NO: 24001 - DNA, 498 bp, Unknown
  Obtained from environmental sample
  misc_feature (1)..(498): n is a, c, g, or t
atgcttttatttttattatggaagggtattgtacacactaccttacgtttcccagagcataaatatttaattgggggggttagtattagtaatcagttttctaatttctcgaaatcgctaatgatcgagtttatgaaatcgcattattacgacccgtatgtggcacaatatgtccatccaaaaaaagaatttaaagtgaagctgaaagacgctgataaagattttgtttttgatgctactgaagccgatttaaataagtttgataagattatcgatgaaattgaacccggcgctttacgtttgccagtactacttaaaaaatacataaaacagaatgcccgtttggtagcatttaatgtggatccgttatttaataatgcggtagatggattaatgtatattaaaattgaagatttaccagaaagcacagtaagaccagtgatggaagagtttcaggcagaattggaaagtaaatttttaaataatgaagacaaataa

SEQ ID NO: 24002 - protein, 165 aa, Unknown
  Obtained from environmental sample
  misc_feature (1)..(165): Xaa is any amino acid
MLLFLLWKGIVHTTLRFPEHKYLIGGVSISNQFSNFSKSLMIEFMKSHYYDPYVAQYVHPKKEFKVKLKDADKDFVFDATEADLNKFDKIIDEIEPGALRLPVLLKKYIKQNARLVAFNVDPLFNNAVDGLMYIKIEDLPESTVRPVMEEFQAELESKFLNNEDK

SEQ ID NO: 24003 - DNA, 429 bp, Unknown
  Obtained from environmental sample
  misc_feature (1)..(429): n is a, c, g, or t
ttgccctatattgttgtgccttacaaagctaaattagaattaccaaaagaaattgtgtttccaacaagttataaaacacattataagagaagagaactcgtgtacctaacaaacatagctaactcttgtaatgcaaatattgccgtgctatatatccttgagcaagagaaattagatgacaggcaagaagagaataagaggttactacaagacatattaaaaggaacagagtatagattttataatatttctagtgattccgtaataagtgcggtaaatgtttttgttcaaagtagatcgagcggtatggtcgcttttataaataagaaacatacctttttcgatagcatattaactaatcctatggtaaaacaaatttcttttcatttagacgtcccgatattaacactccacgatttaagagattaa

SEQ ID NO: 24004 - protein, 142 aa, Unknown
  Obtained from environmental sample
  misc_feature (1)..(142): Xaa is any amino acid
MPYIVVPYKAKLELPKEIVFPTSYKTHYKRRELVYLTNIANSCNANIAVLYILEQEKLDDRQEENKRLLQDILKGTEYRFYNISSDSVISAVNVFVQSRSSGMVAFINKKHTFFDSILTNPMVKQISFHLDVPILTLHDLRD

SEQ ID NO: 24005 - DNA, 435 bp, Unknown
  Obtained from environmental sample
  misc_feature (1)..(435): n is a, c, g, or t
atggccccccccagttcattggcatattcctggggcaataagggcaatgcaagtggaaggcccgtttatttggaaaaaccttgtagtcataatatgcatgaaacgattgattgtggctgctcaggagaaatacataaagtggtccaaatgggtaatcagcagagatcttctgctgaaactacacaaatagttaaaagatattcacaaggggcattatttgtaaaacnctataaggccactgcattttacattaataancggggagaggtgcctgtcaaacaaaagcttcaccaccagaaggattggattgggacctttttcaagggccatctccaagaaaggaatataggcacaatacttttgattataattggcattggtatggttgggattttggcacagccgaaatgggcaacaatgcaacacatgaattag

SEQ ID NO: 24006 - protein, 144 aa, Unknown
  Obtained from environmental sample
  misc_feature (1)..(144): Xaa is any amino acid
MAPPSSLAYSWGNKGNASGRPVYLEKPCSHNMHETIDCGCSGEIHKVVQMGNQQRSSAETTQIVKRYSQGALFVKXYKATAFYINXRGEVPVKQKLHHQKDWIGTFFKGHLQERNIGTILLIIIGIGMVGILAQPKWATMQHMN

SEQ ID NO: 24007 - DNA, 513 bp, Unknown; identical to SEQ ID NO: 21097
  Obtained from environmental sample
  misc_feature (1)..(513): n is a, c, g, or t

SEQ ID NO: 24008 - protein, 170 aa, Unknown; identical to SEQ ID NO: 21098
  Obtained from environmental sample
  misc_feature (1)..(170): Xaa is any amino acid

SEQ ID NO: 24009 - DNA, 666 bp, Unknown
  Obtained from environmental sample
  misc_feature (1)..(666): n is a, c, g, or t
atgaaacaaataataaaaaataatgtaagcataaaacgtaagaaactattatttaaggaattgccagtatatacaattttaaaatacttttattcattttctttttataatgggatagtaaatactctcacaaacaaacttgaagatgaattttatctggattgtttaaactcaacaagtaattttaaacccttagttgcagaacaatttatgttgtctttaaaaccagtaaaaaatatagaaacttcaaagtatacaacaaatggaaacataacagaaatcgaaaataattttaaaaatctaaagattcatgaaacatgtatagatatcccgcataaaaatataaaaacggtaagcttagatgcttcaaaaaaattaaagttaattaaagcagaaatgctagatattaccgatgttaaagataaggttacttcagattcaattctattgtttatagtaacagaccattctcataatggtaaaaacactattcaccactacgttattgcaaatgaccctttttttaacactaaaatcgtgtggaaagctaatttaaatggctgtagaagaattattatggatgttaaaaatgaaatatttgactttgatgaaataattgagcgtatcgttgatgaaagtattatcaaacaaataaaaaacttataa

SEQ ID NO: 24010 - protein, 221 aa, Unknown
  Obtained from environmental sample
  misc_feature (1)..(221): Xaa is any amino acid
MKQIIKNNVSIKRKKLLFKELPVYTILKYFYSFSFYNGIVNTLTNKLEDEFYLDCLNSTSNFKPLVAEQFMLSLKPVKNIETSKYTTNGNITEIENNFKNLKIHETCIDIPHKNIKTVSLDASKKLKLIKAEMLDITDVKDKVTSDSILLFIVTDHSHNGKNTIHHYVIANDPFFNTKIVWKANLNGCRRIIMDVKNEIFDFDEIIERIVDESIIKQIKNL

SEQ ID NO: 24011 - DNA, 732 bp, Unknown
  Obtained from environmental sample
  misc_feature (1)..(732): n is a, c, g, or t
gtgtaccatttttacttcaggtgtaccataaaaaaactaaacaatatgagcaattataaaatatcaatcttgtttctattgcagaaagttagattgaataaacaagggaaatgccctgtaaggtgtagagtaacatatcttaaaaaaaggaaagaatttgctacaggcttattcattaatccagagtattggaataatacacagcaacaagctaaaccacctaatacacaaaacaacataattaacacacagttaagccttattagtcataagattaatgaggcttttttaatgcttcaagttttaccagatagctttgatgtagatgatatctacaaaaagtacaaaggagaagatgtaaaaacagaaattacaatactaggagcttatgatttgcacaatgaaaagactaaaaaactaataggtgtagattttaatgaactgtcttggaagagatatattgaaagtaggaggaaagtagcaggttttatatctaaattttacaagaaaaatgatataaagcttaaagacttagatttaaaattcattaaagatttagaatactactttaaaacagacttgaatttaaaacatgccactgtatatagaagcttacagagagttaagaaaattatactgtttgcaattgctgaaaactatttacagaaagatccttttttattatttaagaataagaagtataaaactgaaaattgtgtatttaactgttga

SEQ ID NO: 24012 - protein, 243 aa, Unknown
  Obtained from environmental sample
  misc_feature (1)..(243): Xaa is any amino acid
MYHFYFRCTIKKLNNMSNYKISILFLLQKVRLNKQGKCPVRCRVTYLKKRKEFATGLFINPEYWNNTQQQAKPPNTQNNIINTQLSLISHKINEAFLMLQVLPDSFDVDDIYKKYKGEDVKTEITILGAYDLHNEKTKKLIGVDFNELSWKRYIESRRKVAGFISKFYKKNDIKLKDLDLKFIKDLEYYFKTDLNLKHATVYRSLQRVKKIILFAIAENYLQKDPFLLFKNKKYKTENCVFNC

SEQ ID NO: 24013 - DNA, 729 bp, Unknown
  Obtained from environmental sample
  misc_feature (1)..(729): n is a, c, g, or t
atggtaataagtagagaaaatatcttgaagaaaacgcattacggtttaaatatctatgcgtatgtattaagacagtattattctgaaacaacagtcctttccttaaaaggaagggactgcggggtaacccgtaacccttttaacggtggtaaatcaacattacaaattaatgttgttgaaaataaagcaatacattatgatacagaactaaccgattttaaaggtgatgtttttgattttgcatcctatcattttaaactcgtagatgatgaagaattattacttaaaatcaacactgaattacatctaaatcttgaagttaaaaaagaaaatgaattgtcttggttagatgatcccgatgatacttggtatgcttacagcagtttttataaagcaccaattagaaatgtatttccaaatcaaaaagtaagattacatcaaatatttgagcgtattacaagcgataagtataaaagtatcacagaacaattcagagcgattaaagacccaaaagaagcacgaaaatttaaagcaaatcattttgattatgtaacattttcaggtgtgttttctaaacgaaatgatgatagtttaattgagcattcatcattactgacaatcgattttgaccatttagaaaatcttgaagaactaaaacaacaattattaaacgatgaatatttcgaaaaccgaattgctgtttacatcacccttcaggagaaggcttaa

SEQ ID NO: 24014 - protein, 242 aa, Unknown
  Obtained from environmental sample
  misc_feature (1)..(242): Xaa is any amino acid
MVISRENILKKTHYGLNIYAYVLRQYYSETTVLSLKGRDCGVTRNPFNGGKSTLQINVVENKAIHYDTELTDFKGDVFDFASYHFKLVDDEELLLKINTELHLNLEVKKENELSWLDDPDDTWYAYSSFYKAPIRNVFPNQKVRLHQIFERITSDKYKSITEQFRAIKDPKEARKFKANHFDYVTFSGVFSKRNDDSLIEHSSLLTIDFDHLENLEELKQQLLNDEYFENRIAVYITLQEKA

SEQ ID NO: 24015 - DNA, 309 bp, Unknown
  Obtained from environmental sample
  misc_feature (1)..(309): n is a, c, g, or t
atgccatattgtacaggtcatgttgatcaaattggaatatgtaaggatattataaatgaggatggtagttgggtttttacttttgaatatgatacgtctaccgataatattactatagaaaaaggttcaattagtgtaaatggagtaagtttgaccgtaattaattctaaggataatcagttcagtgttgctataataccatatacatttgataatacaaattttggtaaattaaaaattaatgatgtagtaaatttagaatttgatgttataggaaaatatgtagctaagatcgctacaataaaataa

SEQ ID NO: 24016 - protein, 102 aa, Unknown
  Obtained from environmental sample
  DOMAIN (5)...(89): Lumazine binding domain
  misc_feature (1)..(102): Xaa is any amino acid
MPYCTGHVDQIGICKDIINEDGSWVFTFEYDTSTDNITIEKGSISVNGVSLTVINSKDNQFSVAIIPYTFDNTNFGKLKINDVVNLEFDVIGKYVAKIATIK

SEQ ID NO: 24017 - DNA, 309 bp, Unknown
  Obtained from environmental sample
  misc_feature (1)..(309): n is a, c, g, or t
atgtataacgctaaagccttaggtaaaataacagcgcctaacctacgcaaacgacaggattggttattatggctgtctgccatcaaaaagtctggtaaacctgctctaggtatccaggagccattagcatattatcgtgttagagcaaactctatctcttctaataaattagagttattaaaatataactattgggtgtataaaaaaggcttaggattttcaacaataaaatccatatacaggatggttatttttatttacgaacatttttttgttaagtcaagactaattgtatctactaaacaatag

SEQ ID NO: 24018 - protein, 102 aa, Unknown
  Obtained from environmental sample
  misc_feature (1)..(102): Xaa is any amino acid
MYNAKALGKITAPNLRKRQDWLLWLSAIKKSGKPALGIQEPLAYYRVRANSISSNKLELLKYNYWVYKKGLGFSTIKSIYRMVIFIYEHFFVKSRLIVSTKQ

SEQ ID NO: 24019 - DNA, 381 bp, Unknown
  Obtained from environmental sample
  misc_feature (1)..(381): n is a, c, g, or t
ttggttgtagatagcacaaagcanctaaattggaagtggactaaagactataaaaaaattggcgattatacttgttttaaagcacaactattaaatggctcagaggttctggcttataaagatggtacggctatagaggcatggtatacaccacaaataccagtaccttttggtccacttcagtttgaaggtctgcctggattaatcttagaagtaaatgtaggtaataacacttattttgcttcagaaataaagtttgatgtagaccataaaatagagcaaccaacagaaggaaaagaggtacaacgtaaaacttttttttctgaaattaaagctaatttagaagctagaataaaacgagcaaagcaatctagacaataa

SEQ ID NO: 24020 - protein, 126 aa, Unknown
  Obtained from environmental sample
  misc_feature (1)..(126): Xaa is any amino acid
MVVDSTKXLNWKWTKDYKKIGDYTCFKAQLLNGSEVLAYKDGTAIEAWYTPQIPVPFGPLQFEGLPGLILEVNVGNNTYFASEIKFDVDHKIEQPTEGKEVQRKTFFSEIKANLEARIKRAKQSRQ

SEQ ID NO: 24021 - DNA, 525 bp, Unknown
  Obtained from environmental sample
  misc_feature (1)..(525): n is a, c, g, or t
ttgacagactttggtactcgtatttttgaaaaacgagatgcttttttaaaggaatttattcctatttttaagtcgcgttacgaagctattagcaatggtaacgaagcggtggatttaaaatatcatagcgatttatttgaaaccgatttaaacacgcttttaaaaaatatcatcaataaagacaaaaccttacaatacacaagtgttgggatccataaagatgatttacattttaatattgaagggcaccctattaaaaaatttggaagtcaaggtcaacaaaaatcatttttaattgcattaaagttggcccaattcgattttataaaagcgcaaagtggcgtaaatcctattttactgctagatgatatttttgataaattagatgaacatcgtgtcgctcaaatcattaaattagtagatgatgaaaattttggacaactatttataagcgacactcacgcagagcgtactgaagcagctgtaaaacagattcatcaatcttatgaaatttttagactataa

SEQ ID NO: 24022 - protein, 174 aa, Unknown
  Obtained from environmental sample
  misc_feature (1)..(174): Xaa is any amino acid
MTDFGTRIFEKRDAFLKEFIPIFKSRYEAISNGNEAVDLKYHSDLFETDLNTLLKNIINKDKTLQYTSVGIHKDDLHFNIEGHPIKKFGSQGQQKSFLIALKLAQFDFIKAQSGVNPILLLDDIFDKLDEHRVAQIIKLVDDENFGQLFISDTHAERTEAAVKQIHQSYEIFRL

SEQ ID NO: 24023 - DNA, 312 bp, Unknown
  Obtained from environmental sample
  misc_feature (1)..(312): n is a, c, g, or t
atgaataaatattttatcataatactaatattcatatgttttgattctggctcgcaaaacgaaactaaaatgataacgcctaanaacgctaaagagaaatttgaaatatttgttttaaaaaagaaatttcatgaagaaaattattatcctggaattaccgaagagaaaatgcgacccatattgacaacaaaaattaatgaagtcgcaaatgattttagaagtatagctgaatctacaaatcccactgatggaaagtatcaagaaaaaattagagttgggctttctcgtttttcagatatctatttaaattag

SEQ ID NO: 24024 - protein, 103 aa, Unknown
  Obtained from environmental sample
  SIGNAL (1)...(20)
  misc_feature (1)..(103): Xaa is any amino acid
MNKYFIIILIFICFDSGSQNETKMITPXNAKEKFEIFVLKKKFHEENYYPGITEEKMRPILTTKINEVANDFRSIAESTNPTDGKYQEKIRVGLSRFSDIYLN

SEQ ID NO: 24025 - DNA, 945 bp, Unknown
  Obtained from environmental sample
  misc_feature (1)..(945): n is a, c, g, or t
atgtacttaatgatggaaaagcacacatnccgtggtcaagatggtgctggttttgcaagtattaaaatggacacgcttccaggagaacgttacattagtcgtgtacgctccatagcacaacacctatttcaggatatttttgcacaaattaacgaacgtgtaaataaagagttagcacaacatccagaataccaagatagcgttgcgcttcaaaaaaaacacataccttatattggtgagttactattaggacacgtgcgttatggtacgtttggtaaaaacagtgtggaaagtgtccatccttttttaagacaaaataactggatgcatcgtaacctgattttggcaggtaactttaatatgactaatgttaaagagctgtttaaaaacctagtggaccttggacaacatccaaaagaatatacagacaccattactataatggaaaaaataggtcactttttagatgatgcagtaagtaaaatctataaagacctaaaaaaagaaggttacggtaaacacgaatgctcacctttaattgccgaacgtttaaaaattgccaaaatattaagacgtgctgctaaaaattgggatggtggttatgctatggctggtttaattggacatggagatgcttttgtacttcgtgatccagcaggtatacgtcctgtatattactatacagatgacgagatagttgttgttgcttcagaacgtcctgtgatacaaacagtttttaatgtcgagtttgaggatgttaaagagctaactccaggtcatgctttaatctctaaaaaatctggtgcagtttcgataaaaaaaatattagaacccttagagcgtaaatcttgtagttttgagcgcatttacttttctagaggaagtgatgccgaaatctatcaagagcgtaaaatgcttggacgtttattaatgccacaagtttaa

SEQ ID NO: 24026 - protein, 314 aa, Unknown
  Obtained from environmental sample
  DOMAIN (4)...(153): Glutamine amidotransferases class-II
  misc_feature (1)..(314): Xaa is any amino acid
MYLMMEKHTXRGQDGAGFASIKMDTLPGERYISRVRSIAQHLFQDIFAQINERVNKELAQHPEYQDSVALQKKHIPYIGELLLGHVRYGTFGKNSVESVHPFLRQNNWMHRNLILAGNFNMTNVKELFKNLVDLGQHPKEYTDTITIMEKIGHFLDDAVSKIYKDLKKEGYGKHECSPLIAERLKIAKILRRAAKNWDGGYAMAGLIGHGDAFVLRDPAGIRPVYYYTDDEIVVVASERPVIQTVFNVEFEDVKELTPGHALISKKSGAVSIKKILEPLERKSCSFERIYFSRGSDAEIYQERKMLGRLLMPQV

SEQ ID NO: 24027 - DNA, 501 bp, Unknown
  Obtained from environmental sample
  misc_feature (1)..(501): n is a, c, g, or t
gtgactacaaaaaacgtagaactcgccaacgtaataaagcaattgcgtaattatggtacgtcctctaaatatgttaacgaacgattaggcgttaataaccgcttagacgaaattcaagcacggtttttatctgtgaaattgaagtatttagatgccgataataataaaagacgcgacgttgcaaaacgttatttacaaagtatagcaaataaaaaagtaatcttgccatattataacggttctaaaaatcacgtgtttcacttgtttgtagttttagtagaagaacgcgaggtgtttataaactatttaaaacaaaatggagtagagactgcagtgcattatcccattgctccgcaccagcaaaatgccttaaaaacgtatagtgatttagcgttacctattaccgaaaaaatacataaaaactgtgtaagtttaccaataagtccagtaatggaagcatttgaagtcgataaaatcatagacctcataaacgattactaa

SEQ ID NO: 24028 - protein, 166 aa, Unknown
  Obtained from environmental sample
  DOMAIN (1)...(164): DegT/DnrJ/EryC1/StrS aminotransferase family
  misc_feature (1)..(166): Xaa is any amino acid
MTTKNVELANVIKQLRNYGTSSKYVNERLGVNNRLDEIQARFLSVKLKYLDADNNKRRDVAKRYLQSIANKKVILPYYNGSKNHVFHLFVVLVEEREVFINYLKQNGVETAVHYPIAPHQQNALKTYSDLALPITEKIHKNCVSLPISPVMEAFEVDKIIDLINDY

SEQ ID NO: 24029 - DNA, 831 bp, Unknown
  Obtained from environmental sample
  misc_feature (1)..(831): n is a, c, g, or t
atgacagatcggctgagctttttaccagaatctcttgcggcaaaagagatagaattacttattaatcagtccgcgtttaatgacaccttccaatttgatgatggtaaattgactatggttggttttaagttatctaaaaatgctccgtttgtaggaaaaagtgtaaaagaagctgctagtatttttcctaaacttcattttattcctatagccattcagcgatttggtacacaatatactcttataccaagaggagatactcaatttagagaaggagatcaagtatattttatcactaccgaagatggtgtacaagaactttataagcttactggaaaagtaaaacaagagattataaatgtaatgatccttggcggaagtaaaattgggagacatactgcaatggtattaagtgcagctaaattcaatgtaaagctggtagagaaagatcatgataaagcgttcgagctagctgatgaaatgtctaaggttttagtaattaaaggagacgggagaaatgtagggcttctagaagaagaaaatatccatgacatggatgcctttatcgctgttactggaaattctgaaactaatattatgtcatgcttagtggcaaaatctaagagtgttaaaaaaacaatttctttggtggagaatatggactattttcagctcagtcattctataggaattaatacgcttattaataagaagcttcttgctgcaaataatatttttagatacgtaagaaaaggagaagtggtcgctatgactaaactcaataatatgaatgcagagttgctagagtttattgtaaatcttaatttctaa

SEQ ID NO: 24030 - protein, 276 aa, Unknown
  Obtained from environmental sample
  DOMAIN (120)...(237): TrkA-N domain
  misc_feature (1)..(276): Xaa is any amino acid
MTDRLSFLPESLAAKEIELLINQSAFNDTFQFDDGKLTMVGFKLSKNAPFVGKSVKEAASIFPKLHFIPIAIQRFGTQYTLIPRGDTQFREGDQVYFITTEDGVQELYKLTGKVKQEIINVMILGGSKIGRHTAMVLSAAKFNVKLVEKDHDKAFELADEMSKVLVIKGDGRNVGLLEEENIHDMDAFIAVTGNSETNIMSCLVAKSKSVKKTISLVENMDYFQLSHSIGINTLINKKLLAANNIFRYVRKGEVVAMTKLNNMNAELLEFIVNLNF

SEQ ID NO: 24031 - DNA, 411 bp, Unknown
  Obtained from environmental sample
  misc_feature (1)..(411): n is a, c, g, or t
ttggctggaggcaaggctttcttcttgaaaaatggcaaaaacagtaatcgttccctccgtccggatggtggtttttatctaaggggggttgctaaattcacaaattcagggcgtcggatttggagcaatttatcatggaaaacttctagattgtttcttgaaacagcaaaatatttaaaggaacatggtggcgagttgattcgattgcagacttttatggatttggacaataaaacggatctaaaactatttataaatcgatttaaatctgtttcctcacaactttcagacataataatctccctcatcttctttaagaagtccaaaatattctatttcaaattcatttttctatctaaatatctttccgaaaactattacaataaaggctccccttttttacttcattaa

SEQ ID NO: 24032 - protein, 136 aa, Unknown
  Obtained from environmental sample
  misc_feature (1)..(136): Xaa is any amino acid
MAGGKAFFLKNGKNSNRSLRPDGGFYLRGVAKFTNSGRRIWSNLSWKTSRLFLETAKYLKEHGGELIRLQTFMDLDNKTDLKLFINRFKSVSSQLSDIIISLIFFKKSKIFYFKFIFLSKYLSENYYNKGSPFLLH

SEQ ID NO: 24033 - DNA, 462 bp, Unknown
  Obtained from environmental sample
  misc_feature (1)..(462): n is a, c, g, or t
atgaaagacaaaaccatagattacgtccttagaaccacatggttagcagttaataaaatgtacaacgaagaagctgctaaatttggtacaactatggctactggttttactttattaagtattgatcaagaagaaggaacaccttccacctcattaggtccaattatgggtatggaagcaactagtctttccagaatcctaaaacgtatggaagaattagatttaatagtacgtcgaccaaacccaaatgatggtcgtggtgtattaatttatctaacaccttttggtaaagaaaaacgtaaagatgccaaagagcgtgttttagtttttaacgaagcaattagagaacacgtatctgatgaaaaattaaaaagcttttacgaagtttcggatacaattaatgaattgatccccaacaaaaaaatattccatccaaaagaacccccctttaaaataatatga

SEQ ID NO: 24034 - protein, 153 aa, Unknown
  Obtained from environmental sample
  DOMAIN (30)...(133): MarR family
  misc_feature (1)..(153): Xaa is any amino acid
MKDKTIDYVLRTTWLAVNKMYNEEAAKFGTTMATGFTLLSIDQEEGTPSTSLGPIMGMEATSLSRILKRMEELDLIVRRPNPNDGRGVLIYLTPFGKEKRKDAKERVLVFNEAIREHVSDEKLKSFYEVSDTINELIPNKKIFHPKEPPFKII

SEQ ID NO: 24035 - DNA, 915 bp, Unknown
  Obtained from environmental sample
  misc_feature (1)..(915): n is a, c, g, or t
ttgggattaccaattgttaaaccagacgattataagtatacaaatcttgaagaagccagcagagagtttgaaaagatttttactgatgcagtcaaattaagactgagagcagatgttcaggtagcggcttatttaagtggagggattgattcgagtgttacaacctcatttatcaaaagtattttaccagataatcttagaactttttctattggttttacagaaaaagattacgatgagtcatcgtatcaaaatatagctgcttcattttttaataccaaacattcaagtgttgtttgcagtccgaatgacattgctgaaaatttcaaaagcgttatatggcactctgaagccccattattgcgtactgctccagcaccaatgagcctattggctaaaagtgttaaagaaagtaatattaaagtagttataactggtgaaggtgctgacgaattgttgggaggatataatatttttaaagaaacaaaaattagacatttttgggcaaaagacccccaatctaaatatagatcacttttgctaaaaaagttgtatccatatctgcctcaaatgaacaatgctaacagcaatgtgctaaagatgttttttggttacaaactgaaagaaacttcttcatctatttattctcatttattaaggtggaataatacttctcgtattaataattatttatcagaagaatataaaaaagaaattggtgattacaatgcaattagtaaatttgaaaaactagttgatcataaactaaaggggtatgattatttatcaaaagcgcaatggattgaattaaaactttttatgtcaggatatttactatcctctcaggagatagaatggcaatgggccaattcattgaagggaagatatccttttttagatcatcgggtaaattga

SEQ ID NO: 24036 - protein, 304 aa, Unknown
  Obtained from environmental sample
  DOMAIN (22)...(303): Asparagine synthase
  misc_feature (1)..(304): Xaa is any amino acid
MGLPIVKPDDYKYTNLEEASREFEKIFTDAVKLRLRADVQVAAYLSGGIDSSVTTSFIKSILPDNLRTFSIGFTEKDYDESSYQNIAASFFNTKHSSVVCSPNDIAENFKSVIWHSEAPLLRTAPAPMSLLAKSVKESNIKVVITGEGADELLGGYNIFKETKIRHFWAKDPQSKYRSLLLKKLYPYLPQMNNANSNVLKMFFGYKLKETSSSIYSHLLRWNNTSRINNYLSEEYKKEIGDYNAISKFEKLVDHKLKGYDYLSKAQWIELKLFMSGYLLSSQEIEWQWANSLKGRYPFLDHRVN

SEQ ID NO: 24037 - DNA, 570 bp, Unknown
  Obtained from environmental sample
  misc_feature (1)..(570): n is a, c, g, or t
atggcaagtccaactttcggaatagtcactgaagttgattgtgatgtatgctttatgaattctaaagtaaatgaggaatcattctttgcaaattatttacataaatcaatgattgctgttaattctgtagatgaactaaaatatagaatcatagatgacgagataataaaattcgaaaaaattcatgctggaataactataggaagagaagatgaaacattcggatttggatttgtgaattttacttctgattttgaaacctttaacgcagaattagagagggaaattttagcagtaaaaaactgttcaggattaagactaaataacgatgatgttaaaaagaatttaatacggcattcaacctttccttggaattcatttagcggcttattacatccaacaaattttgatcaaaaagaatctgttccaaaaataacttttggaaaatttataattcgagaaggcaaaaaaatgttgccgatttccatagaagcacatcatggattagttgatggctttcatatagcaaaatatttaaatgaatttcaaaatcaacttaatataaaataa

SEQ ID NO: 24038 - protein, 189 aa, Unknown
  Obtained from environmental sample
  DOMAIN (5)...(183): Chloramphenicol acetyltransferase
  misc_feature (1)..(189): Xaa is any amino acid
MASPTFGIVTEVDCDVCFMNSKVNEESFFANYLHKSMIAVNSVDELKYRIIDDEIIKFEKIHAGITIGREDETFGFGFVNFTSDFETFNAELEREILAVKNCSGLRLNNDDVKKNLIRHSTFPWNSFSGLLHPTNFDQKESVPKITFGKFIIREGKKMLPISIEAHHGLVDGFHIAKYLNEFQNQLNIK

SEQ ID NO: 24039 - DNA, 657 bp, Unknown
  Obtained from environmental sample
  misc_feature (1)..(657): n is a, c, g, or t
atgaaaaaccaaagcacaacagttcttgctacagatgataagggaatagaaataaatcccaatactctaaaaacatgggtaactaataaatcaaaaatagaattagctaattttttttatcatagattttatggtcgttacatcaaaccatttgactttaaaaataaagaatatataaatgagtataaaaatgggtttgcaattatgacgagttgctgccttttaattgaaacatatacatcatttgcagaactagcatttttaaatacaaaccacaagagtgagaaaacctttggatacttcttccttaaaaacattgaatttcaatcattttctaaaaatggattgcaattaaacgaatatctatcagagaatagaattaaaaataaagggattccatccgacttttacaaaaacgttagatgtggtattttacacaatggtgaaacgcgaaatggatggaaaattgttagaaacggaccgttatttgacgaaaattccaagcgtattaactctgttttatttctagaaaagttgaaaaatattctaataaactttaaaactaaattaatcgcatctgattttgacaatagcgaaatatggaaaacttacaggagtcgaatagagattttaattgaggaaacggaaaataactaa

SEQ ID NO: 24040 - protein, 218 aa, Unknown
  Obtained from environmental sample
  misc_feature (1)..(218): Xaa is any amino acid
MKNQSTTVLATDDKGIEINPNTLKTWVTNKSKIELANFFYHRFYGRYIKPFDFKNKEYINEYKNGFAIMTSCCLLIETYTSFAELAFLNTNHKSEKTFGYFFLKNIEFQSFSKNGLQLNEYLSENRIKNKGIPSDFYKNVRCGILHNGETRNGWKIVRNGPLFDENSKRINSVLFLEKLKNILINFKTKLIASDFDNSEIWKTYRSRIEILIEETENN

SEQ ID NO: 24041 - DNA, 639 bp, Unknown
  Obtained from environmental sample
  misc_feature (1)..(639): n is a, c, g, or t
gtggcaacattacacaaaacaatgcggaaatacgaaaatgttgaatatacaaacccatttgaattactattcttacttggttcaacaatagctgtcttttcgggaataatatttgtgttgaatagaattatgagttttgggctattaaaaggaattttagcttttcttcttgctggaatttatttctatatattaaaaaagaagtttatagtaaaagtttcagattttgaattaacatcaaatcagttggaatggaataataaaaatgttgattttaaaaatttagaatattataaaattcattggatgaaaggagctggaataaaatttaagctcaaaaatggaaaaacagtccgattaagctcaaatgacaatttttgcaattccgaaaaattcgtgaatttatgctataatattgactcaaaactcttgaaatataataacggacaaatagaaaggaaaaaatcgtttttcgaatctaaacaaggatattacttcgctgtaattatgtcgattttatttgtgattgggacaatttacaaatcgtttacggatgagaaatttaattttgggaattttgcgttaattttagtttcattaggaattgtatggagtggagttaaatggaaaagaaaataa

SEQ ID NO: 24042 - protein, 212 aa, Unknown
  Obtained from environmental sample
  misc_feature (1)..(212): Xaa is any amino acid
MATLHKTMRKYENVEYTNPFELLFLLGSTIAVFSGIIFVLNRIMSFGLLKGILAFLLAGIYFYILKKKFIVKVSDFELTSNQLEWNNKNVDFKNLEYYKIHWMKGAGIKFKLKNGKTVRLSSNDNFCNSEKFVNLCYNIDSKLLKYNNGQIERKKSFFESKQGYYFAVIMSILFVIGTIYKSFTDEKFNFGNFALILVSLGIVWSGVKWKRK

SEQ ID NO: 24043 - DNA, 687 bp, Unknown
  Obtained from environmental sample
  misc_feature (1)..(687): n is a, c, g, or t
atgccatatccacaaattaaagaatcacttgaagcattacaaggctcgaaactttcgtttaaatattcagcaacagacaccaaaaatacaaatattgatgattcattttacgaatcgaacatgaactttttatcgtcactgcattttagtggaaaaaaaggtcaaggcgggaatgttaaatgtgttgcgtgtttaaatgcatttgtgcataacatgattgataaccttgaatacaaaggatattactttaacagcgcccaagaattaaaacgcggattgtcgcgttggatgatgctacgcttatatcatctttggcgttatgcagcgccgggtaaaacataccattttagattactgtctattatggaaaagtacggctcaatttattcaacggataatattaccgaaaataaattaaaagcgctgcgtcgtgatatgaccacaacaatgaaagatctgatcgaaaaaggggctatctctgagtacagtattaccaatgttaaagacgacaaaaccggtaatattattgactacacttacgaaatgcatccatcagaccaattttgtgatgagatacttactctgaataaacacaataaacgtattgaaatacaaggcggtaagcgtattgttgaaaatgctgtgcttattgatgaagacaaacttgttgaaatagtagataagtaa

SEQ ID NO: 24044 - protein, 228 aa, Unknown
  Obtained from environmental sample
  misc_feature (1)..(228): Xaa is any amino acid
MPYPQIKESLEALQGSKLSFKYSATDTKNTNIDDSFYESNMNFLSSLHFSGKKGQGGNVKCVACLNAFVHNMIDNLEYKGYYFNSAQELKRGLSRWMMLRLYHLWRYAAPGKTYHFRLLSIMEKYGSIYSTDNITENKLKALRRDMTTTMKDLIEKGAISEYSITNVKDDKTGNIIDYTYEMHPSDQFCDEILTLNKHNKRIEIQGGKRIVENAVLIDEDKLVEIVDK

SEQ ID NO: 24045 - DNA, 960 bp, Unknown
  Obtained from environmental sample
  misc_feature (1)..(960): n is a, c, g, or t
ttggaagcaaagctttttcagagcaattccattaatacggctcatttattgttgtgcattcttcggaatgaaaatgacccaacaacgaaattgttgaacaaaatgaagatagattatgacgtggtaaaagaccaatttaaacttatgattacaaacgacgacgattatatagatactccaagcgctgaatcattcccgaatgaagatgacacttctggtgaagatgccggaaaagaaaacttattttcaggaaccaccgcaaaaacgaacaaaaaatccaagacacctgttttggacaacttcggaagggatcttactgcaatggcagaagaagggaaacttgatcctgttgtaggtcgcgaaagcgaaattcaacgtgtttcacagattttaagtaggagaaagaaaaacaaccccttactaatcggtgagcctggcgttggtaaatctgcaatcgcagaaggccttgcgcttcgcataattcaacgaaaagtatcgcgtattctttatgacaaaagagtggttaccttggatttggcaagccttgtggctggaaccaaatatcgtgggcagtttgaagaacgcatgaaagccgtgatgaacgagcttgaaaaaaatgacgacattattcttttcatagatgaaattcacactattgttggtgctggtggcgctacaggttccttagatgcttcaaatatgttcaaacctgcgttggcacggggtgaaatcaatgtattggtgcaaccactttggatgaatacagacaatatattgaaaaagacggcgccctcgaaagacgtttccaaaaagtattggttgaaccaacttctgttgaagaaactatcgagattcttattgaatattaaggataaatacgaagcaccaccccaatgtaatctataccgaatgaagcccttgaagcttgcgtggaagctaccaattagatttatgacctga

SEQ ID NO: 24046 - protein, 319 aa, Unknown
  Obtained from environmental sample
  DOMAIN (138)...(316): ATPase family associated with various cellular activities (AAA)
  misc_feature (1)..(319): Xaa is any amino acid
MEAKLFQSNSINTAHLLLCILRNENDPTTKLLNKMKIDYDVVKDQFKLMITNDDDYIDTPSAESFPNEDDTSGEDAGKENLFSGTTAKTNKKSKTPVLDNFGRDLTAMAEEGKLDPVVGRESEIQRVSQILSRRKKNNPLLIGEPGVGKSAIAEGLALRIIQRKVSRILYDKRVVTLDLASLVAGTKYRGQFEERMKAVMNELEKNDDIILFIDEIHTIVGAGGATGSLDASNMFKPALARGEINVLVQPLWMNTDNILKKTAPSKDVSKKYWLNQLLLKKLSRFLLNIKDKYEAPPQCNLYRMKPLKLAWKLPIRFMT

SEQ ID NO: 24047 - DNA, 306 bp, Unknown
  Obtained from environmental sample
  misc_feature (1)..(306): n is a, c, g, or t
atgaataaacagcaaaaaataaaacactggcaaggcatttttgagcagcaaaaatcgagtggtttagccatcattcaattttgtcgtgataacaacattaacgcatcgactttctatgtttggcgtaaacgcctttctgacgaaacgataagggttaaaaagcaacaggtgatcccgtttgttattcatgagcaagcctttacacacccttcaatcattaaactcaccataccaaacggctatcaaatagacttcgagtcgacattagcgcaccaagcactcgccaaattattgagcgtactgtga

SEQ ID NO: 24048 - protein, 101 aa, Unknown
  Obtained from environmental sample
  misc_feature (1)..(101): Xaa is any amino acid
MNKQQKIKHWQGIFEQQKSSGLAIIQFCRDNNINASTFYVWRKRLSDETIRVKKQQVIPFVIHEQAFTHPSIIKLTIPNGYQIDFESTLAHQALAKLLSVL

SEQ ID NO: 24049 - DNA, 327 bp, Unknown
  Obtained from environmental sample
  misc_feature (1)..(327): n is a, c, g, or t
ttgcgggtacgaggttcggagtttccaaataagtccaccgatcaatccctctgcggcatcattaaagaattttgtacttcctgtagtaccggattctctttgttcaagaagattctcgataagtaccctggaaacttcgtttacgctttcctcattttcaagatatcttggcgcgattggatttactttatggataattttatcaaaagaaattatataaaaaggaatttccgaatccctaaagagtggaaaggccatttcggtgatctcaaaatccttgtagtcgtggattaccccacagaagaaatactttttaaaatgctttag

SEQ ID NO: 24050 - protein, 108 aa, Unknown
  Obtained from environmental sample
  misc_feature (1)..(108): Xaa is any amino acid
MRVRGSEFPNKSTDQSLCGIIKEFCTSCSTGFSLFKKILDKYPGNFVYAFLIFKISWRDWIYFMDNFIKRNYIKRNFRIPKEWKGHFGDLKILVVVDYPTEEILFKML

SEQ ID NO: 24051 - DNA, 339 bp, Unknown
  Obtained from environmental sample
  misc_feature (1)..(339): n is a, c, g, or t
ttgggagaaaaaacgataaatgaccaagcctatgacatcgttaaagtcacttttgatattgcgaataaagaagccacggacatctatcatttgtatattaataaaaagaccaatttggtagatcaattcctttttacagtggcagactatgatgttattgaaacgccatatctaatgatacttgaatacgaaacgattgatggcctcattttaccaacacgacgtaagtataaaaaatccacttgggatgctaatatctctgaggagccttggatagtggttacatggtctgacattaagttcgataataatttaactaaagaagagtttcaaaaataa

SEQ ID NO: 24052 - protein, 112 aa, Unknown
  Obtained from environmental sample
  misc_feature (1)..(112): Xaa is any amino acid
MGEKTINDQAYDIVKVTFDIANKEATDIYHLYINKKTNLVDQFLFTVADYDVIETPYLMILEYETIDGLILPTRRKYKKSTWDANISEEPWIVVTWSDIKFDNNLTKEEFQK

SEQ ID NO: 24053 - DNA, 621 bp, Unknown
  Obtained from environmental sample
  misc_feature (1)..(621): n is a, c, g, or t
gtgaaagaaaacaaacaacatagtattaatgaccaattggatattatatacgaagaacttatagcttatcagcagcaaggtaaaattacttttgaagaacgtatttgggtttggtcacaatgttcacaatggttgcacattaaaaatactatttacatagagcagatcaggcttttctttattgataagggactagatgaacctagcttctttactcaatataatcgtgaagtaacgaggctgcgcatagttggtgatgacagcaagccagaaaaagttatgataaaaaagcaatttgatacagcactaatgactatggcttacttgaaagccgtaggtgcaaatgtaaaagaagcatcaatatttgcggctataacagttgctttggaatttaaaggcaaagcaaaaaataatatcacagcatcatctattgcaaagaagtaccctaaacaattcaaaaataaatcaataaattctaataagtctattgaggacgaaataaaagctattgtagagagtgatactaagcttaaagctacctggttaagtcagttagatggttttagaagacgatttgatatcgacaatttggctgattgtatagtaggaacacgtaggtaa

SEQ ID NO: 24054 - protein, 206 aa, Unknown
  Obtained from environmental sample
  misc_feature (1)..(206): Xaa is any amino acid
MKENKQHSINDQLDIIYEELIAYQQQGKITFEERIWVWSQCSQWLHIKNTIYIEQIRLFFIDKGLDEPSFFTQYNREVTRLRIVGDDSKPEKVMIKKQFDTALMTMAYLKAVGANVKEASIFAAITVALEFKGKAKNNITASSIAKKYPKQFKNKSINSNKSIEDEIKAIVESDTKLKATWLSQLDGFRRRFDIDNLADCIVGTRR

SEQ ID NO: 24055 - DNA, 672 bp, Unknown
  Obtained from environmental sample
  misc_feature (1)..(672): n is a, c, g, or t
atgagcattaaactagcaatagagtttcttgaaaaattagaaaaaaataataatcgcgaatggtttgcagataacaaaccagagtatgataaggcgttaaaagtaactaaattggtttttaatgacatatattcaaaaatgcaagtgcatgatgaacttgataaaatgaagctgtttaggatttatagagacgtgcgtttttctaaaaataaattaccttacaaaaataattttggaggtacgttccatcgtgttaaaccaagattacgaggtggatattatgtgcaaatacaaccaggaaataattttattgcctgtggtttttgggatcctagcaaagacgatttgttaagaattagaaaagaatttgaaatggatgattatgagattaaatcaatcattaatgattcaaaatttaaatctgtttggggagcactaaaaggtgacgaactaaaaacagctccaagaaattttgacaaagatcatgaagctattgatttaattaagaaaaagcaatacatattttctatacaatttacagacgcagaagtcatctcagaagactttgctcaaaaggtcaatgactattttaaaaccattagacccttttttgattatatgagtgatgtattaactacagacttaaatggtgtgtctttaatacaagattaa

SEQ ID NO: 24056 - protein, 223 aa, Unknown
  Obtained from environmental sample
  misc_feature (1)..(223): Xaa is any amino acid
MSIKLAIEFLEKLEKNNNREWFADNKPEYDKALKVTKLVFNDIYSKMQVHDELDKMKLFRIYRDVRFSKNKLPYKNNFGGTFHRVKPRLRGGYYVQIQPGNNFIACGFWDPSKDDLLRIRKEFEMDDYEIKSIINDSKFKSVWGALKGDELKTAPRNFDKDHEAIDLIKKKQYIFSIQFTDAEVISEDFAQKVNDYFKTIRPFFDYMSDVLTTDLNGVSLIQD

SEQ ID NO: 24057 - DNA, 660 bp, Unknown
  Obtained from environmental sample
  misc_feature (1)..(660): n is a, c, g, or t
atgaaatttgaattagataatgtagaactttactttaaaaataagcgtattttacaaggtatttaccttaaagcagaaacaggatacgttactgctgtattaggcagaaatggctgtggtaaaagttctttactcaacattgcgtttggaaacttaaaacccaaatacatgttagttagaatagacaacaaaccactattgaaacctttatacaccacaaaacgcgccgtatatttaccacagtaccattttatcccaagtgatgttactttggcgtttgtgtttaaattatacgtagttgattgggttgtatttattgaaagttttaaagcttttgctaaatataaaaagtctaattttaaagtattatcaggtggagaaagacggattgttgaaacctatattattctaaaaactaaaagtgaaatcgtatttttagacgaacctttttctcatttatctcctttacacattgacacggtaaaacaacttattaaaacagagaaaaaagagaaagtgattataatttcagatcatatgtaccaacacatcattgatgcctcggattgtatttatttattaaataatggcaccacaaaaaagattaatcagctctcagagcttgaggattacaaatacctaagtgaaggtacgttgtaa

SEQ ID NO: 24058 - protein, 219 aa, Unknown
  Obtained from environmental sample
  DOMAIN (28)...(197): ABC transporter
  misc_feature (1)..(219): Xaa is any amino acid
MKFELDNVELYFKNKRILQGIYLKAETGYVTAVLGRNGCGKSSLLNIAFGNLKPKYMLVRIDNKPLLKPLYTTKRAVYLPQYHFIPSDVTLAFVFKLYVVDWVVFIESFKAFAKYKKSNFKVLSGGERRIVETYIILKTKSEIVFLDEPFSHLSPLHIDTVKQLIKTEKKEKVIIISDHMYQHIIDASDCIYLLNNGTTKKINQLSELEDYKYLSEGTL

SEQ ID NO: 24059 - DNA, 579 bp, Unknown
  Obtained from environmental sample
  misc_feature (1)..(579): n is a, c, g, or t
atgcaggtaagtccatttagaaacagcagcaatcttaaaaaagccattaaagaatttaaagtactgtttcctgattctaattatttagtaaaaatagaggaattagcagaaaatatagatttgttaaataagatgccacctaaagagattcttcatgaaaaattaattacgatgcatggagataccctaacgtttaacgatatacttacacaaacagataagaaaattagggtgatagatttttgggcaagttggtgtggtccttgtattaatgatataaaaaatggaggtaaaaacaaagccttatatgccaaagaatacttgttagactgggtatatatttccatagatacagaggtagaaaaatggaaacaaaaggctatagaattaaaaaaacacggaaccttaaagcatcaatatcttttactagactccgaaaactcagaaataaaaaggaaatttgaacttaacaccataccaaggtatgttattattgataaaaatggatatctatacaatgataatgcaccaaaaccaactgaatataatagctttatgagtgctttaaagggtttgtaa

SEQ ID NO: 24060 - protein, 192 aa, Unknown
  Obtained from environmental sample
  misc_feature (1)..(192): Xaa is any amino acid
MQVSPFRNSSNLKKAIKEFKVLFPDSNYLVKIEELAENIDLLNKMPPKEILHEKLITMHGDTLTFNDILTQTDKKIRVIDFWASWCGPCINDIKNGGKNKALYAKEYLLDWVYISIDTEVEKWKQKAIELKKHGTLKHQYLLLDSENSEIKRKFELNTIPRYVIIDKNGYLYNDNAPKPTEYNSFMSALKGL

SEQ ID NO: 24061 - DNA, 357 bp, Unknown
  Obtained from environmental sample
  misc_feature (1)..(357): n is a, c, g, or t
atgactaaaaagaaaaaacaagtcgataaagaatttggtttatcatcgtgggcaataaataacaaaaccacgatgtatgtcctaattgcagtaattttttacttagggatatctgcgttttttgacatgccaagagaaaactttccggaagtaaacgaaactaaaatatatgtaagttctatttacccaggaaacactgcagaggatattgaaaaattaatttcagatcctttagaagacaaattaaaaacggttagtaatgttgtagaaatcacctcaacatcgcaagaagactactcgatattaatagtcgagtttgatgatggtataaccgtagatcaggccaaacaaaagtaa

SEQ ID NO: 24062 - protein, 118 aa, Unknown
  Obtained from environmental sample
  misc_feature (1)..(118): Xaa is any amino acid
MTKKKKQVDKEFGLSSWAINNKTTMYVLIAVIFYLGISAFFDMPRENFPEVNETKIYVSSIYPGNTAEDIEKLISDPLEDKLKTVSNVVEITSTSQEDYSILIVEFDDGITVDQAKQK

SEQ ID NO: 24063 - DNA, 456 bp, Unknown
  Obtained from environmental sample
  misc_feature (1)..(456): n is a, c, g, or t
atgaaaaaaatactcatactttttttactaataagctcaacagtttctgcacaaaagaaattagacaaacttctagataaatggaacaccaggaatgttccttatatgtctgttgaaactttagcaatgccaaaaacagctgcaattttactggatgcaagagatgaaaaggaattcaacgtaagccatttagaaaatgcaatacgtgttggatatgatgattttaaaactaaagaaaccatagctatattaccaaaagacaaaagcacaaaaattgtggtgtattgttctttaggaatcagatctgaaactgttgctcataaattaattcaaggaaggatataccaatgtttacaattttatatggaaggaatcttcgaatgggaaaaatgccgaattttaaaagtgattgaatactttagggaaaatccaccagaaaaagtccctcccttttaa

SEQ ID NO: 24064 - protein, 151 aa, Unknown
  Obtained from environmental sample
  SIGNAL (1)...(17)
  DOMAIN (37)...(131): Rhodanese-like domain
  misc_feature (1)..(151): Xaa is any amino acid
MKKILILFLLISSTVSAQKKLDKLLDKWNTRNVPYMSVETLAMPKTAAILLDARDEKEFNVSHLENAIRVGYDDFKTKETIAILPKDKSTKIVVYCSLGIRSETVAHKLIQGRIYQCLQFYMEGIFEWEKCRILKVIEYFRENPPEKVPPF

SEQ ID NO: 24065 - DNA, 816 bp, Unknown
  Obtained from environmental sample
  misc_feature (1)..(816): n is a, c, g, or t
gtgtattataaagataggtaccttgcattaaacgttaagattatcagcttagctctaataatatttgccattatctcttttttttataagatctaccaagggcgaaattcatatgctcagatactagacgataaatttcaatctgaagaaataataaacgaaatccgtcaaaattctgaagaccttaccaggttagccagattgtataccaatacaaaggacacgctttacaaaaatcaatattttgaaatcttaaacatcagtaaaggcgtatcgcctcggcccgagaattttaacagggtttactggggtattttaactacaaaagatcagcaagaccccccctttgtaaaaacgattaaaaaatcgggttcacaactaatagccactgcaaaattggacacacttgaaaaggagaggatttccaatgccctaaactattcccttttattaacacagcgagaaatagaagcactccgtgttttagaaggagcaccttcagttggaaacacacctgaagctctcccaaatcaaaaaaaggcaattgacttagtgaattctgaggattatcacaagcgtgttatattaataatggaagaattaaacaaggcttaccaattgctggatacccgaaccaccaaagaattatccaccttggaaagtgaaattaaaaaaagtataatcataaattctggtcttttatttattatcattttaactatagtagtcattattcaatcggcttttccactaaaaaaagggacccatgaatcaattacaaatatcctgttcaaaacaaaaccaaagaaactttaa

SEQ ID NO: 24066 - protein, 271 aa, Unknown
  Obtained from environmental sample
  misc_feature (1)..(271): Xaa is any amino acid
MYYKDRYLALNVKIISLALIIFAIISFFYKIYQGRNSYAQILDDKFQSEEIINEIRQNSEDLTRLARLYTNTKDTLYKNQYFEILNISKGVSPRPENFNRVYWGILTTKDQQDPPFVKTIKKSGSQLIATAKLDTLEKERISNALNYSLLLTQREIEALRVLEGAPSVGNTPEALPNQKKAIDLVNSEDYHKRVILIMEELNKAYQLLDTRTTKELSTLESEIKKSIIINSGLLFIIILTIVVIIQSAFPLKKGTHESITNILFKTKPKKL

SEQ ID NO: 24067 - DNA, 786 bp, Unknown
  Obtained from environmental sample
  misc_feature (1)..(786): n is a, c, g, or t
ttggttcatttacaaatattcgtttcaaaccaaaaacaaagaaacttaagaaagttttatggttcaccagggaaatcccaaaggactttacagacattgaatatttccaaagacctttttttctccattatagcccatgatttaaaaggtcttttaaattcactcattggttttagcacccttttgttagatgatcctgtcgtcaatgaacatgaagaattaaaagaatctgtccaaattataaaaagcagttcccaaaacaccttcgaattgttgcaaaatcttttaaattgggctcaaatacagaaaggaaatttaccgtttactcgtgaaaacctaaaaattgacgatatcgtaaataatgtattgaaagttttaagctatcaatcaatgcataagaatattgaaattaaaactataataccagacggtcctatactggtatatgccgataaagatatgctgagcaccatcctaaggaacttaatctccaatgccattaaatacagccacaagaatggcactattgaaataatctgcgaaaaaacaaccaatgcggtaaatatcattatttctgacaccggaattggtatacctgaagaaagaatcaagaaacttttcgattttcagtatgttcaaaaaaccagaggtacacaaggagaaaaaggaactggtctgggtttaatcctcaccaaagattttattcaaagacaccatggttccatttgggttgaaagcgaattgggcaagggttctaaatttacgtttactttacctgatttttag

SEQ ID NO: 24068 - protein, 261 aa, Unknown
  Obtained from environmental sample
  DOMAIN (36)...(104): His Kinase A (phosphoacceptor) domain
  misc_feature (1)..(261): Xaa is any amino acid
MVHLQIFVSNQKQRNLRKFYGSPGKSQRTLQTLNISKDLFFSIIAHDLKGLLNSLIGFSTLLLDDPVVNEHEELKESVQIIKSSSQNTFELLQNLLNWAQIQKGNLPFTRENLKIDDIVNNVLKVLSYQSMHKNIEIKTIIPDGPILVYADKDMLSTILRNLISNAIKYSHKNGTIEIICEKTTNAVNIIISDTGIGIPEERIKKLFDFQYVQKTRGTQGEKGTGLGLILTKDFIQRHHGSIWVESELGKGSKFTFTLPDF

SEQ ID NO: 24069 - DNA, 348 bp, Unknown
  Obtained from environmental sample
  misc_feature (1)..(348): n is a, c, g, or t
gtgacttttaaagaaaatgaaaaagtaggctttgtaaatattccactaaacgatcacggtagattctacacatttaattctaaagaagattttcacattacttttatagatgatattgttcgctataaaatgtcatcggtgtttcccaatgaagaagttacaggcatttatgagataaaaatgtctcgagatgcagagttatatatcgatgatcaatacgatggtgttttagctgaaaagatttacgattctttagcccaacgaacagatgggcaacctacacgtttattgtacgatgcccatatgccaaaagattttcagaaaaaactaagaagacatctaggttag

SEQ ID NO: 24070 - protein, 115 aa, Unknown
  Obtained from environmental sample
  misc_feature (1)..(115): Xaa is any amino acid
MTFKENEKVGFVNIPLNDHGRFYTFNSKEDFHITFIDDIVRYKMSSVFPNEEVTGIYEIKMSRDAELYIDDQYDGVLAEKIYDSLAQRTDGQPTRLLYDAHMPKDFQKKLRRHLG

SEQ ID NO: 24071 - DNA, 660 bp, Unknown
  Obtained from environmental sample
  misc_feature (1)..(660): n is a, c, g, or t
gtgtttaatgagttagatgctttagtaaatatagatttagagactaggaaggttaaaaaagaacaccaacagcttacttttgtaaggattggaacatcgggatctattcaaaaagatattcctgtaaactcttttttagcttcagaaaaagcgattggttttgatggactcctatactattatgagagtgatgaattcttagagaaaggtattgccaataaacttcaagaacacttaaatttacatccgcataaagcaacaccttatgtagtaaattctagtaaaacccttttagatcattttacgaaagatgaaaaggtttttaaaggaatcacaggtacaaacgttggcttttacggtccgcaaggccgtgttttgagagcaagcttacaagatgaaaattttatagatgaattaaccagttttaagtatcaagattataaaatcactaatctagaaatggaaacaagtggtatttacggtatgtctaagctattaggtcacagagcattgtctatgaatgcaattatagcgaatagagaaactggagattttagtaatgatcctttacnagccgtagaagacctcattatatttacttttaaacaaaatggctactatataataggcctttatttaaacaaaactttagccgcctaa

SEQ ID NO: 24072 - protein, 219 aa, Unknown
  Obtained from environmental sample
  misc_feature (1)..(219): Xaa is any amino acid
MFNELDALVNIDLETRKVKKEHQQLTFVRIGTSGSIQKDIPVNSFLASEKAIGFDGLLYYYESDEFLEKGIANKLQEHLNLHPHKATPYVVNSSKTLLDHFTKDEKVFKGITGTNVGFYGPQGRVLRASLQDENFIDELTSFKYQDYKITNLEMETSGIYGMSKLLGHRALSMNAIIANRETGDFSNDPLXAVEDLIIFTFKQNGYYIIGLYLNKTLAA

SEQ ID NO: 24073 - DNA, 717 bp, Unknown
  Obtained from environmental sample
  misc_feature (1)..(717): n is a, c, g, or t
ttgtatttagcacccaatgctagtaaagggtttaacgattttcagtataaatatttaaaaggaagaaaagaagtcaataaaaatgtactgaagcagattaacgataacgatattatctatgtaagtaattttgatgcaaaaagtaaaacgggtagaaattttactttagagcattttaacgaaggtaaaatggcttataaaataagtgcagatagaattaattttattgatgcggattctacgtatcgattaaataactatgtgaaaagaaaaattaatgaacacgacgatattcttgaggtaacacgccgtaaagacactttgttttcattcgatttagaagatttaacacccgaagaatatatagccgaaactttacgctataacgaattagttcattttatagatcgcgaagaaaaacgtggctcatctaatattggtcgttataaattggagttgtacagaaaatggagtttaccagtttcggtatttatattaaccattattgcggttgccgtttcctctcgaaaaagaagaggaggaatgggggttaacttagcctttggtatttgcattgcaatggtgtttgtgtttttcgataaaatattcggaacgctagcctcacaatcagacttttctccattattggccgtgtggtttccaaacataatatttggggtcatagctgttattcttcttattaatgctaaacgataa

SEQ ID NO: 24074 - protein, 238 aa, Unknown
  Obtained from environmental sample
  misc_feature (1)..(238): Xaa is any amino acid
MYLAPNASKGFNDFQYKYLKGRKEVNKNVLKQINDNDIIYVSNFDAKSKTGRNFTLEHFNEGKMAYKISADRINFIDADSTYRLNNYVKRKINEHDDILEVTRRKDTLFSFDLEDLTPEEYIAETLRYNELVHFIDREEKRGSSNIGRYKLELYRKWSLPVSVFILTIIAVAVSSRKRRGGMGVNLAFGICIAMVFVFFDKIFGTLASQSDFSPLLAVWFPNIIFGVIAVILLINAKR

SEQ ID NO: 24075 - DNA, 813 bp, Unknown
  Obtained from environmental sample
  misc_feature (1)..(813): n is a, c, g, or t
atgaaaacactccaaataaaaacagcacaaaatgtaaatataaaatttacggctgcaaatgtatttcaaaggcttttagcttttactgtagataatgtaataaagttcgcttatatctattttggaatacaactttttgattttagcttgtttgatcctgctattaatggcgatacttggactgtaaaagccttagatgtgttgttcttcttacccgtaactttttactctttgtattccgaaattttaatggaaggccaaactttgggtaaaaagctcttaaagattaaagtaattaatgtagatggttttaaaccttctattacagactatattattcgttggtttctacgaattgtagactttaatttatttatgctgctctttgtgtatgtggcttccttagggttatcagaccaatataccttgttgatgttattatttatgggaggtaaattagtagggtttctgttgatattatttacagataagaatcaacgttttggagatattattgctgataccattgttatttatttaaaagacgatgtgcagttttcgcaaaccattttagagaatatcaacgatacttacaaacctacgtaccccaatgttattaaactttctgataatgatgcacgaattattaaagagacttttcaaacaaccatgaaactgaacgattatacaaccttgattaaattgcgttctaaaatactagaagtcactgatattaaatcggttcatcaaagtgacaaagaatttattgatacagttttaaaggattataattattacacacagaacatgtag

SEQ ID NO: 24076 - protein, 270 aa, Unknown
  Obtained from environmental sample
  DOMAIN (18)...(179): RDD family
  misc_feature (1)..(270): Xaa is any amino acid
MKTLQIKTAQNVNIKFTAANVFQRLLAFTVDNVIKFAYIYFGIQLFDFSLFDPAINGDTWTVKALDVLFFLPVTFYSLYSEILMEGQTLGKKLLKIKVINVDGFKPSITDYIIRWFLRIVDFNLFMLLFVYVASLGLSDQYTLLMLLFMGGKLVGFLLILFTDKNQRFGDIIADTIVIYLKDDVQFSQTILENINDTYKPTYPNVIKLSDNDARIIKETFQTTMKLNDYTTLIKLRSKILEVTDIKSVHQSDKEFIDTVLKDYNYYTQNM

SEQ ID NO: 24077 - DNA, 678 bp, Unknown
  Obtained from environmental sample
  misc_feature (1)..(678): n is a, c, g, or t
atggacattagaaaaatacaacatattctcgaacaactggctgacgtaaatgagcagttagtatctttatcggatgatatttggctgggcatcgatcatcgtgataatgagtcaattatcgagggctctcagtttattcaagactataatttggcaaccagtcaactgagtaaggctgctgctactgtcgaacaacagcttctaacatattttaaaaacgatatagaaagcgtacagccagtcattgagcatggcaatgatgacacgataaaaaaccagcgtatgataaaagagttggatcgtagcaaggcttactcgttaaacgataacttcacttataagcgtccctatggttttgtgctaaaaggtattgcttataccaatatcactacttggaaagcggtgtatctaaaagttttgcacgtactttacgagatgagccctgcagagttttcgactctactgactgataaacgctttattagtaaacgaggtaatcccttatttacgaaagatcctaaaaagctacgggtagctcagtctttgcctgctggtttttataccgaagtgaatatgtctgcaaatagtattaaggatacgcttttacaaattcttgcttatttttcaattgatgaaaaagaaatgaagatatatttgcgcgaagatagagatgcttag

SEQ ID NO: 24078 - protein, 225 aa, Unknown
  Obtained from environmental sample
  misc_feature (1)..(225): Xaa is any amino acid
MDIRKIQHILEQLADVNEQLVSLSDDIWLGIDHRDNESIIEGSQFIQDYNLATSQLSKAAATVEQQLLTYFKNDIESVQPVIEHGNDDTIKNQRMIKELDRSKAYSLNDNFTYKRPYGFVLKGIAYTNITTWKAVYLKVLHVLYEMSPAEFSTLLTDKRFISKRGNPLFTKDPKKLRVAQSLPAGFYTEVNMSANSIKDTLLQILAYFSIDEKEMKIYLREDRDA

SEQ ID NO: 24079 - DNA, 474 bp, Unknown
  Obtained from environmental sample
  misc_feature (1)..(474): n is a, c, g, or t
atggctgaggctttttcagcctgtttagattctgtaaacgttaatcatttgaaaagcacagtggagattcattttaaactaccaaaaaaatatgttacaaaaacttttggtaaattgataattgaagatggaaagaaagaagtcgtcaatgtttatctacttgatgaaatttacagtagaatattgaaaatgcattatgaaaaaatttattgctcaaagttttggaagggaatgattgaaattgagaatatttgggttgagattgagttttacaaagatattgatgagtcttctgaagaaatagattttgaggaattgattgttcataaagacataacctttaatcttcacgacaattattaccctattgaagataaaaaaagtatattttatcattgtccagatttaatctacccagatgattccagtcaaattactggaaaaaatttaaaaaaaagaatagataaaaaatga

SEQ ID NO: 24080 - protein, 157 aa, Unknown
  Obtained from environmental sample
  misc_feature (1)..(157): Xaa is any amino acid
MAEAFSACLDSVNVNHLKSTVEIHFKLPKKYVTKTFGKLIIEDGKKEVVNVYLLDEIYSRILKMHYEKIYCSKFWKGMIEIENIWVEIEFYKDIDESSEEIDFEELIVHKDITFNLHDNYYPIEDKKSIFYHCPDLIYPDDSSQITGKNLKKRIDKK

SEQ ID NO: 24081 - DNA, 399 bp, Unknown
  Obtained from environmental sample
  misc_feature (1)..(399): n is a, c, g, or t
atgaataaaaacccttttgaattcaagtatccagatgatattgatccaaatgatgtcattgatttatttgttccagtatttggagaatattatagcgttcctgtaattggtcacacattcattaatggagcacgtggatctggaaaaagtatgatgtttcgctttatgaaaccagattgccaagttttagtagatgatttagggattaaactagatcaaccaagaaaaatatctgatattggctattttggaatttatataccaataaaaaagggtcacttaaataaaaccgatattaagttaaacaataaacatggagaagctttgctcaatgagcattttatggttattaattttacattatcaatttttaaagaactttcagaggtttggttttga

SEQ ID NO: 24082 - protein, 132 aa, Unknown
  Obtained from environmental sample
  misc_feature (1)..(132): Xaa is any amino acid
MNKNPFEFKYPDDIDPNDVIDLFVPVFGEYYSVPVIGHTFINGARGSGKSMMFRFMKPDCQVLVDDLGIKLDQPRKISDIGYFGIYIPIKKGHLNKTDIKLNNKHGEALLNEHFMVINFTLSIFKELSEVWF

SEQ ID NO: 24083 - DNA, 402 bp, Unknown
  Obtained from environmental sample
  misc_feature (1)..(402): n is a, c, g, or t
atgaagaaaaaagaagtaccacaggataaaagcaatttggaatcagccaactttcgggaattgtgctatgccgttgacgaaaatggcgaatacactaccgaaaatagcagtggttgggaaccaaaaacagtagctttaaataatgctattgaggaaataaatgagcgcatcacagatgctcaaaaccgcgtaattgcaggtaaaaccagcccaatagaatattatatggaactccacaaaatggacattggcattttggcgagttatgtaggtttttggcaatggaaagtgaaacgtcactttaagccttctatttttaaaaaattaagtgataataccttgaataaatacgctgaagcatttgatatttcagtagaagaacttcagaacatctcaaaataa

SEQ ID NO: 24084 - protein, 133 aa, Unknown
  Obtained from environmental sample
  misc_feature (1)..(133): Xaa is any amino acid
MKKKEVPQDKSNLESANFRELCYAVDENGEYTTENSSGWEPKTVALNNAIEEINERITDAQNRVIAGKTSPIEYYMELHKMDIGILASYVGFWQWKVKRHFKPSIFKKLSDNTLNKYAEAFDISVEELQNISK

SEQ ID NO: 24085 - DNA, 327 bp, Unknown
  Obtained from environmental sample
  misc_feature (1)..(327): n is a, c, g, or t
ttgtattttttgaaggatggaaaactttcagaaactggacttattgaaaatgctgcncaagctgcttctggtgttgtgggacagagtttttttgaaaaggacgatttggaaggcaaaggcaataaattggttggttatataagcgctataaaaaaagtcgaaatttttcagcttccaaatgttggcgaaaccattatcaccaaagcaaaactcctttcgaggtttgatactggcgaagtaaccttgtgcagccttgaggccgaaacctacctcgatgaaaatttaattgtatcttctaccatgaattttttaatccatgaagtctga

SEQ ID NO: 24086 - protein, 108 aa, Unknown
  Obtained from environmental sample
  misc_feature (1)..(108): Xaa is any amino acid
MYFLKDGKLSETGLIENAAQAASGVVGQSFFEKDDLEGKGNKLVGYISAIKKVEIFQLPNVGETIITKAKLLSRFDTGEVTLCSLEAETYLDENLIVSSTMNFLIHEV

SEQ ID NO: 24087 - DNA, 741 bp, Unknown
  Obtained from environmental sample
  misc_feature (1)..(741): n is a, c, g, or t
ttgcctcaaattttaacagataaatctataagcgataaagaaaaaaagcaggaagcagtaagtttattttctgttttaaataaaaccacttttacatctgaatggattggaaatcaatctttagaaaaaagttataaagacattatttattctaattcttctaaagttattattgatgaatttcattcttttttaagcttcaaaaaagaaaaagatttagcgttattggattatttttctttggatgattctcttgcagataataaaatatctacttttcatatgattgggagtcattggtattacaatgccagaattacaagtgatttcgaatattttaaacccattattactagtaaatatttgggttcatcaaccaaagaagctttgattaattcttatgataataccatactgtatttagataattttttaaatattctgatagaaaagctgaaaaaatcatctcaaaaaacaattttaatttacatttccgatcatggagaaaccctgggtgaagatgacaaatggttgcatgcacaagagcatgaagcatctaaaaacccagcaatgttagtttggtattctgataattttgagaaaagttacccaataaaaatcgataaaatgaagttgaaaaaaaatgattcaattacaaccgattttttgtttcatagtgttttagatctcagtaatattcaaggttttgaatatcaaaaagagcaaagtatattcaattaa

SEQ ID NO: 24088 - protein, 246 aa, Unknown
  Obtained from environmental sample
  DOMAIN (1)...(242): Sulfatase
  misc_feature (1)..(246): Xaa is any amino acid
MPQILTDKSISDKEKKQEAVSLFSVLNKTTFTSEWIGNQSLEKSYKDIIYSNSSKVIIDEFHSFLSFKKEKDLALLDYFSLDDSLADNKISTFHMIGSHWYYNARITSDFEYFKPIITSKYLGSSTKEALINSYDNTILYLDNFLNILIEKLKKSSQKTILIYISDHGETLGEDDKWLHAQEHEASKNPAMLVWYSDNFEKSYPIKIDKMKLKKNDSITTDFLFHSVLDLSNIQGFEYQKEQSIFN

SEQ ID NO: 24089 - DNA, 936 bp, Unknown
  Obtained from environmental sample
  misc_feature (1)..(936): n is a, c, g, or t
ttggtcgagtttgacagaagaagaagaaagccagcggtaaatgatgataaaaagagtaagaaaaatgggaagaaagagaataagaaaagtgaattggtggtaacaattgatcaaactggaattcagcaaagaataatggaggtaccaataaaagcaggtaactacaatggacttggagtaactgaagatgctatttatttattatctagtgagactggcattaatgcgaaaaggcatttatcagtggttaaaatagataacgaagatgtcaaggtcaagactatgattaaagatgtaaggggttttgaattgacaggaaatggaaagagcatattggtctcaaaagatcgtaactattatatggtgaaagcgggcacagcagctataactgatctttccaaagacaagattgatctaagcggttggcgattcgcaatcacaccaagagaggattggaaacaaatctttacggatgcctggcgcatggagcgtgattatttttatgacaaaaatatgcatggtgtagattggaaggctatgcatgccaaataccttccgcttgtggatagggtaacaactcgtaacgaactgtctgatctgataggcagatttgttggtgagctttcggcacttcataccagtgttcgagggggagatatgaggagtgataataaaaatatttctgtagcaagtttgggcgccgtatttagcagagatactcaaaatagtggatataggattgactatatatataaagttgaccctgactaccctgacgaaaaatcaccactggacgatccttatttaaatgttaaggttggagatgtggtaaccaaaataaatggcatagatgcattgtcagcacttggatattggagaattaataagaaatcagaggggcaagcaagttcgggttaccctgaaaagaggaaatga

SEQ ID NO: 24090 - protein, 311 aa, Unknown
  Obtained from environmental sample
  misc_feature (1)..(311): Xaa is any amino acid
MVEFDRRRRKPAVNDDKKSKKNGKKENKKSELVVTIDQTGIQQRIMEVPIKAGNYNGLGVTEDAIYLLSSETGINAKRHLSVVKIDNEDVKVKTMIKDVRGFELTGNGKSILVSKDRNYYMVKAGTAAITDLSKDKIDLSGWRFAITPREDWKQIFTDAWRMERDYFYDKNMHGVDWKAMHAKYLPLVDRVTTRNELSDLIGRFVGELSALHTSVRGGDMRSDNKNISVASLGAVFSRDTQNSGYRIDYIYKVDPDYPDEKSPLDDPYLNVKVGDVVTKINGIDALSALGYWRINKKSEGQASSGYPEKRK

SEQ ID NO: 24091 - DNA, 507 bp, Unknown
  Obtained from environmental sample
  misc_feature (1)..(507): n is a, c, g, or t
atggaagaagcgcctacaatccgtttattgaatatgcaccgtattccggctaccttacgtagctataatatttctacgatttacgtgatgcaagacaaaatccaaaacgatatgatgtatggggataaagcgagtaaagcaattttaagtaatctttcctatcaattcttcggaaaggtaaatgacccagacaccgccaaatactatgaacgtttttttgaaatcatcaaagacccaacaaaaagcattagtcgtgggcataacttggattttgacacacgaattacgactggagagaaagaaattccaaaaattagagcggatgttttctttcggttaaagcagggcgagtttataacgtatgctgatggaaaggataagaaggtgcagtttaaattagccgacattcaaagggaatttccaaaggaaactaagcagttttctaaggctgatttggaggctaattttgaaagggtttatgaggaagcgaagtcgatatttaaatag

SEQ ID NO: 24092 - protein, 168 aa, Unknown
  Obtained from environmental sample
  misc_feature (1)..(168): Xaa is any amino acid
MEEAPTIRLLNMHRIPATLRSYNISTIYVMQDKIQNDMMYGDKASKAILSNLSYQFFGKVNDPDTAKYYERFFEIIKDPTKSISRGHNLDFDTRITTGEKEIPKIRADVFFRLKQGEFITYADGKDKKVQFKLADIQREFPKETKQFSKADLEANFERVYEEAKSIFK

SEQ ID NO: 24093 - DNA, 330 bp, Unknown
  Obtained from environmental sample
  misc_feature (1)..(330): n is a, c, g, or t
atgatagtaatggttattacacacctgctccagggttgccagacacaggcgattttattgaatttgcaaacaaaccaaaatctcttctacaagataatttaccaaacatctataaattacctaattaaaatgagtatcaaaaaaacattactgattgttgttgtctttacttttttttacgcctgtaaaagtacaagtgtaaaaacaaaaattaaacccaacagtatagaaagaattactgttaaagattctaaattttataaaggtgaaaaaccttattattttgtcggagcaaattattggtatggtccattctcgagccgaatctga

SEQ ID NO: 24094 - protein, 109 aa, Unknown
  Obtained from environmental sample
  misc_feature (1)..(109): Xaa is any amino acid
MIVMVITHLLQGCQTQAILLNLQTNQNLFYKIIYQTSINYLIKMSIKKTLLIVVVFTFFYACKSTSVKTKIKPNSIERITVKDSKFYKGEKPYYFVGANYWYGPFSSRI

SEQ ID NO: 24095 - DNA, 435 bp, Unknown
  Obtained from environmental sample
  misc_feature (1)..(435): n is a, c, g, or t
gtgtctacagaagaagcagaagatgcgacacaagagattttaataaagctgtggaataataaaaagaatataaaaaactataaaatgtttgaagcattttcgatgacgatgacaaagaatttttgttatgataaattaaaatcgaaacaagctcaaaatttaaaaatagttcataataattacgaagacacgcaagtagcctttcaaaaacaattagaagttagtgacagtttagactgggtaggccgaataataaatacgttacccgagcaacaaaaactaatcgtccaacttcgagacatcgagcaatacgagtttaaagagattgcaaaaatgctggatatgaatgaaaccgccatacgcgtgaatttgtctagagcaagaaaaacaattagagaacaattaactaatacacataattatggtattaaataa

SEQ ID NO: 24096 - protein, 144 aa, Unknown
  Obtained from environmental sample
  DOMAIN (84)...(133): Sigma-70, region 4
  misc_feature (1)..(144): Xaa is any amino acid
MSTEEAEDATQEILIKLWNNKKNIKNYKMFEAFSMTMTKNFCYDKLKSKQAQNLKIVHNNYEDTQVAFQKQLEVSDSLDWVGRIINTLPEQQKLIVQLRDIEQYEFKEIAKMLDMNETAIRVNLSRARKTIREQLTNTHNYGIK

SEQ ID NO: 24097 - DNA, 693 bp, Unknown
  Obtained from environmental sample
  misc_feature (1)..(693): n is a, c, g, or t
ttggttcataaaaaagttcacagctcttggtttcaggaatttaaagatgctaaacaagttgaaatagacacattgcaagaaagtgccaacgaattacattccgaagaattgaaaatggatgaggtcatcaaaatgctttcagaaatcaccaacggagaagcagttgtcgttaccgatgtgggtcaacaccaaatgatgacagcgcgccattatcaatacaacaaaacaaaaagcaacattacgtcaggaggtttgggaaccatgggatttgcactaccagctgctattggagcaaaatttggtgcgccagataaacctgtaatagccattattggagatggaggctttcaaatgacgctacaagaattgggaaccattttgcaaagtgatgtagatataaaaatcatcattttaaataaccgatttcttgggatggtacgtcaatggcaacagttattttttgagaaacgctattcatttacaaatatgatcagccctgattttatagccctttctaaagcgtatagtatagaagcctccaaaattgaagctagaaaagacttaaaagaaaatctattaaaaatgctaaatcacaacggatcttacttgttagaagtcatggtcgctaaagaggaaaatgtatttccaatgatgacaaccggagcctctgtatcagaagtttcgttaaactaa

SEQ ID NO: 24098 - protein, 230 aa, Unknown
  Obtained from environmental sample
  DOMAIN (31)...(213): Thiamine pyrophosphate enzyme, C-terminal TPP binding domain
  misc_feature (1)..(230): Xaa is any amino acid
MVHKKVHSSWFQEFKDAKQVEIDTLQESANELHSEELKMDEVIKMLSEITNGEAVVVTDVGQHQMMTARHYQYNKTKSNITSGGLGTMGFALPAAIGAKFGAPDKPVIAIIGDGGFQMTLQELGTILQSDVDIKIIILNNRFLGMVRQWQQLFFEKRYSFTNMISPDFIALSKAYSIEASKIEARKDLKENLLKMLNHNGSYLLEVMVAKEENVFPMMTTGASVSEVSLN

SEQ ID NO: 24099 - DNA, 903 bp, Unknown
  Obtained from environmental sample
  misc_feature (1)..(903): n is a, c, g, or t
ttggctgagagagattacgatgagtattatgaagatgactattcttataacgatcaagaatataccgttgctgaagcggaagatgctgacgaacgtgaagagcaatattgggataatctaatttacaactatcaaaacaataattattatagttgggaagatagaaataacccttgtaaagaagcatattactacaatgataatagcattgtatctacaaatattttagcttcaaatttgggtgttattgccaaaaaaggagataacaaatcataccattttgcggttacagatattttgaccacaaaccccattgctaatgctgatataacactctataattaccaacaacaagagataggctcagtaaaaacaaatgatcaaggttttgcagtttacgatgctgataaaaacgcctattttgcaattgctttaagtggaaaaaacaaaacttatattaaacttgatgacggctattctttatcgctgagtaagtttgatgtttcagggaaaagactccaaaaaggtctcaaaggctatatatatggagaacgcggtgtttggaggccaggtgacactttacacttgaattttgtattaaatgataacgcaaatcctctacctgagaatcatccaattcgattagaagttactgatccgcatggtaagttaacctataaaaagattgaaacgcaaggtgtaaatgggttttataaatttgatgtgccaacttctgatgaggctgcaactggtacttggaatgccaaaataagtattggtggcgctactttttataaacgtttaaaagttgaaacagtaaaaccaaatcggttaaaaataaatattgattttgatgacgaaatattgacaccagataaacaattaatgcagaacttaaagtaa

SEQ ID NO: 24100 - protein, 300 aa, Unknown
  Obtained from environmental sample
  DOMAIN (75)...(299): Alpha-2-macroglobulin family N-terminal region
  misc_feature (1)..(300): Xaa is any amino acid
MAERDYDEYYEDDYSYNDQEYTVAEAEDADEREEQYWDNLIYNYQNNNYYSWEDRNNPCKEAYYYNDNSIVSTNILASNLGVIAKKGDNKSYHFAVTDILTTNPIANADITLYNYQQQEIGSVKTNDQGFAVYDADKNAYFAIALSGKNKTYIKLDDGYSLSLSKFDVSGKRLQKGLKGYIYGERGVWRPGDTLHLNFVLNDNANPLPENHPIRLEVTDPHGKLTYKKIETQGVNGFYKFDVPTSDEAATGTWNAKISIGGATFYKRLKVETVKPNRLKINIDFDDEILTPDKQLMQNLK

SEQ ID NO: 24101 - DNA, 468 bp, Unknown
  Obtained from environmental sample
  misc_feature (1)..(468): n is a, c, g, or t
atgtcgaactctctcagtggcaaaactgttttcaataaaaatctaagctgcgatagcgtaatagctggagcttttttttcccaatcttatcttgaggtgccagaggaaaaaatggccaagcatacaggtcaatatatgatggtgccaacctggaaacttccgcacctcgtactgatccattcccaaatctgtttttgtttcttcaaagcactgctcgatggaccaacgcaaaccgctcaaccagacgaacaaattcaatctggtactgactggggcattggaaatataataggaatatattggttccttgcccaaagttcttcgaataagcaaccaaagcgtctttttgggaagtccctggaaagagagtacaacacgccttttggtaaattcatactcaatgggccccttggtcccttcggagacttttcgacgataccaaaaaaagttgttaatactcttggctaa

SEQ ID NO: 24102 - protein, 155 aa, Unknown
  Obtained from environmental sample
  misc_feature (1)..(155): Xaa is any amino acid
MSNSLSGKTVFNKNLSCDSVIAGAFFSQSYLEVPEEKMAKHTGQYMMVPTWKLPHLVLIHSQICFCFFKALLDGPTQTAQPDEQIQSGTDWGIGNIIGIYWFLAQSSSNKQPKRLFGKSLEREYNTPFGKFILNGPLGPFGDFSTIPKKVVNTLG

SEQ ID NO: 24103 - DNA, 768 bp, Unknown
  Obtained from environmental sample
  misc_feature (1)..(768): n is a, c, g, or t
atgacggcaccaataaatttcaggtttacccgaaagcttatgtttttgattccggggaaaaaaaaatggaaaacatatgatagctggcctcctgtcggagttgaaaaaacagctttgtacctttcagagggccaaaaattatctgaaattcagcctactaaaaaagcgatcacgtttgtcagtgacattaaacgccctgttccgtactcagaggatatcaaagcagggttaattccgagaaaatatatgaccgatgatcaaagattcgccgcccgaagacccgatgtactagtttttgaaactaatattttagaagaagacctaactttggcaggagatattttagcgaagctaaatgtggcaactacgggtaccgatgcggattggatcgttaaaattattgatgttcatcctgcagatgccaaagaacaggaagagggtatgcaagatcatttaaaaatgagtaattaccacttattggttcgtagtgaagtgatgcgtggtaaatttagaaatagcttttctatacctgagccatttgttcctaacaaacaaacggaagtatttattaaattacaagatgtttttcacaccattaaaaaagggcataaattacaagtgcaggttcagagtacttggtttcctttaatcgatttaaatccacaaacatttgtacccaatatttttaaagcgaacaaagaagattttaaaacacaaacgcatactgtttttacatcatcttccatcgaattttcagtattaaaataa

SEQ ID NO: 24104 - protein, 255 aa, Unknown
  Obtained from environmental sample
  misc_feature (1)..(255): Xaa is any amino acid
MTAPINFRFTRKLMFLIPGKKKWKTYDSWPPVGVEKTALYLSEGQKLSEIQPTKKAITFVSDIKRPVPYSEDIKAGLIPRKYMTDDQRFAARRPDVLVFETNILEEDLTLAGDILAKLNVATTGTDADWIVKIIDVHPADAKEQEEGMQDHLKMSNYHLLVRSEVMRGKFRNSFSIPEPFVPNKQTEVFIKLQDVFHTIKKGHKLQVQVQSTWFPLIDLNPQTFVPNIFKANKEDFKTQTHTVFTSSSIEFSVLK

SEQ ID NO: 24105 - DNA, 876 bp, Unknown
  Obtained from environmental sample
  misc_feature (1)..(876): n is a, c, g, or t
atgggtaaaatacatgcatccaaagtatcaaagacgaatattttttccagatttatggagcaaacaagaattacaagattggggcaaaaatgtttaatattactagcttttgctttagtaataattagttgtaaaaaagaagataaaacaccaatagatactgtttcggttattgaacctgaagaggtttatgagtttggttttaaacttaacgattatgttgttaagcgtgataccattagaaaaggtgatagctttggcgaaatcctgcaacgcaaccagatagattattctaaaatatttcaaatagcacaacaaacaaaggatagttttgatattacacgattgcaaatcggaaaaccttacaccttgttgtgttcaaacgattcgcttcaacaaccaaaatgttttatatatcaacctactaaaacggactatgttgtaatcaattttcaagattcaattcatgcctattcaagtactaagcctataaaatttgtagaaaaagaagtctcaggtgttatcgagtctaatatatctgaagcttttgcaaagcaaggtaaaagtgtattattagcttataaaatgtctgatatttatgcttggacgattgacttttttagacttcaaaaaaacgataaattcagattaatttataccgaaaaatatatcgatgacagtatttatgctggaattgataatattaaggcagcatactttcagcacaacggagaagatttttatgcattcgaatttgaaacagatacagttaaagggcttaaagattattttaccgaagatgcaaaaaactttagacgtgcccttttaaaagcacctgttgagtataaccgtattttcttccagaatataatttaa

SEQ ID NO: 24106 - protein, 291 aa, Unknown
  Obtained from environmental sample
  misc_feature (1)..(291): Xaa is any amino acid
MGKIHASKVSKTNIFSRFMEQTRITRLGQKCLILLAFALVIISCKKEDKTPIDTVSVIEPEEVYEFGFKLNDYVVKRDTIRKGDSFGEILQRNQIDYSKIFQIAQQTKDSFDITRLQIGKPYTLLCSNDSLQQPKCFIYQPTKTDYVVINFQDSIHAYSSTKPIKFVEKEVSGVIESNISEAFAKQGKSVLLAYKMSDIYAWTIDFFRLQKNDKFRLIYTEKYIDDSIYAGIDNIKAAYFQHNGEDFYAFEFETDTVKGLKDYFTEDAKNFRRALLKAPVEYNRIFFQNII

SEQ ID NO: 24107 - DNA, 618 bp, Unknown
  Obtained from environmental sample
  misc_feature (1)..(618): n is a, c, g, or t
atggatgaattagatttattacgaaaagattggaaaaatcaggaagagaaccttccgcattttaaggcagagcaactttataaaatgttgcttaaaaaatcgtcttcgatcgtgaaatggatttttattattagccttatagaattaagctttggtattttaatgaatatcctatttatggatgatcaattttggaaagaagttgatactattcatttgaagactgctactatagttatatacattatcagttacatcattactggtgcatttatagttttctttcacaaaagatatagaaaaatttctgctgccgattcttcctttcatttaatgaaaaacatcttaaaaaccaggagagtggtaaaatactatatcatctatatcttagcatcttctgggattactatgatgctattttatatttatacgcttaaatatactcctgccctttctcaaaatttagaagacacgagttggcttactattattggtataggtttaatttgtatactagtacttctactttttttatggggagtttattctttactttacggaattctactaaagaaattattacgtaactataaagagttaaaaaacttagacttttaa

SEQ ID NO: 24108 - protein, 205 aa, Unknown
  Obtained from environmental sample
  misc_feature (1)..(205): Xaa is any amino acid
MDELDLLRKDWKNQEENLPHFKAEQLYKMLLKKSSSIVKWIFIISLIELSFGILMNILFMDDQFWKEVDTIHLKTATIVIYIISYIITGAFIVFFHKRYRKISAADSSFHLMKNILKTRRVVKYYIIYILASSGITMMLFYIYTLKYTPALSQNLEDTSWLTIIGIGLICILVLLLFLWGVYSLLYGILLKKLLRNYKELKNLDF

SEQ ID NO: 24109 - DNA, 519 bp, Unknown
  Obtained from environmental sample
  misc_feature (1)..(519): n is a, c, g, or t
atgaaaatattagcaaacgacggattatcaaaaagcggaattgacgctttagaaaaaggaggttttgaagtactaaatgtaaaagttgctcaaaatcaattagaaaattatataaatgataacaatgtagatgcacttattgttaaaagtttaacggaagttagagacgatttaattgatgaatgtccgtctttaaaattaattgcttttgctggtgttggtatggatactattgatgtagattatgctattgacaaaggtttacatgtaataaatgctccagaatcttctacagtttcagtggctgaaatggtttttgctcatttatttggaatggtaagatttttacattctgccaatagagaaatgcctttagaaggagattcaagatttagagaattaaagaaagcttattctgaaggaacagaattacgtgggaaaaaattaggaattattggttttggaagtattggtcaaaaaagttgcaaaaattgccatccgaatttggaatggaagtaa

SEQ ID NO: 24110 - protein, 172 aa, Unknown
  Obtained from environmental sample
  DOMAIN (1)...(95): D-isomer specific 2-hydroxyacid dehydrogenase, catalytic domain
  misc_feature (1)..(172): Xaa is any amino acid
MKILANDGLSKSGIDALEKGGFEVLNVKVAQNQLENYINDNNVDALIVKSLTEVRDDLIDECPSLKLIAFAGVGMDTIDVDYAIDKGLHVINAPESSTVSVAEMVFAHLFGMVRFLHSANREMPLEGDSRFRELKKAYSEGTELRGKKLGIIGFGSIGQKSCKNCHPNLEWK

SEQ ID NO: 24111 - DNA, 783 bp, Unknown
  Obtained from environmental sample
  misc_feature (1)..(783): n is a, c, g, or t
atgatgaaactcttgagaattcatcataagaaaaaagtaaaaaatcctgaatatgagttttctacaactgataaaatgttgcataaactttgggttgttatngatgaaattattactcaaaaaataacaaaagcttttgcaaaaatagaatctttatatattgctgatggccatcatagaactgcatcttctgctttattagcaaaagatttggcatcagaaaacgaaaatcatacaggtgcagaaccttataatttttttatgagttatttaattccagaatcgcaattaaaaatctctgaatttaatcgatttgtaaaagacttaaatggattgtctgttgatgagtttctggagaaattaagcgttcattttgttattcaaaatcgtggacaattgatttattttccagataaaaaacatcattttagcatgtatttaaatggcgaattttattctctttacttcaaagaagacaattataattttacaaatgctttgagtaaattagattcagaaattttgtttagaactgttttagaaccaattttaggtgttaaagacttaacgaacaatgatagagttgggcattctgataataaaaaagatgtaatttccatcaaaacaaaagtagatgctggtttttatacgattggttttagtatgatgcctgtaacgatttttgaattgaaagaaattgcggatgctaatttaaaaatgcctccaaaaactacgtatattcagccaaaattaagaagtggtttaactgtttatgagttttaa

SEQ ID NO: 24112 - protein, 260 aa, Unknown
  Obtained from environmental sample
  DOMAIN (1)...(260): Protein of unknown function (DUF1015)
  misc_feature (1)..(260): Xaa is any amino acid
MMKLLRIHHKKKVKNPEYEFSTTDKMLHKLWVVXDEIITQKITKAFAKIESLYIADGHHRTASSALLAKDLASENENHTGAEPYNFFMSYLIPESQLKISEFNRFVKDLNGLSVDEFLEKLSVHFVIQNRGQLIYFPDKKHHFSMYLNGEFYSLYFKEDNYNFTNALSKLDSEILFRTVLEPILGVKDLTNNDRVGHSDNKKDVISIKTKVDAGFYTIGFSMMPVTIFELKEIADANLKMPPKTTYIQPKLRSGLTVYEF

SEQ ID NO: 24113 - DNA, 666 bp, Unknown
  Obtained from environmental sample
  misc_feature (1)..(666): n is a, c, g, or t
ttgtttggtcgctatggtctaaaccgaattcatctgctactacaaacctatgatgacaaaataccattaaacaaagcggcacaattggcaaatatttctatgcacgatgcagatattttaataaaacgtgccagcgaggttgccgacatcgctaccaaacgcggcaaatctcgctttgttaagctatcagattcaaagaattccgtactgagtccactgaacattcaatatcaaagtgacttaagattgctatcgcttttgttaagcaatgcctatcgcttacgggaagaattaaggattgactgggcttggttcattgagatatgtagtgaaaaaatatctactagcaaagcatacctatcatttgggaaaggagatgagaaagagttgcagcgtttcattgatattgtggataaactactgcctttgaaacattggctgatgagtagcaacgaagccttgttaatgaaaactatgtcatctactgattatcaagatatcaagcggcagtctaatgacaagatagaagctatccatatcggtattgctagccgagaccatagagaacagacgaataaatggcaatactcgccgctactacggttttttgtgcatatgatgcttatcactgatgaaaacatactcattatagatagtaaactatag

SEQ ID NO: 24114 - protein, 221 aa, Unknown
  Obtained from environmental sample
  misc_feature (1)..(221): Xaa is any amino acid
MFGRYGLNRIHLLLQTYDDKIPLNKAAQLANISMHDADILIKRASEVADIATKRGKSRFVKLSDSKNSVLSPLNIQYQSDLRLLSLLLSNAYRLREELRIDWAWFIEICSEKISTSKAYLSFGKGDEKELQRFIDIVDKLLPLKHWLMSSNEALLMKTMSSTDYQDIKRQSNDKIEAIHIGIASRDHREQTNKWQYSPLLRFFVHMMLITDENILIIDSKL

SEQ ID NO: 24115 - DNA, 558 bp, Unknown
  Obtained from environmental sample
  misc_feature (1)..(558): n is a, c, g, or t
ttgttaaggcactacctaattacagaacagcttaatatggaaatctcaaaaacaggatggtggatgataggtggcgcaggacttggcgttatcgggataggtgtttttgttacgctttcgcgaaagcgtacaaagcaacaagcactgcaatccacaacaatcacatctattggaaacggcgtgcaagtcactactggaaacgtaggaactaccaaacaagagccgaactggaacagtccatttgatctgaactacctaactgatgttcagaaatgggtagcgcccaaaagtattcaagtattggatgatgcttcggctaagaaactggctaaaatcattagggatgcgaaaggcacttttaatgatgacgaagaggctatcaaagatgttttcggtaaaaagttgcgtgataaaacacaaatcgccagtctttctaaagcattttatcagctctacaaaaaggatatgtggcaacacttgaatagcttcttaagccaaagcgaaatgaaggaatacgtctcaaaatatgtgcaacgccttcccaattatcaatcataa

SEQ ID NO: 24116 - protein, 185 aa, Unknown
  Obtained from environmental sample
  misc_feature (1)..(185): Xaa is any amino acid
MLRHYLITEQLNMEISKTGWWMIGGAGLGVIGIGVFVTLSRKRTKQQALQSTTITSIGNGVQVTTGNVGTTKQEPNWNSPFDLNYLTDVQKWVAPKSIQVLDDASAKKLAKIIRDAKGTFNDDEEAIKDVFGKKLRDKTQIASLSKAFYQLYKKDMWQHLNSFLSQSEMKEYVSKYVQRLPNYQS

SEQ ID NO: 24117 - DNA, 486 bp, Unknown
  Obtained from environmental sample
  misc_feature (1)..(486): n is a, c, g, or t
atgttagtagattttaaaacattaccagaaacttcaaaagtttggatatatcaagcgaatcgctctttttcagatgttgaattagaagaaataaaagaaaaattaaccgtttttatttctaattgggctgctcacggtaccgatttacaagcgggttttgagataaaatataagcgctttattattttagcggtagaccaagatatacaagcagcaacgggttgtagtgtagatagttctgtgcattttattcagcaattagaaaaagaatataacgttgatttaatggataaaatgaatgtatcctacaagcaaggcgaatatgtggcgtataaaacattaacagattttagaaaaatggcgaaagataaagccgtttctaaaaatactattgtgtttaataatttggtcacaaacattggtgaatttaatgaaaattgggaagttccagcgagcgaaagctggcacaatcgctttttaaaataa

SEQ ID NO: 24118 - protein, 161 aa, Unknown
  Obtained from environmental sample
  misc_feature (1)..(161): Xaa is any amino acid
MLVDFKTLPETSKVWIYQANRSFSDVELEEIKEKLTVFISNWAAHGTDLQAGFEIKYKRFIILAVDQDIQAATGCSVDSSVHFIQQLEKEYNVDLMDKMNVSYKQGEYVAYKTLTDFRKMAKDKAVSKNTIVFNNLVTNIGEFNENWEVPASESWHNRFLK

SEQ ID NO: 24119 - DNA, 426 bp, Unknown
  Obtained from environmental sample
  misc_feature (1)..(426): n is a, c, g, or t
atgaacaggggacggagtgaaaagactatcatttgcaaggttttgagtagtcgctctaataaaagctttcgtcaagaaaatgaagcacacgttctacggtttttaagttatggtcttaataatatagacacgcccttgctcacactattaaatgatatcaaagcagataaaatcactgaaaaaaatgatactggcaatacctttatagatcaatatctcaacatgctaggtggactcattaaaaattactatcctaaaggcgagcgtgtagtccttaatactgatcctgcttatgagaagtatcgtatgttggctaaagtcgattatgttagtcctagattttatacagctaaaaacccacagcactttgatgctaacatcttaaatccaagggataaaccagctgatggcatctaccatgcttaa

SEQ ID NO: 24120 - protein, 141 aa, Unknown
  Obtained from environmental sample
  misc_feature (1)..(141): Xaa is any amino acid
MNRGRSEKTIICKVLSSRSNKSFRQENEAHVLRFLSYGLNNIDTPLLTLLNDIKADKITEKNDTGNTFIDQYLNMLGGLIKNYYPKGERVVLNTDPAYEKYRMLAKVDYVSPRFYTAKNPQHFDANILNPRDKPADGIYHA

SEQ ID NO: 24121 - DNA, 453 bp, Unknown
  Obtained from environmental sample
  misc_feature (1)..(453): n is a, c, g, or t
gtgggcgagttacaaatcacaactttgggtgttgaggcgatgccacttttgcgttttaaaactggcgatatggttcaagcatacaatgaaccctgtaactgtggaagaaatactttacgtttaggacccgtggtgggacgtaaaaagcagatgataaaatacaagggaactacgctttatccaccagcaatgtataatattctaaatgatttttctaaaattgaaagctacgtcattgaaatttttcacaatgaattaggcactgatgaaatactgataaaaattacttccgaagaaatgtcagcagaattattgctggaaattaaagaccattttcgagcaaaattacgcgttgcgccaaaaattgaatttgctacttctaaagaaattgaagcgctacgctttccgcctttaagcagaaaacctgtcgatttgatagatcgcaggctttag

SEQ ID NO: 24122 - protein, 150 aa, Unknown
  Obtained from environmental sample
  misc_feature (1)..(150): Xaa is any amino acid
MGELQITTLGVEAMPLLRFKTGDMVQAYNEPCNCGRNTLRLGPVVGRKKQMIKYKGTTLYPPAMYNILNDFSKIESYVIEIFHNELGTDEILIKITSEEMSAELLLEIKDHFRAKLRVAPKIEFATSKEIEALRFPPLSRKPVDLIDRRL

SEQ ID NO: 24123 - DNA, 918 bp, Unknown
  Obtained from environmental sample
  misc_feature (1)..(918): n is a, c, g, or t
ttggtcggctttttcatgctcacaatagttcaatcagatgattttaaaactgagatccaaactcccttttgcaaaacaaaatcaagcattcagctaaaaggctttccaactttttatgaagatggtgaatacgtcatgccaataaacctttggatgaatcacctcattaacgttaagcgcgcaaaaaacatcaattcaaacgttcgtgccataagtcgatattggcgctttttaaaaagccatgaactctcttggaaagactttccaactatcaaatcaaataagcccacatatattttccgaaaccaagatcttttggcctcagtgaaagccggtgagctaaatagttcaacagcagctgtatatatgaaccatataattaaattctacgagtgggcatattacgagaggttaattaacttctctaaggaaaataaaccatttgaagtagagtttgttagcatcaaaacgactgggatgcttgcgcatatcaatcgtaattatgttgttagaagctcagacttaaggatcagggtcccaaggcgtacaccagagcaaagcttgaatccccttacagaagatgaggtaaaattatattcgcgagcactcaaagaacagtcaattgagttccaaatacatcaactattacaactcatgtgcggccttcgtatagaagaagcctgcaccttttctgctaatctagtgaatagatgtgacccgaataaataccatattccagttagtataggaacttcatacggtgtactccccaaatttggctcaaccgaaactatcgaaattcccaccccgttaatgaacaagaagcatcccctctttattaagggagcctcccccgaaaaaaaaaagttaaaaaccgataaacccgattacgggattttttatttcccaatccagggn

SEQ ID NO: 24124 - protein, 306 aa, Unknown
  Obtained from environmental sample
  misc_feature (1)..(306): Xaa is any amino acid
MVGFFMLTIVQSDDFKTEIQTPFCKTKSSIQLKGFPTFYEDGEYVMPINLWMNHLINVKRAKNINSNVRAISRYWRFLKSHELSWKDFPTIKSNKPTYIFRNQDLLASVKAGELNSSTAAVYMNHIIKFYEWAYYERLINFSKENKPFEVEFVSIKTTGMLAHINRNYVVRSSDLRIRVPRRTPEQSLNPLTEDEVKLYSRALKEQSIEFQIHQLLQLMCGLRIEEACTFSANLVNRCDPNKYHIPVSIGTSYGVLPKFGSTETIEIPTPLMNKKHPLFIKGASPEKKKLKTDKPDYGIFYFPIQG

SEQ ID NO: 24125 - DNA, 720 bp, Unknown
  Obtained from environmental sample
  misc_feature (1)..(720): n is a, c, g, or t
atggctaaaaaaagacaaaaaaaacgcactcaaaattacaaaaagcacttaggacaagttcctggagctttagtttatactggaaataaagaagacaaagtattacatttaaatgcttttgattatagcgaagacagttataaagaggcggatttaaataccgtcgaggaagcctttaattttaaagactctgaaaccgtaacgtggtttaatcttaacggacttaattttattgaccaaattgaaaaaattggacaacattacaagcttcaccctttaattttagaagacattgttaacacctcacagcgtcctaaaattgacgagtataaagattacttttttatagtcttaaaaatgatgtattacgatgcagacgaaaaacttgtctctgaacaagtcagtattgtcatgggtaaaaattatgtattgacttttcaagaagcagaaggcgatgtatttgatagtcttagagatcgaattagacaaaaaaaaggacgtgtacgcgaagaaggttcagactatttaatgtatgccttaatggatgcaattgttgaccattactatgctattatagagattatgggtaacaagattgaagaccttgaggacgatttatttacaggcttaacccaagagcaaatttcgcaacaaatacaaaatcttaagcgtgaaattttaaaactacgacgtgcnatttttccgcttcgcgaaatataa

SEQ ID NO: 24126 - protein, 239 aa, Unknown
  Obtained from environmental sample
  DOMAIN (64)...(239): CorA-like Mg2+ transporter protein
  misc_feature (1)..(239): Xaa is any amino acid
MAKKRQKKRTQNYKKHLGQVPGALVYTGNKEDKVLHLNAFDYSEDSYKEADLNTVEEAFNFKDSETVTWFNLNGLNFIDQIEKIGQHYKLHPLILEDIVNTSQRPKIDEYKDYFFIVLKMMYYDADEKLVSEQVSIVMGKNYVLTFQEAEGDVFDSLRDRIRQKKGRVREEGSDYLMYALMDAIVDHYYAIIEIMGNKIEDLEDDLFTGLTQEQISQQIQNLKREILKLRRAIFPLREI

SEQ ID NO: 24127 - DNA, 444 bp, Unknown
  Obtained from environmental sample
  misc_feature (1)..(444): n is a, c, g, or t
atgtttattaaaaacgatagtactgccgagaaacgctattttaatggtaaaataggtcaagttgtagctttaaataagagtaaagtcacggtacgttgcccagacgatgaaaatgatattataaccagtatagaaacttgggaaaacattaaatacaatctagatgcggaaactaaagccatttcagaggataaaataggcagcttttcacaaattccattgcgtttagcgtggtctattacaatacacaaaagtcaagggttaacatttgaaaaagccattattgatgcagaagatgcatttgcccacggacaaacctatgttgcgttgagtagatgtaaatccttagaaggtttagtgttaaaaagcaaaatagaatcgaagcaaattattagtgatcagaatgtgatttcttttataaaagaaccgaagaaatgctcctaa

SEQ ID NO: 24128 - protein, 147 aa, Unknown
  Obtained from environmental sample
  misc_feature (1)..(147): Xaa is any amino acid
MFIKNDSTAEKRYFNGKIGQVVALNKSKVTVRCPDDENDIITSIETWENIKYNLDAETKAISEDKIGSFSQIPLRLAWSITIHKSQGLTFEKAIIDAEDAFAHGQTYVALSRCKSLEGLVLKSKIESKQIISDQNVISFIKEPKKCS

SEQ ID NO: 24129 - DNA, 342 bp, Unknown
  Obtained from environmental sample
  misc_feature (1)..(342): n is a, c, g, or t
atgattggcaatgatgttgttgatttaaatcttgcaaaaaccgaaagtaattggcaacgtaaaggatttttagaaaaacaatttaccgattttgaaattagcgaaatcttaaaatcagtaaatccttttttgaaagtttggttgttttggtctatgaaagaagctgcttacaaatgctatgttcaagaatatcaaaaacgatttttttcacctaaaaaatttagctgtaaaataatttcagagagggaaggagttgtgcaaattgaggctaaaaaatattatataaattatttaatatcagataaatatataacttctgtggctaggagaaataaagattaa

SEQ ID NO: 24130 - protein, 113 aa, Unknown
  Obtained from environmental sample
  misc_feature (1)..(113): Xaa is any amino acid
MIGNDVVDLNLAKTESNWQRKGFLEKQFTDFEISEILKSVNPFLKVWLFWSMKEAAYKCYVQEYQKRFFSPKKFSCKIISEREGVVQIEAKKYYINYLISDKYITSVARRNKD

SEQ ID NO: 24131 - DNA, 879 bp, Unknown
  Obtained from environmental sample
  misc_feature (1)..(879): n is a, c, g, or t
ttgggacaagtctataatcaaaaaaacatgtttgataaagctaatgagacgtatttaaaagcgttatctattacttcgacttcaagagatagtttggtgttgtataataacatttctaatatttataaaaatcaaaaattatataataaagctcagagcacattaataaaagcaactaatttatttaatagggtagaagactcaatagaaaaggccagagttattgataatttagggtttataaaatttaaattaaataatcatggtgcatttgacgattttaagacagcctacaccatacgtcaaaatgttgataatttagccgagttatatccaagttataaaaatttatccgaatattacttaagtaaaaaggatacagtccaagctttatcctttgcaataaaagcctatgacgttgctaataaggtaaacagtttgtcctacaaattagatgcagttaaaacaaggtataatttaggagataatacggtatttaaggagtattcatttttaaacgatagcttattaaaagcgacaaaactaagtcaaaataagtttgctttgctaaaatataacgttagtaaaagtcaattacagtctcaaatagagaaagctcaaaaacaaatctaccaattattagcagttgtaatattgattttagctttgggattactctatttttttagagcaaaacataataaagaaaaattaaaagaggtttatataacagaaactagaatatctaaaaaagtacatgatgaggtagcaaatgatgtctatcaaataatgacaaaattacagagtaaagctactataaatgaagactttttagaccatctggaaaaaatttacattaaaaccagagatattttctaa

SEQ ID NO: 24132 - protein, 292 aa, Unknown
  Obtained from environmental sample
  misc_feature (1)..(292): Xaa is any amino acid
MGQVYNQKNMFDKANETYLKALSITSTSRDSLVLYNNISNIYKNQKLYNKAQSTLIKATNLFNRVEDSIEKARVIDNLGFIKFKLNNHGAFDDFKTAYTIRQNVDNLAELYPSYKNLSEYYLSKKDTVQALSFAIKAYDVANKVNSLSYKLDAVKTRYNLGDNTVFKEYSFLNDSLLKATKLSQNKFALLKYNVSKSQLQSQIEKAQKQIYQLLAVVILILALGLLYFFRAKHNKEKLKEVYITETRISKKVHDEVANDVYQIMTKLQSKATINEDFLDHLEKIYIKTRDIF

SEQ ID NO: 24133 - DNA, 495 bp, Unknown
  Obtained from environmental sample
  misc_feature (1)..(495): n is a, c, g, or t
ttgggaaaaaaaggaggaaaaccatttattgttttaaccttgggaaaaggatggttttttaagtttacgcaaactaaaagggaaaccccaaactccaggataaaaacagtttcaaaaaacccgataaggaatgggaaagctcaattaacacaagagcattttagaattacaagattaaaaggaactgaaagaccacattctggagaattatgtagtatttatgatgaaggccaatacaattgtgtatgttgtaacacaccacttttcgattctactattaaattcgaatctagttctggttggccaagttttacacaacctattaaagaaaatgccataaagtatgtaaaagatacaactttagggatgattagagttgaagtgctttgcaatacttgcgatgctcatttaggacacattttccctgatggaccagaaccaagtggtttgcgttattgcataaattctgaatcgatggttttagacacaaaatag

SEQ ID NO: 24134 - protein, 164 aa, Unknown
  Obtained from environmental sample
  DOMAIN (46)...(164): SelR domain
  misc_feature (1)..(164): Xaa is any amino acid
MGKKGGKPFIVLTLGKGWFFKFTQTKRETPNSRIKTVSKNPIRNGKAQLTQEHFRITRLKGTERPHSGELCSIYDEGQYNCVCCNTPLFDSTIKFESSSGWPSFTQPIKENAIKYVKDTTLGMIRVEVLCNTCDAHLGHIFPDGPEPSGLRYCINSESMVLDTK

SEQ ID NO: 24135 - DNA, 948 bp, Unknown
  Obtained from environmental sample
  misc_feature (1)..(948): n is a, c, g, or t
ttggcaaaacaacccttgtgctgtgggcttaaaggatcatttttcgcgatgggcgaagtaattcaacgaaaaccttattcgacaacccagggtcgaatactcaccgcgtgttttaatacccaaacccctattgctgcaaatcttaaagattactctcacgatatttttccgctaacagggcttacccaaagcgagttatttagcggcgcgaatgcgggtatatcgctcgaaaccgagctaaaacgcgagattaaatcatccgacactatttactggcttgtctcatttataaaatggacggggctgcgcatttttaaaaatgagcttgaagcttttaccaaaagcggcaataaactcaaagtaattaccacctcgtacatgggcgcaacggatgcgaaagcggtggagtttttagctaacctaccaaacactgaggtaaaacttagctacaacaatcaacaagagcgcttacacgcaaagtcatacttgtttatacgtaatacgggttttcataccggttatattggctcgtctaatttgtcgcattcggcgcttaccagtggccttgagtggaacttaaaaattaccgcgcaagaaatcccgcacatcataggcaaaaccaaaagcacttttgagacctactggcaatcaccagattttgagctgtttacaggcaaggttgaatgtaaagaaaagctcataaattcacttaatgaacaacgcggtattggccaagcaagcagccagttttattttgatatcacgccaaaaacccaccagctcgcaatattagaaaaactaagcgtagagcgcagcgtgcataatcgctttaaaaatttagtagttgccgcaacgggcacgggtaaaaccattatatcggcgtttgactttaaagccgtttacgacaaaaacccaaacgcacactttttgtttgtagccccaccgtga

SEQ ID NO: 24136 - protein, 315 aa, Unknown
  Obtained from environmental sample
  misc_feature (1)..(315): Xaa is any amino acid
MAKQPLCCGLKGSFFAMGEVIQRKPYSTTQGRILTACFNTQTPIAANLKDYSHDIFPLTGLTQSELFSGANAGISLETELKREIKSSDTIYWLVSFIKWTGLRIFKNELEAFTKSGNKLKVITTSYMGATDAKAVEFLANLPNTEVKLSYNNQQERLHAKSYLFIRNTGFHTGYIGSSNLSHSALTSGLEWNLKITAQEIPHIIGKTKSTFETYWQSPDFELFTGKVECKEKLINSLNEQRGIGQASSQFYFDITPKTHQLAILEKLSVERSVHNRFKNLVVAATGTGKTIISAFDFKAVYDKNPNAHFLFVAPP

SEQ ID NO: 24137 - DNA, 846 bp, Unknown
  Obtained from environmental sample
  misc_feature (1)..(846): n is a, c, g, or t
ttgacagattcggctcgaggaagagaagctgaaaagtttattaaagaaggtagagtttccatcaatggaaaaccaacacagttaggtaacagagttggtaaaaaagatgttgtaaagttagatggacggttggtaaaaccaaaagatgaggtactttacatagctttaaataaacctgttggtattgtttctaccacagatgatagagagccaaacaacattgtaaaacacattaattatcctgaaagattattcccaattggacgattagacaaaccttctgaagggttaattttcttaacgaatgatggagatattgtcaataaaattttaagagcaggaaacaatcacgaaaaagaatactttgtttctgttaataaaacaattacagacgattttatcgaaaaaatgagtaatggaattccgattttaggaactgtaactcaaaagtgtttggtagaaaaaattagtgctaaaatttttaaaattgtattaactcaagggttaaatcgtcaaattcgtagaatgtgcgaatatttagactatgaagtaaccaagttaaaacgcaccagaattatgaatgtagaattaggttatctacaatctggagattggcgcgaattaacagaagaagaaatgaaagaaattaatgcaatgatttctgattcttccaaaactgaggaagcatccaaagttaaagaacctgcaaaaaagaaagtgtttaagaaaaaattagcgcctgctaaaaacgatttcaataaaaaaagtgcttcttttagaaaatcatcaccaaaaaatagtagaactacaggttctaaatctaattttcgtaaaaaacgaaactaa

SEQ ID NO: 24138 - protein, 281 aa, Unknown
  Obtained from environmental sample
  DOMAIN (52)...(179): RNA pseudouridylate synthase
  misc_feature (1)..(281): Xaa is any amino acid
MTDSARGREAEKFIKEGRVSINGKPTQLGNRVGKKDVVKLDGRLVKPKDEVLYIALNKPVGIVSTTDDREPNNIVKHINYPERLFPIGRLDKPSEGLIFLTNDGDIVNKILRAGNNHEKEYFVSVNKTITDDFIEKMSNGIPILGTVTQKCLVEKISAKIFKIVLTQGLNRQIRRMCEYLDYEVTKLKRTRIMNVELGYLQSGDWRELTEEEMKEINAMISDSSKTEEASKVKEPAKKKVFKKKLAPAKNDFNKKSASFRKSSPKNSRTTGSKSNFRKKRN

SEQ ID NO: 24139 - DNA, 378 bp, Unknown
  Obtained from environmental sample
  misc_feature (1)..(378): n is a, c, g, or t
atgctcggtattgattggagtactgtagattcatatccattgttcgattcttgtgacgaaggggttactaaagacgagcaaaaaaaatgctttgaagaaactttggcgtctcattttcaagaaactttaagcgagtttgaatttacgcttaccgataaagagagtgagattgtagaagttatttttgtaattgataccatgggtagaatcaatgtcattaatattgaaaaagatgcttctgtattaacccaaatgccagaatttgatggtgttattacgcaaagcttaaagaatcttcctaaacttgcacccgctataaaacaagcaattccggtgaataccaaataccggattcctgttcaattaaaaacaaactaa

SEQ ID NO: 24140 - protein, 125 aa, Unknown
  Obtained from environmental sample
  misc_feature (1)..(125): Xaa is any amino acid
MLGIDWSTVDSYPLFDSCDEGVTKDEQKKCFEETLASHFQETLSEFEFTLTDKESEIVEVIFVIDTMGRINVINIEKDASVLTQMPEFDGVITQSLKNLPKLAPAIKQAIPVNTKYRIPVQLKTN

SEQ ID NO: 24141 - DNA, 345 bp, Unknown
  Obtained from environmental sample
  misc_feature (1)..(345): n is a, c, g, or t
atgaacatgatgaagggttttttactattttttttattttccgtacacattttatcggctcaaaaaatcacggttcaagataaagaatcgacatttccaatttacaatgttactgttaacaacgaggataagtctatacatgcaatatcagataaaaagggaattgttgacatttctgcctttgcagttaatgatattttaaccttcacacatcttgcatatgttgaatatgaattgttaaaaaggggtaataacaggcaaagaaaattatttacttacaaagtaaaagcagagcaactcccaggaggtcttttttttcagctttcaaaagggaagggagtttaa

SEQ ID NO: 24142 - protein, 114 aa, Unknown
  Obtained from environmental sample
  SIGNAL (1)...(20)
  misc_feature (1)..(114): Xaa is any amino acid
MNMMKGFLLFFLFSVHILSAQKITVQDKESTFPIYNVTVNNEDKSIHAISDKKGIVDISAFAVNDILTFTHLAYVEYELLKRGNNRQRKLFTYKVKAEQLPGGLFFQLSKGKGV

SEQ ID NO: 24143 - DNA, 495 bp, Unknown
  Obtained from environmental sample
  misc_feature (1)..(495): n is a, c, g, or t
atgaatcaaagatatctagactatgccaactataatatttgggcaaataataagttaataaataatttattggaacaagatgacaaactattaagtcaggaattaatcggaagctttccaacaattcgtgccactatattacacatttggtttgcagaaacaggatggctttctcgtttgaatggaaaaggatgggaaacagtaaacgtcacagacttttcggatggcaatgaaaaattatttaagttatggcaaattacttcagagagctttaaaaagttcgtagaaaaagtagatttagaaaaagaaatccaatttcagcataaagaagaaaaattttcaattccaactcgtgaaatagttcagacggtttttaatcatgggagttttcatcgaggacaagttgtaattatgatgagacaattaggagttttaaaaatatctcagacggattatattgaatgggttcgagaaaaagaaagaggtaatatctga

SEQ ID NO: 24144 - protein, 164 aa, Unknown
  Obtained from environmental sample
  DOMAIN (1)...(160): DinB family
  misc_feature (1)..(164): Xaa is any amino acid
MNQRYLDYANYNIWANNKLINNLLEQDDKLLSQELIGSFPTIRATILHIWFAETGWLSRLNGKGWETVNVTDFSDGNEKLFKLWQITSESFKKFVEKVDLEKEIQFQHKEEKFSIPTREIVQTVFNHGSFHRGQVVIMMRQLGVLKISQTDYIEWVREKERGNI

SEQ ID NO: 24145 - DNA, 762 bp, Unknown
  Obtained from environmental sample
  misc_feature (1)..(762): n is a, c, g, or t
ttgtctaattcctatgagcttaaggtcaaaaataaatctggagaaataagatattggttaattagtggtgcacctaattataatatagaaggtgacattgtagggtcaattgggatccatttagacatcaccgaaattaaaaatttagagcttcaaaaagaaaaacttttagccaaattagaaaaaagtaatgacgagttgcaagaatatgcacacattgtttcacacgatttaaaatcgcctttacgaagcatagacgcactaattagttggttaaaagaagacaatcaagggaagttagacgatgtaagtcttcaaaattttgcattgatagaatctactctagaaaaaatggagcaactaattacagatgttttaaattactctagcgtaggagctgataatacagcaaaatctgaagtagatttaaatagtatggttagtgagctaattagtatgctctacattcctgaccatatacacattaaaagccttaaaacattaccaaatattaatggtgataaaaccaaattacagcagttatttcaaaatctaattagtaacgcagtaaagtttattgataaaacagaaggacatattatcatagatgtggaggatttaaaaagtcactacaagttttcaatttcagataatggtatgggaattgataaaaagtttcatgataaaatatttaaaatattccatgcacttaataaaagtaaagactccacaggaattggattatctattttaaaaagatag

SEQ ID NO: 24146 - protein, 253 aa, Unknown
  Obtained from environmental sample
  DOMAIN (4)...(46): PAC motif
  misc_feature (1)..(253): Xaa is any amino acid
MSNSYELKVKNKSGEIRYWLISGAPNYNIEGDIVGSIGIHLDITEIKNLELQKEKLLAKLEKSNDELQEYAHIVSHDLKSPLRSIDALISWLKEDNQGKLDDVSLQNFALIESTLEKMEQLITDVLNYSSVGADNTAKSEVDLNSMVSELISMLYIPDHIHIKSLKTLPNINGDKTKLQQLFQNLISNAVKFIDKTEGHIIIDVEDLKSHYKFSISDNGMGIDKKFHDKIFKIFHALNKSKDSTGIGLSILKR

SEQ ID NO: 24147 - DNA, 318 bp, Unknown
  Obtained from environmental sample
  misc_feature (1)..(318): n is a, c, g, or t
atggaacaacctaaccaatcctacattaacagtctatcaggaggtgatgaagccttcaaacaaaagctaattgatattattaaaaaagagtttccagaagagaaacaagtctattttgataattttgaagctaataattttaaattagcagcagataatgtgcataaacttaagcataaaattagtattttaggcctggaaaaaggttatgaagtcgcagtagcatacgaaaacaatttgttagacggtactacagatcttaaagatcagtttgaagcgatattgcaaagcataacaaactatctagaagaaatttaa

SEQ ID NO: 24148 - protein, 105 aa, Unknown
  Obtained from environmental sample
  misc_feature (1)..(105): Xaa is any amino acid
MEQPNQSYINSLSGGDEAFKQKLIDIIKKEFPEEKQVYFDNFEANNFKLAADNVHKLKHKISILGLEKGYEVAVAYENNLLDGTTDLKDQFEAILQSITNYLEEI

SEQ ID NO: 24149 - DNA, 438 bp, Unknown
  Obtained from environmental sample
  misc_feature (1)..(438): n is a, c, g, or t
gtggatgctaatctactaacagaaaacattctaaaaattattcatgtaccaagtaatattagtgttactaaaaccaatttaccagtaataaaaggtgataaatataggttgcaacaattgtttcaaaaccttattagtaatgctattaaatacaatgataaagaccaaggcgttattgaaattggagcagaagataaagccaactactggcaattttacgtaaaagataacggtaagggtattgataaatcctactttgataaaatatttaaaacctttataaaattagaaaacaatccagactcaacaggaattggattgtctatagttaaaaaaattgtcgaattatatggtggtaaaatctggctagaatctcaagtcaatgttggtacaacattttatttcactttaaaaaaatccccaaatggaacaacctaa

SEQ ID NO: 24150 - protein, 145 aa, Unknown
  Obtained from environmental sample
  DOMAIN (32)...(140): Histidine kinase-, DNA gyrase B-, and HSP90-like ATPase
  misc_feature (1)..(145): Xaa is any amino acid
MDANLLTENILKIIHVPSNISVTKTNLPVIKGDKYRLQQLFQNLISNAIKYNDKDQGVIEIGAEDKANYWQFYVKDNGKGIDKSYFDKIFKTFIKLENNPDSTGIGLSIVKKIVELYGGKIWLESQVNVGTTFYFTLKKSPNGTT

SEQ ID NO: 24151 - DNA, 444 bp, Unknown
  Obtained from environmental sample
  misc_feature (1)..(444): n is a, c, g, or t
atgacaacagtaacagcagatttgaaaaaagtaacaaaaaaagtacctgtaagaggtatgatggataatgtaatggagcagtttaacagtgctgcagaccatattaatttacatccaaatattagaaaaatattaagtattactaacaacgagattttagtcaactttccggtaaaaatggataatggagacgtcgagatttttacaggttatagagtgcaacataataatgcattaggaccatataaaggaggtttacgttaccacccaacagtggatattgatgctgctagagcattagcgatgtggatgacttggaaaacatcattagcaggtttgccatatggtggaggtaaaggtggtattaaaatagatccttcaaaatattcgcaatcagagttagagcgtattacaagacgtttacgttgctctcagccaatctga

SEQ ID NO: 24152 - protein, 147 aa, Unknown
  Obtained from environmental sample
  DOMAIN (48)...(147): Glu/Leu/Phe/Val dehydrogenase, dimerisation domain
  misc_feature (1)..(147): Xaa is any amino acid
MTTVTADLKKVTKKVPVRGMMDNVMEQFNSAADHINLHPNIRKILSITNNEILVNFPVKMDNGDVEIFTGYRVQHNNALGPYKGGLRYHPTVDIDAARALAMWMTWKTSLAGLPYGGGKGGIKIDPSKYSQSELERITRRLRCSQPI

SEQ ID NO: 24153 - DNA, 375 bp, Unknown
  Obtained from environmental sample
  misc_feature (1)..(375): n is a, c, g, or t
atggctcggtcaagaaacattctaaatctagaaggcaatccagtggattacctgacggaaaaataccaaatgattgatgagttgtttggaatagaaaaaccaattttaattaacgattttaaagcaattgaagcagctattaaaaagaaagaaaattgggaatattttgaagatttaggaaaattagctagaaaagaatatccagatacattattaggaaattattatttaggacgcttttatgaagaaacaggagagcctaaaaaagcaatgaaaacataccagtcggcttatgtgctatcagaaatagcaggtattactaaagatcacgttttagaattatcagaacagattaaagcagattttggatattaa

SEQ ID NO: 24154 - protein, 124 aa, Unknown
  Obtained from environmental sample
  misc_feature (1)..(124): Xaa is any amino acid
MARSRNILNLEGNPVDYLTEKYQMIDELFGIEKPILINDFKAIEAAIKKKENWEYFEDLGKLARKEYPDTLLGNYYLGRFYEETGEPKKAMKTYQSAYVLSEIAGITKDHVLELSEQIKADFGY

SEQ ID NO: 24155 - DNA, 537 bp, Unknown
  Obtained from environmental sample
  misc_feature (1)..(537): n is a, c, g, or t
atggctaaagtaaaaactacctttttttgtcaaaattgcggtacgcaatatgctaaatggcaaggacaatgtaatgcctgcaaggagtggaatacaattgttgaagaggttgtgcaaaaaccagaaaaaagcgattggaaaacacctactaataatacaaaacgagcatcaaaaccattaagaataaacgaaattgattcctctaaagaagcaagattagatacgcttgatgcggaatttaatcgtgtgttgggtggtgggattgtaccaggatctttaacgcttttgggtggagaaccaggtattggtaaaagtacattgttacttcaaatttcattaaaattaccctataaaaccttatacgtttctggagaaganagtcaaaagcaaataaaaatgcgtgccgagcgtataaacccgaaaaacgaaagttgctacattcttactngaacaaaaacacaaaatatttttaagcaaatagaagccttagagccagatattgtaattattgattctattcaaacattgcattcctga

SEQ ID NO: 24156 - protein, 178 aa, Unknown
  Obtained from environmental sample
  misc_feature (1)..(178): Xaa is any amino acid
MAKVKTTFFCQNCGTQYAKWQGQCNACKEWNTIVEEVVQKPEKSDWKTPTNNTKRASKPLRINEIDSSKEARLDTLDAEFNRVLGGGIVPGSLTLLGGEPGIGKSTLLLQISLKLPYKTLYVSGEXSQKQIKMRAERINPKNESCYILTXTKTQNIFKQIEALEPDIVIIDSIQTLHS

SEQ ID NO: 24157 - DNA, 738 bp, Unknown
  Obtained from environmental sample
  misc_feature (1)..(738): n is a, c, g, or t
atgaaatgctttacctacagttttatattcgcaattttattcattggatgtgatcaaaaaaataaaccatcaactaaattatcagataatttaaccatagatcttacactaaaatccaatccaaaaatttcttttggttatcttcatgaatctagaagaatttcttcctttaatgagaaattacccaaatattatcaaaatcaattagaacttttaaattatagtgataatgactctgttattatctctactatgaatactgattatcatcaattttattatcagatgtatacaaaaggttttatagataaggatcaatttttagcaaaaggaattgatagtcttatagaagtaaataaacctaatcaaatacagcttttagcaagtataaaatttaaagatgaaacgcaaacattaattattgatgataataataatggagatttttctgatgataaagtagtggttttcgataaagattttagaattgatgccaatgattctttaaaaattgaaagtttacctattcttaattttaagtattggaattataaagattctcaaatagattcttttgaaagaaaggttattgtgtatccatctttaaattattttacattttcatcaacagataatgaaatttcaaaaaaatcgagactagtacttcatataatggattattggtcaggttctttggaaactgaaaatcagaagtatgatgtggctatcaaggattaa

SEQ ID NO: 24158 - protein, 245 aa, Unknown
  Obtained from environmental sample
  misc_feature (1)..(245): Xaa is any amino acid
MKCFTYSFIFAILFIGCDQKNKPSTKLSDNLTIDLTLKSNPKISFGYLHESRRISSFNEKLPKYYQNQLELLNYSDNDSVIISTMNTDYHQFYYQMYTKGFIDKDQFLAKGIDSLIEVNKPNQIQLLASIKFKDETQTLIIDDNNNGDFSDDKVVVFDKDFRIDANDSLKIESLPILNFKYWNYKDSQIDSFERKVIVYPSLNYFTFSSTDNEISKKSRLVLHIMDYWSGSLETENQKYDVAIKD

SEQ ID NO: 24159 - DNA, 477 bp, Unknown
  Obtained from environmental sample
  misc_feature (1)..(477): n is a, c, g, or t
atgaacaaaataaaatattttttactcaccattacactattttcactcagtgcatgtactagtccgccagaagggatcactgcggttaaaagctttgacttacaaaaatatcaaggtaaatggtacgaaatagcacggctaaatcattcgttcgaagagggtatggagcaggttactgctaactatactattaatgacgatggcactgtaaaggtaattaataagggctacattactaaagagcaacaatggaagaatgctgaaggccttgcaaaatttgttggggattctgacataggacattttaaagtatcgttttttggtccattttatggggcttacgttatttttgaacttgagcaagctgattaccaatatgcatttataacgagttataacaaagattacttatggtttttatcacgtacgccacaggtaggcgatgagttaaaagagcactttttaaaaaccagttaa

SEQ ID NO: 24160 - protein, 158 aa, Unknown
  Obtained from environmental sample
  SIGNAL (1)...(20)
  misc_feature (1)..(158): Xaa is any amino acid
MNKIKYFLLTITLFSLSACTSPPEGITAVKSFDLQKYQGKWYEIARLNHSFEEGMEQVTANYTINDDGTVKVINKGYITKEQQWKNAEGLAKFVGDSDIGHFKVSFFGPFYGAYVIFELEQADYQYAFITSYNKDYLWFLSRTPQVGDELKEHFLKTS

SEQ ID NO: 24161 - DNA, 675 bp, Unknown
  Obtained from environmental sample
  misc_feature (1)..(675): n is a, c, g, or t
atgaataaatttttacaacgcatatcattcaccttattactatcatgtattttgttaggttgcaataaagtaactaacaatagttttgagttaaaagaaggtgatttactgtttcaaaacacaggatcagacgacattgataatgctataaaggacgttacagcaaccgcttctgccaaaaattattctcatgttggtatggctatgcaaaaagacaacaaatggtttgtggtggaagctatacctaaacaaggcgtttgtataacaccaatagctaaatttttagaaaggaataaaaataaatttaataaatcgcaaaccacagttgcgaggctagacaactactacaagccctatataaaaacagccataaactatggtattaccagagttaatataccttatgatgatatttttttatgggatgacacatcctattattgctcagagttagtttacaaaatgttttcaactcaaaacttacctaaagattccatcccgtttttgacacacccaatgacttttaacgatagttctggtcaaccaatgactagttgggttaaatattacaaagctcgcaaccaatcaattccagaaggcattgaaggaacaaaccctaatttaatggcaagcagtaatcatattacgtttgttcatgattacgaaaatgactag

SEQ ID NO: 24162 - protein, 224 aa, Unknown
  Obtained from environmental sample
  SIGNAL (1)...(20)
  DOMAIN (23)...(222): Protein of unknown function (DUF1105)
  misc_feature (1)..(224): Xaa is any amino acid
MNKFLQRISFTLLLSCILLGCNKVTNNSFELKEGDLLFQNTGSDDIDNAIKDVTATASAKNYSHVGMAMQKDNKWFVVEAIPKQGVCITPIAKFLERNKNKFNKSQTTVARLDNYYKPYIKTAINYGITRVNIPYDDIFLWDDTSYYCSELVYKMFSTQNLPKDSIPFLTHPMTFNDSSGQPMTSWVKYYKARNQSIPEGIEGTNPNLMASSNHITFVHDYEND

SEQ ID NO: 24163 - DNA, 678 bp, Unknown
  Obtained from environmental sample
  misc_feature (1)..(678): n is a, c, g, or t
atgactaaccatattattgataataaatacataaacagagagttaagttggctacaatttaaccatcgtgttttacaagaagctgccgacgagtctgtacctttgattgaaagacttcgttttttaggaattttttctaataatctagacgaatttttcaaggttagatacgcaaccgttaaacgtatcgattacgctggtagagctggtaaaagccagcttggtggaataaaagcttctgagttgttggagattattaccaacatagttataaagcatcaaaccgaaagtttaaagattttaagtgatattcaaaaaaagttaaaagcagagaatattttcattttaagagaatctaaaatcacaaaagctcaaaagcaatatcttagaaagtactttttagaaaaagttagcccagctcttgttaccattgttttaaataccgaaatcaagttacctaatcttaaagatagtgcagcttatctagcggtaaatatgcatttaaaagatggagaaaatcaatacgctttaatagaaatatctaaaaatatggatcgatttatcgtgttgccaaaagttggcgatactgataatataatcatgttagatgatttacttagacctattttaaacgatattttaacatcttcgagtaaaacaaaattactgctcctatga

SEQ ID NO: 24164 - protein, 225 aa, Unknown
  Obtained from environmental sample
  DOMAIN (7)...(225): Polyphosphate kinase
  misc_feature (1)..(225): Xaa is any amino acid
MTNHIIDNKYINRELSWLQFNHRVLQEAADESVPLIERLRFLGIFSNNLDEFFKVRYATVKRIDYAGRAGKSQLGGIKASELLEIITNIVIKHQTESLKILSDIQKKLKAENIFILRESKITKAQKQYLRKYFLEKVSPALVTIVLNTEIKLPNLKDSAAYLAVNMHLKDGENQYALIEISKNMDRFIVLPKVGDTDNIIMLDDLLRPILNDILTSSSKTKLLLL

SEQ ID NO: 24165 - DNA, 453 bp, Unknown
  Obtained from environmental sample
  misc_feature (1)..(453): n is a, c, g, or t
atgaatagtatatctaactatccaatgatagataaactatacgaagcaagtcaagcaggagttaaaatacaaatgatagttcgtggaatttgttgtttagtgccaggcgtaaaaggtataagtgaaaacatagaagtaataagtatagtcgataaatttttagagcacacaagactttacgttttttgcaataataacaatcctttggtttatatctcttctgcagattttatgaccagaaatatcgagaacagggtagaagtaagctgtcctatttatgataaagatataaaagaagaattgattgatacgtttcatatttgttggaatgataatgttaaagctaggatattaaataaagcacaaaacaatacctacaagcgtaacgataaaccacagtacagaagtcaatttgaagcttacaattatttaaaaaataaattagatgcttaa

SEQ ID NO: 24166 - protein, 150 aa, Unknown
  Obtained from environmental sample
  misc_feature (1)..(150): Xaa is any amino acid
MNSISNYPMIDKLYEASQAGVKIQMIVRGICCLVPGVKGISENIEVISIVDKFLEHTRLYVFCNNNNPLVYISSADFMTRNIENRVEVSCPIYDKDIKEELIDTFHICWNDNVKARILNKAQNNTYKRNDKPQYRSQFEAYNYLKNKLDA

SEQ ID NO: 24167 - DNA, 684 bp, Unknown
  Obtained from environmental sample
  misc_feature (1)..(684): n is a, c, g, or t
ttgattataaaatctgcatatcaaaattctgatgaattttttgagtatatcattaaaaataaaagtgatcaaaaagaagatattgaaaataccctctttactcctattcaaaaaattgttgtgacttctacaactcacattccaatggttgagttattgaatgaagaaaactcgatagttggttttccttattctaaatatgtatcatcagcaaaaacaagagctttaattgatgcaggaaaaatacaagaaattggaaaagaaagttcgctaaacacagaaatcttattggatttacaaccagaattagtggttggttatagtgtttcttctgctgataaatctctaacaaccattcaaaaatctggcataaaagtaatttataatggagattggctagaagaaactcctctaggaagagctgaatggattaagttttttggagttttgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatcttga

SEQ ID NO: 24168 - protein, 227 aa, Unknown
  Obtained from environmental sample
  misc_feature (1)..(227): Xaa is any amino acid
MIIKSAYQNSDEFFEYIIKNKSDQKEDIENTLFTPIQKIVVTSTTHIPMVELLNEENSIVGFPYSKYVSSAKTRALIDAGKIQEIGKESSLNTEILLDLQPELVVGYSVSSADKSLTTIQKSGIKVIYNGDWLEETPLGRAEWIKFFGVLFDKEKQADSIFKVIEANYLDAKQIALKSTKKPTILSGAIMSKDIWNLPAGESFVAQFLIDANLDYLWKNTEGKGSLS

SEQ ID NO: 24169 - DNA, 639 bp, Unknown
  Obtained from environmental sample
  misc_feature (1)..(639): n is a, c, g, or t
gtggcaaaatcgaatggatttataggcagtgaaaataaattattacagcttatggggttatcaaaaagttatatgcttaatcgggtaaaccgaaaatacttaggttcacaatatcagcgttttatatttggcccagcaacaagcgacttatcaattaccgacagctataattttaaaacacaaaaaatagcgcttacccaaaataatttaaaagatgccttacttgcatcgggttcaataccgttagttatgcaaggaattaaaaatattgcaggaacacccgttggcatgtatcgcgatggcggaattattgattaccactttgatttaaaaattaacaacccaggactcattttatatccgcactttaattcagagccaaaagcagggtggtttgataaaaatttaaaacgtaaagtatcgccacttaattacgataacgtggtaatgatcacgccatcaaaagaatttatagcaggcttaccttacggaaaaattccagatagaaatgattttacagatctagatgccgacacacgcattaaatattggaatacagtatttagtgaaacagaaagattagcagaggcgtttgatgagaagttatataataattttaaaataataccagttgaataa

SEQ ID NO: 24170 - protein, 212 aa, Unknown
  Obtained from environmental sample
  misc_feature (1)..(212): Xaa is any amino acid
MAKSNGFIGSENKLLQLMGLSKSYMLNRVNRKYLGSQYQRFIFGPATSDLSITDSYNFKTQKIALTQNNLKDALLASGSIPLVMQGIKNIAGTPVGMYRDGGIIDYHFDLKINNPGLILYPHFNSEPKAGWFDKNLKRKVSPLNYDNVVMITPSKEFIAGLPYGKIPDRNDFTDLDADTRIKYWNTVFSETERLAEAFDEKLYNNFKIIPVE

SEQ ID NO: 24171 - DNA, 648 bp, Unknown
  Obtained from environmental sample
  misc_feature (1)..(648): n is a, c, g, or t
atgtttaaaggagtaattttcgatttagatggtacacttgtaaattctttagaagatattagtaatgccataaatacagtattaaaaaaacataactttccaacacatagtgttgagacttgccaaagttttatagggcatggagttagagatttggtggtaaaagctttgcctaaagaaaataaaaatgaagaatggatagatcgttgttttcatgaaatgatagcaatttatagtgaaaaatgcacaattaaaacagctatgtatgctggtattagcgatttgttagatgagttaacggctcgtaatttaaaactggcagtgttttctaataaagcagatgaactgactaagaaagttgtaaaagcggttttttctaaatggaatttcgaagttgtagaaggtttaaaagtagaagcattaaaaaaaccaaatcctactgttgctttagaaattagtaaaaagttagccatacctgcagaacaattaatttttgtgggtgatacagatgtagatatattaacagctaagaactcaggcatgcatcctgttggtgtagtttggggttacagaaccaaagaagaattaatgttaagtggagcaaagtacattctagaaaaccctttagatttaattaaaattttataa

SEQ ID NO: 24172 - protein, 215 aa, Unknown
  Obtained from environmental sample
  DOMAIN (2)...(189): haloacid dehalogenase-like hydrolase
  misc_feature (1)..(215): Xaa is any amino acid
MFKGVIFDLDGTLVNSLEDISNAINTVLKKHNFPTHSVETCQSFIGHGVRDLVVKALPKENKNEEWIDRCFHEMIAIYSEKCTIKTAMYAGISDLLDELTARNLKLAVFSNKADELTKKVVKAVFSKWNFEVVEGLKVEALKKPNPTVALEISKKLAIPAEQLIFVGDTDVDILTAKNSGMHPVGVVWGYRTKEELMLSGAKYILENPLDLIKIL

SEQ ID NO: 24173 - DNA, 639 bp, Unknown
  Obtained from environmental sample
  misc_feature (1)..(639): n is a, c, g, or t
ttgacccaaataaaacctgaatctttaataggtatctctatacttcaagaagaatatttagagcaaagcatacagttagccagtcttattcaagataatatggttaaattaaagcgtaaagacagaaaagtaaagcaggatattttttgggtgttgcataatacttatatgccaagtgttttagttgaaacaggttttttaacgtacaaaaaagaaggtgcttacttaaattctgataaaggtcaaaaagaaatggctaaatctatttctgatgcaattgagacatttaaaaataaattagatggtaatgttggaaaacttattgttgaagaaaccattaaagacaccattccaaacgaagaaaaaacaataaaaaatacagtttttaaaatccaaatcgcagcaagctcaaaagcattagagcctaaagcctataattttaaagggcttaaagatatttcaagggaaaaatctggagcactttacaaatactattttggttacacatcagactataataaggctcaaaaactacaaatagaagctaaaaataaaggttataaggacgcttatattgttgcttttaaagatggtaaacaaatcaaactttcagaagcattaaaaaccgagtctaattag

SEQ ID NO: 24174 - protein, 212 aa, Unknown
  Obtained from environmental sample
  DOMAIN (2)...(98): N-acetylmuramoyl-L-alanine amidase
  misc_feature (1)..(212): Xaa is any amino acid
MTQIKPESLIGISILQEEYLEQSIQLASLIQDNMVKLKRKDRKVKQDIFWVLHNTYMPSVLVETGFLTYKKEGAYLNSDKGQKEMAKSISDAIETFKNKLDGNVGKLIVEETIKDTIPNEEKTIKNTVFKIQIAASSKALEPKAYNFKGLKDISREKSGALYKYYFGYTSDYNKAQKLQIEAKNKGYKDAYIVAFKDGKQIKLSEALKTESN

SEQ ID NO: 24175 - DNA, 375 bp, Unknown
  Obtained from environmental sample
  misc_feature (1)..(375): n is a, c, g, or t
atggctggttggagtttattttttggagtaatactgatgtccgtattaaaaaaaatgataagcaatcaatcaggattaataattagtaaggaaggtatatgggataattctagcggtgtaagcgtgggtatgataaaatgggaagacattgtaggaattcgtaaagtgaaagcatcaggagtcaaatttattctgatagatgtaaagaacgcagagagttatttaaataatacaaagggtattataaaaagacaagctataaaggcaaacatgagaaaatatagtactccaatttcattatctgcggcaggattaaaaattagttttaataaactcgaagaattagtactgaaggagtacaaagaaaatagttaa

SEQ ID NO: 24176 - protein, 124 aa, Unknown
  Obtained from environmental sample
  misc_feature (1)..(124): Xaa is any amino acid
MAGWSLFFGVILMSVLKKMISNQSGLIISKEGIWDNSSGVSVGMIKWEDIVGIRKVKASGVKFILIDVKNAESYLNNTKGIIKRQAIKANMRKYSTPISLSAAGLKISFNKLEELVLKEYKENS

SEQ ID NO: 24177 - DNA, 870 bp, Unknown
  Obtained from environmental sample
  misc_feature (1)..(870): n is a, c, g, or t
atgggtaattggcaagccaatatgctcactaatacggtgaaatggtccgctaatctctaccgtatttttcaattagatgaacatacagatacaacccttgagacttaccttagttttacgcatcctgaagataaagaaagagtcgcagaacatatgcgtaatacccgtgaaggaaaagaattcacggatttggtacaccgaattcaattagcagatggtactgtaaaaacggtacaactattagcgcaggtaatcaaaaacgatttcgataatgttagagaagtcattggtacttgccaagatgtaactgctcaaaaaatggcagagacagagcttatacgtaaaaatcaccttttaagttttgcagaaaggataaccatgatggggaattggcaatgggatgttattactgatagcttaaagtggtcttctaatttgtataaaattttcgaacatgatgaaagcctaacagatttaaagtacgatacgttctacagttatgttcatccagatgataaagagtatattactaaatatgtggaagattcattcttagaaaaaaagtttcctggtaattttatacaccgcattataacaggcagtggaaaaataaaaacagttcattttttaggggaagttatacttaatgatcaaggtaagattattgaaatgatgggaacttgccaagatattaccgaacaaaagatggaggaaaataagtttagaggcttattagaatctgcaccagatgctatggtaattgtgaatgcagaaggtaaaatacaactggataataaacagttagaaaaattatttgggtatacgacagatgaattgtttggtgagtctgttgaagttcttatcccctga

SEQ ID NO: 24178 - protein, 289 aa, Unknown
  Obtained from environmental sample
  DOMAIN (63)...(105): PAC motif
  misc_feature (1)..(289): Xaa is any amino acid
MGNWQANMLTNTVKWSANLYRIFQLDEHTDTTLETYLSFTHPEDKERVAEHMRNTREGKEFTDLVHRIQLADGTVKTVQLLAQVIKNDFDNVREVIGTCQDVTAQKMAETELIRKNHLLSFAERITMMGNWQWDVITDSLKWSSNLYKIFEHDESLTDLKYDTFYSYVHPDDKEYITKYVEDSFLEKKFPGNFIHRIITGSGKIKTVHFLGEVILNDQGKIIEMMGTCQDITEQKMEENKFRGLLESAPDAMVIVNAEGKIQLDNKQLEKLFGYTTDELFGESVEVLIP

SEQ ID NO: 24179 - DNA, 579 bp, Unknown
  Obtained from environmental sample
  misc_feature (1)..(579): n is a, c, g, or t
atgggaaatcagatgaaagaggaaagaaaaagccctttttgtttaaaaaaattcgaagcagttattggtcatcttacattaaccttaaatactttaatagaagctttaaaggttagaagtgataactcaaggaaaaaggaaaacattctgtttgatgatgtttttagaaaaacaacagaaattttaggtggagaaatattaaaaaccaatgctgtagttacagctgatttttctaaattgccgcaaattagttatgataaaatttatttagaaagtattttccttaacttggtggggaatgccattaagtatagctcaaaggacagaatcccagaagttagaatagaatctgataattatggtgggaaaataaaattaacaataactgataacggtttaggtataaatttaaaaagacatggagataaaatttttggtttaaataaagtatttcacagacatccagatgctaaaggcgtaggtttatatatgactaaaacgcaactagaagctatgggtggtgctattacagtaatgagtaaagttaatgaggggtcaacgtttacaataatcttttaa

SEQ ID NO: 24180 - protein, 192 aa, Unknown
  Obtained from environmental sample
  DOMAIN (85)...(192): Histidine kinase-, DNA gyrase B-, and HSP90-like ATPase
  misc_feature (1)..(192): Xaa is any amino acid
MGNQMKEERKSPFCLKKFEAVIGHLTLTLNTLIEALKVRSDNSRKKENILFDDVFRKTTEILGGEILKTNAVVTADFSKLPQISYDKIYLESIFLNLVGNAIKYSSKDRIPEVRIESDNYGGKIKLTITDNGLGINLKRHGDKIFGLNKVFHRHPDAKGVGLYMTKTQLEAMGGAITVMSKVNEGSTFTIIF

SEQ ID NO: 24181 - DNA, 417 bp, Unknown
  Obtained from environmental sample
  misc_feature (1)..(417): n is a, c, g, or t
atgaccggagagctttttgaaattctctctcaaataagcatattgtctaattcaattattaaggaagatacagaacaaatttctgaaggtccttttttagaaggcgtaaaattagggagtcaaggaaaactttcttcaagtctcttttcaattagagtgaatgatttattcgggaaatccaccaaagctgaaaattatttttatttaagtggcttattgattggtgatgaattggcatatttgaaaaatgaaaccagaaacatatttttagccgctccatatccgctttcaaaggtgtacaaaatagcattagaccatattattggtgcaggtaattatatgttcttagatgatgaaatagttgaaaaagccgtgttagttggtcaaaagaaaatactagaatattatgaaaagtaa

SEQ ID NO: 24182 - protein, 138 aa, Unknown
  Obtained from environmental sample
  misc_feature (1)..(138): Xaa is any amino acid
MTGELFEILSQISILSNSIIKEDTEQISEGPFLEGVKLGSQGKLSSSLFSIRVNDLFGKSTKAENYFYLSGLLIGDELAYLKNETRNIFLAAPYPLSKVYKIALDHIIGAGNYMFLDDEIVEKAVLVGQKKILEYYEK

SEQ ID NO: 24183 - DNA, 642 bp, Unknown
  Obtained from environmental sample
  misc_feature (1)..(642): n is a, c, g, or t
ttgatcgaaatatgccgtgataaaagagaagttaataagttttttgtcaatctcgatataaatataccaaatcagtttgatatcaataatttagagtttcctgtgtttgtaaagccttacgatggtagtagaagcgaaggcatatttacagcatttgaaagctcagatataaaagaagagcatataagcaacacgaaactgatgttcatggagtatatttctgatgaggattatgacgaattcacagtagactgttactatgacaaatactctaacttgaaatgtgtggtaccacgtaagcgtatatatgtgagagcaggcgaagttagcaaaggtatcactaaaaaaaatattattgtcgaacactttcaaaagaatattgccactattcaaggggcaaaaggttgcttaactattcaggtatttttacataaacattcaaatgaaattaaagggattgaaataaatcctagatttggtggaggttaccccttaacttatcttgctggtgctaactatactaaatggttgattgaagaatatttgcttgataaaaacattgaagatttcgatgattggaaagaaaatcttttgatgctgcgttatgatgcagaagttttagtggaaaactacaatgaatag

SEQ ID NO: 24184 - protein, 213 aa, Unknown
  Obtained from environmental sample
  misc_feature (1)..(213): Xaa is any amino acid
MIEICRDKREVNKFFVNLDINIPNQFDINNLEFPVFVKPYDGSRSEGIFTAFESSDIKEEHISNTKLMFMEYISDEDYDEFTVDCYYDKYSNLKCVVPRKRIYVRAGEVSKGITKKNIIVEHFQKNIATIQGAKGCLTIQVFLHKHSNEIKGIEINPRFGGGYPLTYLAGANYTKWLIEEYLLDKNIEDFDDWKENLLMLRYDAEVLVENYNE

SEQ ID NO: 24185 - DNA, 636 bp, Unknown
  Obtained from environmental sample
  misc_feature (1)..(636): n is a, c, g, or t
atggaaacaatagaacttcaaaacgaacagattatgagtgctttggatgtaaacaatgtgaaagattattgtcttgagattttacgaaaaagtaggtgcaaagccttaccgtttcatgggattaaacataccatagaagtttttgagaacgtgatgttaatgggtggttatgaaaaactaaatgaagcagaacaggagatattgaaaattgcggcattgttccatgatacaggaatgtctgaaacttatataggtcatgaaagtataagtgctaataatgctaaatcatatttacacgaaaccaactatccaaagaaaaagacggaacacatcctaaagtgcattcaagcaactaaaatgcctcaagatccaaaaacacttctgcaatgtattatctgtgatgccgatttgtttcatctggcaagtacgaactacatttttaaaaacgacctgttaaaaactgaatgggcaaattatatggatttggtatttacggatgaagaatggtatcaactgaatttggaatttctgatggagcatacatatcatacggattttggtaaaaccgttctgaaagaaggaaagcaaaaaaatattgcgcttatggaacgattgaagaatgaggctaaccaataa

SEQ ID NO: 24186 - protein, 211 aa, Unknown
  Obtained from environmental sample
  DOMAIN (40)...(141): HD domain
  misc_feature (1)..(211): Xaa is any amino acid
METIELQNEQIMSALDVNNVKDYCLEILRKSRCKALPFHGIKHTIEVFENVMLMGGYEKLNEAEQEILKIAALFHDTGMSETYIGHESISANNAKSYLHETNYPKKKTEHILKCIQATKMPQDPKTLLQCIICDADLFHLASTNYIFKNDLLKTEWANYMDLVFTDEEWYQLNLEFLMEHTYHTDFGKTVLKEGKQKNIALMERLKNEANQ

SEQ ID NO: 24187 - DNA, 558 bp, Unknown
  Obtained from environmental sample
  misc_feature (1)..(558): n is a, c, g, or t
atgaaacaattgcgtaaatggagtcgaatacttcatagagatattggtttcttttttattggaacaaccatattatatggattatcgggaattgctttgaatcatatgagcgactggaacccaaattacaccgtagaacttaaaaattttaaaacttcaataaatttagaaaaaactgctagtactaaaaataatatattagaactgttagatgaagtcgataaaaggaaaaattacaaaaaacattattatcctaactctaatcaccttaaaatatttttgagaggaggttcttctataatggtaaatatcaataatggtaatggaacagccgaatatttaaaaagacgacctgttttttacgaagctaattttttacattataatccgaacagaatttggacatggttttctgatgtcttttcagcttctttaattctttttgccataacatcattctttatggttaaaggaaaaaaaggtatcaaaggccgtggtggcatttatacgatacttggtattcttatacccctgctatttctaatatattacatataa

SEQ ID NO: 24188 - protein, 185 aa, Unknown
  Obtained from environmental sample
  misc_feature (1)..(185): Xaa is any amino acid
MKQLRKWSRILHRDIGFFFIGTTILYGLSGIALNHMSDWNPNYTVELKNFKTSINLEKTASTKNNILELLDEVDKRKNYKKHYYPNSNHLKIFLRGGSSIMVNINNGNGTAEYLKRRPVFYEANFLHYNPNRIWTWFSDVFSASLILFAITSFFMVKGKKGIKGRGGIYTILGILIPLLFLIYYI

SEQ ID NO: 24189 - DNA, 375 bp, Unknown
  Obtained from environmental sample
  misc_feature (1)..(375): n is a, c, g, or t
atgaatttaaaccaagtaaccatatcctctaaaaatttagacagatccgtcacattttataaacttttaggactgcaacttattgttgacgctctaccaagatatgctaggtttacctgtcccgatggtgacgctactttttctatacaccaaaatataaatatgcaacctagtgataatacagtgctatattttgaagatgaaaatttaaaagatttagtttttaaactgaaacaaaaagggatagtttttacatctaatattgaagacaagtcatggctttggacagaagcgcatttaaaagatcctgacggaaataacattattttatttaaagcaggaaagcatagaaaaaatccaccttggcgaatttaa

SEQ ID NO: 24190 - protein, 124 aa, Unknown
  Obtained from environmental sample
  DOMAIN (2)...(110): Glyoxalase/Bleomycin resistance protein/Dioxygenase superfamily
  misc_feature (1)..(124): Xaa is any amino acid
MNLNQVTISSKNLDRSVTFYKLLGLQLIVDALPRYARFTCPDGDATFSIHQNINMQPSDNTVLYFEDENLKDLVFKLKQKGIVFTSNIEDKSWLWTEAHLKDPDGNNIILFKAGKHRKNPPWRI

SEQ ID NO: 24191 - DNA, 315 bp, Unknown
  Obtained from environmental sample
  misc_feature (1)..(315): n is a, c, g, or t
atggaggatttagggattattcaaaatcatatcactttaatttctccttttgaagtcggttatcagttaaaagctttaattactttacaggcgtttatgggtaaattaaaaccgtttttagaaaaagtaaaaacccttgatgaggtggttaattgctacaggattactggaaatgaaaatatagttatggaagtggttttaaaaaaccacaagcatttagaggcttttattgatcaattaattatttatggcgaatgtaaaacgcaaataattttatctcatgtagttaaaaataatgctattaagccagtttaa

SEQ ID NO: 24192 - protein, 104 aa, Unknown
  Obtained from environmental sample
  DOMAIN (1)...(85): AsnC family
  misc_feature (1)..(104): Xaa is any amino acid
MEDLGIIQNHITLISPFEVGYQLKALITLQAFMGKLKPFLEKVKTLDEVVNCYRITGNENIVMEVVLKNHKHLEAFIDQLIIYGECKTQIILSHVVKNNAIKPV

SEQ ID NO: 24193 - DNA, 654 bp, Unknown
  Obtained from environmental sample
  misc_feature (1)..(654): n is a, c, g, or t
ttggatcccaagaaaaaacgccccaaaatgggcctacaaaagattttgatggatgggggtatgaaagttttgacgcgagatttccccgatggccagagtatcaaattttcatcgtttcatggcaaaatgaaacctgcagataaggagtttgaaatgcaacgttttgttaaaggagaaacacaaattatggtcgcaactaccgttatagaagttggtgtaaatgtacccaatgcttcggtcatgataattgaaagtgcagagcgttttggactgtcacaattacaccaattaagaggtcgtgttggacgaggtgcagaacaaagttattgcatattaatgaccagtcataaattgtccgaaaatagcaaaacacgcatccaaaccatgactagtacaaatgatggttttgagattgccgaagtggatttaagacttcgtggaccaggagatattatgggtacacaacaaagcgggattttaaatttacgcatcgcagatattgtaaaagataacgacattttacaacacgcgcgttattgggcaaaagaccttttaactaaagatccaagtttaagtagttcagaaaatgcaattattttagagacttaccgacaaatgagtaagtataaaaacatttggaattacattagctaa

SEQ ID NO: 24194 - protein, 217 aa, Unknown
  Obtained from environmental sample
  DOMAIN (28)...(105): Helicase conserved C-terminal domain
  misc_feature (1)..(217): Xaa is any amino acid
MDPKKKRPKMGLQKILMDGGMKVLTRDFPDGQSIKFSSFHGKMKPADKEFEMQRFVKGETQIMVATTVIEVGVNVPNASVMIIESAERFGLSQLHQLRGRVGRGAEQSYCILMTSHKLSENSKTRIQTMTSTNDGFEIAEVDLRLRGPGDIMGTQQSGILNLRIADIVKDNDILQHARYWAKDLLTKDPSLSSSENAIILETYRQMSKYKNIWNYIS

SEQ ID NO: 24195 - DNA, 696 bp, Unknown
  Obtained from environmental sample
  misc_feature (1)..(696): n is a, c, g, or t
atgaaaatcagcaccaatctactacctactctatttgaaagtaaaatatctatttttacaaacagtgatgatgaaaaaataaaaagcttttctactaaaacaagcgaaagtggcttaaaaattaatataaacacaactcaccttgatcctaaagttaaagaaaaaaaagacaataatgcttttgattcatcattaattgagggaagtgcatatgaaaaagtatttaaaaaagaagagctcaacttttctaatatgagtataaaagaacttcatagtattgttaaaaatgtgaatgaaatggaacgagaatacacacaaaaatacgatagtgatgaaccagttagattaggtaagtcaggaaaccccataatatccaaaaaaagagaagatatgaatagtttagagtctaaacttaggatcctttcttatggtggaggggatgtagatcctgataaaaaaattaatgttatggagtatttttctaatagttcagagaaattagatggacttgctaaagaatatcctgaacgtcagacttatcaagtaagagcctcttacatgaaagaaataatttatacgtttgataattttatatcagacgatacttttgatttatatcaagaaaaaggctgctttatggttaacgaccaaaaaaaaagtcgatgtttttattttaaaaaaagcctagaacattag

SEQ ID NO: 24196 - protein, 231 aa, Unknown
  Obtained from environmental sample
  misc_feature (1)..(231): Xaa is any amino acid
MKISTNLLPTLFESKISIFTNSDDEKIKSFSTKTSESGLKININTTHLDPKVKEKKDNNAFDSSLIEGSAYEKVFKKEELNFSNMSIKELHSIVKNVNEMEREYTQKYDSDEPVRLGKSGNPIISKKREDMNSLESKLRILSYGGGDVDPDKKINVMEYFSNSSEKLDGLAKEYPERQTYQVRASYMKEIIYTFDNFISDDTFDLYQEKGCFMVNDQKKSRCFYFKKSLEH

SEQ ID NO: 24197 - DNA, 783 bp, Unknown
  Obtained from environmental sample
  misc_feature (1)..(783): n is a, c, g, or t
atgagttaccatttcattgatattgaggccaaatggcaaaaatattgggcagaacatcaaacttttaaagcagagaataattctgaaaaacccaagtattatgtattagacatgtttccgtacccttcgggtgccggtttacatgtggggcatcctttggggtatatagcatcggatatttatgcacgctacaaacgtcataaagggttcaatgtattacatccacaagggtatgatagttttggattacccgcagaacaatatgcaatacaaaccggtcaacatccagctttaaccacggaagagaacattaaaacttacaggcgtcagttagatcaaatcgggttttcatttgattggtctcgtgaagtgcgtacttcagatccgaaatattataaatggacacagtggatctttattcagttatttaattcctggtacaataatgatgctgataaagcagaagatatctctactttagtaactatttttgagaaagaagggaatacaaaagtgaacgccacagcggatgatgatgtaataccattttctgctgaagaatggaaaggtttttctaaggaacaaaaacaaaaaatattattacaatatcgcttaacgtttttatcggaaactgaggtgaactggtgccctgcattgggaacggtattggcgaatgacgaaataataaacggcgtttcagaacgtggaggtcaccctgtagttcgtaaaaaaatgaaacaatggagtatgcgaattaccgcatatgccccaacgattggttaa

SEQ ID NO: 24198 - protein, 260 aa, Unknown
  Obtained from environmental sample
  DOMAIN (11)...(253): tRNA synthetases class I (I, L, M and V)
  misc_feature (1)..(260): Xaa is any amino acid
MSYHFIDIEAKWQKYWAEHQTFKAENNSEKPKYYVLDMFPYPSGAGLHVGHPLGYIASDIYARYKRHKGFNVLHPQGYDSFGLPAEQYAIQTGQHPALTTEENIKTYRRQLDQIGFSFDWSREVRTSDPKYYKWTQWIFIQLFNSWYNNDADKAEDISTLVTIFEKEGNTKVNATADDDVIPFSAEEWKGFSKEQKQKILLQYRLTFLSETEVNWCPALGTVLANDEIINGVSERGGHPVVRKKMKQWSMRITAYAPTIG

SEQ ID NO: 24199 - DNA, 672 bp, Unknown
  Obtained from environmental sample
  misc_feature (1)..(672): n is a, c, g, or t
ttgatactaaatgaatccaaaaatattccaaatacattagccgcttcattaaaagaatttgtaaataatggtggagacctggtaataatacctccgatagatttgaatttaaattcatataccgctgcttttaatacgctcaatattggtagattatctgatctaaataatgctgaattagctatttcgactattaatttttctcatcctttactaaaaggtgtttttgagaaaaaaataaaaaaatttcaatatccaactgttcaaagtagttatcgtagtaattttagaaatagttcttcaattttgaagtttgaaaacaatagagattttatttcacaaataaccctaaacaaagggaaaatatattgtttttcatcatctttagacagtaaaaattcaaattttaagagttcaccgcttatcgttccaatcttttacaactttggactgtacagccatcaaccagaagatctatattatattaatggaacaacaaacataattgaagtctcaacccaaataaaaaaagatcaagttgtacacttggtatcaacaattgaagattttattcccacacaacaaatatcaactaaaaaagtaacgctgacttcagaaacaatccaatcaaaagtggttttatcgaagtgcagcaaaataacaaccgaataa

SEQ ID NO: 24200 - protein, 223 aa, Unknown
  Obtained from environmental sample
  misc_feature (1)..(223): Xaa is any amino acid
MILNESKNIPNTLAASLKEFVNNGGDLVIIPPIDLNLNSYTAAFNTLNIGRLSDLNNAELAISTINFSHPLLKGVFEKKIKKFQYPTVQSSYRSNFRNSSSILKFENNRDFISQITLNKGKIYCFSSSLDSKNSNFKSSPLIVPIFYNFGLYSHQPEDLYYINGTTNIIEVSTQIKKDQVVHLVSTIEDFIPTQQISTKKVTLTSETIQSKVVLSKCSKITTE

SEQ ID NO: 24201 - DNA, 588 bp, Unknown
  Obtained from environmental sample
  misc_feature (1)..(588): n is a, c, g, or t
gtggttagtgtcataccagattatacacttagtcccaaagcaaactatgagaagatgactcaagaaattgcaaaaaatataaattgggttaaaaagaatatagaaaattatggaggtgatcctcagcaaatttacgtaacaggacattctgcaggtggacatttggtggctttagcggtgatgaacccaaaatatagaataggtcaagatgatatttctggtataattttaaatgatactgcaggattagatatgttttcatacttgcaaaaaaatccgcctacgagcgagaataattaccttactacttggagtaaccatcccaacacttgggaaaaagcatcacctataaattatattagtgaaaacacgcctcctattttacagtattgggggagcaagtcttatttgtctatcatagaagctaatcaagatttttataataagttagaagagtttcaacctaatttagagaagatcgttttaaagaaaaaacacgttcctatggttcttcagtacatctggccttggagtaaacgttatgacgaaattttacattttatggacactactaaaacatctaattag

SEQ ID NO: 24202 - protein, 195 aa, Unknown
  Obtained from environmental sample
  misc_feature (1)..(195): Xaa is any amino acid
MVSVIPDYTLSPKANYEKMTQEIAKNINWVKKNIENYGGDPQQIYVTGHSAGGHLVALAVMNPKYRIGQDDISGIILNDTAGLDMFSYLQKNPPTSENNYLTTWSNHPNTWEKASPINYISENTPPILQYWGSKSYLSIIEANQDFYNKLEEFQPNLEKIVLKKKHVPMVLQYIWPWSKRYDEILHFMDTTKTSN

SEQ ID NO: 24203 - DNA, 417 bp, Unknown
  Obtained from environmental sample
  misc_feature (1)..(417): n is a, c, g, or t
atggcaacatcagtattaaattcagtaaaaccatgtgaggtcacgattaaaagtcgtgacctttgcatggctgaatttaatgcatttaagccaccgtacaatgacgagtcaatggaagagctagccagtcttgcgactattatattggcgcaagaaaaaggaaaaagactttcaaaatatcaacttaaagatcaaataagaattgtcttccagcatgatggcattattaaattttttactcattttaaaaaagaacatggcataaaaaacacaaagattggtgattctaatgatatgagtttttcagcagcgaaattaaaagcggccgaaatatacaaaaagaacaccctctattacacattcggatttgtagtgagtaaacaaatagaaaacttacagggcattaataaaccatag

SEQ ID NO: 24204 - protein, 138 aa, Unknown
  Obtained from environmental sample
  misc_feature (1)..(138): Xaa is any amino acid
MATSVLNSVKPCEVTIKSRDLCMAEFNAFKPPYNDESMEELASLATIILAQEKGKRLSKYQLKDQIRIVFQHDGIIKFFTHFKKEHGIKNTKIGDSNDMSFSAAKLKAAEIYKKNTLYYTFGFVVSKQIENLQGINKP

SEQ ID NO: 24205 - DNA, 378 bp, Unknown
  Obtained from environmental sample
  misc_feature (1)..(378): n is a, c, g, or t
atgaagaaagtgctaactaaaaaaattgggttatcaacaattgctgaaattgactctaaaaaaatgcttcatcactctgtttcagagcacgatccgatgagtaaacattatgaccactcgaataaaatatataacactgatattaaagcactttataaaaacttttccctttttgagaaggaaatactcaaagaagtaaaaatacagactaagttaaaaaacaaaacggttaaaaaatcattttttaaattagattattcaaataaatttatcgccaaagtcaaaagtacagtaagtgcttattcaactatctggagtaatataaaccagcaagcccgaaagcttaaaaagagccgccctatgcatatattagagtag

SEQ ID NO: 24206 - protein, 125 aa, Unknown
  Obtained from environmental sample
  misc_feature (1)..(125): Xaa is any amino acid
MKKVLTKKIGLSTIAEIDSKKMLHHSVSEHDPMSKHYDHSNKIYNTDIKALYKNFSLFEKEILKEVKIQTKLKNKTVKKSFFKLDYSNKFIAKVKSTVSAYSTIWSNINQQARKLKKSRPMHILE

SEQ ID NO: 24207 - DNA, 774 bp, Unknown
  Obtained from environmental sample
  misc_feature (1)..(774): n is a, c, g, or t
ttgagtagtgagtttggggtagaacatttcaaaataaaatatatgatagtaatatctgctgggatgcaaaaatctggaagtgcatacatttataacttgatcaatgacattcttatatgctctggtaaaccggatgcacgaaatgtaaaagaaaaatatggcctagatgaggttatgaaatggcacaacaataatgttggccatttggaaaagaggcttcttgcgaaattagtgctcttaagtgtaaaagcaggaagctttgttgtaaaaacacattctggcccatcgcggtttcataacctgttgctccggttaggacttattaagacagtctacatatatagggatcctagagatgttttattgtctgcgcaagatcatgggagaaaaattattgaaggtggagagaatcatacttttgctcaaatgatagattttaatgatgcgtttaagaatgttagtatttggactaaaatttttaaatcatataaaaaaattaaaggtgttttgattattcgttatgaggatatcatggaaactccccttgtagaaatgcaaaaaatttgtcgttatcttaatgtaagtttatcggaagaaagtttaaaagggatattagcgaaatacgatagaaaaaaccctgatgcaaatatgactggattgcattttaataaaggaataaccaatcgctatgtaaatgagctaagcgaagcacagattgatagatttagttcggaaatggggatattaatgaaagaaatgggttatgaaaaatag

SEQ ID NO: 24208 - protein, 257 aa, Unknown
  Obtained from environmental sample
  DOMAIN (17)...(254): Sulfotransferase domain
  misc_feature (1)..(257): Xaa is any amino acid
MSSEFGVEHFKIKYMIVISAGMQKSGSAYIYNLINDILICSGKPDARNVKEKYGLDEVMKWHNNNVGHLEKRLLAKLVLLSVKAGSFVVKTHSGPSRFHNLLLRLGLIKTVYIYRDPRDVLLSAQDHGRKIIEGGENHTFAQMIDFNDAFKNVSIWTKIFKSYKKIKGVLIIRYEDIMETPLVEMQKICRYLNVSLSEESLKGILAKYDRKNPDANMTGLHFNKGITNRYVNELSEAQIDRFSSEMGILMKEMGYEK

SEQ ID NO: 24209 - DNA, 423 bp, Unknown
  Obtained from environmental sample
  misc_feature (1)..(423): n is a, c, g, or t
atgacagatcggctgagtgcattgacgaacgatttccaatcaaatttcaaatcacttaaaattaccgataaaattaatttagagcgtgcaatgaaattaggggacagactcgatggccatattgtacaaggtcatgttgatcaaattggaatatgtaaggatattataaatgaggatggtagttgggtttttacttttgaatatgatacgtctaccgataatattactatagaaaaaggttcaattagtgtaaatggagtaagtttgaccgtaattaattctaaggataatcagttcagtgttgctataataccatatacatttgataatacaaattttggtaaattaaaaattaatgatgtagtaaatttagaatttgatgttataggaaaatatgtagctaagatcgctacaataaaataa

SEQ ID NO: 24210 - protein, 140 aa, Unknown
  Obtained from environmental sample
  DOMAIN (43)...(127): Lumazine binding domain
  misc_feature (1)..(140): Xaa is any amino acid
MTDRLSALTNDFQSNFKSLKITDKINLERAMKLGDRLDGHIVQGHVDQIGICKDIINEDGSWVFTFEYDTSTDNITIEKGSISVNGVSLTVINSKDNQFSVAIIPYTFDNTNFGKLKINDVVNLEFDVIGKYVAKIATIK

SEQ ID NO: 24211 - DNA, 498 bp, Unknown
  Obtained from environmental sample
  misc_feature (1)..(498): n is a, c, g, or t
atgtttttcttcgatattagtataccaccatcaaaagatgctgtatatcaatctggtgtggatctcgcatcttatgtaaaaaaacatttaccaaattccaaagttgtgttattaacaatgtttaacgagtcgtatcgtattcacaatattataaaaaaaattaaacctgatgggtttttaataaaaagtgatattactgcaagcgaattgtctagtgcctttcaagctgttattagtaatcctcctttttatagtggaacagtaaacgagattttaaaaaaaacgaggtctagcaatttagatgtagacgatgtgagtcatgaaattttatatctactttctcaaggagttaaaaataaggatatgacgaaacgtctccatatctcattaagtatgattgaaaaacgtaaaaaatatttgaaagagatttttgatgttagtgatggtaaagatgatactttgattattgaagctagaaaagctggttttatagagtga

SEQ ID NO: 24212 - protein, 165 aa, Unknown
  Obtained from environmental sample
  misc_feature (1)..(165): Xaa is any amino acid
MFFFDISIPPSKDAVYQSGVDLASYVKKHLPNSKVVLLTMFNESYRIHNIIKKIKPDGFLIKSDITASELSSAFQAVISNPPFYSGTVNEILKKTRSSNLDVDDVSHEILYLLSQGVKNKDMTKRLHISLSMIEKRKKYLKEIFDVSDGKDDTLIIEARKAGFIE

SEQ ID NO: 24213 - DNA, 972 bp, Unknown
  Obtained from environmental sample
  misc_feature (1)..(972): n is a, c, g, or t
atggggnnncccaagtatcagatcggctcgagccctaataatattaataaagcatatgaattagcaaaagagctcaatgctaacgaatcggttttaaacactttacttttaaaagccaaaatagaagacgaaaccatttcgaaaaattatttgcttcaacatataaaattaaatgatagtctggtattgaaagaacgcctgattagaaataagtttgcgcgaatagattacgaaacagatattataattaaagaaaaggaagttatctcaaaacaacgtttatggttattgctgatttcagctgtcttattaatttcacttttttttgtctacagtattaaaacccaccgagcgcgtaaaagggaaattgaaatagctaaatctcaacaagaagcgaacgaggatatttataacttgatgttgtcgcaacaagaacaattaaatgtagcaaaagagcaagaaaagaaaaggatttcgcaagaattgcatgacggtattttagggcgcttatttggcacacgtttaagtttagacagtttaaattggaataaaacaaatgaggcaatagaaacacgtagtaattatattaatgaattaaaaaatattgaaaatgatctcaggcaagtctctcacgatttaaataccgactttattaatcagtcaaaattcaccgatattatagataatttagtaaaaacacacacagcaactttaggtttaaaatatagtattgaaatagatgataatattaattgggagcaattgtctaacaaaacgaaaattcatatgtatcgaattacacaagaatcgttacaaaatatttttaaacacgctgaagcttccgaagtaaaattgagtgttctattaaagaataaaaatgttattttagagataaaagataatggcaaaggctttagcggctcgaaatcaaaaaaaggaatcggctttaaaaatatgagaagaccgtggtaa

SEQ ID NO: 24214 - protein, 323 aa, Unknown
  Obtained from environmental sample
  misc_feature (1)..(323): Xaa is any amino acid
MGXPKYQIGSSPNNINKAYELAKELNANESVLNTLLLKAKIEDETISKNYLLQHIKLNDSLVLKERLIRNKFARIDYETDIIIKEKEVISKQRLWLLLISAVLLISLFFVYSIKTHRARKREIEIAKSQQEANEDIYNLMLSQQEQLNVAKEQEKKRISQELHDGILGRLFGTRLSLDSLNWNKTNEAIETRSNYINELKNIENDLRQVSHDLNTDFINQSKFTDIIDNLVKTHTATLGLKYSIEIDDNINWEQLSNKTKIHMYRITQESLQNIFKHAEASEVKLSVLLKNKNVILEIKDNGKGFSGSKSKKGIGFKNMRRPW

SEQ ID NO: 24215 - DNA, 783 bp, Unknown
  Obtained from environmental sample
  misc_feature (1)..(783): n is a, c, g, or t
atgctagtgacaatgcataaatataaccacatacaaatcgctgatgggcaaaaaatctattttgcatccgataaccatttaggagctccaacatctgaagcgtcaaagccacgtgaaaaaaaatttgtggcttggttagacgaaataaaagaagatgccgctgcgatttttttaatgggagacctttttgatttttggtttgaatataaaaccgtcgtccctaaaggatttacaagaacgctggggaaactagccgaaattagtgattctgggattccaattcattattttgtaggcaatcatgatttatggatgagtggctattttgaagaagaactcggaattacggtataccataaacctgaagaatttacgtttaaccaaacaaccgtttttgtaggtcatggtgatggtttaggtccgggagataaaggctacaaacgcatgaagaaagtgtttacaaatcctttttttcaatggtgttttaaatggatgcatcccgatattgggattaaaatcgggcaatatatgtctgtaaaaaacaaaatgatttcaggtgatgatgatgctaaatttttaggtgaggataatgaatggttagtggcgtattgtaaacgtaaactacaagataaacatcgtgatttctttgtgtttggtcatagacacttacctttagaaattcaactaaatacaacttctaagtatattaatttaggcgactggattcactattacacttatggtgtttttgatggtgaaaattttgagctgaagaaatattaa

SEQ ID NO: 24216 - protein, 260 aa, Unknown
  Obtained from environmental sample
  DOMAIN (17)...(224): Calcineurin-like phosphoesterase
  misc_feature (1)..(260): Xaa is any amino acid
MLVTMHKYNHIQIADGQKIYFASDNHLGAPTSEASKPREKKFVAWLDEIKEDAAAIFLMGDLFDFWFEYKTVVPKGFTRTLGKLAEISDSGIPIHYFVGNHDLWMSGYFEEELGITVYHKPEEFTFNQTTVFVGHGDGLGPGDKGYKRMKKVFTNPFFQWCFKWMHPDIGIKIGQYMSVKNKMISGDDDAKFLGEDNEWLVAYCKRKLQDKHRDFFVFGHRHLPLEIQLNTTSKYINLGDWIHYYTYGVFDGENFELKKY

SEQ ID NO: 24217 - DNA, 555 bp, Unknown
  Obtained from environmental sample
  misc_feature (1)..(555): n is a, c, g, or t
atgttggtaagaacaggggctttatatcatgatattggtaaaatgcttaatcctatgtattttatagagaaccatctacagggagtaaatcctcataacgatctatctccaagagatagttctaaaataataacagatcatgttataaaaggagtagaattagccaagaaatataatttaccagatagaataattgattttataaggacacatcatggaacaagttctacgtattatttttataaaaaggagcaggagttaaatccagatacaaaagttgatattaaaaacttccaatataaaggacccatccctttttctaaagaaaccgccattttaatgatgtgtgatactgcagaagctgcctcaaaaagtataaaaaatcctacagcccagtctatcagtagtttaattgataaaattattgataaacaaatggcagataatcagtttttgaattcagatatcacatttagagagattaaagtcatcaaaaaagtcatcaaaaagaaattgatgaatatctatcatttacgggttgaatatccagaataa

SEQ ID NO: 24218 - protein, 184 aa, Unknown
  Obtained from environmental sample
  DOMAIN (3)...(122): HD domain
  misc_feature (1)..(184): Xaa is any amino acid
MLVRTGALYHDIGKMLNPMYFIENHLQGVNPHNDLSPRDSSKIITDHVIKGVELAKKYNLPDRIIDFIRTHHGTSSTYYFYKKEQELNPDTKVDIKNFQYKGPIPFSKETAILMMCDTAEAASKSIKNPTAQSISSLIDKIIDKQMADNQFLNSDITFREIKVIKKVIKKKLMNIYHLRVEYPE

SEQ ID NO: 24219 - DNA, 666 bp, Unknown
  Obtained from environmental sample
  misc_feature (1)..(666): n is a, c, g, or t
ttgacatctaaagatgtattaaaaattattaaaattaatttaggaaaagaaccttataattatggccaaaaatcgcttttaaatatattagcaggcattgtaaaaccaaatgtaactttcgatgaggttcatacaaataaggtaatagaaaatgaaattagtaaaatttcctacacaaaaggtaaagttacagaaggcgaattaataattttaaaaggtggaattgtagagggaaaaaaactcgctattttaaattctctaaaaagtgaatcagcatctaaagtttggacagactctaattataattggatagtttttgggtacacaatcttggtttctttagcattattaatgttattattatttctacataaatacagaattgaaatttttgaaaataacaacaaagtaacatttatcttttttaatgtttttgctatcatttttattcaaaccttggttataaaatacaatgcagattatttgtatgtagttcccttaagtatcctaccaattataatcaaagctttttttgatgcaagattggggttatttacccatgttttaacagtgttgttgttaggttacatcgttcctaatagttttgaatttatttatcttcatataatagctgggaatggtaacccatcccttacaggtttctga

SEQ ID NO: 24220 - protein, 221 aa, Unknown
  Obtained from environmental sample
  misc_feature (1)..(221): Xaa is any amino acid
MTSKDVLKIIKINLGKEPYNYGQKSLLNILAGIVKPNVTFDEVHTNKVIENEISKISYTKGKVTEGELIILKGGIVEGKKLAILNSLKSESASKVWTDSNYNWIVFGYTILVSLALLMLLLFLHKYRIEIFENNNKVTFIFFNVFAIIFIQTLVIKYNADYLYVVPLSILPIIIKAFFDARLGLFTHVLTVLLLGYIVPNSFEFIYLHIIAGNGNPSLTGF

SEQ ID NO: 24221 - DNA, 792 bp, Unknown
  Obtained from environmental sample
  misc_feature (1)..(792): n is a, c, g, or t
atgaaccatcttccgcttatcataaaaagggaatacctcactaaagttcgcaataaatcgttcatcatcatgacgtttttgactccctttatttttatagggatttttgctttggtagcctatttatctagtttaaatagtgatactatccgtaaaatttcaattttggacgacagtggattgtttgcgaatgaatttaatagttcgccacatacacagtataaaatgttgcataacgtttccttggaagaagcaaaaaaggaatcagaaacagaagaaattaatggcttgctgtacattccaaaaactgaaaatttggaagacctttccaaaggaatcactttttattccgaagattcaccatcgctatcgatgatgagtgacataaacgatatgctggaaaggaaagtgaatacgctaaagttgaaagaagccggaattgattccgaaactattaaaagtcttcacatagacattcgcgctaatcaggaaacttttaaagggaaggaaacctccaaactcggttctggcttaaaattggcttttggaggagctgcaggttaccttctctttatgtttatcattatttatggcaatatgattatgcgcagtgtaatagaagaaaaaaccagcagagtaattgaggttatcatttcatctgtaaaaccacgcgtattgcttttgggaaaaatatttggaactactttggcgggtattacccagtttttaatttgggtggtcctaatcttgggtttgatgacccgttgtaacctctgttttttggaattgacc

SEQ ID NO: 24222 - protein, 264 aa, Unknown
  Obtained from environmental sample
  misc_feature (1)..(264): Xaa is any amino acid
MNHLPLIIKREYLTKVRNKSFIIMTFLTPFIFIGIFALVAYLSSLNSDTIRKISILDDSGLFANEFNSSPHTQYKMLHNVSLEEAKKESETEEINGLLYIPKTENLEDLSKGITFYSEDSPSLSMMSDINDMLERKVNTLKLKEAGIDSETIKSLHIDIRANQETFKGKETSKLGSGLKLAFGGAAGYLLFMFIIIYGNMIMRSVIEEKTSRVIEVIISSVKPRVLLLGKIFGTTLAGITQFLIWVVLILGLMTRCNLCFLELT

SEQ ID NO: 24223 - DNA, 330 bp, Unknown
  Obtained from environmental sample
  misc_feature (1)..(330): n is a, c, g, or t
ttgaaaacgaggtctagcctcacagaactgaacgtgattgaagtagttaaagagaggggattatcaatgttgtcgaagtctaacgcttcaccgtatatcataaccttaatcctctctttgttctttctgatttatagtttaaatttaataagaatcaaacttaagccgtatataagctatggcttggtcagtccacacttggaaaatcctgcggattttccaaagccagtttttatctggaaaggttcgtgccaatacacgccacagctcatatacataaacgttaggcaacatttgaaaaaaaattgcggtaaacaacaaacacactaa

SEQ ID NO: 24224 - protein, 109 aa, Unknown
  Obtained from environmental sample
  misc_feature (1)..(109): Xaa is any amino acid
MKTRSSLTELNVIEVVKERGLSMLSKSNASPYIITLILSLFFLIYSLNLIRIKLKPYISYGLVSPHLENPADFPKPVFIWKGSCQYTPQLIYINVRQHLKKNCGKQQTH

SEQ ID NO: 24225 - DNA, 564 bp, Unknown
  Obtained from environmental sample
  misc_feature (1)..(564): n is a, c, g, or t
atgaaaaagattgaattacgaaaaaaatataaatcactaagacgcttacttaatcaagatcaaattgaagcacaaagcattactattgccaatcagttactaacccttcctatttgggattatagtttttaccatttatttttaactatcacatcacaacatgaagttaataccgattatattttaaatatcttatcaggaaaggataaaaacatagttgtttctaaaagcaattttaccaacaacacattaaccaattatttactaacagacgctaccacattaaaactaagtgattataatatcccagagccaatagatggcattgagattttaaaccataatatagacgtcgtatttttaccgcttttagcgtttgatttaaaaggaaatcgtgtaggttatggtaaaggattttatgataatttattagcgtcttgcaaacccaacacccttaaagttggcttatccttttttgaagctgaagctgaaattgaagatgtttttgatggagatatccctatggattactgcgtaactccaaaaaagatttacatattttaa

SEQ ID NO: 24226 - protein, 187 aa, Unknown
  Obtained from environmental sample
  DOMAIN (3)...(181): 5-formyltetrahydrofolate cyclo-ligase family
  misc_feature (1)..(187): Xaa is any amino acid
MKKIELRKKYKSLRRLLNQDQIEAQSITIANQLLTLPIWDYSFYHLFLTITSQHEVNTDYILNILSGKDKNIVVSKSNFTNNTLTNYLLTDATTLKLSDYNIPEPIDGIEILNHNIDVVFLPLLAFDLKGNRVGYGKGFYDNLLASCKPNTLKVGLSFFEAEAEIEDVFDGDIPMDYCVTPKKIYIF

SEQ ID NO: 24227 - DNA, 330 bp, Unknown
  Obtained from environmental sample
  misc_feature (1)..(330): n is a, c, g, or t
atgatggcttctggtatgaatggtcaaagttttgcttttaatggttatttacctatagataaaggagagcgtaaagcagaattaaaacgcttagaacgtttaagttttgaacataaccagacacagtcttttattgaaacaccttaccgaaacaataaattattagaagatttatgtaacacattaagtgaaaacacagaaatttgcgtggcgtgtgatataacattacctactgagtttattaaaacaaaaacagtaaatcaatggaaaaaaaacagtgttgacctacataaaagaccaacactatttataatacacaaaagcttttaa

SEQ ID NO: 24228 - protein, 109 aa, Unknown
  Obtained from environmental sample
  misc_feature (1)..(109): Xaa is any amino acid
MMASGMNGQSFAFNGYLPIDKGERKAELKRLERLSFEHNQTQSFIETPYRNNKLLEDLCNTLSENTEICVACDITLPTEFIKTKTVNQWKKNSVDLHKRPTLFIIHKSF

SEQ ID NO: 24229 - DNA, 582 bp, Unknown
  Obtained from environmental sample
  misc_feature (1)..(582): n is a, c, g, or t
ttgcaagatattgagcaacgtttattatcaagatttaaatggggattatctgccgagttacaaactccagattttgaaacacgtgtatccatattaaaaaacaaattatatagagatggtgtagaaatgcctgaagatataattgaatatgttgctaaaaacataaaatctaatattagagagcttgaaggtgccattatttcattaatagctcaatcttcttttaacaaaaaagaaattaatatagagttagctagacaggttgtcgagaagtttgttaaaaacacaaaacgtgaagtttcaatagattatatacaaaaaatagtatcagattatttccaaatggatgtggatactttacaatctaaaactagaaaacgtcacattgtacaagctagacagttagccatgttttttgctaaaaagtttactaaagcctctttagctagtattggttctcagataggaaaacgtgatcacgctacagtattacatgcttgtaaaacggttgataatttatcaactacagacaagcagtttagaaaatacgtggaagatttaacgaaaaaactttcggtttaa

SEQ ID NO: 24230 - protein, 193 aa, Unknown
  Obtained from environmental sample
  DOMAIN (1)...(170): Bacterial  dnaA  protein
  misc_feature (1)..(193): Xaa is any amino acid
MQDIEQRLLSRFKWGLSAELQTPDFETRVSILKNKLYRDGVEMPEDIIEYVAKNIKSNIRELEGAIISLIAQSSFNKKEINIELARQVVEKFVKNTKREVSIDYIQKIVSDYFQMDVDTLQSKTRKRHIVQARQLAMFFAKKFTKASLASIGSQIGKRDHATVLHACKTVDNLSTTDKQFRKYVEDLTKKLSV

SEQ ID NO: 24231 - DNA, 948 bp, Unknown
  Obtained from environmental sample
  misc_feature (1)..(948): n is a, c, g, or t
atgaacatgaataaagaagaactcgaagcgtttgcaaaagaagcagctaaaagtattaaaacacctgacgatttaaatcaatttagtcagatgttaaaaaagataactgttgaagccgcacttaatgcagaaatggatgaacatttaggctatcaaaaacacagtaaatccacgagcagtaatagccgaaatggtaaaacaagtaagcgtatcaagacagaagacggtgagtttgagcttgatacgccccgcgaccgtgaaggctcttttgagccacagcttgttaaaaagcatcaatctcgattcacctcaatggatgataaaattttatggctgtatgcccaaggaatgagcacacgcgatatcgtgaatgcctttcatgagtggtatggcgctgatatctctcccacattggtgtcacgtgttaccagcgctgttatggagcaagtcactgaatggcaatctcgccccctggatgcgatttatcctattgtttatttggattgcttggttgtaaaaatacgccaagataagcgcgttatcaaaaagtctatttaccttgctttaggtattaatattgacggccataaagaattgcttggcatgtggatttcagaaaatgaaggggctaagttttggttgagcgtgctcaccgaattaagccaacggggcgttgaagatatcttaatcgcgtgcgtagatgggctgaagggatttcctgatgcaattaatactgcttacccgcaaactcatgttcaattgtgtatagtgcatatggttcgaaactcattgaaatatgtctcatggaaagattataaagccgtgacggcccgattgaagctgatttaccgctcgtcgacaagagaaaaggcgttgctggagttggaacgatttgcagagaaatgggacaatcaatatcctcaaataacaaagtcatgccgtgcgaaa

SEQ ID NO: 24232 - protein, 316 aa, Unknown
  Obtained from environmental sample
  DOMAIN (4)...(316): Transposase, Mutator family
  misc_feature (1)..(316): Xaa is any amino acid
MNMNKEELEAFAKEAAKSIKTPDDLNQFSQMLKKITVEAALNAEMDEHLGYQKHSKSTSSNSRNGKTSKRIKTEDGEFELDTPRDREGSFEPQLVKKHQSRFTSMDDKILWLYAQGMSTRDIVNAFHEWYGADISPTLVSRVTSAVMEQVTEWQSRPLDAIYPIVYLDCLVVKIRQDKRVIKKSIYLALGINIDGHKELLGMWISENEGAKFWLSVLTELSQRGVEDILIACVDGLKGFPDAINTAYPQTHVQLCIVHMVRNSLKYVSWKDYKAVTARLKLIYRSSTREKALLELERFAEKWDNQYPQITKSCRAK

SEQ ID NO: 24233 - DNA, 339 bp, Unknown
  Obtained from environmental sample
  misc_feature (1)..(339): n is a, c, g, or t
atgagagaaatctatattacagaagaatgtttggaatttatcgacaaacagaatgatagagtttcgctgaaattcttccaactaattgaagttattggagaaattaagattgtaaactcaaactttctaaaaaaacttcaatctacacaattttatgaattgaggtttaaagctggaaatgaatatcgaattgtactctttgctatcgaccatctgaattttgctgaatgtacgaaagcagtttgtttatgtgggtttcagaaaaaaggaactaaagattataagaaagcaattaaacaagcagaaaaaatattagaagaatatctaaaagaagaataa

SEQ ID NO: 24234 - protein, 112 aa, Unknown
  Obtained from environmental sample
  misc_feature (1)..(112): Xaa is any amino acid
MREIYITEECLEFIDKQNDRVSLKFFQLIEVIGEIKIVNSNFLKKLQSTQFYELRFKAGNEYRIVLFAIDHLNFAECTKAVCLCGFQKKGTKDYKKAIKQAEKILEEYLKEE

SEQ ID NO: 24235 - DNA, 483 bp, Unknown; identical to SEQ ID NO: 22847
  Obtained from environmental sample
  misc_feature (1)..(483): n is a, c, g, or t

SEQ ID NO: 24236 - protein, 160 aa, Unknown; identical to SEQ ID NO: 22848
  Obtained from environmental sample
  DOMAIN (71)...(156): 6-O-methylguanine DNA methyltransferase, DNA binding domain
  misc_feature (1)..(160): Xaa is any amino acid

SEQ ID NO: 24237 - DNA, 591 bp, Unknown
  Obtained from environmental sample
  misc_feature (1)..(591): n is a, c, g, or t
ttgggccccataaattttgttctgttgaaaaatgtaattcttcttgtttctttgttaatgttatcattttgcatgtatagtcaaaaatcaacggctaaaagtataatgattaatggcaaagtaattgattccataactcaacaacctattgaatttgcaacgatttcttttagaaataatgaagatattgtaggtacaacttcagacaaaagcgggaaatttaatattaaattagccacaggaatttacaccattaacattcaatttctttcctatacgcctcaacaatttttcaataaagaacttaaaagtgatacgtccttgggtgatattcagctatcgctgcatactgaaaatttggaagaagtaaatattattgcaaaaacaaatttagtcgaatttaaaattgacaaaaaaatatataatgcctccaaagacattgctaataaagggggtactgccatggatgtattaaataatgctccttccgtaagagttgatcaagagggtaatgttatcatgaggggctctaatgcatcagttttgattgatggtaaacctttgtttggcttaatactcagccgaatctga

SEQ ID NO: 24238 - protein, 196 aa, Unknown
  Obtained from environmental sample
  misc_feature (1)..(196): Xaa is any amino acid
MGPINFVLLKNVILLVSLLMLSFCMYSQKSTAKSIMINGKVIDSITQQPIEFATISFRNNEDIVGTTSDKSGKFNIKLATGIYTINIQFLSYTPQQFFNKELKSDTSLGDIQLSLHTENLEEVNIIAKTNLVEFKIDKKIYNASKDIANKGGTAMDVLNNAPSVRVDQEGNVIMRGSNASVLIDGKPLFGLILSRI

SEQ ID NO: 24239 - DNA, 669 bp, Unknown
  Obtained from environmental sample
  misc_feature (1)..(669): n is a, c, g, or t
gtgactcctgaggctgttttttttatgaaattagcacataaggaatttgaaaaaatacttgataaagactatttaaaaggcataacggttcatgaagcagtagattttaatgaaatttctaagggtattcttgaaacctgtaaaaatcatgatgtcgatttaattgtcatgggatctcatggtgcagaaggacttaaagaactttttattggatctaccacagaaaaagttgttagaacctccaacacacctgttctggttattaaaaacgaacatgacaattttgatataaaagaatttgtgtttgcttcagattttaaaaatgacaacaaagaaacttatgtacaagcggtaaaactagctaacctttttgaggctaaaatccacttacttaatgttaatacaccaagtaactttaccacaacagcagcctccaaagttagaatgagagattttatagccaattcaacttttgataattacacgataaacatttataacgacgaaacaattgaaaaaggtatattaaatttttctagaataatagatgccgatttaataggaattagcacacatggacgacaaggtattgctcactttttaaacggtagcatcagcgaagatttagtcaatcatgcaaaacgaccagtcattacttttaagatataa

SEQ ID NO: 24240 - protein, 222 aa, Unknown
  Obtained from environmental sample
  DOMAIN (96)...(221): Universal stress protein family
  misc_feature (1)..(222): Xaa is any amino acid
MTPEAVFFMKLAHKEFEKILDKDYLKGITVHEAVDFNEISKGILETCKNHDVDLIVMGSHGAEGLKELFIGSTTEKVVRTSNTPVLVIKNEHDNFDIKEFVFASDFKNDNKETYVQAVKLANLFEAKIHLLNVNTPSNFTTTAASKVRMRDFIANSTFDNYTINIYNDETIEKGILNFSRIIDADLIGISTHGRQGIAHFLNGSISEDLVNHAKRPVITFKI

SEQ ID NO: 24241 - DNA, 876 bp, Unknown
  Obtained from environmental sample
  misc_feature (1)..(876): n is a, c, g, or t
gtgagtgttgacgatataaaaaagttgaataaggatttatattcccgtggcttgaataaaggcgagcgattattgattcctgcagcttccaaaaacaccgaaataattggctcaaacactggaaaccctttaccgggaactcaaaaatatacggtagcggcaaaagaaacaaagtttggaatcgctagaaaatttggagtttccattgctgaattggaagatttaaacccagctatgggcgaaagtcttaatataggtgaaacacttattgttcccgataaaacagtaatcgaaaatgctgagattgatgaagaaaactttcagtattacgaagtaaaacccaaggaaggtttttatagattgaaagtaaaattcggtctttctgaagaagaagtcatcgctttgaatccgtatacaaaagaggggctgaaggaagggatgattttaaaaatcccgaaagaagatacctttatttcaaacgaagatatttcaatcgtcaatttagaaaatagaattgacaacaaaaagatgaaaaaggtagccttgatgcttccattccgtttaacgagaagcgcaagcgattcaacaagtaacgacaacgatttgctaaaaaaagacccaacacttcgcgtggctttggatttttacagcggtgcgctgatggctgctgaatttgcaaaggataaaggaatttcggtaacactgaacgtttatgacaccgaaaatagtgaaagcaaagttgcttccatagtatcaaaaagcgaattcaaaaacgtggatgccgttattggtcccttacttcaaaaaaatgttgaaaaagcttcctatatattgaaagacgaaaaaaatcccagttttttcgcctttgagcaatag

SEQ ID NO: 24242 - protein, 291 aa, Unknown
  Obtained from environmental sample
  DOMAIN (50)...(92): LysM domain
  misc_feature (1)..(291): Xaa is any amino acid
MSVDDIKKLNKDLYSRGLNKGERLLIPAASKNTEIIGSNTGNPLPGTQKYTVAAKETKFGIARKFGVSIAELEDLNPAMGESLNIGETLIVPDKTVIENAEIDEENFQYYEVKPKEGFYRLKVKFGLSEEEVIALNPYTKEGLKEGMILKIPKEDTFISNEDISIVNLENRIDNKKMKKVALMLPFRLTRSASDSTSNDNDLLKKDPTLRVALDFYSGALMAAEFAKDKGISVTLNVYDTENSESKVASIVSKSEFKNVDAVIGPLLQKNVEKASYILKDEKNPSFFAFEQ

SEQ ID NO: 24243 - DNA, 579 bp, Unknown
  Obtained from environmental sample
  misc_feature (1)..(579): n is a, c, g, or t
atgaaagtattaacattaaatactgaaacttttgaaaaagagagtctcaaattaatttctaaacttgaagttaatccagatttagttgttggtatattgtcaggaggaggtcatgtgttggaagctatcaaacagcatcccaatgtaaaaagtagtttatttgaagtagtaaccttacaaagacaatctacaaatgttaaacagcgctttttaaaacctgttttatccatattaccatattctatcttaaattggcttcgtattttagagtctaatagtgtgaaagctaaaatttctaatttagatttagaaaaattacaagataatattatagcatttgatacagtaaatacaatagcaaaacccataaaaaacatgcttattatagatgatgctattgatagtggaaaaaccatgtttgttgttaaaaataatttgcagcaaaagtttcctaaagcaaaaataaaaattgcagtattagcttggacaattgatagttcaataataaaaccagattattatttgtataataacacattattaagatttccttggtccaatgattataaacgaaaataa

SEQ ID NO: 24244 - protein, 192 aa, Unknown
  Obtained from environmental sample
  misc_feature (1)..(192): Xaa is any amino acid
MKVLTLNTETFEKESLKLISKLEVNPDLVVGILSGGGHVLEAIKQHPNVKSSLFEVVTLQRQSTNVKQRFLKPVLSILPYSILNWLRILESNSVKAKISNLDLEKLQDNIIAFDTVNTIAKPIKNMLIIDDAIDSGKTMFVVKNNLQQKFPKAKIKIAVLAWTIDSSIIKPDYYLYNNTLLRFPWSNDYKRK

SEQ ID NO: 24245 - DNA, 672 bp, Unknown
  Obtained from environmental sample
  misc_feature (1)..(672): n is a, c, g, or t
ttgtgtagttttgcgtgcttaacaacaacacaacaaatgagcacttcaaaaacaattaaatctgccttaatttcggtatttcacaaagatggtttagcaccaattgtacaaaaactaaatgaattaaatgttactatttattctactggtggtacagaaaaattcattaaagaattaggtattgatgtggttcctgtagaagatgttacttcttacccatctattttaggaggaagagtaaaaactttacatccaaaagtttttggaggaattttaaacagacaagatcatgaaggtgatgttgctgaaatgaaagaatacaacattccacaattagatttggtaattgtagatttatatccgtttgaaaaaacagttgcttctggagcacctgagcaagatattgttgagaaaattgatattggaggaatttctttaattagagcatcagcaaaaaactttaaagacacatttacggtttcttctatggaacagtatgatgagtttttatcgattttatcagaaaataatggtgaaacttctattgagcaaagaaagaaatttgctgcaaaatcttttaatgtttcttctcattatgatactgccatctttaattattttaatgaagatgaagttgtttttaaagcaagtgaaactacttctaaagtttaa

SEQ ID NO: 24246 - protein, 223 aa, Unknown
  Obtained from environmental sample
  DOMAIN (31)...(145): MGS-like domain
  misc_feature (1)..(223): Xaa is any amino acid
MCSFACLTTTQQMSTSKTIKSALISVFHKDGLAPIVQKLNELNVTIYSTGGTEKFIKELGIDVVPVEDVTSYPSILGGRVKTLHPKVFGGILNRQDHEGDVAEMKEYNIPQLDLVIVDLYPFEKTVASGAPEQDIVEKIDIGGISLIRASAKNFKDTFTVSSMEQYDEFLSILSENNGETSIEQRKKFAAKSFNVSSHYDTAIFNYFNEDEVVFKASETTSKV

SEQ ID NO: 24247 - DNA, 942 bp, Unknown
  Obtained from environmental sample
  misc_feature (1)..(942): n is a, c, g, or t
ttggattctaagggcgttgatggtattgaaaaagactatcaacattttgaaccaccgtttttgttagccttagacgaggtatataacaaaattcgcaatctcaattaccgctacatgcctgctggtacgctgtttcctgaagaggtgcagcagtatgatccctatatcatccgtgaagcattaagtaatgctattggtcatcaagactatcgtctgggcggacgtattactgtagttgaaaaagaagactcaacactgatttttcaaaacagtggggagtttattcctaagactatcgagaacgtcttgctacaagatgcgcctgaagcgagctatcgtaatccatttttggttaacgccatggtcagtctaaacatgatggacaccatcggtagcggtatcaaaaaaatgtatcagattcagtctaagcgttttttcccattgccagattatgacttaacccgtgaaagagtaggcgtgaagtttacaggtaaagtgcttgatcaagagtacgccaagcagttagcaagcgtagataatctcacactacacgatattatagcgcttgataaagtgcaaaaggggcaggcgatcactgaaaacgaagctgatacgctacgtaaaaagtcattgatagaagggcgcaaaaatagctatattatcgccgctgatgttgccaagcatactgagcagcaggcggagtatatgcagatgcgcggcttagatgacatgcattatcaaagcttgattatagggtacctcaagacgtttgaacgaggtagactagctgactttgataagatgctggctaataagttgcccacagtactagatgataagcagcgtaaaaataaggtgcgtaatctattgcagaagatgcgccgtgatggtttagtcgtttctgaaggttggtcttggcatcttccaaatagcttagaatag

SEQ ID NO: 24248 - protein, 313 aa, Unknown
  Obtained from environmental sample
  misc_feature (1)..(313): Xaa is any amino acid
MDSKGVDGIEKDYQHFEPPFLLALDEVYNKIRNLNYRYMPAGTLFPEEVQQYDPYIIREALSNAIGHQDYRLGGRITVVEKEDSTLIFQNSGEFIPKTIENVLLQDAPEASYRNPFLVNAMVSLNMMDTIGSGIKKMYQIQSKRFFPLPDYDLTRERVGVKFTGKVLDQEYAKQLASVDNLTLHDIIALDKVQKGQAITENEADTLRKKSLIEGRKNSYIIAADVAKHTEQQAEYMQMRGLDDMHYQSLIIGYLKTFERGRLADFDKMLANKLPTVLDDKQRKNKVRNLLQKMRRDGLVVSEGWSWHLPNSLE

SEQ ID NO: 24249 - DNA, 321 bp, Unknown
  Obtained from environmental sample
  misc_feature (1)..(321): n is a, c, g, or t
ttgtcgccaaaactaggtccaattgccaattggggattagaaatcgagaaaaatgccatcaaagtaaacaacgctttagattaccaaaccaatattccaggaatttacgcaattggcgatgtcaatacatatccaggaaaattaaaactgattctttgtggttttcacgaagcaactttaatgtgccaaagtgcgtatcanagaatttttccagacaaaaaatacataatgaaatataccacagttggtggtgtagaaggttttgatggcacaaaaaaagaaccacccaaagcagtttgtaagggctattcagtaaattag

SEQ ID NO: 24250 - protein, 106 aa, Unknown
  Obtained from environmental sample
  misc_feature (1)..(106): Xaa is any amino acid
MSPKLGPIANWGLEIEKNAIKVNNALDYQTNIPGIYAIGDVNTYPGKLKLILCGFHEATLMCQSAYXRIFPDKKYIMKYTTVGGVEGFDGTKKEPPKAVCKGYSVN

SEQ ID NO: 24251 - DNA, 663 bp, Unknown
  Obtained from environmental sample
  misc_feature (1)..(663): n is a, c, g, or t
ttgcccttacccaaggttaccaacgcggaaatgggttccggactgatttgcgaccctaataaaattgatactatttnagatcgtgcgcacagtgaaacagatattttagtctcaatgaaaatgagaatgggctacgagaatcctgaagaaattttacacacgtttcctattttagaaaaatatcctattaaaaatattgctattcacgctcgcattggaaaacagctttataaaggtggtgtaaatttggatgcatttcaaaaatgtgtggaaacctctaaacaaaaactgtattataacggcgatattacaacagttgatggctttaaagcaatgcaagaacagtttccatctatcgatcattttatgattggtcgcggtttaattgccgatccgtttttgccgagtatgattaaaaataacacgacagaatatcctaaaaaccgctggtttatttttaaagagtttcacgatgaaatttatcaccaatacgatgcaacactttcgggtcctacacctataaaaatgaaaatgttaggcttttgggaatacttttctcagtcatttactaatccgcagaaaacctataagaaaatcaaaaaagcatcaaatcctgcaaaatatcaagcggcggttgctgaaattctgtcttcagaaaaataa

SEQ ID NO: 24252 - protein, 220 aa, Unknown
  Obtained from environmental sample
  misc_feature (1)..(220): Xaa is any amino acid
MPLPKVTNAEMGSGLICDPNKIDTIXDRAHSETDILVSMKMRMGYENPEEILHTFPILEKYPIKNIAIHARIGKQLYKGGVNLDAFQKCVETSKQKLYYNGDITTVDGFKAMQEQFPSIDHFMIGRGLIADPFLPSMIKNNTTEYPKNRWFIFKEFHDEIYHQYDATLSGPTPIKMKMLGFWEYFSQSFTNPQKTYKKIKKASNPAKYQAAVAEILSSEK

SEQ ID NO: 24253 - DNA, 381 bp, Unknown
  Obtained from environmental sample
  misc_feature (1)..(381): n is a, c, g, or t
atgttattaaaaattatgaaaaacatttcctatagttctaatatagtcttagaaaacacatttaggtccatcgagttggatgttgtgcaagatgctgaccgtttggatgctttaggagctattggtattgcgcgcacttttaattatggaggctttaaaaacaggactttatataatccagacattaagcctaatttaaatatgactaaagccgaatataaaacatctaacgctccaacaattaatcatttttacgaaaaattactgcttttaaaagataaaatgaataccactactggttataaaattgctaaacaacgacaccaatatatggtagactttttaaaacaatttgatgctgaatgggaaggtgagaaataa

SEQ ID NO: 24254 - protein, 126 aa, Unknown
  Obtained from environmental sample
  misc_feature (1)..(126): Xaa is any amino acid
MLLKIMKNISYSSNIVLENTFRSIELDVVQDADRLDALGAIGIARTFNYGGFKNRTLYNPDIKPNLNMTKAEYKTSNAPTINHFYEKLLLLKDKMNTTTGYKIAKQRHQYMVDFLKQFDAEWEGEK

SEQ ID NO: 24255 - DNA, 636 bp, Unknown
  Obtained from environmental sample
  misc_feature (1)..(636): n is a, c, g, or t
atgcttaaatggatttttaaactgtttacaaacaataaatcctcaaattttattgaagaattagatcccatgaaaaaatttttaatcgtaggcttaggtaatattggtgaaaagtatgagaatacacgccataatataggctttaaaatattagactttttagctacaaaggaggacattacatttgaaactcaaaaattaggagatgttgcaacctttagatataaaggccgaacatttattttactaaaaccaagtacctatatgaatttaagtggtaagtctgtattatattggttaactaaagaaaaaattcctttagataatttacttgttattacagatgacttaaacctaccgtttggaagtctcaggattaaaactaaaggtagtgatggaggacataatggactaaaagacattcaagaaaaattaaacacctcaaaatataatcgttttagatttggtataagcgatgcttttagcaaaggaagacaggttgattatgtattaggcgaatgggaagatgatgaaaacaaaaaacttccggaacgctatgaaaaaagtgcagaaatagtaaaatcttttggtactgctggaatcaataatacaatgaataattttaatggaaaataa

SEQ ID NO: 24256 - protein, 211 aa, Unknown
  Obtained from environmental sample
  DOMAIN (28)...(209): Peptidyl-tRNA hydrolase
  misc_feature (1)..(211): Xaa is any amino acid
MLKWIFKLFTNNKSSNFIEELDPMKKFLIVGLGNIGEKYENTRHNIGFKILDFLATKEDITFETQKLGDVATFRYKGRTFILLKPSTYMNLSGKSVLYWLTKEKIPLDNLLVITDDLNLPFGSLRIKTKGSDGGHNGLKDIQEKLNTSKYNRFRFGISDAFSKGRQVDYVLGEWEDDENKKLPERYEKSAEIVKSFGTAGINNTMNNFNGK

SEQ ID NO: 24257 - DNA, 789 bp, Unknown
  Obtained from environmental sample
  misc_feature (1)..(789): n is a, c, g, or t
atgactatactagataaaataatcgcatttaaaaagaaggaaattgctaagattaaagcagaagttcctgttcagaagttagtacaaagtccgaagtttaacagatctacaatttctttaaaaaagtcattgttagaagttggttcaacaggaattattgctgagtataaacgtcaatctccatcaaaaggaattattaacgacaaagctacaattgctgatgttactaatggatatttagatgcaaacgttgcagcacaatcaatattaactgatacttctttttttggaggaactatggcagatttgatggaggctagagttatcaaccaaataaaaccaattttaagaaaagattttatagttgatggattccaaattgtagaagcaaaagcaattggtgcagatgttattttgttaattgcttcttgtttaacatcaacagaacttaaaaactacggaaatttagctatagatttaggtttagaagttttgtatgaagtgcatacgcaagaagatttagataaaattaataatttggataacaaaataatcggaatcaataatagaaatttaaagacttttgaagttgatttagaacattctattaagttatctagtcaaattcctgatacaagtttaaaggtttcagaaagcggaatttctgacccaagaattattacaggattaaaagaatatggttttcaaggttttttaattggagaaaactttatgaaagaagaaaatcctggagaagcgtgtaaggaatttattagtcaattgagataa

SEQ ID NO: 24258 - protein, 262 aa, Unknown
  Obtained from environmental sample
  DOMAIN (3)...(257): Indole-3-glycerol phosphate synthase
  misc_feature (1)..(262): Xaa is any amino acid
MTILDKIIAFKKKEIAKIKAEVPVQKLVQSPKFNRSTISLKKSLLEVGSTGIIAEYKRQSPSKGIINDKATIADVTNGYLDANVAAQSILTDTSFFGGTMADLMEARVINQIKPILRKDFIVDGFQIVEAKAIGADVILLIASCLTSTELKNYGNLAIDLGLEVLYEVHTQEDLDKINNLDNKIIGINNRNLKTFEVDLEHSIKLSSQIPDTSLKVSESGISDPRIITGLKEYGFQGFLIGENFMKEENPGEACKEFISQLR

SEQ ID NO: 24259 - DNA, 558 bp, Unknown
  Obtained from environmental sample
  misc_feature (1)..(558): n is a, c, g, or t
gtgtctttaagctttagaatggaaaaagataaaaccatctggatgagttatttagggattgctaaagtacttattacgccagtaagagttgccttttataacaaatgggataatacttattttgatggcgattttacttatttaagtaacctattaggtacagatttggattttaataaggtgcaaaatatgctattaggtcaatcgctttttgacttaaacgatgataaatataacctatctgcaaacgataaatcgtatatactacaacctaaaaagcaacgcgagttgatcaagttgtttttatttgtaaacccgccgcattttaaaatggacgctcaagaaatctctcaacctaatgataagcgcatattacatattgattatttagcttatcaaaaaatagacgacaaaaccttaccagaactaaccaaaatactagcaatagaagatgaagagcaattagagattaatctagagcttaagtctgtaaaattaaatgaagacgtacgttttccttttactataccttctggctataaaaaaatagagttgtaa

SEQ ID NO: 24260 - protein, 185 aa, Unknown
  Obtained from environmental sample
  misc_feature (1)..(185): Xaa is any amino acid
MSLSFRMEKDKTIWMSYLGIAKVLITPVRVAFYNKWDNTYFDGDFTYLSNLLGTDLDFNKVQNMLLGQSLFDLNDDKYNLSANDKSYILQPKKQRELIKLFLFVNPPHFKMDAQEISQPNDKRILHIDYLAYQKIDDKTLPELTKILAIEDEEQLEINLELKSVKLNEDVRFPFTIPSGYKKIEL

SEQ ID NO: 24261 - DNA, 630 bp, Unknown
  Obtained from environmental sample
  misc_feature (1)..(630): n is a, c, g, or t
gtggaatattcgcttggaaagtttgatggtaaaagcgtgttatacgattttgataaaatcctgatttatttggatgcaaagggaaagttgctctttggcaaacaatttagaatctatgatgaggacacggttatcatccgcaaactatgtcactatttcatcaaggacaaagaaaattgcctgaaagatgatatcgacactaacaagggtattcttctatccgggcctgtgggatgtggaaagaccactttgatgaaactattgcgatatatcgtgccaatgcaacgaccttatgaaatgattccgtgcaggaatgttgcttttagctttaaccatctaggctttaaaaccattgaggattatggcagcaccaaattctactgctttgatgatttaggcattgaacctgcaggacgattctatggtaaagatttgaatgtgatgggcgaagtattactttcccgatacgaactttaccttgagaccaaacacaaagtcaaaacccacgctactacaaacctaaatgctgaagaactggaagaacggtatggaaaccgtgttcgtagtagaatgcgcgaactgtttaatttgattgcttttgatacaaaagctggggataagcggaagtaa

SEQ ID NO: 24262 - protein, 209 aa, Unknown
  Obtained from environmental sample
  misc_feature (1)..(209): Xaa is any amino acid
MEYSLGKFDGKSVLYDFDKILIYLDAKGKLLFGKQFRIYDEDTVIIRKLCHYFIKDKENCLKDDIDTNKGILLSGPVGCGKTTLMKLLRYIVPMQRPYEMIPCRNVAFSFNHLGFKTIEDYGSTKFYCFDDLGIEPAGRFYGKDLNVMGEVLLSRYELYLETKHKVKTHATTNLNAEELEERYGNRVRSRMRELFNLIAFDTKAGDKRK

SEQ ID NO: 24263 - DNA, 897 bp, Unknown
  Obtained from environmental sample
  misc_feature (1)..(897): n is a, c, g, or t
gtgccagtaatttgtatggcacaatggcttcgtcaacaaattatagatacggtcaaaaaggcttcttatcgaaaacagtttgtcgttggaaatattccaaccttggcgcacaacaagccttttgtgtctggtgttaaaaaaaacttagttataatacttgaggaaagtttaggtgcccgatttgttggagaacttggtgggttagatattacgcccgaacttgataagctatatcaacaagggtgggggtttgacaacctttatgctacgggcacgcgctccgtaagaggtattgaagcaattactacaggttttacaccatcaccatctcgctcagtagttaaactatctaaatcgcagcataactttttttcactagcggatgtattcagtcaagaaggttacaaaacacagtttatctacggcggtgaaagccattttgacaatatgaaaagcttttttctaggaaacgggtttaacgatattgttgacatcaaccatattgataatccccaatttatctcctcttggggggtaagtgatgaggacttattcaatcaagcagataaagaactgactaaattaagtaattcgacagagccattttttagtcttgtatttacttctagtaatcacgatccgtttgatataccacaaggcaaagtatcgctacccaaaggacataaccctgaaaactataagcgtgatcttgcaattaagtatgccgattacgcactaggtaaatttataaataaagcaaaaacacggtcgtactgggaaaacaccgtatttttggttgtagcagaccatgatgtgcgtgtttttggctctgaacctgtccctttgaagtcttttcatataccagctgttattttaaacagcgatatgaaaaagtaa

SEQ ID NO: 24264 - protein, 298 aa, Unknown
  Obtained from environmental sample
  DOMAIN (45)...(298): Sulfatase
  misc_feature (1)..(298): Xaa is any amino acid
MPVICMAQWLRQQIIDTVKKASYRKQFVVGNIPTLAHNKPFVSGVKKNLVIILEESLGARFVGELGGLDITPELDKLYQQGWGFDNLYATGTRSVRGIEAITTGFTPSPSRSVVKLSKSQHNFFSLADVFSQEGYKTQFIYGGESHFDNMKSFFLGNGFNDIVDINHIDNPQFISSWGVSDEDLFNQADKELTKLSNSTEPFFSLVFTSSNHDPFDIPQGKVSLPKGHNPENYKRDLAIKYADYALGKFINKAKTRSYWENTVFLVVADHDVRVFGSEPVPLKSFHIPAVILNSDMKK

SEQ ID NO: 24265 - DNA, 606 bp, Unknown
  Obtained from environmental sample
  misc_feature (1)..(606): n is a, c, g, or t
atgaaaaattgtctgttttacctttgtcgacgattatatgaaacaacaacaatcttgatattcgaaagaagaatgttggttaaaatagaacagacattagatagtaaagaaaagattgattccaaagaacttaatgttgaaactagtttaatggagaactctgaagataattctaaagaaattcatataaccaaagatgaagatatttttgaaccaaaattcgattccgttagaatagatattaaaagtttaaagtcaaatcagattagtttaaaagaagaattcagagattctatttcagctgataaaacatctacccttttcgatgataccgaaaaaaaaggtcatgataagaaaaccttaaatgataggcttgtaaaaaacactattcaagttgggctgaatgatagaattgcttttgtaaatcacttatttaattttaaccaacaagattttaatagagtgttgtcgcaacttaatacgtttaagactgaatacgaggctaaagattttataaataacaaggttaaacccgattatgattggactggaaaagaagagtaccaagaaagattaattacattaattgaaagaaaatttacataa

SEQ ID NO: 24266 - protein, 201 aa, Unknown
  Obtained from environmental sample
  misc_feature (1)..(201): Xaa is any amino acid
MKNCLFYLCRRLYETTTILIFERRMLVKIEQTLDSKEKIDSKELNVETSLMENSEDNSKEIHITKDEDIFEPKFDSVRIDIKSLKSNQISLKEEFRDSISADKTSTLFDDTEKKGHDKKTLNDRLVKNTIQVGLNDRIAFVNHLFNFNQQDFNRVLSQLNTFKTEYEAKDFINNKVKPDYDWTGKEEYQERLITLIERKFT

SEQ ID NO: 24267 - DNA, 708 bp, Unknown
  Obtained from environmental sample
  misc_feature (1)..(708): n is a, c, g, or t
atgaaacaacttttagccttagcattattagtcttgttttgcgcttgtaaaagcacaaaacaaactgtacaaaatactcaaatagcaactaatacaattaaaaaagaagctatagctgaaattaaaatggatactatcaacaaaacaaatgatagtagttacataattaaaaaagcaaaatacttaataactgaagatgtaaaaattgctgaatatgatcttgttgataaacgacaaaaatttatatcaaacaaaaaagattcaattcctaaaaataacgaattcaatcagattcttacgaaaacagagcattctaacattcattttttatggaatgaattattacaaaaacatgtttcagctaacggaaatgtaaattataaatcatttaaaacagattataaaaaattactagaatacataaatattctcgcgatattaaagtctaaacctgaatttgattctatttcaaaagaagaaaaactagccttttggatcaacgcttataatgctttaacaatagatttaattataaaaaactatcctgtaaaaagcataaaagacattaaagacccttgngaacaacgcttatggcaatttggtgacaaatggtataatcttgaagatatagagcataaaatactacgtaaaatggacgaaccacgcatacattttgctattgtttgcgcctcttactcttgcccctaa

SEQ ID NO: 24268 - protein, 235 aa, Unknown
  Obtained from environmental sample
  SIGNAL (1)...(20)
  DOMAIN (136)...(235): Protein of unknown function, DUF547
  misc_feature (1)..(235): Xaa is any amino acid
MKQLLALALLVLFCACKSTKQTVQNTQIATNTIKKEAIAEIKMDTINKTNDSSYIIKKAKYLITEDVKIAEYDLVDKRQKFISNKKDSIPKNNEFNQILTKTEHSNIHFLWNELLQKHVSANGNVNYKSFKTDYKKLLEYINILAILKSKPEFDSISKEEKLAFWINAYNALTIDLIIKNYPVKSIKDIKDPXEQRLWQFGDKWYNLEDIEHKILRKMDEPRIHFAIVCASYSCP

SEQ ID NO: 24269 - DNA, 498 bp, Unknown
  Obtained from environmental sample
  misc_feature (1)..(498): n is a, c, g, or t
atgaagaataaaatttttatgtatttgtttattttcacactgttaatattattatttcagtatatgacgtctaaacaaatttttgacgacagtaataaaacagtcgcaagttataaagcacaaaccgcaaagtataaagattctattgtaacattaaataacaaaattactgacttatctctttttgatattgaaaggaacgatcctgctttatcttattttgaagatagcggttataatatttctaaattattaccattaattaaagatggtttataccaacaaaacgaaactaaaggacagcatccattaattccttacgcctctagtgaagggaatagaatgcagataaattctattagaattttaaatcacaaatggattatttgcaacttcaccgatggtgagttttcaggagaattatttataaaatattttatagacgataatagtcagcttgaatatgtggttgaagattcgtttttgtatcgtatgtaa

SEQ ID NO: 24270 - protein, 165 aa, Unknown
  Obtained from environmental sample
  misc_feature (1)..(165): Xaa is any amino acid
MKNKIFMYLFIFTLLILLFQYMTSKQIFDDSNKTVASYKAQTAKYKDSIVTLNNKITDLSLFDIERNDPALSYFEDSGYNISKLLPLIKDGLYQQNETKGQHPLIPYASSEGNRMQINSIRILNHKWIICNFTDGEFSGELFIKYFIDDNSQLEYVVEDSFLYRM

SEQ ID NO: 24271 - DNA, 960 bp, Unknown
  Obtained from environmental sample
  misc_feature (1)..(960): n is a, c, g, or t
atggatcagattcggctgagaatagactctcccctactttctattggaacacaaaaaaaagaatacactccaagagaagtaataaacattaatattgacattgatgaaagaattaaaaatggaaactatagcttgtcaataagaaaattagattccattgaagctataaatcctaataacaataattatagctctgaaaacaagacagacaccttttacattccagaaatgagaggcgaattaattagtggtaaaataactaatattacaaatacatccgatattgtagataagcatattgcgctttctatatctggaaaaaaacctatatttaaaatagcaacaacaaataataatggtcagtttttctttaacctaaatgagaattatgataatcctaatgctttatttcaggtaatagaatctaataacgaagactttaaaatgaaattggattctatagtatctattaattatgattcgcttcatttttccgatttacaaatagattccaaattaaaaaaaactattcaagatcgtaatattcaaaatcaaatagaaaatgcgtattacgaaaaaaaacaagatagtgttctaccttccttagatagcgaattattttatggtaatttggctataaaatacgaattagacgattatacacgatttaaaacggttagagaaaccttcattgaagttatacagcaagcgggtttaagaagcgacaacgataactatagatttgtagtttatgatgatgtttctaataatgatttaatatcatcagacttacaacctttagttttagtggatggtattattgtacaaaataataatgatgttgttttttataaccctaaaaaaataaaatctatagcagttgtgcaaggtcaatacatttatggctcaaaactttttcagggtattatagatattaaaaccctttcttcaagattttaa

SEQ ID NO: 24272 - protein, 319 aa, Unknown
  Obtained from environmental sample
  misc_feature (1)..(319): Xaa is any amino acid
MDQIRLRIDSPLLSIGTQKKEYTPREVININIDIDERIKNGNYSLSIRKLDSIEAINPNNNNYSSENKTDTFYIPEMRGELISGKITNITNTSDIVDKHIALSISGKKPIFKIATTNNNGQFFFNLNENYDNPNALFQVIESNNEDFKMKLDSIVSINYDSLHFSDLQIDSKLKKTIQDRNIQNQIENAYYEKKQDSVLPSLDSELFYGNLAIKYELDDYTRFKTVRETFIEVIQQAGLRSDNDNYRFVVYDDVSNNDLISSDLQPLVLVDGIIVQNNNDVVFYNPKKIKSIAVVQGQYIYGSKLFQGIIDIKTLSSRF

SEQ ID NO: 24273 - DNA, 948 bp, Unknown
  Obtained from environmental sample
  misc_feature (1)..(948): n is a, c, g, or t
ttggctgagcacagaatggtaacancaatggaataccaaagtattacctcatgcatttcgcctttaggaaatgcacatggcaagcacattgttaccgttgaaggcacaaatcttaaagacaaattaaccactgcccaagaggccatgaaagcaaattacgccacgcaatgcggattttgcacacctggttttgtagtggccttaacaggatttgcattatcaaattcggataaaaattatactaatgcaattgacgctataagcggaaacatttgcaggtgcacaggatacaaagcaattgaaaaagcagcgcatcaagttgtcaagaaactagacaataacacaaatacgacgtttgattggttaattgaaaaccaatttattcctgaatattttaaaagcatcccacaacgtttaaatgacattgaagctaaagatttaaatcaacccaaagggaaatttgtttctggaggtacggatttatatgtccaaaaagcggattatttagcagacaacgctgtacatctaatagccgaaaaggagtatttaaaaggaattactattgaaaatggtatttgcacgattggaaccaacgcaacggtttcagatttatggaatcatacggaattaaatagtattttaccaaacttaagaaaccacttaaagttagtctcttcagaacaaattagaaacatggcttcgcttggagggaatttagtaaacgcctcgcctattggagacatgactatcttttttctctcgcttgatagtaatattacaatattaaattccgaagaaaaagaaagaaccattgcactcaaaaacttttacaaagggtacaaaacttacgatttaaaagacgacgaacttttaaagcgcattcaatttaaattacaacagaacagtcatttttcaatttttgaaaagtgtgtaaacggacacatttag

SEQ ID NO: 24274 - protein, 315 aa, Unknown
  Obtained from environmental sample
  DOMAIN (129)...(299): FAD binding domain in molybdopterin dehydrogenase
  misc_feature (1)..(315): Xaa is any amino acid
MAEHRMVTXMEYQSITSCISPLGNAHGKHIVTVEGTNLKDKLTTAQEAMKANYATQCGFCTPGFVVALTGFALSNSDKNYTNAIDAISGNICRCTGYKAIEKAAHQVVKKLDNNTNTTFDWLIENQFIPEYFKSIPQRLNDIEAKDLNQPKGKFVSGGTDLYVQKADYLADNAVHLIAEKEYLKGITIENGICTIGTNATVSDLWNHTELNSILPNLRNHLKLVSSEQIRNMASLGGNLVNASPIGDMTIFFLSLDSNITILNSEEKERTIALKNFYKGYKTYDLKDDELLKRIQFKLQQNSHFSIFEKCVNGHI

SEQ ID NO: 24275 - DNA, 543 bp, Unknown
  Obtained from environmental sample
  misc_feature (1)..(543): n is a, c, g, or t
atgcaaactttcctaaatgatgttgttaaagaaatactatctcagactcacaatcttaccaaccatactttcatcttaccaagtaaaagggccggagtttttttaaaggagcagtttaaattatcaataacaacaacatctatactgccaaaaatcattagtattgaagagtttattgctgagttgtcatctataaatttgatagaaactaccacattactatttgaattttatcatatctataaagaaaatacgccttcgaaagaaatcgatagtttcgataaattttcatcctgggcaacaatattattgcaagattttaatgagattgacaggcatttaattgatgcggcttatatttttagttacttgaaggatattaaaagattagaagaattattaaacggcgagaagaaaactgaccttattaaaaatcgctttaatttttttgaaaaattagaaacttactataattccttttcgtgcacatttggtggaaaaaaaaactggatatcaagggtttacaatataggggaagcgtaa

SEQ ID NO: 24276 - protein, 180 aa, Unknown
  Obtained from environmental sample
  misc_feature (1)..(180): Xaa is any amino acid
MQTFLNDVVKEILSQTHNLTNHTFILPSKRAGVFLKEQFKLSITTTSILPKIISIEEFIAELSSINLIETTTLLFEFYHIYKENTPSKEIDSFDKFSSWATILLQDFNEIDRHLIDAAYIFSYLKDIKRLEELLNGEKKTDLIKNRFNFFEKLETYYNSFSCTFGGKKNWISRVYNIGEA

SEQ ID NO: 24277 - DNA, 582 bp, Unknown
  Obtained from environmental sample
  misc_feature (1)..(582): n is a, c, g, or t
atggcacagaaaccaagtataccaaaaggaacaagagattttaatccggagcaagttgctaaaagaaattatatttttagtactataaagtcgcagtttgaacgtttcggatttcaaccaatagaaactcctagttttgagaactcagatacattaatggggaaatatggtgaagaaggcgaccgactgattttcaaaatattgaattctggggattatttgtctaaagttgaagatactttatatcaaaaaaaggattccaatgcaacgacttcaaaaatctctgaaaaagcgttgcgttacgatttaacggttccttttgcgcgttatgtagtgcagcaccaaaacgagattgaatttccgtttaaacgttaccaaatgcaaccggtttggagagccgatcgtccgcaaaaagggcgttttagagaattctatcaatgtgatgccgatgtcgtgggaagtgattctttatttcaagaagttgaatttattcagttgtacgacaacgtgttttcagctttaaaattagaaggtgttactattaaaataaataaccgaaaaatacatcccgagccgatctga

SEQ ID NO: 24278 - protein, 193 aa, Unknown
  Obtained from environmental sample
  DOMAIN (10)...(178): tRNA synthetase class II core domain (G, H, P, S and T)
  misc_feature (1)..(193): Xaa is any amino acid
MAQKPSIPKGTRDFNPEQVAKRNYIFSTIKSQFERFGFQPIETPSFENSDTLMGKYGEEGDRLIFKILNSGDYLSKVEDTLYQKKDSNATTSKISEKALRYDLTVPFARYVVQHQNEIEFPFKRYQMQPVWRADRPQKGRFREFYQCDADVVGSDSLFQEVEFIQLYDNVFSALKLEGVTIKINNRKIHPEPI

SEQ ID NO: 24279 - DNA, 564 bp, Unknown
  Obtained from environmental sample
  misc_feature (1)..(564): n is a, c, g, or t
atgaaaaatttatcaaccctgcagatgtttcagcagaactcgtggacacccactcttctatatgtaaaaaagtatcacaccattgcagattttagcttgaccacccaaaacgggaagaccattacgcaggaagattacaaagacaanatatatgtggctgattttttcttcaccacctgccagaccatttgcccaataatgacggataatatggtagaaatacaagaaaaattgaaagatgacgatggggtcttcttgctctcgcatactgtaactccagaaattgactctgttgcccaacttaaaaaatacgctttggaaaaaggcgtgaacgatgaaaaatggaacttggtaacaggcgacaaaaaagaaatttacgacctggccagaaaatcctacctcgcggcgaaagatgttccatattctgacaatgacttggtacataccgaaaattttgtgctcgttgataaaaaaaagcgcattcggggtttttatgacggcaccgattcggagtctattgaaaaattattgacggatattaaaattttggaacaagaagattaa

SEQ ID NO: 24280 - protein, 187 aa, Unknown
  Obtained from environmental sample
  DOMAIN (1)...(168): SCO1/SenC
  misc_feature (1)..(187): Xaa is any amino acid
MKNLSTLQMFQQNSWTPTLLYVKKYHTIADFSLTTQNGKTITQEDYKDXIYVADFFFTTCQTICPIMTDNMVEIQEKLKDDDGVFLLSHTVTPEIDSVAQLKKYALEKGVNDEKWNLVTGDKKEIYDLARKSYLAAKDVPYSDNDLVHTENFVLVDKKKRIRGFYDGTDSESIEKLLTDIKILEQED

SEQ ID NO: 24281 - DNA, 765 bp, Unknown
  Obtained from environmental sample
  misc_feature (1)..(765): n is a, c, g, or t
atgttaatggtatgtcaccatttagataaaaacgtaaaagaagatgtatcatttgcagattcccgtattcgtccagaaactattgctgcagaagatattttacatgatttgggtgtgttctcaatgatgagttctgattctcaagcaatgggaagagttggtgaagttgtttcgcgtacttggcaaactgctgataagatgaagcaacaatttggagaattaaaagaagataaaggaacggataatgataactatagaataaaaagatatatttctaaatacactatcaacccagcgatttctcacggtatttctaaatatgtaggttccatagaagttggcaaaatggccgatttggtaatgtggagaccagatatgtttggtgctaaacctgagttaattattaaaggtggtatggtgctggcttctaaaatgggagatgccaatgcatctattcctacacctcagcccgtaatcaacaaaccaatgttcggttattatgggaaggcaatgaagaatacatctgcattgtttgtttctcaagtttctatagataaaggtatcactcctgggtatggtttaggaaagaaaatcttacctgttgtaaattgtagagacatcagtaaagctgatatggtccataaccatgaaactcctcaactggaggttaaccctcaaacctatgaggtaaaggttgatggtaaagcaattacttgtccgcctattgatgtagtgccaatggcacagagatatttcatgttctaa

SEQ ID NO: 24282 - protein, 254 aa, Unknown
  Obtained from environmental sample
  DOMAIN (1)...(123): Amidohydrolase family
  misc_feature (1)..(254): Xaa is any amino acid
MLMVCHHLDKNVKEDVSFADSRIRPETIAAEDILHDLGVFSMMSSDSQAMGRVGEVVSRTWQTADKMKQQFGELKEDKGTDNDNYRIKRYISKYTINPAISHGISKYVGSIEVGKMADLVMWRPDMFGAKPELIIKGGMVLASKMGDANASIPTPQPVINKPMFGYYGKAMKNTSALFVSQVSIDKGITPGYGLGKKILPVVNCRDISKADMVHNHETPQLEVNPQTYEVKVDGKAITCPPIDVVPMAQRYFMF

SEQ ID NO: 24283 - DNA, 831 bp, Unknown
  Obtained from environmental sample
  misc_feature (1)..(831): n is a, c, g, or t
gtgttatggaacactccattacagaagctaaaagctgccaaatcattaataagaaaagggtataaatctacgccattaaaaagggtattcatccccaagaagaatggaaagaaacgccttcttggtattcccacgatgtatgatagagctatgcaggcactgtatctgatggctctcaatcctgtttccgagactaaggcggatagctgttcatacggctttcgtcataaaagaagttgtgctgatgccattgcaaggtgttttattcacctagctagaaatagcagtgcaacttgggtattggaagcagacattaaaggatgctttgaccatattagccatagttggatgttagataacattcttatggataaaatgattcttaaacagtggcttaatgctggtttcattgataacaaacggttatttcctaccaaagaaggaactccacaaggtggtattatctctcctacccttgccaatatgacgcttgacggacttcaggccactatcaacaaggctttgaaaatcaagtcagataaaggtggtaggctaagcaataacaagcacaaaattcatttggtaaggtatgccgatgattttattgttactggagatagcaaagaagtactcactgataaagttctgccagttattgaaaaattcttgacagaaagaggacttcaactatcagaggagaaaacaggtattacccatatttataatgggttagacttcttaggacagcatattaggaaatacactaatagtactttactgataaaaccatcgaaagatagctgtaaatcagtaaaaactaaaattagttag

SEQ ID NO: 24284 - protein, 276 aa, Unknown
  Obtained from environmental sample
  DOMAIN (22)...(251): Reverse transcriptase (RNA-dependent DNA polymerase)
  misc_feature (1)..(276): Xaa is any amino acid
MLWNTPLQKLKAAKSLIRKGYKSTPLKRVFIPKKNGKKRLLGIPTMYDRAMQALYLMALNPVSETKADSCSYGFRHKRSCADAIARCFIHLARNSSATWVLEADIKGCFDHISHSWMLDNILMDKMILKQWLNAGFIDNKRLFPTKEGTPQGGIISPTLANMTLDGLQATINKALKIKSDKGGRLSNNKHKIHLVRYADDFIVTGDSKEVLTDKVLPVIEKFLTERGLQLSEEKTGITHIYNGLDFLGQHIRKYTNSTLLIKPSKDSCKSVKTKIS

SEQ ID NO: 24285 - DNA, 669 bp, Unknown
  Obtained from environmental sample
  misc_feature (1)..(669): n is a, c, g, or t
gtgaagccaataataaatagtttagaaattacacgtaatgtctttcaaaaaaaaattcaatgtgagttggtgactatgaatattagtttgcaaaatcttttcaatgatattaaagccgaaaaaatgttttatcatgaaggttactatagtttgaaattggccgatattttcagggagatgcaatcctttgaaggcaaagattttctcaaaaaactatttttggaaggtaaagctttccaaatgttaacagaacaaattttacaatatgaggatgatttatttgactcttctaaaagaagtattcttagaagaactgaaattaaacaagtggagattgccgcgcaattaataaagaagcaaatatcagaacttaataatatatccgatatcgctggtgatgtaggtcttaatccaaataaattacaagaaggatttcaaaatctatatggaagtactgtcaatcaatatatacaaaaagttcgtttagatttgatcaaagactttgtgttaaattcagaatatacaatgtctgaaatagtgcatatgtcgggattatcaagtaaaagttatctctcaaaaatttttaaagaagagtatggcacttcaccttctgaataccgtaaaaatttcattgattctttgctaaaaaaaaggtctaatcaaaaatag

SEQ ID NO: 24286 - protein, 222 aa, Unknown
  Obtained from environmental sample
  DOMAIN (112)...(158): Bacterial regulatory helix-turn-helix proteins, AraC family
  misc_feature (1)..(222): Xaa is any amino acid
MKPIINSLEITRNVFQKKIQCELVTMNISLQNLFNDIKAEKMFYHEGYYSLKLADIFREMQSFEGKDFLKKLFLEGKAFQMLTEQILQYEDDLFDSSKRSILRRTEIKQVEIAAQLIKKQISELNNISDIAGDVGLNPNKLQEGFQNLYGSTVNQYIQKVRLDLIKDFVLNSEYTMSEIVHMSGLSSKSYLSKIFKEEYGTSPSEYRKNFIDSLLKKRSNQK

SEQ ID NO: 24287 - DNA, 876 bp, Unknown
  Obtained from environmental sample
  misc_feature (1)..(876): n is a, c, g, or t
ttgaatttaggcgatgattttaaaacatggattttagaaagcaatctttttcatagcacattggtagatagaattgtacctggttatccaggagcagaaatagaagaatacaatgcacaattagattataaagataatttaattgtttctgcagaagcttttttactgtgggttattgaaggtggtgaagagttaaaagcaaaattaccattcgagaaaaccaaattagatgtaaaaattgtggacgatatgcaaccctttagaacaagaaaagttcgtattttaaatggtgcacatacttcattaattgctttttcttatttatatggaaataaaacggttaaagaatctgtagataatgaatttacaggaggtttaatcaatcaaattatttttgatgaaattataccaacattagattttgaaaaagatcaaattgaagaatttgctcatgaaattttagaccgttttagaaatccttttatcaaacataatatatcaagtttagccttaaactgtatttctaaatttaaagttagagttttacctagcattttagaatacattaaaatttatgataaactaccaacaaatttaacttttgcttttgctgcattaattcgattttataaaggcacttacaatggagaaagtttgcctatagatgataataaagaaatagttgaaaattttgtagaaatctggaagcataatgattacactacaataactaatgctgttttaagtaatgaagaatattggggagaagaattaactaaggttaaaaacctaagtaatgcaatttcttttgctttagaagaaatagatacaaatggtgttgaaaaaggttttgaaaatttcaacaaaaaatattaa

SEQ ID NO: 24288 - protein, 291 aa, Unknown
  Obtained from environmental sample
  DOMAIN (1)...(264): Mannitol dehydrogenase
  misc_feature (1)..(291): Xaa is any amino acid
MNLGDDFKTWILESNLFHSTLVDRIVPGYPGAEIEEYNAQLDYKDNLIVSAEAFLLWVIEGGEELKAKLPFEKTKLDVKIVDDMQPFRTRKVRILNGAHTSLIAFSYLYGNKTVKESVDNEFTGGLINQIIFDEIIPTLDFEKDQIEEFAHEILDRFRNPFIKHNISSLALNCISKFKVRVLPSILEYIKIYDKLPTNLTFAFAALIRFYKGTYNGESLPIDDNKEIVENFVEIWKHNDYTTITNAVLSNEEYWGEELTKVKNLSNAISFALEEIDTNGVEKGFENFNKKY

SEQ ID NO: 24289 - DNA, 918 bp, Unknown
  Obtained from environmental sample
  misc_feature (1)..(918): n is a, c, g, or t
atgcaaatgtatgcaccattatatttaagcaacgaatgccaaaacatctgtacctatgtgggcttcagtgtaaccaataaaatacctagacgtactttaaccgattcagagattttaaaagaagctcaatttttaaaaaataaaggctataatcatattctattggtcactggtgaagccaataaaaccgtcggggtagagtatataaataatgctgttaaacttcttaaaaaaaagtttgcaaacattactattgaagtccaacccttagaccaaaacgagtatgaattattagtagagaatggcttatatgcggtgttggtatatcaagaaacttaccatagagaagaatacaaaaaacaccatcctaaaggcaaaaaatctaattttaattaccgattagaaacccccgaccgtttaggaaaagcaggagtacataaaattggtttaggtgccttatttggtttagaggattggcgagcagagagtttttttacagctttacacttacagtatttacaaaaaacatattggcaaaccaaatactctatttcattccctaggttacgaccacattctggaggattagaccccaaagtggttatggaggatgccgatttagcccaattaatttgtgcttatcgcttgttagacgaagatatagagttatcgatttctacaagagaaagcgagacgtttagaaacaatattatcaactttggcattacctctataagtgctgaatctaaaacaaatccaggtggctatgttgtagaaccgcaatctttagagcagtttgaaatttccgatgagcgtaacacagaaaccattactgcaatgctaaaagaaaaaggttttgaagtggttggaaagattgggaagcgtttcaatagcagaatagtaaatcctcagcgataa

SEQ ID NO: 24290 - protein, 305 aa, Unknown
  Obtained from environmental sample
  DOMAIN (7)...(168): Radical SAM superfamily
  misc_feature (1)..(305): Xaa is any amino acid
MQMYAPLYLSNECQNICTYVGFSVTNKIPRRTLTDSEILKEAQFLKNKGYNHILLVTGEANKTVGVEYINNAVKLLKKKFANITIEVQPLDQNEYELLVENGLYAVLVYQETYHREEYKKHHPKGKKSNFNYRLETPDRLGKAGVHKIGLGALFGLEDWRAESFFTALHLQYLQKTYWQTKYSISFPRLRPHSGGLDPKVVMEDADLAQLICAYRLLDEDIELSISTRESETFRNNIINFGITSISAESKTNPGGYVVEPQSLEQFEISDERNTETITAMLKEKGFEVVGKIGKRFNSRIVNPQR

SEQ ID NO: 24291 - DNA, 810 bp, Unknown
  Obtained from environmental sample
  misc_feature (1)..(810): n is a, c, g, or t
atgcctagtttcactccgctctttaagagtcaaaattgggatactataatggctgacatctataataaaacacgtgaagatgtaaaaattgcgttgcaaaaaaacagtcgtgatttagaagattttaaagctttaatttcccctgctgcgaaaccttatttagagcaaatggcacaattaagcaacgctttaactaaaaaacgttttggaaatacaatgcaaatgtatgcaccattatatttaagcaacgaatgccaaaacatctgtacctattgtggcttcagtgtaaccaataaaatacctagacgtactttaaccgattcagagattttaaaagaagctcaatttttaaaaaataaaggctataatcatattctattggtcactggtgaagccaataaaaccgtcggggtagagtatataaataatgctgttaaacttcttaaaaaaaagtttgcaaacattactattgaagtccaacccttagaccaaaacgagtatgaattattagtagagaatggcttatatgcggtgttggtatatcaagaaacttaccatagagaagaatacaaaanacaccatcctaaaggcaaaaaatctaattttaattaccgattagaaacccccgaccgtttaggaaaagcaggagtacataaaattggtttaggtgccttatttggtttagaggattggcgagcagaagagtttttttaccggctttacccttacagtattttacaaaaaaacatattggccaaacaaaataactctattttcatcccccaggttaacgaaccacctttctgggag

SEQ ID NO: 24292 - protein, 270 aa, Unknown
  Obtained from environmental sample
  DOMAIN (79)...(240): Radical SAM superfamily
  misc_feature (1)..(270): Xaa is any amino acid
MPSFTPLFKSQNWDTIMADIYNKTREDVKIALQKNSRDLEDFKALISPAAKPYLEQMAQLSNALTKKRFGNTMQMYAPLYLSNECQNICTYCGFSVTNKIPRRTLTDSEILKEAQFLKNKGYNHILLVTGEANKTVGVEYINNAVKLLKKKFANITIEVQPLDQNEYELLVENGLYAVLVYQETYHREEYKXHHPKGKKSNFNYRLETPDRLGKAGVHKIGLGALFGLEDWRAEEFFYRLYPYSILQKNILAKQNNSIFIPQVNEPPFWE

SEQ ID NO: 24293 - DNA, 789 bp, Unknown
  Obtained from environmental sample
  misc_feature (1)..(789): n is a, c, g, or t
atgactcagcctcgtaatttaattgtggttgatgaaaatgcacatgttcaaattatagaacgtcatcaaagtttaacttcgaatgcagttttatcgaatatagttacagaaattttttctgcaaaaagttctactgtagatgtttataaaatccaaaatgatgatttaaacgcttctattgttgataatacctatgtagatcaaaaatcaaatagtgttgtttctgtacatactttttcttttggtggaaacatcaccagaaataatttgaacttttatcaaaatggagaacatatagattctattttaaaagggattacaattattgaaggaaaacaacatgtagatcatcacactttagtgcatcatattgaaccaaattgtgaatctcaccaagattacaaaggtatttttgacgaacgttctacaggagtttttaacggaaaagtaatagtaaataaagaagctcaaaaaacaaatgcttatcagcaaaacaacaatgttctaataagtgataaagcaacaataaatgcaaaacctcaactagaaatttttgcagatgatgtaaaatgttctcatggttgtactattggtcaattagatgatgatgcattattttacatgcaacaacgtggaattcctaaaaaagaaggaaaggctttattaatgtttgcttttgcaaatacagtattagagagtgtaaaaattcctgaagttaaaacaagaattaccaagttaattgccaacaaattgggtgttaaaattggggttcgatttataattgattga

SEQ ID NO: 24294 - protein, 262 aa, Unknown
  Obtained from environmental sample
  DOMAIN (1)...(226): Uncharacterized protein family (UPF0051)
  misc_feature (1)..(262): Xaa is any amino acid
MTQPRNLIVVDENAHVQIIERHQSLTSNAVLSNIVTEIFSAKSSTVDVYKIQNDDLNASIVDNTYVDQKSNSVVSVHTFSFGGNITRNNLNFYQNGEHIDSILKGITIIEGKQHVDHHTLVHHIEPNCESHQDYKGIFDERSTGVFNGKVIVNKEAQKTNAYQQNNNVLISDKATINAKPQLEIFADDVKCSHGCTIGQLDDDALFYMQQRGIPKKEGKALLMFAFANTVLESVKIPEVKTRITKLIANKLGVKIGVRFIID

SEQ ID NO: 24295 - DNA, 405 bp, Unknown
  Obtained from environmental sample
  misc_feature (1)..(405): n is a, c, g, or t
atgactaaaacgaatatagcttgtattattgatgatgatcctatttctgtgttaataacgaaaaagataatgcagcgttcaaacttctgcaacagtttattagtttactccgatggggaaaaagcaatttcgggattaaccgatattatagcatccggaatcggaatcccagaagttattttactcgatttaaatatgcctgtaatgaatggttgggagtttttagaaaaatttgcagatatattaaatgaaaagaaaatcactatttttattgtcacttcttccattaacccatccgacttaaaaaaagcaaaaaattatcagaccgttagtaattacatagttaaaccaatcaccgacaaagctcttatccaaatgtctaaaaaaataacaccagagcaataa

SEQ ID NO: 24296 - protein, 134 aa, Unknown
  Obtained from environmental sample
  DOMAIN (5)...(134): Response regulator receiver domain
  misc_feature (1)..(134): Xaa is any amino acid
MTKTNIACIIDDDPISVLITKKIMQRSNFCNSLLVYSDGEKAISGLTDIIASGIGIPEVILLDLNMPVMNGWEFLEKFADILNEKKITIFIVTSSINPSDLKKAKNYQTVSNYIVKPITDKALIQMSKKITPEQ

SEQ ID NO: 24297 - DNA, 597 bp, Unknown
  Obtained from environmental sample
  misc_feature (1)..(597): n is a, c, g, or t
ttggaaattatagaaacaaaatataattattggactgatgtattagatttagataacacaagaacttataaagtaaaaaacgtaaagctgaccttaaaccaaaacccatttaaaaaaataaatggattatgtggaaattacattttagaaattgaacatttttacaacgactctttgacaaaaacagctacttttaaaggcaaattcaagtcttttaaaggaattgacaaaacttcggcagattacttatgggctttggaacaaaacaaaatattttatggaattactaacgaaaacggagtttacttgcgacctgacaaaatgccttcattaaaatctgaccataaaatcttgaccgaaaaaataaaaaatatcaaaggctacaaaccagataaaataagggcttatgtggtaataaacgaaaatggaaaaatcgagaaagaaccgtttagattctttggaaattttggacaatggaatgatgaaactcaaaataaagttaaagatttactgattgaattaaccgaatggtatcccgcttgtgtaaatgaaaaggaagttaaatcacaaattccattagtaattggaattgaataa

SEQ ID NO: 24298 - protein, 198 aa, Unknown
  Obtained from environmental sample
  misc_feature (1)..(198): Xaa is any amino acid
MEIIETKYNYWTDVLDLDNTRTYKVKNVKLTLNQNPFKKINGLCGNYILEIEHFYNDSLTKTATFKGKFKSFKGIDKTSADYLWALEQNKIFYGITNENGVYLRPDKMPSLKSDHKILTEKIKNIKGYKPDKIRAYVVINENGKIEKEPFRFFGNFGQWNDETQNKVKDLLIELTEWYPACVNEKEVKSQIPLVIGIE

SEQ ID NO: 24299 - DNA, 384 bp, Unknown
  Obtained from environmental sample
  misc_feature (1)..(384): n is a, c, g, or t
atgattaaacctttaataattttaatatattttcttcttcattcaggattgtgcatatcacaagttgaaattaacgctgaattatcaagagaaattaatgagcaagtcttcaaatctgatatctctttaccggcaaccgcaattttatcgaataaaaaatatgaccaatttaatgaaagtgtacgtgaagaaataattcactttacagatagcaccaaagtaagaaataaatacaatgaatcaggcagtcttgtagcatctcaatttttcaaaaatgattcagttacttcagaatataaatttgaataccaagaagacggaaagacactcaaaaaagagacaggtataaatacattagactttttcgttttgaaaaagngatga

SEQ ID NO: 24300 - protein, 127 aa, Unknown
  Obtained from environmental sample
  misc_feature (1)..(127): Xaa is any amino acid
MIKPLIILIYFLLHSGLCISQVEINAELSREINEQVFKSDISLPATAILSNKKYDQFNESVREEIIHFTDSTKVRNKYNESGSLVASQFFKNDSVTSEYKFEYQEDGKTLKKETGINTLDFFVLKKX

SEQ ID NO: 24301 - DNA, 672 bp, Unknown
  Obtained from environmental sample
  misc_feature (1)..(672): n is a, c, g, or t
atgctactaaaagcctttttagattacctgttgcttgaaaaaaaatattcccagctaacagttaatgcctataaaaaagatatagaatcctttatggcttttatttctagtgaagaagaaacaaatactattcaagaaacaaattattcgcaaattagatcttggattgttaatttagttcaaaaaggaataaccaacagaagtataaatagaaagatttctgcattaaatggcttctttaaattcctacttaaaattgaagaagtaaacctaaatccactttcaaaacataaggccttaaaaacaagtaaaaaagttcaaatccccttttcagaaaatgaaattaatacagttctagatcaaattaaccacaatcaagattttgaaggtgttagaaataaattaataatagaattattttactctacaggaattagacgtatagagttgataaacattaaattaaaagatattgatttagaaaataagacaattaaaattttaggtaaaagaaataaagaacgtattattcctttgttaaacatggtaatggatagtgtagatatttataagttagaaagaaataaattagaaactattacagataatgagtatttgtttttaacaaaaaaggagttaaagtatatgaaactcttgtctacagaattataa

SEQ ID NO: 24302 - protein, 223 aa, Unknown
  Obtained from environmental sample
  DOMAIN (3)...(89): Phage integrase, N-terminal SAM-like domain
  misc_feature (1)..(223): Xaa is any amino acid
MLLKAFLDYLLLEKKYSQLTVNAYKKDIESFMAFISSEEETNTIQETNYSQIRSWIVNLVQKGITNRSINRKISALNGFFKFLLKIEEVNLNPLSKHKALKTSKKVQIPFSENEINTVLDQINHNQDFEGVRNKLIIELFYSTGIRRIELINIKLKDIDLENKTIKILGKRNKERIIPLLNMVMDSVDIYKLERNKLETITDNEYLFLTKKELKYMKLLSTEL

SEQ ID NO: 24303 - DNA, 849 bp, Unknown
  Obtained from environmental sample
  misc_feature (1)..(849): n is a, c, g, or t
ttgagattatgctttaatacttctacttttaatacggatagagaaccagaagcaaaaactatctgttctaattttatgtcatccttaatggggcaagggtttttctacttagtcttagagtatggagacacattattatcaaaagattttaatgtgaaatgggattttttatattacatattaggtagagttcatagaatgcaaggggaatatagaaagtcatttaagatgtatgatctaggtattaaactattttcggattcttccttaaaatcaccttttttgtttgaaaaggctagcatactaacttatctttctaaagaggaattagatgatagtaaactaaatgaagctgtaagtatttataaagagctttcgcactcagaaagccctactatatttgttaagagtaaaatagctttatttcgcatactagtaatcaacaataaagaaaaacaggcgcttagtgaactattagaatttcgaggttctatctcaaatttagaattacagatttacgattcagctcaaatatatcattctattggcgatgtatatagagcaaactctatgcacaaaaaagcttttgaagcttttgatacaagtattgattattatagagaagcgatagatcttcatggtatgaatatgtttgaaggtttatatcatttatatataagctatggtcagacatactctgaggctaaagattatgaatcagctgctgaaatgtttggtattaacgttcaactagcaaaacagttcaagatggatgttaagttggaatctgncattctagattttggatatcatttattattgagtgaaaattcgaaacatctattttag

SEQ ID NO: 24304 - protein, 282 aa, Unknown
  Obtained from environmental sample
  misc_feature (1)..(282): Xaa is any amino acid
MRLCFNTSTFNTDREPEAKTICSNFMSSLMGQGFFYLVLEYGDTLLSKDFNVKWDFLYYILGRVHRMQGEYRKSFKMYDLGIKLFSDSSLKSPFLFEKASILTYLSKEELDDSKLNEAVSIYKELSHSESPTIFVKSKIALFRILVINNKEKQALSELLEFRGSISNLELQIYDSAQIYHSIGDVYRANSMHKKAFEAFDTSIDYYREAIDLHGMNMFEGLYHLYISYGQTYSEAKDYESAAEMFGINVQLAKQFKMDVKLESXILDFGYHLLLSENSKHLF

SEQ ID NO: 24305 - DNA, 684 bp, Unknown
  Obtained from environmental sample
  misc_feature (1)..(684): n is a, c, g, or t
gtgctaactacagctgataaaataattgtacccagcaataacacaaaaaaagagtttcagcagttaacagagcaaccaataaccgtcataactaatggttatgatgttgtcaaatcatctgttattattagggattcaaagtttactctgtctcatattggctcttttttgtctgaaaggaatccaaaaatattgtgggaagttcttcaagatttgcgaaatgaagatgccggttttaaattggacttcgaattgaaactagttggagctgttagtgattctgtactgaaatctattcagaaatataatttaactaattgtttaaataatataggctatgtgtctcataatgaagcattaaaaattcaaaaagaaacacagttgttgctgttggttgaaattgattccgaagaaacaaaagcaattattccaggaaagttatttgagtatatggtttcagagcgtcccatagttgctatcgggccaactagaagtgatgttgaagttatcttaaaagaaacgaatacaggaacttattttaactacaccgactctgaggccttaaaatctgtaattaaaacatattaccaaacctataaaacgggcgatttaaaaacgaatgctattggggtgcaaaaatacagtagaaagaatttaacaaaaactttagcgcaactcatataa

SEQ ID NO: 24306 - protein, 227 aa, Unknown
  Obtained from environmental sample
  DOMAIN (34)...(216): Glycosyl transferases group 1
  misc_feature (1)..(227): Xaa is any amino acid
MLTTADKIIVPSNNTKKEFQQLTEQPITVITNGYDVVKSSVIIRDSKFTLSHIGSFLSERNPKILWEVLQDLRNEDAGFKLDFELKLVGAVSDSVLKSIQKYNLTNCLNNIGYVSHNEALKIQKETQLLLLVEIDSEETKAIIPGKLFEYMVSERPIVAIGPTRSDVEVILKETNTGTYFNYTDSEALKSVIKTYYQTYKTGDLKTNAIGVQKYSRKNLTKTLAQLI

SEQ ID NO: 24307 - DNA, 591 bp, Unknown
  Obtained from environmental sample
  misc_feature (1)..(591): n is a, c, g, or t
ttgtttgacttctatatttcccaaaataacattaacgtacttaatatgcttaatgctaagtatattattgtgccagacgaagaagaaggcactgcggtttacactaatgaagatgcgaatggtaatgcgtggtttgtagaaaaagtgatgcctgtggcgtctccagatgaagaaatactcgctttaaatcagttagataataaaacaatggcaattacaacagacgagactttaaagaatgcttttacagttgattctttagcgtctattactgttttagaatataaaccaaactacattaaatacgattccaagaacctaaacgaagggtttgctgtgttctcagaaatgtattataaagaagggtggagtgcttatgtaaatggcgaattaaagcctattcacaaagtaaattacaccttacgcggactaaaaacaccgaaaggaagaagtgttatagagtttaaatttgagcctcaagtagtagcaacaggaagtacgattgcattagtatcgtctcttgtgttgttattattaatagttggcggtttgttttatgagtttaaaaacagtaagaaattaagtgaataa

SEQ ID NO: 24308 - protein, 196 aa, Unknown
  Obtained from environmental sample
  misc_feature (1)..(196): Xaa is any amino acid
MFDFYISQNNINVLNMLNAKYIIVPDEEEGTAVYTNEDANGNAWFVEKVMPVASPDEEILALNQLDNKTMAITTDETLKNAFTVDSLASITVLEYKPNYIKYDSKNLNEGFAVFSEMYYKEGWSAYVNGELKPIHKVNYTLRGLKTPKGRSVIEFKFEPQVVATGSTIALVSSLVLLLLIVGGLFYEFKNSKKLSE

SEQ ID NO: 24309 - DNA, 552 bp, Unknown
  Obtained from environmental sample
  misc_feature (1)..(552): n is a, c, g, or t
atgagttacgtaccaagattaaaagcagaatacaaagaaagagtagtgagtactcttactgaggaattcagttatacaaatataatgcaagtacctaaattagaaaaaattgtaatttctaaaggtgttggtgctgcaattgctgataaaaaattaatagattacgcattagaagagttgactaaaattactggtcaaaaagctatatctacaatgtctaagaaggatgttgcagcttttaaattacgtaaaggtatgccaattggtgcaaaagttactttacgtggagataaaatgtatgagtttttagatagattagttactgcttctttaccacgtgtaagagactttaatggaatcaaagctaatggatttgatggtagaggtaattacaatttaggtattactgaacaaattatttacccagaaataaatattgaccaagttaagaaaattaacggtatggatattacttttgtaacatctgcaaatactgataaagaagcaaagtcattattaggagaattaggtttaccattccaaaaaaattaa

SEQ ID NO: 24310 - protein, 183 aa, Unknown
  Obtained from environmental sample
  DOMAIN (27)...(83): Ribosomal protein L5
  misc_feature (1)..(183): Xaa is any amino acid
MSYVPRLKAEYKERVVSTLTEEFSYTNIMQVPKLEKIVISKGVGAAIADKKLIDYALEELTKITGQKAISTMSKKDVAAFKLRKGMPIGAKVTLRGDKMYEFLDRLVTASLPRVRDFNGIKANGFDGRGNYNLGITEQIIYPEINIDQVKKINGMDITFVTSANTDKEAKSLLGELGLPFQKN

SEQ ID NO: 24311 - DNA, 774 bp, Unknown
  Obtained from environmental sample
  misc_feature (1)..(774): n is a, c, g, or t
atgacggagcgctttttgcccgataaagctattgatgctttagatgaagcaggttcgcgtgtgcatattactaatatcgaagtacctaagaaaattttagaactcgaaaagaaacttgaagaagttaaagagactaaaaactcggtagttaaaaaacaaaagtatgaagaggcagcgcgtttacgcgatgacgaaaaacgtcttgaaaaagaattaagtatcgcccaagaaaaatgggaagaagacacaaaactgaataaagaaattgtaaccgaagataatgttgccgatgtggtgtctatgatgacggggattcctgtaaatcgtattgcacaaaccgaaagtaataaattagccgaattgccagaacttattaaaggccgcgttattggtcaagaagaagctgttgctaaagtggtaaaagcgattcagcgtaatcgtgcaggattaaaagatcctaataagccaattggttcgtttatatttttaggacaaacaggtgtaggtaaaacacaattagcaaaagtattatctcaacaattattcgatagtgaagattctttaattagaatcgatatgagtgagtatatggagaaattcgctatttctagattagttggggcacctccaggatacgtaggttacgaagaaggtggacaattaaccgagaaagtgagacgtaaaccatacgccgtaatcttattagatgaaattgaaaaagcgcatccagacgtttttaatatgcttttacaagtattagacgatggttattaa

SEQ ID NO: 24312 - protein, 257 aa, Unknown
  Obtained from environmental sample
  DOMAIN (36)...(71): UvrB/uvrC motif
  misc_feature (1)..(257): Xaa is any amino acid
MTERFLPDKAIDALDEAGSRVHITNIEVPKKILELEKKLEEVKETKNSVVKKQKYEEAARLRDDEKRLEKELSIAQEKWEEDTKLNKEIVTEDNVADVVSMMTGIPVNRIAQTESNKLAELPELIKGRVIGQEEAVAKVVKAIQRNRAGLKDPNKPIGSFIFLGQTGVGKTQLAKVLSQQLFDSEDSLIRIDMSEYMEKFAISRLVGAPPGYVGYEEGGQLTEKVRRKPYAVILLDEIEKAHPDVFNMLLQVLDDGY

SEQ ID NO: 24313 - DNA, 504 bp, Unknown
  Obtained from environmental sample
  misc_feature (1)..(504): n is a, c, g, or t
ttgtcagattggctcgagacaggggtcaagccgaaactgtttactctaggcttgaaaaaactcaaaattaaacccgactcttgtactagtttgactatttttaatattgataccatccgcccaaattttttacaccctgaattgaatagcaacgttgatggctatttagaagtttttagaggtgagggtgataattggtcttttgttcagcctaaaagtagtgagtctccacaagtaatattgacaacagagaaaaaacctatatctgatttatgttcgacggggttgtattacttttcatcattttaccttttcgaaaagtcctatcagaactatataaataggcctaaagactcatgggtaaatggtgaaatatatattgctcctttatataattacttgattgaaaatggtttttatattgagtatgttgaaatcaataaaagtgaagtgctttttagtggtacgcctgaagagtatttggagctaaaatgtgatttctga

SEQ ID NO: 24314 - protein, 167 aa, Unknown
  Obtained from environmental sample
  misc_feature (1)..(167): Xaa is any amino acid
MSDWLETGVKPKLFTLGLKKLKIKPDSCTSLTIFNIDTIRPNFLHPELNSNVDGYLEVFRGEGDNWSFVQPKSSESPQVILTTEKKPISDLCSTGLYYFSSFYLFEKSYQNYINRPKDSWVNGEIYIAPLYNYLIENGFYIEYVEINKSEVLFSGTPEEYLELKCDF

SEQ ID NO: 24315 - DNA, 498 bp, Unknown
  Obtained from environmental sample
  misc_feature (1)..(498): n is a, c, g, or t
ttgacaattaaagaggtggatagtaaatttaatattattcaacattctaaaataaaagagtatttatacgtttttgcatttggcggtaagtttcatccgttttgtgcaccaatattaactacaattttagatcctttagatattgagttaatgaaaaaggcagcgagactgtttgaaggagaacattttttaaaacactattgttatagaccaacagataatggtatatataataggactattttaaaatgcgaaattgttgaaaacacgatttatacagcaaacttttttccagaacaaagttatatactgcgtgtaaagggaaaggggtttatgcgtaatcaaatccgtttaatgatgggagcattgattgaaattggtcaaggtaaacgcacattagcagatattgaagccagtttaaaaccagattttgaaggtcataatcactacatagctcctgcttctggattaattttaaaggatatcgagttcgagtaa

SEQ ID NO: 24316 - protein, 165 aa, Unknown
  Obtained from environmental sample
  DOMAIN (54)...(165): tRNA pseudouridine synthase
  misc_feature (1)..(165): Xaa is any amino acid
MTIKEVDSKFNIIQHSKIKEYLYVFAFGGKFHPFCAPILTTILDPLDIELMKKAARLFEGEHFLKHYCYRPTDNGIYNRTILKCEIVENTIYTANFFPEQSYILRVKGKGFMRNQIRLMMGALIEIGQGKRTLADIEASLKPDFEGHNHYIAPASGLILKDIEFE

SEQ ID NO: 24317 - DNA, 621 bp, Unknown
  Obtained from environmental sample
  misc_feature (1)..(621): n is a, c, g, or t
gtgctgtttattgctccgctggttttctatattttattactaacgggtactaataattttgcgaaacttcctgtcttaacagaaactattagtgatgtcactcatttcaaaagcgagaattcatcagtcatatcattagaaaataaaatttctgttttatgttttttgggtagtgatttaacaacggtaaaaaataatgcccttaatttgaatgagaaaatatacaaacatttttataagtttagagattttcaatttattgtagtactcccagaaggaactgaaggacaagcattagaacttaaaaaggaacttggagctataaccgatatgcaaaaatggaattttttgtatggatctacatcagatatttctgatttgtttgatagtttaaaaacatcgcatcaattaagctctaatagttattcgccttatgcatttattattgataaggacatgcacctgcgtggtagaacgaatgatgaagatgtacatgatgggatattatatggttataatgctgagaccgttgctccaattcatagtaaaatggtagacgatgtgaaagtgctgatagccgaatatagattagccttgaaaaagaataaacgagaaatataa

SEQ ID NO: 24318 - protein, 206 aa, Unknown
  Obtained from environmental sample
  SIGNAL (1)...(21)
  misc_feature (1)..(206): Xaa is any amino acid
MLFIAPLVFYILLLTGTNNFAKLPVLTETISDVTHFKSENSSVISLENKISVLCFLGSDLTTVKNNALNLNEKIYKHFYKFRDFQFIVVLPEGTEGQALELKKELGAITDMQKWNFLYGSTSDISDLFDSLKTSHQLSSNSYSPYAFIIDKDMHLRGRTNDEDVHDGILYGYNAETVAPIHSKMVDDVKVLIAEYRLALKKNKREI

SEQ ID NO: 24319 - DNA, 312 bp, Unknown
  Obtained from environmental sample
  misc_feature (1)..(312): n is a, c, g, or t
atgaagaacaaatcttacatcgggataacatttattatactgatttttggtatttgggcaattcccaaaatattaaataaaatttcgaatcaacctttagtgaagtttgaaaaagttcctgattttgaatttaccgatcaaaataatacagtaattactaatgcaacctttcaagacaaagtgtatgttgttgaatttttctttgcatcctgtcctactatttgtcccaaaatgcataaaagcatgctcaagattcaaaatgaaattttatggcaatcccaaattttgggaattgcggcctataaacgatag

SEQ ID NO: 24320 - protein, 103 aa, Unknown
  Obtained from environmental sample
  misc_feature (1)..(103): Xaa is any amino acid
MKNKSYIGITFIILIFGIWAIPKILNKISNQPLVKFEKVPDFEFTDQNNTVITNATFQDKVYVVEFFFASCPTICPKMHKSMLKIQNEILWQSQILGIAAYKR

SEQ ID NO: 24321 - DNA, 378 bp, Unknown
  Obtained from environmental sample
  misc_feature (1)..(378): n is a, c, g, or t
gtgtctagtttgtcaaaatataaaaaccatttaaaagtaattgaagacacaacttttgatattaaaattttagcaactgcagcgccaaattgctattcaaaaatcattgctttaaacgaaggatttgatgtgtgtttggcaactaatacaccagaaaaaaactataaatccgattttgaaaatgttagagatgttaaaaagcaggcagttaccacttatttaaaaacattgggtagcaatcgcgttgatactgtagtaaccgatcattttgatgatttaccattaattaagatagctcaacatgttattttagtaaatcccaataaagagactaaaaatatcttaaaacaaaaccaaatattttttaatattgtataa

SEQ ID NO: 24322 - protein, 125 aa, Unknown
  Obtained from environmental sample
  misc_feature (1)..(125): Xaa is any amino acid
MSSLSKYKNHLKVIEDTTFDIKILATAAPNCYSKIIALNEGFDVCLATNTPEKNYKSDFENVRDVKKQAVTTYLKTLGSNRVDTVVTDHFDDLPLIKIAQHVILVNPNKETKNILKQNQIFFNIV

SEQ ID NO: 24323 - DNA, 636 bp, Unknown
  Obtained from environmental sample
  misc_feature (1)..(636): n is a, c, g, or t
ttggatattaccttaataaagcaaacaaaatgtcttggtgtaactgcagccttaaataatggtttaaattatattctaaaccaacctcattttaaatatatagcaagactagacgcaggagataagtgtataaataatagattagcaaaacaactgctggcattacaattagatcccaagttaggattagtcgcaagctacgttacttttacagcaaaggataatagctttttatttaattttaaaccaccagtaactcatagtaaattacaagaagccatttataaatacaacccatttatccatcctgctgtaatgtataagacggaagttgttaaaattattgggttgtatccagaaaattatccagctcttgaagatcatgcctatttttttaaagtaattaaacattttaaaactatggtgctgccagagttattgttagagtatgaggttaatccaaatagtatttctaatttaaaaagaaagcagcaaactaaaagcagaattaaactacttaaggataattataattatacatttactgcaactttaggtttggttagagcttttgcgactagtctaatacctaaaagtattttactatactttaaaaaaacttttttttataaataa

SEQ ID NO: 24324 - protein, 211 aa, Unknown
  Obtained from environmental sample
  misc_feature (1)..(211): Xaa is any amino acid
MDITLIKQTKCLGVTAALNNGLNYILNQPHFKYIARLDAGDKCINNRLAKQLLALQLDPKLGLVASYVTFTAKDNSFLFNFKPPVTHSKLQEAIYKYNPFIHPAVMYKTEVVKIIGLYPENYPALEDHAYFFKVIKHFKTMVLPELLLEYEVNPNSISNLKRKQQTKSRIKLLKDNYNYTFTATLGLVRAFATSLIPKSILLYFKKTFFYK

SEQ ID NO: 24325 - DNA, 570 bp, Unknown
  Obtained from environmental sample
  misc_feature (1)..(570): n is a, c, g, or t
ttgttgatgaattgcgccagacttttaaaaaatgaaattgaaaatgtagtcattactagtcaaaatgcagttgaagcactattaactaatttttcgcctatcgagttacaattcaaaaatatatactgtgtgggtcgccgtacaaaacgcgaaattgaaaagcgcattggcaaagtgaagcactcagaaaataatgcaaaaaaattagcagaatatttaatagaatacattgatggtaccgaagtaacttacttctgtagcgatgtaagattagacgagcttccaacaatccttactgaaaacaatattaaagtaaacgaagtggaagcttaccaaacaaagctagatcctttaaaattaaaagacagtatagaaggtgttatgttttatagcccgtctaccgtgcaaagttttaaacaagaaaacaaccctacagacacaacggttgcttattgtataggagataccactgcaaaagaagcatctagacattttaaagatgttcgcgttgcaaaattaccaactgtagaaagtgttatcgcattggtgaatgaaaattattcattataa

SEQ ID NO: 24326 - protein, 189 aa, Unknown
  Obtained from environmental sample
  DOMAIN (1)...(182): Uroporphyrinogen-III synthase HemD
  misc_feature (1)..(189): Xaa is any amino acid
MLMNCARLLKNEIENVVITSQNAVEALLTNFSPIELQFKNIYCVGRRTKREIEKRIGKVKHSENNAKKLAEYLIEYIDGTEVTYFCSDVRLDELPTILTENNIKVNEVEAYQTKLDPLKLKDSIEGVMFYSPSTVQSFKQENNPTDTTVAYCIGDTTAKEASRHFKDVRVAKLPTVESVIALVNENYSL

SEQ ID NO: 24327 - DNA, 327 bp, Unknown
  Obtained from environmental sample
  misc_feature (1)..(327): n is a, c, g, or t
ttggcgtcagggctgcatgaagatagattcttcttagtattcaaaaatgaacaagcgcttgctgttgaagatgaagaaattttaaaagacgatataacagtgtttatgaataattcaatatctgaaatccagataagaaataatggcgaggcttttgttgaaaaagtaattctttataattctttgggtcagataatgaatacgtggatagaaaaagagtttaaatctgaaatcaatttaccggtagtaaaacttactacaggtgtatatattgtgaatcttaaaacggataaaggacaagtgtctaaaaaggttattatagaataa

SEQ ID NO: 24328 - protein, 108 aa, Unknown
  Obtained from environmental sample
  misc_feature (1)..(108): Xaa is any amino acid
MASGLHEDRFFLVFKNEQALAVEDEEILKDDITVFMNNSISEIQIRNNGEAFVEKVILYNSLGQIMNTWIEKEFKSEINLPVVKLTTGVYIVNLKTDKGQVSKKVIIE

SEQ ID NO: 24329 - DNA, 789 bp, Unknown
  Obtained from environmental sample
  misc_feature (1)..(789): n is a, c, g, or t
gtgtattatgatatcctaacaaaaatgaaggagagcaaagaggaacaagatgcttacattaaagaatttaataatattataaaaaactctttagacaaagagggcttgagttatgaaattaaagggcgtccaaaatctattttttcgattaaaagaaaaatggataaacaaggtgtgtcttttgatgaagtttacgacaagtttgccgttagaattatctacaaagcagatactcttaataacgaaaaatttattgcttggaaaatctattctgtagttaccgaccactttagacccaacccaacgcgcttaagagactggatttcttctccaaaatctacgggttacgaagcattacacattactgttatgggccccaaagggcgctgggttgaagtacaaattcgtagtcgccgtatgaatgagattgccgaaaaagggtacgctgcacattataaatataagaataatgacaaagaagacagtttagatgtttgggttaatcgcttacaggaagctttagaaaataacgaaactaatgccgttgattttgttgagcagtttaaactgaatttatactcgaaagaaatttttgtttttacaccaaaaggagatttaaaatctttgccaaaaggagccactcctttagattttgcattcagtattcataccgaagtaggaatgaaaacaagaggtgctaaagtaaatggaaaattagtacctttaagtcacgaattaaaaagtggcgatcaggtagacattctaacctcagaaaatgctaaaacctaa

SEQ ID NO: 24330 - protein, 262 aa, Unknown
  Obtained from environmental sample
  DOMAIN (193)...(256): TGS domain
  misc_feature (1)..(262): Xaa is any amino acid
MYYDILTKMKESKEEQDAYIKEFNNIIKNSLDKEGLSYEIKGRPKSIFSIKRKMDKQGVSFDEVYDKFAVRIIYKADTLNNEKFIAWKIYSVVTDHFRPNPTRLRDWISSPKSTGYEALHITVMGPKGRWVEVQIRSRRMNEIAEKGYAAHYKYKNNDKEDSLDVWVNRLQEALENNETNAVDFVEQFKLNLYSKEIFVFTPKGDLKSLPKGATPLDFAFSIHTEVGMKTRGAKVNGKLVPLSHELKSGDQVDILTSENAKT

SEQ ID NO: 24331 - DNA, 642 bp, Unknown
  Obtained from environmental sample
  misc_feature (1)..(642): n is a, c, g, or t
atggcacttaagggaataccagatttaataatttcagatgttattatgccagaaatggatggttttgagttttgtacacacattaaagaaaatttaaaaacaagtcatatccctgttttaatgcttaccgctaaagcgatgagcagtgacaaaataaaaggtatagattctggtgcagacgcatacctcaataagccttttgaaatgaaattattaaaatcatatataaagcgcctaattgagactcgccaacaatttatagaaaagaacataaacgaggagaataagataaccctactcgaaaacacgactagtttagataaaacatttatgcaaaaagtgctcgattatgtaaacgaaaatttaggagaaccagatttaaacgttgaacatttagctgacgacatgtctttaagtagaagtcaattatatagaaaaataaaggccattactgggatgaccgccaccgaactcatcagaaaaataagacttaaaaaagcgaagcaaatgatagaaagtggaagtgaatctattagtgaggttggttttaaagttggtttttcatctgcatcttactttagcaaatgttttaagaatgagtttgatatactcccaacggaactaaagggaaattcacagtaa

SEQ ID NO: 24332 - protein, 213 aa, Unknown
  Obtained from environmental sample
  DOMAIN (2)...(84): Response regulator receiver domain
  misc_feature (1)..(213): Xaa is any amino acid
MALKGIPDLIISDVIMPEMDGFEFCTHIKENLKTSHIPVLMLTAKAMSSDKIKGIDSGADAYLNKPFEMKLLKSYIKRLIETRQQFIEKNINEENKITLLENTTSLDKTFMQKVLDYVNENLGEPDLNVEHLADDMSLSRSQLYRKIKAITGMTATELIRKIRLKKAKQMIESGSESISEVGFKVGFSSASYFSKCFKNEFDILPTELKGNSQ

SEQ ID NO: 24333 - DNA, 804 bp, Unknown
  Obtained from environmental sample
  misc_feature (1)..(804): n is a, c, g, or t
atgcacatttttgaacgattttatcaatctcatacccagcaaaatgcacataggagtggttctggtattggcttggcattctccaaaaaattaattgaaatgcattatggatttatagaggccactagtacattgaaccttggaaccactataaaagttcgtctacctatagttaaagaactattagaccaagaaatcattgaaactataaagttaccaagggaaaaagaaattattgtagacactcatttttttaaggaaattccaataactaaattaaaaactacaggagatttttcagaaacacttattttttatgcagaggataattctgaaatgagacattttgtgtccgggattctttcaaaattttttagaattaaaagctttagaaatggtcaagactgttatgatgcattggatgatgaatggccggacattgttatcagcgatgttcaaatgcctgaattaaatggcctagacttatgcattaaaataaaatctgatttaaagacgagccatattcctgtgattttacttacagctctggccaatattgaagatcatttacaaggtataagagatggtgcagatgcttatatcaagaaaccatttaacgttcaacatttagtgactaatgtagaagccttgcttatcaataggaaacaattgcgggagcgttatcaaatcggtattcctttaactaaagaaaacaataaaaataatagaaatgacaatgcgtttctagaaaaactttatagtttaatagaagaaaatcttgataatcaaagatttttgatttaa

SEQ ID NO: 24334 - protein, 267 aa, Unknown
  Obtained from environmental sample
  DOMAIN (102)...(222): Response regulator receiver domain
  misc_feature (1)..(267): Xaa is any amino acid
MHIFERFYQSHTQQNAHRSGSGIGLAFSKKLIEMHYGFIEATSTLNLGTTIKVRLPIVKELLDQEIIETIKLPREKEIIVDTHFFKEIPITKLKTTGDFSETLIFYAEDNSEMRHFVSGILSKFFRIKSFRNGQDCYDALDDEWPDIVISDVQMPELNGLDLCIKIKSDLKTSHIPVILLTALANIEDHLQGIRDGADAYIKKPFNVQHLVTNVEALLINRKQLRERYQIGIPLTKENNKNNRNDNAFLEKLYSLIEENLDNQRFLI

SEQ ID NO: 24335 - DNA, 948 bp, Unknown
  Obtained from environmental sample
  misc_feature (1)..(948): n is a, c, g, or t
gtgtctacttacagagacggtaaattggtagtagatagaccatgggaagaagcagctatgaagttagtacaaaaagcgaaagtacctgtagtgccaatatactttcatgctaataatagtaagttgttttataagctatctaaaattagcgatatttttagaaccgcaaaattaccatcagagttgttgactcaaaaaagacgagtgataaaggttagaataggaaagtcaatctctgtgaacgatcaagccgagcatgagtcgctttcagatttttctgaatttataagaagaaaaacctatatgctatccaatgcatttgaaccaaaagaaaaaataatagataccatttcctctagcttaaaatctccaaaatctgtaaaagcacctaaacaaattgtgacacctgttagtcagcaggctatgattactgaggttgatgctttaagacagcaggattgcaaattgttaactagtaaaaattacgaagtctttttggctactgccgaaaacatgccaaacctgcttcgtgaaattggtcgtttaagagaaataacttttagagaagtaggagaaggaacaaacgaacctatagatctagatcaatttgataactattaccaccatttatttttgtgggatagtgaggctaatgttttagcaggagcctacaggatgggattaggatctcagatttttgccaactatggtattaacggattctatttacaagatttatttggttttgaaccggaattatataaaatgatgagtgagtctattgaaatgngacgagcttttattattaaagagtatcagcaaaaaccaatgcctttatttttattatggaaaggtattgtacacactacgttacgtcatcctgagcataagtttttattggtgggtgtagtatcagtaatcagttttcagaattttctaaatcgttaa

SEQ ID NO: 24336 - protein, 315 aa, Unknown
  Obtained from environmental sample
  misc_feature (1)..(315): Xaa is any amino acid
MSTYRDGKLVVDRPWEEAAMKLVQKAKVPVVPIYFHANNSKLFYKLSKISDIFRTAKLPSELLTQKRRVIKVRIGKSISVNDQAEHESLSDFSEFIRRKTYMLSNAFEPKEKIIDTISSSLKSPKSVKAPKQIVTPVSQQAMITEVDALRQQDCKLLTSKNYEVFLATAENMPNLLREIGRLREITFREVGEGTNEPIDLDQFDNYYHHLFLWDSEANVLAGAYRMGLGSQIFANYGINGFYLQDLFGFEPELYKMMSESIEMXRAFIIKEYQQKPMPLFLLWKGIVHTTLRHPEHKFLLVGVVSVISFQNFLNR

SEQ ID NO: 24337 - DNA, 699 bp, Unknown
  Obtained from environmental sample
  misc_feature (1)..(699): n is a, c, g, or t
atgaataatttatcaaaaaacataaaacatctaagaggtttaaagaaactaacacaagaatctttagcagaagaattatctgtaacaaggtctagaataagctcttatgaagagaataggtcttcaccaaccatagattttttaattgctttttctgaatattttagaataccgatagatattattattaaaaacgatttaactaaagcgaaagatgtttcttttatagaggtaggtaataaaagagttttgtttcctattacggtagataatgataatgagaatttaatagaaattataccgtctaaagcttctgcaggatatttacttgggtatgacgatccggaatacatagaacaattagaaaaaattaaattgccctttttacctaccggaaagcaccgagcatttcctataaagggagattctatgctgccaatgaaagacggttcttatgtagttgcagaatttatagaagatattaaagaagcaaaaagtgggcattcttatattgtagttaccaaagaagacgggatgacttataagaggttagaaaacttggtagaagaaaagaaggcatttttattaaaaccagacaacgctaattaccaatcttatgaagtacctgtttctgaaatattagagttatggaaatttacatgcagtataacacaccagaatatgaagaacatgagttaa

SEQ ID NO: 24338 - protein, 232 aa, Unknown
  Obtained from environmental sample
  DOMAIN (8)...(62): Helix-turn-helix
  misc_feature (1)..(232): Xaa is any amino acid
MNNLSKNIKHLRGLKKLTQESLAEELSVTRSRISSYEENRSSPTIDFLIAFSEYFRIPIDIIIKNDLTKAKDVSFIEVGNKRVLFPITVDNDNENLIEIIPSKASAGYLLGYDDPEYIEQLEKIKLPFLPTGKHRAFPIKGDSMLPMKDGSYVVAEFIEDIKEAKSGHSYIVVTKEDGMTYKRLENLVEEKKAFLLKPDNANYQSYEVPVSEILELWKFTCSITHQNMKNMS

SEQ ID NO: 24339 - DNA, 1059 bp, Unknown
  Obtained from environmental sample
  misc_feature (1)..(1059): n is a, c, g, or t
atgtcagatcggctgaggccatctatagcgcaaggtacagcgccagaaaaaatacaaattcttacgtttacaaagcgctctgctaatgaaattgtagaacgtgtaaaagcatcacttacaagcaaccaagcacttagtttaaatggtgctacctttcactcttggtgcaaccaattaattgtacgctacccaaatctctttggcgcggctgggtatacggtaatagacccagatgaccagttaagtgttatgaaaatggtttgtggcaatcaaattatagagtttaagggcattcgtataaaacctcagcaacttatagatattttttcttttggaagaaatacaagacaaaatttatctagtgccattagagagaaaatctttaaaggcaaaatagatgatgaaaccaatgatgagatagatataataagacccaaagtagaaatattattaaaggcttaccaagttaaaaaaggagaaggaaggtatttagattatgatgatttgttgttagttgttgctaatagattaaagaatgatgcagaagctagagaaattttaagtcatcaaattaagcatttacttatagatgagtttcaagataccaacccacttcaatggtatttattagcaccttttttagatattgctaagttctattgtgttggagatgatgcacaatctatttattcttttagaggtgccgattataaaaacgtacacctctttaaagaacgggtaccagattcagaaattttaattttagataanaattacaggtctacacaagaaattttagatgtttctaattggcttatagaccaatctcctttaaattataagaagaaattagtttcttctagaggtacaggaattacacccaaattnaataatgttactagccaatggggagaggctaattttatagcagaaaatatcttagagaattttacagaaaaatacaaacaatttgcagaccacttaatctatctaaattaccctatatcaaagccattgcaagccgtttttattcagaaaaaaataccctatgtaacctaa

SEQ ID NO: 24340 - protein, 352 aa, Unknown
  Obtained from environmental sample
  DOMAIN (1)...(350): UvrD/REP helicase
  misc_feature (1)..(352): Xaa is any amino acid
MSDRLRPSIAQGTAPEKIQILTFTKRSANEIVERVKASLTSNQALSLNGATFHSWCNQLIVRYPNLFGAAGYTVIDPDDQLSVMKMVCGNQIIEFKGIRIKPQQLIDIFSFGRNTRQNLSSAIREKIFKGKIDDETNDEIDIIRPKVEILLKAYQVKKGEGRYLDYDDLLLVVANRLKNDAEAREILSHQIKHLLIDEFQDTNPLQWYLLAPFLDIAKFYCVGDDAQSIYSFRGADYKNVHLFKERVPDSEILILDXNYRSTQEILDVSNWLIDQSPLNYKKKLVSSRGTGITPKXNNVTSQWGEANFIAENILENFTEKYKQFADHLIYLNYPISKPLQAVFIQKKIPYVT

SEQ ID NO: 24341 - DNA, 915 bp, Unknown
  Obtained from environmental sample
  misc_feature (1)..(915): n is a, c, g, or t
atggctacttcaaagaataaattcacttttaagattatcctcagctacctcgttttgggagctttgtcggttttagttggtttttttatatattctgaattcaaaaattttactgccgaatccattgaaattaaaggtgaaaaaaagtttattgaaactggaacgctcatcaatttagtttacgaaactgacggattttcaaggctcgcgcttttaactgaaagcgatgacgacttcgaaaaatatatggtcaagacggaatctcttttcaaaaaaattgaagaaattaaatcgctcacaactaacgattttcaaataaagcaactggatagtgttaattcactggtccaagaaaaaaatcgaaatattgagcaattgcggatcctacggctgacaaaccaaaaagacacttcgctggacgatattatgaaggaagtgagaaaattagaggcctccatcggtttaaattctgtggaatccatggtgaaaaatccttcaaatctcagcaacaaggatcgaagaatatgggaagcttatgccgattatttaaacagtagttcacttcgcgacacttccacagtaaaatcaaaaactgtggattctatgcttaccgcttcgcgttatattgttgctgaagcgaaaaaagaaaactcgagaattcgcgaatccttaatgcaaaaggagaatgaattgatccgcaacgacctcaatatttccgaacgattgcgagaaataatcgccagttttgaccgcngaattacaaagaacaataatatagaaaagcaacagcgtgcggaatccatgggacgcaccaagcagattctgaaatttgccggaaattttgggtggcatcgnaagtttactggtttttctatttcatcctttcaaaatttttttagggcagaacgcttttaa

SEQ ID NO: 24342 - protein, 304 aa, Unknown
  Obtained from environmental sample
  misc_feature (1)..(304): Xaa is any amino acid
MATSKNKFTFKIILSYLVLGALSVLVGFFIYSEFKNFTAESIEIKGEKKFIETGTLINLVYETDGFSRLALLTESDDDFEKYMVKTESLFKKIEEIKSLTTNDFQIKQLDSVNSLVQEKNRNIEQLRILRLTNQKDTSLDDIMKEVRKLEASIGLNSVESMVKNPSNLSNKDRRIWEAYADYLNSSSLRDTSTVKSKTVDSMLTASRYIVAEAKKENSRIRESLMQKENELIRNDLNISERLREIIASFDRXITKNNNIEKQQRAESMGRTKQILKFAGNFGWHRKFTGFSISSFQNFFRAERF

SEQ ID NO: 24343 - DNA, 444 bp, Unknown
  Obtained from environmental sample
  misc_feature (1)..(444): n is a, c, g, or t
atgtcagatcggctgaggaagagagttacactaaaaccaaagtctcaaaaagctattaatcaacaattggaattgattagtttggatagtattcaagctattgccatcaattatgtaaacttacagaacttaccatctgaaataaaccggattgattacagaccctctaaaggcattgccaaaatacgctttgaaacccatttcactgaaattcaaattgattgttattcgggtgctattctttcagacaaaactcgaacggctgatattattgaaatgattcatgatggttccattcttgattatctttttggaaatcagtccaaacctataaaattattttattcaaccattagctcatttggcttgatgttattagcttttacgggattttggttgtggctaaaaccgaaacagattaaaatgaaaaaacgatcaaattga

SEQ ID NO: 24344 - protein, 147 aa, Unknown
  Obtained from environmental sample
  misc_feature (1)..(147): Xaa is any amino acid
MSDRLRKRVTLKPKSQKAINQQLELISLDSIQAIAINYVNLQNLPSEINRIDYRPSKGIAKIRFETHFTEIQIDCYSGAILSDKTRTADIIEMIHDGSILDYLFGNQSKPIKLFYSTISSFGLMLLAFTGFWLWLKPKQIKMKKRSN

SEQ ID NO: 24345 - DNA, 363 bp, Unknown
  Obtained from environmental sample
  misc_feature (1)..(363): n is a, c, g, or t
atgagtaaaacatataaaacaaacgttaattctaactatgattttgaattatcggtagataacgtttcagcattagatgctttaaaaacagcagataacagctttcatattcttgaaaacaacactccttttaatgcgaaaattatagcttcagattttaattctaaacgttataaagtggacattaataacaccacgtacaccgttcaaataaatgacgaaatagacgatttaattaaagaaatgggatttgaaattggcgcttcaaaaacagttaacgacattaaagctcctatgccaggacttattttatctattgctgttaccgaaggtcaagaggttaaagaaaatgatccgctataa

SEQ ID NO: 24346 - protein, 120 aa, Unknown
  Obtained from environmental sample
  misc_feature (1)..(120): Xaa is any amino acid
MSKTYKTNVNSNYDFELSVDNVSALDALKTADNSFHILENNTPFNAKIIASDFNSKRYKVDINNTTYTVQINDEIDDLIKEMGFEIGASKTVNDIKAPMPGLILSIAVTEGQEVKENDPL

SEQ ID NO: 24347 - DNA, 852 bp, Unknown
  Obtained from environmental sample
  misc_feature (1)..(852): n is a, c, g, or t
atgaatccatcggcgtatgaacacgcatatattggagatgaacgttttcactcccctggaaattttgatgatcttatagtagcccttgttgaaagatttccgaaggaggagaaaaacataaaaaaatatttaaatctggttagaaaagtaagtgaagaactgcaattacttcctaatgtggaagggttttggcaacatcttactattccttaccggaccaagcatatgggtaagtatgcgcttttcagtctgaaaagggttatagattggcacattgaagatccgctactaaaaaaaattcttaacattcagtttggggatcatggactagcacctgcaaaagccagttttccattgcattgcgctgttatggatcattattttaacggagggttttatccttgtggtggcggtggtgctattgtaaaagctatgaccacggctataaaaaagaatggaggagatgtaaaaacaaaacagaccgttaaaagaattttactggaagggaaaaataaaaaaacagccataggtgtagaaatggagagcggggagaagttgtttgcaaaaaggataatatcaaattcagaccctaatattacgtatctcaatttagtgggagaagaaaatttgagtagtaaactgaataagaaattaaagaaaacaaaatattcctgtacttcactaatgctctttctaactgttgatatggatttgaaagctgcaggaatcgactctgggaatatctggttgatgcctaacgaagatatggacaaggtatatgaaaggatgatgattccagatataaccaatgacgatgcattagacggaatgtttattagttgcactacataa

SEQ ID NO: 24348 - protein, 283 aa, Unknown
  Obtained from environmental sample
  misc_feature (1)..(283): Xaa is any amino acid
MNPSAYEHAYIGDERFHSPGNFDDLIVALVERFPKEEKNIKKYLNLVRKVSEELQLLPNVEGFWQHLTIPYRTKHMGKYALFSLKRVIDWHIEDPLLKKILNIQFGDHGLAPAKASFPLHCAVMDHYFNGGFYPCGGGGAIVKAMTTAIKKNGGDVKTKQTVKRILLEGKNKKTAIGVEMESGEKLFAKRIISNSDPNITYLNLVGEENLSSKLNKKLKKTKYSCTSLMLFLTVDMDLKAAGIDSGNIWLMPNEDMDKVYERMMIPDITNDDALDGMFISCTT

SEQ ID NO: 24349 - DNA, 336 bp, Unknown
  Obtained from environmental sample
  misc_feature (1)..(336): n is a, c, g, or t
ttgcagtatacaagtgtgggaacacataaagacgatttactttttaatattgatggtcatcctattaaaaaatttgggagtcaaggtcagcaaaaatcttttttaattgcgttaaaattggcgcaatttcagtttataaaaaagcaaagtggtggaattcctattttgctattggatgatatttttgataaattagatgaagaacgcgtatcgcaaattataaaattggtgaacgacgaaaattttggtcagatttttataagtgatacacacgccgaacgtaccgaacgcgctgtaaaacaagtgcatcaatcgtacgaaatttttaatatttaa

SEQ ID NO: 24350 - protein, 111 aa, Unknown
  Obtained from environmental sample
  misc_feature (1)..(111): Xaa is any amino acid
MQYTSVGTHKDDLLFNIDGHPIKKFGSQGQQKSFLIALKLAQFQFIKKQSGGIPILLLDDIFDKLDEERVSQIIKLVNDENFGQIFISDTHAERTERAVKQVHQSYEIFNI

SEQ ID NO: 24351 - DNA, 492 bp, Unknown
  Obtained from environmental sample
  misc_feature (1)..(492): n is a, c, g, or t
atgatattaaaatccctttctttactaaattataaaaactttgactccaaaacatttaactttaatgacaccataaactgcatcgtgggtaacaatggcgtcggaaaaacaaatattttagatgccatttatcacctctcttttggtaaaagttattttaaccctatcgcttcgcaaaacattaaacacgatgaagatttttttgttataaatggcgattatgaaaaagaagaaaaaacagagaaaattgtaattagcttaaaaaaaggacaaaaaaaggttattaaacgcaatagtaagtcttacgaaaaattagtgatcacattggttttttaccatagtcattatttctcctgcgatcgcgatttaattatgaaagtagcgatacaagaagaaattatagatagtggtatttcgcaaatgataacattatttaaatacgttataatacataaattttgcgcacgtaatcgctttaaaaatttgctctaa

SEQ ID NO: 24352 - protein, 163 aa, Unknown
  Obtained from environmental sample
  DOMAIN (1)...(138): RecF/RecN/SMC N terminal domain
  misc_feature (1)..(163): Xaa is any amino acid
MILKSLSLLNYKNFDSKTFNFNDTINCIVGNNGVGKTNILDAIYHLSFGKSYFNPIASQNIKHDEDFFVINGDYEKEEKTEKIVISLKKGQKKVIKRNSKSYEKLVITLVFYHSHYFSCDRDLIMKVAIQEEIIDSGISQMITLFKYVIIHKFCARNRFKNLL

SEQ ID NO: 24353 - DNA, 708 bp, Unknown
  Obtained from environmental sample
  misc_feature (1)..(708): n is a, c, g, or t
atggaggttggagcttctttaaccgctgctattattgttcaggggaaactctggggtcttatagcctgccatcattattcggcgaagtttatcaattattttcagcgggaaacctgtaaatttttatcgcaggttttttctaataatattgcctcgatacaaacgggtattttcaataaaaaattaaaggagaattctgaattaagaactaagattttagccgatctaaaaattgaaaacacagtaggtgacgaacttgagaatgctgaaattccttttacttcccttatagaaagtgggggaggcgcagtggtttttgatgatgaaatcaaactttttgggaacacaccaactgaagctgaggtattggatttaagtaatttccttgctgaacatgaagaggttattttctataccaaaaatctaaaaaaatcttatccggtagccgaaaattataaaagatcggcttcaggtattttaagttttaaattgggacgggcaaaaaataattttataatctggtttaggcctggagtagccgaaactgtgagttggggtgggaatcccaataaaaaggtctcctacaacgaagaaaaacaacgattaagtccgcggaaatcttttaaaaaatggacagataaactggatggaatttcgaattcctggctggattatgaaattgaactgcaaagcattcgggagatttaa

SEQ ID NO: 24354 - protein, 235 aa, Unknown
  Obtained from environmental sample
  DOMAIN (68)...(234): Phytochrome region
  misc_feature (1)..(235): Xaa is any amino acid
MEVGASLTAAIIVQGKLWGLIACHHYSAKFINYFQRETCKFLSQVFSNNIASIQTGIFNKKLKENSELRTKILADLKIENTVGDELENAEIPFTSLIESGGGAVVFDDEIKLFGNTPTEAEVLDLSNFLAEHEEVIFYTKNLKKSYPVAENYKRSASGILSFKLGRAKNNFIIWFRPGVAETVSWGGNPNKKVSYNEEKQRLSPRKSFKKWTDKLDGISNSWLDYEIELQSIREI

SEQ ID NO: 24355 - DNA, 354 bp, Unknown
  Obtained from environmental sample
  misc_feature (1)..(354): n is a, c, g, or t
gtgtacctaaaagagaaaaatgacccattattctttgaactctttaaaatccaaaaaaattcaaataaaattgaacatattaatgttgaaaaaagtatgcggtatcaacatgagaaattacttttaccaactttagatttattagacaaagctcattcagaacataaagagtttgatgacaaactcggaaatttatgggttttaacaaatcaaacaatccatcttttcaataatctaaagcaagcctctaatcaaataaaaatcatgctaactcagcaaaatgaatttgtaaaaaatcaaattgacttattagaaaaagccagtcaaaaaataaggaataaatttctagattga

SEQ ID NO: 24356 - protein, 117 aa, Unknown
  Obtained from environmental sample
  misc_feature (1)..(117): Xaa is any amino acid
MYLKEKNDPLFFELFKIQKNSNKIEHINVEKSMRYQHEKLLLPTLDLLDKAHSEHKEFDDKLGNLWVLTNQTIHLFNNLKQASNQIKIMLTQQNEFVKNQIDLLEKASQKIRNKFLD

SEQ ID NO: 24357 - DNA, 840 bp, Unknown
  Obtained from environmental sample
  misc_feature (1)..(840): n is a, c, g, or t
gtggctttattaaatagaattacgcattatattgtgaaccgaaaggggaaacaaatgcgaccaatgtttgtatttttggtagcgaaaatggtatctaaaggagaggttaaagatcgtacttatcgtggcgcatcggttatagaacttattcatactgcgacattggttcatgatgatgtggtggacgatagtaattaccgtcgtggttttttctcagtaaatgcgctttggaaaaataaaatcgccgtacttattggtgattttttattgtctaaaggcttgttgctttctatagataataatgatttcgatttgctaaagattatttcggtggctgttagagaaatgagcgaaggggaactccttcaaattgaaaaagctagaaaactagacatcactgaagctgtttattacgaaattattcgtcaaaaaacagcaaccttaatcgctgcttgttgtagtttaggagctgcttctgtgaaaccagagtcttcagatgtagaaactatgcgaaaatttggagagcttattggaatggcatttcagataaaagatgatttgttcgattacggttctactgcaatcggtaaacccgttggtatagatataaaggaacaaaaaatgacattgcctcttatatacgtccttaatacgtgtactaaaaaagagaagaaatggttaattaattccattaaaaaccataataaagataaaaaacgcgttaatgaagttatcgattttgtaaaagcaaacggtggtttagaatatgctgtaagcaaaatgaaatcctttcaaccgaagcgcttcaattctcgaccaatatccagattcagaatttaa

SEQ ID NO: 24358 - protein, 279 aa, Unknown
  Obtained from environmental sample
  DOMAIN (3)...(258): Polyprenyl synthetase
  misc_feature (1)..(279): Xaa is any amino acid
MALLNRITHYIVNRKGKQMRPMFVFLVAKMVSKGEVKDRTYRGASVIELIHTATLVHDDVVDDSNYRRGFFSVNALWKNKIAVLIGDFLLSKGLLLSIDNNDFDLLKIISVAVREMSEGELLQIEKARKLDITEAVYYEIIRQKTATLIAACCSLGAASVKPESSDVETMRKFGELIGMAFQIKDDLFDYGSTAIGKPVGIDIKEQKMTLPLIYVLNTCTKKEKKWLINSIKNHNKDKKRVNEVIDFVKANGGLEYAVSKMKSFQPKRFNSRPISRFRI

SEQ ID NO: 24359 - DNA, 333 bp, Unknown
  Obtained from environmental sample
  misc_feature (1)..(333): n is a, c, g, or t
atgaaaaaattaatacatctagcattaatcattttaattagtgttagtttttcttgtcagaaaaaaaacgaaaaaacaacgacttctgaagttgtaaccaaagttaaaaacgatatccagcgtatagaacctccacattggtggataggttttaatactacacaagtacaattgttggtgaagcatcctaacatttcggaagcaacacctagtataaattatgcaggagtttctattgaaaaagtgcataacgcagatagtcctaattatctgtttttagatcttaatatttcagaaagtgctaaagaaggacaatttcatattttcatttaa

SEQ ID NO: 24360 - protein, 110 aa, Unknown
  Obtained from environmental sample
  SIGNAL (1)...(18)
  misc_feature (1)..(110): Xaa is any amino acid
MKKLIHLALIILISVSFSCQKKNEKTTTSEVVTKVKNDIQRIEPPHWWIGFNTTQVQLLVKHPNISEATPSINYAGVSIEKVHNADSPNYLFLDLNISESAKEGQFHIFI

SEQ ID NO: 24361 - DNA, 591 bp, Unknown
  Obtained from environmental sample
  misc_feature (1)..(591): n is a, c, g, or t
ttgttttcagatatgattaaaaagaaaaaaaatacaaataaacttaaagataaacttacttttaagtaccgatttgtggtacttaatgaagaaacatttgaagaacggttttcattcaaattaaatagattaaatgtgattattttaggaagtatttttgtttttttattagttggtcttacagcttttataatggcgtttactccattacgagaatatattcctggctattcttcttcagcgttgaaaaagagggcttcagatttagtttataaaatagattcccttcaacaacaattagaagttaacgatatatatattcaaaacattcaacaagtattaacaggtaaaataaaggatatttcttttaataaagattctattattgaacagctccgaatcgaagatgctgactttgcatcaacacccgtggattcttcttttagagatgaagttgaacgtgaagacagatatagtctttttgaaaaagcaacaaaaaaactgatattgttttctttgcacctatttccgggaaaagtacagatacttataancctaaagaaaacattttgctatagatatagccgttga

SEQ ID NO: 24362 - protein, 196 aa, Unknown
  Obtained from environmental sample
  misc_feature (1)..(196): Xaa is any amino acid
MFSDMIKKKKNTNKLKDKLTFKYRFVVLNEETFEERFSFKLNRLNVIILGSIFVFLLVGLTAFIMAFTPLREYIPGYSSSALKKRASDLVYKIDSLQQQLEVNDIYIQNIQQVLTGKIKDISFNKDSIIEQLRIEDADFASTPVDSSFRDEVEREDRYSLFEKATKKLILFSLHLFPGKVQILIXLKKTFCYRYSR

SEQ ID NO: 24363 - DNA, 324 bp, Unknown
  Obtained from environmental sample
  misc_feature (1)..(324): n is a, c, g, or t
atgataaatgagttcaccgtagcccctcaatctagtccggatagtggtttaccatttcatgaatggtttattgagtttgaaaaaataccgaataatatagttgatttagcaattgaaattgataatgctatgcagcaacaaaattcttattattttgatctaattaaaggtaagatattaaagccacttgtaataacggtaatgaaaaaaggggggtttcaaaattatatgaaatctgttggcaaactgggagggcaaaataaagtaccacgattatctaatgatcgaaaaattgcagacactttaaaaaaatggaccttatga

SEQ ID NO: 24364 - protein, 107 aa, Unknown
  Obtained from environmental sample
  misc_feature (1)..(107): Xaa is any amino acid
MINEFTVAPQSSPDSGLPFHEWFIEFEKIPNNIVDLAIEIDNAMQQQNSYYFDLIKGKILKPLVITVMKKGGFQNYMKSVGKLGGQNKVPRLSNDRKIADTLKKWTL

SEQ ID NO: 24365 - DNA, 621 bp, Unknown
  Obtained from environmental sample
  misc_feature (1)..(621): n is a, c, g, or t
gtggttaatcttacaggtataaatagcaagatgcttaaaaatgcgcctaaattttacgagatagctaagcgaatcgttgaaattacagaagacactattttggtggctcacaatgcgcaatttgattatcgtatcttaaaaaccgagtttaaacgtcttggatttccttttaaaagacaaaccctttgtacggttgagttgtctaaagatttaattcctgatcaaaaatcttacagtttaggtaaactagttagatcattgggtatacctgtaacagataggcatcgtgcatctggagatgctttagcaaccgttaaactttttaaattacttcttgccaaggacaccaacaaaacaattattaaggagtctattaaaaaagaaccaaaattccagatggagcctaggttaatagatattattgataatttaacctctgttactggagtttactacatgtacaaagcagatggtgagttaatctatattggaaaaagtaagaacataaaaaatcgcgttaatcaacattttactggtactacaccaaagtccaagaaaatgcaaactcaagtagcagctgtaaaatatgaagctacaggaagtgaattagtggcgctttaa

SEQ ID NO: 24366 - protein, 206 aa, Unknown
  Obtained from environmental sample
  DOMAIN (1)...(108): Exonuclease
  misc_feature (1)..(206): Xaa is any amino acid
MVNLTGINSKMLKNAPKFYEIAKRIVEITEDTILVAHNAQFDYRILKTEFKRLGFPFKRQTLCTVELSKDLIPDQKSYSLGKLVRSLGIPVTDRHRASGDALATVKLFKLLLAKDTNKTIIKESIKKEPKFQMEPRLIDIIDNLTSVTGVYYMYKADGELIYIGKSKNIKNRVNQHFTGTTPKSKKMQTQVAAVKYEATGSELVAL

SEQ ID NO: 24367 - DNA, 603 bp, Unknown
  Obtained from environmental sample
  misc_feature (1)..(603): n is a, c, g, or t
atgaatatgaagattttgttatccatattatcgctgtttcttttgtttaattgcgtcaataaaactgaacgtatttcagaaacattaggaattaaaaaaattgatacaataatgtattcatacaaacatcatcatggttatatgaaactcatgctttttagtaataaagagtttttgtttatcaatcaagttcatccagaactgggttattctaaaactactggcacttacaccaaagaaagcaacgctttaaatttgaaaccttttttatgtatagaatgtaaactattagatcgtcataatgtttataaatttgtttgtgatacaataaatttttctaatattgagcatcaagttaaaaccgaatatttcgtatttaattggaaaaatcacaattatcttttatctgaagaaccagatcaattttatgatccggataatgatgaaaatgattttaatagatttattaatgactatcatgccaaaattaagccagaaaatcataatagatatttagtttccgaaactgaaaaaatcactaataatttgctacctatagattcctttcctgaaaaatataagcatctgatattaaaaaaatga

SEQ ID NO: 24368 - protein, 200 aa, Unknown
  Obtained from environmental sample
  SIGNAL (1)...(20)
  misc_feature (1)..(200): Xaa is any amino acid
MNMKILLSILSLFLLFNCVNKTERISETLGIKKIDTIMYSYKHHHGYMKLMLFSNKEFLFINQVHPELGYSKTTGTYTKESNALNLKPFLCIECKLLDRHNVYKFVCDTINFSNIEHQVKTEYFVFNWKNHNYLLSEEPDQFYDPDNDENDFNRFINDYHAKIKPENHNRYLVSETEKITNNLLPIDSFPEKYKHLILKK

SEQ ID NO: 24369 - DNA, 612 bp, Unknown
  Obtained from environmental sample
  misc_feature (1)..(612): n is a, c, g, or t
atgggtgaattttcaaaaatagaaatcaaaatattagaccgtttaacagaagttgtagatggtagattagaatcaattggctatgacaatagcgaaaaagatagaatgctttattctacctgtattaatgatatagaaaaagacaaattaactaaaaaggaaataaagaaacttcaaaagaagatagctaaatgcaactcaaatattgctggatatatttcagcttttctaaataaatatgaactagaacatcacgacggagatttttatagttaccgagaacgtatttgcaggaatttcataagcaattattatgaaggcattgaacaacttgcagaggaatatctaacagctgaaaaagtagagcaggaaaatgaattttattttgaggcagtttttaatgatgaactttatagttttgataataaggagattgatgagtttattaagtatatggctttagctgaacgactttcaaagtttataagcatttttagatcggtagaagaagaaaagaaaaagcctaaagggaaggttattattgataaaatgaaggctaccgctaaagaaagagatctaaaaaaactaaagatggattatctgatgccctag

SEQ ID NO: 24370 - protein, 203 aa, Unknown
  Obtained from environmental sample
  misc_feature (1)..(203): Xaa is any amino acid
MGEFSKIEIKILDRLTEVVDGRLESIGYDNSEKDRMLYSTCINDIEKDKLTKKEIKKLQKKIAKCNSNIAGYISAFLNKYELEHHDGDFYSYRERICRNFISNYYEGIEQLAEEYLTAEKVEQENEFYFEAVFNDELYSFDNKEIDEFIKYMALAERLSKFISIFRSVEEEKKKPKGKVIIDKMKATAKERDLKKLKMDYLMP

SEQ ID NO: 24371 - DNA, 747 bp, Unknown
  Obtained from environmental sample
  misc_feature (1)..(747): n is a, c, g, or t
atgaaaattttaaagatagaattacaaaatataaattccttaaaatctgattcaccaattgtaatcgattttgaaaatgagcattttaaagatgttggtttgtatgcaattactggttctacaggtgcaggaaaaacaactattttagatgccattacaattgcattatatcatagtgtgcctcgttttaacagcacaaaagctactttgcttgatgttgtaagttatggtgcaactgaggcttttacaagagtaacttttgaaaatgaaaagaatgtatttgaagctttctggggaattcgtttggcttccaataaaggaaaaatcttaaaaaatccacaagaggaagtgagtttaaaaaacttaacaacttcaaaaaatttagcttttcaaaagaaaaattttatcaaaaatatcattcgagttacacaattagattatgatcaatttttaagatctgtattgttagctcaaggtgagtttgcttcttttttaactgctaaaggtccagagaaaggtagattgttagaacaaattactggagagaaaatttataaaaaaattggtttagcgatttcagaaagaaaatctaatgaagaaaatgctttaaaagaaattcaatctaagattaatgctgatgatattttatccgaagaaagaaagcaggaacttgtaaaaaaagacaaagaacttgatgctgaacttataaaatctgataaagaaatagagagtattcagttgatgtga

SEQ ID NO: 24372 - protein, 248 aa, Unknown
  Obtained from environmental sample
  DOMAIN (1)...(182): RecF/RecN/SMC N terminal domain
  misc_feature (1)..(248): Xaa is any amino acid
MKILKIELQNINSLKSDSPIVIDFENEHFKDVGLYAITGSTGAGKTTILDAITIALYHSVPRFNSTKATLLDVVSYGATEAFTRVTFENEKNVFEAFWGIRLASNKGKILKNPQEEVSLKNLTTSKNLAFQKKNFIKNIIRVTQLDYDQFLRSVLLAQGEFASFLTAKGPEKGRLLEQITGEKIYKKIGLAISERKSNEENALKEIQSKINADDILSEERKQELVKKDKELDAELIKSDKEIESIQLM

SEQ ID NO: 24373 - DNA, 609 bp, Unknown
  Obtained from environmental sample
  misc_feature (1)..(609): n is a, c, g, or t
atgagcctttttagaaaattatttagttctaaatctcaagtagaaaaggaggatctaaagtccgacgacagaggcaaatatatgcctaaagaagagctacctattgacgaaagttttactataaactttaaagaaaatggtggtaaattcctgtattgtgactctttagacgaagtttacgacaacttaaataatataatactagaaaataactgggaagatcattctgcttatttttatgacaataacttgaaagataaatttaaatcttctcaacttaaaatcagtgacaaactatcagaatgcacttattttataaccacttgcgaaaacctaatagctaatgatggctctttattggttagctctaaccagctagctgaaaaaaaacttaacgaattccctaataacgttatagtgtttgcaactacaagtcaaataatatcaaacataggcgaaggattaagagaaataaagcataagaatagtgtaaaaatacctactaacatcacaactattaaacattttaagctacaagaggaaaaagactttttatcttacggaagcagtacanaaaacttatatttgctgcttttagaagacctttag

SEQ ID NO: 24374 - protein, 202 aa, Unknown
  Obtained from environmental sample
  misc_feature (1)..(202): Xaa is any amino acid
MSLFRKLFSSKSQVEKEDLKSDDRGKYMPKEELPIDESFTINFKENGGKFLYCDSLDEVYDNLNNIILENNWEDHSAYFYDNNLKDKFKSSQLKISDKLSECTYFITTCENLIANDGSLLVSSNQLAEKKLNEFPNNVIVFATTSQIISNIGEGLREIKHKNSVKIPTNITTIKHFKLQEEKDFLSYGSSTXNLYLLLLEDL

SEQ ID NO: 24375 - DNA, 519 bp, Unknown; identical to SEQ ID NO: 21101
  Obtained from environmental sample
  misc_feature (1)..(519): n is a, c, g, or t

SEQ ID NO: 24376 - protein, 172 aa, Unknown; identical to SEQ ID NO: 21102
  Obtained from environmental sample
  misc_feature (1)..(172): Xaa is any amino acid

SEQ ID NO: 24377 - DNA, 870 bp, Unknown
  Obtained from environmental sample
  misc_feature (1)..(870): n is a, c, g, or t
atgggtaaaatatatgcatccaaagtatcaaagacgaatattttttccggatttatggagcaaacaagaattacaagattggggcaaaaatgtttaatattactagcttttgctttagtaataattagttgtaaaaaagaagataaaacaccaatagatactgtttcggttattgaacctgaagaggtttatgagtttggttttaaacttaacgattatgttgttaagcgtgataccattagaaaaggtgatagctttggcgaaatcctgcaacgcaaccagatagattattctaaaatatttcaaatagcacaacaaacaaaggatagttttgatattacacgattacaaattggtaaaccttacaccttgttgtgttcaaacgattcgcttcaacaaccaaaatgttttatatatcaacctactaaaacggactatgttgtaatcaattttcaagattcaattcatgcctattcaagtactaagcctataaaatttgtagaaaaagaagtctcaggtgttatcgagtctaatatttctgaagcttttgcaaagcaaggtaaaagtgtattattagcttataaaatgtctgatatttatgcttggacgattgacttttttagacttcaaaaaaacgataaattcagattaatttataccgaaaaatatatcgatgacagtatttatgctggaattgataatattaaggcagcatactttcagcacaacggagaagatttttatgcattcgaattcgaaacagatacagttaaagggcttaaagattattttaccgaagacgcaaaaaacttaagacgtgcctttttaaaagcacctgttgagtataaacgattctccagccggcgataa

SEQ ID NO: 24378 - protein, 289 aa, Unknown
  Obtained from environmental sample
  misc_feature (1)..(289): Xaa is any amino acid
MGKIYASKVSKTNIFSGFMEQTRITRLGQKCLILLAFALVIISCKKEDKTPIDTVSVIEPEEVYEFGFKLNDYVVKRDTIRKGDSFGEILQRNQIDYSKIFQIAQQTKDSFDITRLQIGKPYTLLCSNDSLQQPKCFIYQPTKTDYVVINFQDSIHAYSSTKPIKFVEKEVSGVIESNISEAFAKQGKSVLLAYKMSDIYAWTIDFFRLQKNDKFRLIYTEKYIDDSIYAGIDNIKAAYFQHNGEDFYAFEFETDTVKGLKDYFTEDAKNLRRAFLKAPVEYKRFSSRR

SEQ ID NO: 24379 - DNA, 807 bp, Unknown
  Obtained from environmental sample
  misc_feature (1)..(807): n is a, c, g, or t
atggataaaaaactacaaatcgatttactaagaacacctaaacacgtagccattattatggatggtaatggacgatgggcaaaaggtaaaggaatgagtagaatttttggccacagaaatgccctaactgctgttagagaatctgtaaaagcagcctctcaagtaaatgtagaagcgattactttatacgctttttctaccgaaaattggaacagacccaaattagaagtagatgctttaatgagtcttttaataaactcattaaaaaaagaattaccagaatttatgaaggaaggcgtaaaagtgaactccattggttctatagaaacacttcctaaaaaagcacaaaaagttttaaatgatgtaattcttgaaacaaaaaacaatacagaaattgtattaacttttgctttaagttatggctcaagagaagaaattgttaacgcaatcaaaaacatatctaaaaaagttgttaataaagagctcgatttagaaaaaatagatgaaaatactataaataaccatttatatacatttaatttgcccgatgttgatttgatgataagaactagtggagaacaacgcattagtaattttctattatggcaaatggcatatgctgaattatattttacagatatactttggccagattttagacaagaacatttctatgatgccatcatagattatcagaatagagaaagacgatttggaaaaactagcgaacaactttacagagtaaacttacatgaaattattttctgccacatttatagtgttttttacactattttttactcatag

SEQ ID NO: 24380 - protein, 268 aa, Unknown
  Obtained from environmental sample
  DOMAIN (19)...(240): Putative undecaprenyl diphosphate synthase
  misc_feature (1)..(268): Xaa is any amino acid
MDKKLQIDLLRTPKHVAIIMDGNGRWAKGKGMSRIFGHRNALTAVRESVKAASQVNVEAITLYAFSTENWNRPKLEVDALMSLLINSLKKELPEFMKEGVKVNSIGSIETLPKKAQKVLNDVILETKNNTEIVLTFALSYGSREEIVNAIKNISKKVVNKELDLEKIDENTINNHLYTFNLPDVDLMIRTSGEQRISNFLLWQMAYAELYFTDILWPDFRQEHFYDAIIDYQNRERRFGKTSEQLYRVNLHEIIFCHIYSVFYTIFYS

SEQ ID NO: 24381 - DNA, 561 bp, Unknown
  Obtained from environmental sample
  misc_feature (1)..(561): n is a, c, g, or t
atgagtgaacaatcaataatattagccaaagtagcagctttgaaaaagagttttgaaagtattgaatatggctatggacaaagatgcattgggagtagtattgaacctttgctacctcgatacgaaactctaattaataaattagaaacccaatttgacggattatttgatgatttgccgaatttacctttacccaaatcattaggtaatagcggaaatgatagtttatatcanagagatggaattacacccttaataaataatctcgattatgttttggaggtttattcaaatatgcgaattggagaaaaaactgaaaaaacaaaaaaagctaatagagtttttataagtcacggaagaagtgaggaatggagaaagctttcagcttatttagaaaaagacctcgaaacatatactctggaattagcacaagaagcgnatttagggagaaacgatttacaaaaattatcgnaagaagcacagaaatgttctgtggctgtaatcgtaatgactggggatgatatacagaagaacgagaaaatagagcgagagaaaatgtaa

SEQ ID NO: 24382 - protein, 186 aa, Unknown
  Obtained from environmental sample
  misc_feature (1)..(186): Xaa is any amino acid
MSEQSIILAKVAALKKSFESIEYGYGQRCIGSSIEPLLPRYETLINKLETQFDGLFDDLPNLPLPKSLGNSGNDSLYXRDGITPLINNLDYVLEVYSNMRIGEKTEKTKKANRVFISHGRSEEWRKLSAYLEKDLETYTLELAQEAXLGRNDLQKLSXEAQKCSVAVIVMTGDDIQKNEKIEREKM

SEQ ID NO: 24383 - DNA, 684 bp, Unknown
  Obtained from environmental sample
  misc_feature (1)..(684): n is a, c, g, or t
gtgcctgcaaaggaggctagaataggtgttgtgnataaaatatttacacgtgtaggtgcaagtgatacatatcaatggggagaatctacgtttatggtagagatgaatgaaaccgcatcgatcttaaataatatctcagatcgtagtttagtcttgttggatgaaattggaagagggaccagtacctatgacggaatctctattgcttgggctattagtgagtatttacacgagcatccagcaaaacctaaaacgttatttgcaacccactatcatgagttaaatgaaatgacagagacctttgagcgtattaaaaactataatgtctctgtaaaggagttaaaagacaatgtgctatttctgcgtaagcttgttcaaggtggtagcgaacatagttttggtatacatgtagcaaaaatggctggaatgccacaacaagtgctaagacgcgctaatcagatcttgaaaaaactggaaaaaagtcattcaagcgaagaattgacagataaagtaaaatcgatgcaagatgaaatgcaattaagcttctttaatttggacgatccattgcttgaaaatataaaagaagagatcttacatatcgatattgacaccttaacacctgttgaagctttaatgaagctaaatgagatcaaacgtatgttggtgaaaaagaagcaagtataa

SEQ ID NO: 24384 - protein, 227 aa, Unknown
  Obtained from environmental sample
  DOMAIN (1)...(161): MutS domain V
  misc_feature (1)..(227): Xaa is any amino acid
MPAKEARIGVVXKIFTRVGASDTYQWGESTFMVEMNETASILNNISDRSLVLLDEIGRGTSTYDGISIAWAISEYLHEHPAKPKTLFATHYHELNEMTETFERIKNYNVSVKELKDNVLFLRKLVQGGSEHSFGIHVAKMAGMPQQVLRRANQILKKLEKSHSSEELTDKVKSMQDEMQLSFFNLDDPLLENIKEEILHIDIDTLTPVEALMKLNEIKRMLVKKKQV

SEQ ID NO: 24385 - DNA, 756 bp, Unknown
  Obtained from environmental sample
  misc_feature (1)..(756): n is a, c, g, or t
gtgttacaatccaaaacaaataactttttatgttcggtttactttggtaaggttaatattgggatttcgtttttggatatatctacaggagagtttttaacctcacaaggaaatcaagagtatatagataagctacttcaaaattttagtccaagtgaagttttagttgcaaaaccaaagcgtaatacatttacagatcattttggagccgattttcacacgtttaatcttgaagattgggtctatcaatcagattatgcaaatgagacattgttaaaacattttgatactaagtccttaaaaggatttggagttgaaaatttaaatgaaggtattatagcttcaggttctatacttcattatttagccgaaacacagcataacaaactagagcatatctcttcaatttcgcgtatagcagaggatgactatgtatggatggaccgttttaccatccgaaacctcgagctatacaactctacaaacaacaatgcagtcacgttattaaatattattgataaaactatttctccaatgggaggacgattgcttaaacgttggctagcattgcctttaaagcaaatagatcaaatcaagcaacgtcacgaagtggtgtattatttaaaaacagatggtgttgtattggacaagattcagcatcatataaagttaataggcgatttagagcgattaatatctaaaatagcaacacanaaggttagtcctagagaggttattcaacttaaaattctttag

SEQ ID NO: 24386 - protein, 251 aa, Unknown
  Obtained from environmental sample
  DOMAIN (142)...(251): MutS domain III
  misc_feature (1)..(251): Xaa is any amino acid
MLQSKTNNFLCSVYFGKVNIGISFLDISTGEFLTSQGNQEYIDKLLQNFSPSEVLVAKPKRNTFTDHFGADFHTFNLEDWVYQSDYANETLLKHFDTKSLKGFGVENLNEGIIASGSILHYLAETQHNKLEHISSISRIAEDDYVWMDRFTIRNLELYNSTNNNAVTLLNIIDKTISPMGGRLLKRWLALPLKQIDQIKQRHEVVYYLKTDGVVLDKIQHHIKLIGDLERLISKIATXKVSPREVIQLKIL

SEQ ID NO: 24387 - DNA, 960 bp, Unknown
  Obtained from environmental sample
  misc_feature (1)..(960): n is a, c, g, or t
atggctgaagaagtaaagaaaaaagaagagtcttatgagtctttagtagagcaagctacagatgctatcctgacctacacttatgatggagtcattcataactttaataaagcaacctacacaacactaggatatacaaaaaaggagtttttaaaattaaaaattcaagattttataattggagatgttattcaaaatgacgtaacccgtgacgctatacttaaaggtgaagctgttgtctttgatagacaactagtgtgtaaagaccaaacaataatagacgttgaggtttcggcaaaacttcaaaaggatggtaaagttctagctatagtgcgtgatgtttcagaacgtaaaaaagcagaagctaaattattagaaagcgaatataatttaagacaatcccaaatagttgcaaatctaggatcatatgctgtggatctaacaacaatgacttgggattgtactgagttgttatatcaaattttaggaatagatgaatccttcgttagaacaatagatagttgggttgatcttattcatactgaagacaaaataaacgttttaaattattttgatagctgtgtaaaaaacaatacacgatttaataaagagtatcgtgttattcaatataattctaaaaaagaaatttgggtacatggtattggtgaattgttatttgatgacaagtctaaccctatcaaaatgatagggactatgcaaaatattacaaatcgaaaaaaagtagaattaaaacttcagaaaaatgaaaaatcattactagaagctcaaaaaatagctaanataggaagttactttctagatttagaaaccagtttagctcatgcctncataacctttaaagagattgctgggtttagagaaaaagatactnattctcgaaaaatatggaaagatatcacacacccagaagatgccgaaataaatagtgctgagatttga

SEQ ID NO: 24388 - protein, 319 aa, Unknown
  Obtained from environmental sample
  DOMAIN (202)...(245): PAC motif
  misc_feature (1)..(319): Xaa is any amino acid
MAEEVKKKEESYESLVEQATDAILTYTYDGVIHNFNKATYTTLGYTKKEFLKLKIQDFIIGDVIQNDVTRDAILKGEAVVFDRQLVCKDQTIIDVEVSAKLQKDGKVLAIVRDVSERKKAEAKLLESEYNLRQSQIVANLGSYAVDLTTMTWDCTELLYQILGIDESFVRTIDSWVDLIHTEDKINVLNYFDSCVKNNTRFNKEYRVIQYNSKKEIWVHGIGELLFDDKSNPIKMIGTMQNITNRKKVELKLQKNEKSLLEAQKIAXIGSYFLDLETSLAHAXITFKEIAGFREKDTXSRKIWKDITHPEDAEINSAEI

SEQ ID NO: 24389 - DNA, 315 bp, Unknown
  Obtained from environmental sample
  misc_feature (1)..(315): n is a, c, g, or t
atgctcaagcatatcaatggttatacccacatcccagtcgcctttggcgctgccatcgcggcgttgaataaatggcttaagttttacctcaaaaccaattgcacgcaaaatattttgaaactggctttgtttttcatcccctcggtaaattgcataagcaaacgcacattcaatattatattgctgcgccataactcgccaaaatgcgttgtaatcaaagttttttccgtaactttcacggcaagtgtaataaatattttgtacatcgacaaaaatacctacacggggtttggtattttgcagctcgtgttgtga

SEQ ID NO: 24390 - protein, 104 aa, Unknown
  Obtained from environmental sample
  misc_feature (1)..(104): Xaa is any amino acid
MLKHINGYTHIPVAFGAAIAALNKWLKFYLKTNCTQNILKLALFFIPSVNCISKRTFNIILLRHNSPKCVVIKVFSVTFTASVINILYIDKNTYTGFGILQLVL

SEQ ID NO: 24391 - DNA, 621 bp, Unknown
  Obtained from environmental sample
  misc_feature (1)..(621): n is a, c, g, or t
atgaggccaaatgttgttgtgagtcttcaaccatcaatggttagcattactttttgggatgttatcattcaaaacttgggaaaaggaattgcccaaaatgtaaaatttagctttaagaacacagatggaagtaacgcaacagaacaaaataatcacctagtaaaagtcttcaacaaactttccttattcgagaacgggtgttcttctttgggcttaggacaaactattaaaagttttctacttggttttgttgatctcgaaagggacgttggcaaagataacgtattcaaccagaaaattagattagagatctattttgaagatgctgaaggaacaccttataaaaactctttagatatagatttttccgatattaaaggtatatctacacttggtggagctacagatccaatgtattcagtgtttaaagaaattgaaaagttaagaaaggtatttgaaccagttttcaaatcaggaaataaacgacttgaaatcgattcttataacaccggtgacagagtcattgaacgcgaacagcaactagaaagaaacaaagagttattggctcaaatagaaaaacgtaatagtgtagtggtcaataaaatttggccacagttttag

SEQ ID NO: 24392 - protein, 206 aa, Unknown
  Obtained from environmental sample
  misc_feature (1)..(206): Xaa is any amino acid
MRPNVVVSLQPSMVSITFWDVIIQNLGKGIAQNVKFSFKNTDGSNATEQNNHLVKVFNKLSLFENGCSSLGLGQTIKSFLLGFVDLERDVGKDNVFNQKIRLEIYFEDAEGTPYKNSLDIDFSDIKGISTLGGATDPMYSVFKEIEKLRKVFEPVFKSGNKRLEIDSYNTGDRVIEREQQLERNKELLAQIEKRNSVVVNKIWPQF

SEQ ID NO: 24393 - DNA, 537 bp, Unknown
  Obtained from environmental sample
  misc_feature (1)..(537): n is a, c, g, or t
ttgctgttttcgttcctcaacattttagcaaacaattttaagcctcttattggggcgttagaggaatcattcatgaaatggagtttcttaatcctatttgttttatcatttccatcaagtgcaataataatgagacatgatgtagatgagtctaaatatttagaatttgccaaggataataaatcgatagttaccttttacggaaattataaagataaagaaattgtcgaaggaacagggactctaattgccgaagattgggtaattaccgctgctcatgttgccaattatttgttaattgatggaaaagtcagattcaaagattcttactacaaaataaagaaagttgttaaacatccagactggaaagataagcaatttccaaatgatatcgctcttgtccagttacaatcgactatccctaatagtgaaactgtcgctttatatgacaaagaggatgaacttcataaaactttgacgtttatcggtcgcggggactttggtactggtgaagtaggagtctcgagccgattctga

SEQ ID NO: 24394 - protein, 178 aa, Unknown
  Obtained from environmental sample
  misc_feature (1)..(178): Xaa is any amino acid
MLFSFLNILANNFKPLIGALEESFMKWSFLILFVLSFPSSAIIMRHDVDESKYLEFAKDNKSIVTFYGNYKDKEIVEGTGTLIAEDWVITAAHVANYLLIDGKVRFKDSYYKIKKVVKHPDWKDKQFPNDIALVQLQSTIPNSETVALYDKEDELHKTLTFIGRGDFGTGEVGVSSRF

SEQ ID NO: 24395 - DNA, 888 bp, Unknown
  Obtained from environmental sample
  misc_feature (1)..(888): n is a, c, g, or t
ttgtgctttttaaatgcgccaagtgatgttcctggtagtttaagacgtaaaataaatgggatactaattagtatagtactaaccatgttagtgacgtttattatttttattactaaacctgtttttgtcttattaatagttgctattgcagtgttaagctttgcaattagtttaatatctgtttatggctttagagcctctttaatatcattttctggattattatctattgttttagctttagctataagtaaaccaaatcctgcagcaatttttttacatgttggtttaatgggagttggaggtttatggtatttgtttgtttcactgttttctaaatggattgcacctaaaaaagatgacgaccaattactatcagacaccttagctttaactggtcagtatttaaaaattagaggtaaacttttaactaaatccaataaacgagaaaaatatgctaaaaaagcacttatcctacaaacacaaataagtgaaaagcatgaaactttaagagaactactactggaaggccgaaaacgttctggacgttcctactccaatgagagacgccttttaatttttatatcgcttgttgatatttttgaattagcattagcaaataccttagattattctaaaatagatacgttatttggtcttcaaaaatcatacttaacaccttttaaagatttaaataaagcactaggaaatcaccttattactttatcagaacttttaattaaaaaagaaacacttcctgactttgattccatttctaaaataacagataaaaccaacagtgctattgaagattatgtaacagaaatcaccttaccaaaagctagagaaggtgcaataacactaagaaaccttctcgagccgatctga

SEQ ID NO: 24396 - protein, 295 aa, Unknown
  Obtained from environmental sample
  misc_feature (1)..(295): Xaa is any amino acid
MCFLNAPSDVPGSLRRKINGILISIVLTMLVTFIIFITKPVFVLLIVAIAVLSFAISLISVYGFRASLISFSGLLSIVLALAISKPNPAAIFLHVGLMGVGGLWYLFVSLFSKWIAPKKDDDQLLSDTLALTGQYLKIRGKLLTKSNKREKYAKKALILQTQISEKHETLRELLLEGRKRSGRSYSNERRLLIFISLVDIFELALANTLDYSKIDTLFGLQKSYLTPFKDLNKALGNHLITLSELLIKKETLPDFDSISKITDKTNSAIEDYVTEITLPKAREGAITLRNLLEPI

SEQ ID NO: 24397 - DNA, 327 bp, Unknown
  Obtained from environmental sample
  misc_feature (1)..(327): n is a, c, g, or t
atgaaattaaaaatagtattactaatcctttttgtaagcattactacattggttaatgcacaaaccgaagcttttacaaaaaaatcctacatcaaagataatgataccttaaattaccggttattgctacctaaagatttttcagaggacaaacaataccctgtagttttgtttcttcatggcgcaggagagcgtggcaatgataacacaaaacaactagcacatggtagtaaattgtttttaagtcaagaagctagagactcatttcctgcaatagtgatttttcctcagtgtcccaaaatgactattgggctaatgcagaggtag

SEQ ID NO: 24398 - protein, 108 aa, Unknown
  Obtained from environmental sample
  SIGNAL (1)...(20)
  misc_feature (1)..(108): Xaa is any amino acid
MKLKIVLLILFVSITTLVNAQTEAFTKKSYIKDNDTLNYRLLLPKDFSEDKQYPVVLFLHGAGERGNDNTKQLAHGSKLFLSQEARDSFPAIVIFPQCPKMTIGLMQR

SEQ ID NO: 24399 - DNA, 576 bp, Unknown
  Obtained from environmental sample
  misc_feature (1)..(576): n is a, c, g, or t
atgcaatttatggcagacgtacatttggaatgtgatgtttgtaatggaaaacgtttcaaaaaagaagttttagaagtaaagtttgatggaaaatcaatcgatgatattttaaacctaactatagatgatgctgtagcttttttctctgaaaatttagtgactaaaatcgctaaaaaactaaaaccattgcaagatgttggtttgggttatgttactttggggcaatcttcttccacactttctggtggagaagctcaacgtataaaactcgcatcttttttagtaaaaggaaccacaaaagacaaagccttatttatttttgatgaacccacaactggtttacattttcacgatattcaaaaattactaaaatcttttaatgaattaatcaaaaaaggtcattccattattgttattgagcataatattgaactcattaaatgtgcagattatattatcgatttaggtttagaaggtggtaaaaatggtggaaaccttatttttcaaggaactccagaagaattagctaaaaataaagaatcttatacagctaaatatttggctgagaaattatag

SEQ ID NO: 24400 - protein, 191 aa, Unknown
  Obtained from environmental sample
  DOMAIN (16)...(156): ABC transporter
  misc_feature (1)..(191): Xaa is any amino acid
MQFMADVHLECDVCNGKRFKKEVLEVKFDGKSIDDILNLTIDDAVAFFSENLVTKIAKKLKPLQDVGLGYVTLGQSSSTLSGGEAQRIKLASFLVKGTTKDKALFIFDEPTTGLHFHDIQKLLKSFNELIKKGHSIIVIEHNIELIKCADYIIDLGLEGGKNGGNLIFQGTPEELAKNKESYTAKYLAEKL

SEQ ID NO: 24401 - DNA, 933 bp, Unknown
  Obtained from environmental sample
  misc_feature (1)..(933): n is a, c, g, or t
gtgggttcaatcctaaaacctagaggctgtatatatgatgcttttggaaaagaggttaaaaagtacaaaaaaagagattttttggatgtaagtgtagcagatggtatttcaatttttaatgataatagagccaaacgtatagattatacaccaagcgcttatccatatactattgtttttaacttagaaacagtatcaacaaacactgcatttttaccacaatggtatccaatagaaggctatcacttaagtacagaacaatcttcggtaaaaatcattaataattctgagatacaattaagctataaagaaacaaacttggatagttttaaaattgaaaaaaagtctgaattctactatgaagctaaaaacattcctgctataaactatgaagcttatagtccatcgtttacagaaacagttccctctgttaaatttgcgctaaaacagtttagtatggaaagtgtagaaggcgaaaacaaagattggaatgagtttggaaaatggattaatgataagttaattgcaggaacccaagagttaccagaaacagtaaaattagaaattttaaaccttactgcagacgcaaaaacgcctttagaaaaagccaaaattgtatacaattatatgcaaaacaaaacacgctatataagtgttcaaataggtattggaggttggaagcctatgttggcaagtgacgtagataggttgggttatggagattgcaaaggattgtccaattacactaaggcattgttagatgttgttggtgtgcagtcttattataccattgtttatggagactcagatataagagatatagatacttctttctcatccttacaaggtaatcatgcaattttatccattccagataataatagttatattactctagagtgtacagaatcaaccgttcccgtttggttataa

SEQ ID NO: 24402 - protein, 310 aa, Unknown
  Obtained from environmental sample
  misc_feature (1)..(310): Xaa is any amino acid
MGSILKPRGCIYDAFGKEVKKYKKRDFLDVSVADGISIFNDNRAKRIDYTPSAYPYTIVFNLETVSTNTAFLPQWYPIEGYHLSTEQSSVKIINNSEIQLSYKETNLDSFKIEKKSEFYYEAKNIPAINYEAYSPSFTETVPSVKFALKQFSMESVEGENKDWNEFGKWINDKLIAGTQELPETVKLEILNLTADAKTPLEKAKIVYNYMQNKTRYISVQIGIGGWKPMLASDVDRLGYGDCKGLSNYTKALLDVVGVQSYYTIVYGDSDIRDIDTSFSSLQGNHAILSIPDNNSYITLECTESTVPVWL

SEQ ID NO: 24403 - DNA, 618 bp, Unknown
  Obtained from environmental sample
  misc_feature (1)..(618): n is a, c, g, or t
gtgactaatgcgacggttaatttagatatagcgggaagtattattgctgaaataacatttaaatctaaaggcacgcaatattccaaatatagaaggttagaagcacaaaccgaaaaagaaaatatactagattataaagataattttgatgggattaataatattcaaataactaatttgttatttaataataacaaagataatattgagtttgaagagcaaattgctttaaatgccaaaaactatgctaaaaaagtaggtaacagattattgtttgaacccaatctatttaataaatcaaaaaatatacctccaaaatatgctaatcgtaaattaccgtttaaaattaatagagggtttatagatactgatcaatacacaataatattacctgaaaatttaaaaatagaagcgctacaagaggatgtcactataaaaaataagtttggatcatatcagttttctattacaaaaaataatgaaaacaccttagtgtacaacagaaagttaataataaataaaggagatttcagtaaagaagactataaagcctataggttgtttagagctgaagtagctaagcacgatgcttcaaaaatagtattacaaactatttaa

SEQ ID NO: 24404 - protein, 205 aa, Unknown
  Obtained from environmental sample
  misc_feature (1)..(205): Xaa is any amino acid
MTNATVNLDIAGSIIAEITFKSKGTQYSKYRRLEAQTEKENILDYKDNFDGINNIQITNLLFNNNKDNIEFEEQIALNAKNYAKKVGNRLLFEPNLFNKSKNIPPKYANRKLPFKINRGFIDTDQYTIILPENLKIEALQEDVTIKNKFGSYQFSITKNNENTLVYNRKLIINKGDFSKEDYKAYRLFRAEVAKHDASKIVLQTI

SEQ ID NO: 24405 - DNA, 909 bp, Unknown
  Obtained from environmental sample
  misc_feature (1)..(909): n is a, c, g, or t
gtggatgctaaatttccacttaatgccttaactgttgttacaggagtttctggcagtggtaaaagtacgttggtaaaaaatatattatatcctgctttacaaaaacaattatataaatatgggggaaagcctggacagttcacaagtctaacaggcaattattctaccataaaaaacgttgaatttattgatcaaaatcctattggccgttcaagccggtctaatcctgttacttatattaaagcatatgatgatatcagggctctttttactaatcagaaactctcaaaaattagaggttataaggccaaacatttttcatttaatgttgatggcggcagatgtgaaacatgcaaaggcgaaggtgaagtcactattggtatgcaatttatggcagatgtacacttaatttgtgagacttgcaacggtaaacgatttaaaaaagaaatattagaagttaagtttgaagaaaagtcaattgcaaatatattagaatcgactattgatgaggcaattgcgtttttttcattacacaaacagagaaaaattataaacaaacttcagcctttacaagatgtagggctgggttatgtgcaacttgggcaagcttcttccaccctttcgggaggcgaggcacaacgtattaaattagcgtcttttttagtgaaaggaattacgaaagacaaagtgcttttcatttttgatgagcctacaactggtcttcattttcatgatattaaaaaattattagattcttttaatgccttaattgaaaaagggcatactattattattattgaacataatatagaactaataaaatgtgcagattatattattgatcttggcaaagatggaggtaataatggtggtgaaatattatttncagtttgcctgaagatctggtaa

SEQ ID NO: 24406 - protein, 302 aa, Unknown
  Obtained from environmental sample
  DOMAIN (8)...(283): ABC transporter
  misc_feature (1)..(302): Xaa is any amino acid
MDAKFPLNALTVVTGVSGSGKSTLVKNILYPALQKQLYKYGGKPGQFTSLTGNYSTIKNVEFIDQNPIGRSSRSNPVTYIKAYDDIRALFTNQKLSKIRGYKAKHFSFNVDGGRCETCKGEGEVTIGMQFMADVHLICETCNGKRFKKEILEVKFEEKSIANILESTIDEAIAFFSLHKQRKIINKLQPLQDVGLGYVQLGQASSTLSGGEAQRIKLASFLVKGITKDKVLFIFDEPTTGLHFHDIKKLLDSFNALIEKGHTIIIIEHNIELIKCADYIIDLGKDGGNNGGEILFXVCLKIW

SEQ ID NO: 24407 - DNA, 495 bp, Unknown
  Obtained from environmental sample
  misc_feature (1)..(495): n is a, c, g, or t
atgaggaatactttttatgttaaagaaatgaatgaaaaagtacaatttttaactaatcctgatatcaaaaaagaatatatagtattagtaccaaaggatgaaaatagccccttagcatataattacagaaaactgnaagacgaggaaaaaattcccagagaatatttaatgaataaccaatttgacaaagccttagaaggctatctggctataaaggaaaaagattccttagacagctcaataaatgaagacgatttaaatgatttaggatatagagaactccgaaggaataaatttgaaaatgcaattcatatattaaagattaacgttgcattgtatccaaatagttctaacgtttatgacagtttaggagaagcctatatgaaaagtggagataccatacaagctattaccaattataaaaaatcattaaccttagattcaggtaatgcaagagccaaaagaaatattgatagacttgagaacaaagaatag

SEQ ID NO: 24408 - protein, 164 aa, Unknown
  Obtained from environmental sample
  DOMAIN (117)...(150): TPR Domain
  misc_feature (1)..(164): Xaa is any amino acid
MRNTFYVKEMNEKVQFLTNPDIKKEYIVLVPKDENSPLAYNYRKLXDEEKIPREYLMNNQFDKALEGYLAIKEKDSLDSSINEDDLNDLGYRELRRNKFENAIHILKINVALYPNSSNVYDSLGEAYMKSGDTIQAITNYKKSLTLDSGNARAKRNIDRLENKE

SEQ ID NO: 24409 - DNA, 555 bp, Unknown
  Obtained from environmental sample
  misc_feature (1)..(555): n is a, c, g, or t
atgtatgttttaccgtacaaaaaaaacgaagcacttttcgaatacacacttttttctaaggatttattgccttatgatgaatacaaagcagctatagaaaaatatctgcaagaaaaagaaatcacagattacgaaattgtagaaaaggagcaaggttctatacctatgacaagttatgaattttggaaaatgaattcagaaaatatcatacatattggtacttcaggaggttggagcaaagcaagtacaggttatacttttaagaatatcgataaaaaaacggctgaattaattcatcatttaaaacaagaaaaatctttagaaacgtttcatcaaaaaacaaaattttggttgtatgatttattattgttagatattttagccaagaaaaattatttaggagctactatattttcaaacatgtttaaaaaaatagcgcctcaaaaaatcttcaaattcttggacgaagaaacttcaataatggaagaagttcaaatgttttctaaaatgcagaaaagattattttctacagcattgattaaaagaattctataa

SEQ ID NO: 24410 - protein, 184 aa, Unknown
  Obtained from environmental sample
  misc_feature (1)..(184): Xaa is any amino acid
MYVLPYKKNEALFEYTLFSKDLLPYDEYKAAIEKYLQEKEITDYEIVEKEQGSIPMTSYEFWKMNSENIIHIGTSGGWSKASTGYTFKNIDKKTAELIHHLKQEKSLETFHQKTKFWLYDLLLLDILAKKNYLGATIFSNMFKKIAPQKIFKFLDEETSIMEEVQMFSKMQKRLFSTALIKRIL

SEQ ID NO: 24411 - DNA, 693 bp, Unknown
  Obtained from environmental sample
  misc_feature (1)..(693): n is a, c, g, or t
atgaataataattttccatactcaaaatacaattttaataatcaagatttattatctgggttaacaacagctgaatgcgatagactcacagctaataaagaaatactgaactttaaggcaggcacgcagatatttaaagaaggtacagagcctaaaggtatttatagagtactatcaggaaaagtaaagaaatatactgctaccaattttggtacagaccatatattttatatctgtggagaaaacgaatatcttgggtatcacgctattctaagtgaagaagagtatccagactctgcaactgcattattagattgtgaagtagcatttattcctaaaaatgattttttaaatgtggttagcaaatctcacctattatcgcaacgcttgcttaaaaatttaagtcacgaatttggagtttttttaaatgcaactaaaatattagcacgttacacggttagagaacgcacggcaataaatctattgattttacaaagaaaattcagcgttaaagagagtcttaaagaaattgaaataaacagagaagatcttgcaagtatggtaggtacggcaaaagagtccttggtacgaatgttgaaagattttaaagaagaaaagcttatttctactaagggtagaatcatttttattgaagaccttgaagggcttgtaaaagcaagtaattataaataa

SEQ ID NO: 24412 - protein, 230 aa, Unknown
  Obtained from environmental sample
  DOMAIN (177)...(208): Bacterial regulatory proteins, crp family
  misc_feature (1)..(230): Xaa is any amino acid
MNNNFPYSKYNFNNQDLLSGLTTAECDRLTANKEILNFKAGTQIFKEGTEPKGIYRVLSGKVKKYTATNFGTDHIFYICGENEYLGYHAILSEEEYPDSATALLDCEVAFIPKNDFLNVVSKSHLLSQRLLKNLSHEFGVFLNATKILARYTVRERTAINLLILQRKFSVKESLKEIEINREDLASMVGTAKESLVRMLKDFKEEKLISTKGRIIFIEDLEGLVKASNYK

SEQ ID NO: 24413 - DNA, 636 bp, Unknown
  Obtained from environmental sample
  misc_feature (1)..(636): n is a, c, g, or t
atgccacttcaatccctaactcaaaacaaaacagttatgataattctaattgctccagaacaagacattcctaatgaaattgaaatattaaatcaattatttaaagaaggtttaaaattttatcattttagaaaaccagataaaaattacgcagagcacgttgcgtatttaaataaaattgataaaaaatatcacaatagaattgtagtgcatttttatcacgaattgattaatgatttcaatttaaaaggcattcattttcaggaacaaaaaagaaaggattctttagaaaaaggaattggatattttaatggtttaaaaatgaatggaaaaacaatgagcagttcttttcacgaaccagaagagttaacagcttgtaatttagagttcgattatcatttattgagtcctgttttttcttctatttctaaaaaaggatatgaaggtagaggttttgatgtaaatcatataaataaaacaattgttggtatgggaggaattaattcagaaaccatccaagaaaccatacaattaggttttaaaggaattggtgttttaggtggcgtttggaatgctgaaaaccctgtagagagttttaaagagattgaacagatatacaaaattcataattcataa

SEQ ID NO: 24414 - protein, 211 aa, Unknown
  Obtained from environmental sample
  DOMAIN (11)...(203): Thiamine monophosphate synthase/TENI
  misc_feature (1)..(211): Xaa is any amino acid
MPLQSLTQNKTVMIILIAPEQDIPNEIEILNQLFKEGLKFYHFRKPDKNYAEHVAYLNKIDKKYHNRIVVHFYHELINDFNLKGIHFQEQKRKDSLEKGIGYFNGLKMNGKTMSSSFHEPEELTACNLEFDYHLLSPVFSSISKKGYEGRGFDVNHINKTIVGMGGINSETIQETIQLGFKGIGVLGGVWNAENPVESFKEIEQIYKIHNS

SEQ ID NO: 24415 - DNA, 327 bp, Unknown
  Obtained from environmental sample
  misc_feature (1)..(327): n is a, c, g, or t
ttgtttcctgataaatccatagaagaaactatgaaatttatatcagaaaaaacaaatatttatctaaaaggaggccacagaaaagaaaaaattggttgggatgaagtgtattatagtaaaattgtaaaactgaatatttctccaataaccacaaaacctattttcgaaaaacacggaagtggttgtgttttgtcatctgctttggctgcgaatttaacaaaagatattcctttagaagatgcttgtaaaaatgcaaaattatatacagaacaatttttaagttctaacaaaactttattaggaacacataattatcagaataaatga

SEQ ID NO: 24416 - protein, 108 aa, Unknown
  Obtained from environmental sample
  misc_feature (1)..(108): Xaa is any amino acid
MFPDKSIEETMKFISEKTNIYLKGGHRKEKIGWDEVYYSKIVKLNISPITTKPIFEKHGSGCVLSSALAANLTKDIPLEDACKNAKLYTEQFLSSNKTLLGTHNYQNK

SEQ ID NO: 24417 - DNA, 828 bp, Unknown
  Obtained from environmental sample
  misc_feature (1)..(828): n is a, c, g, or t
atgcaacaccctttagctaaagaattacaaaaactttctgagtcatcaaaacatgcaattgctgatgggaattctaataaacttagtgagtttagtgaatacttacatatcaaaagagatgtagaagatgaattaaaaaataaaattgaaacctgcttgcaaaactcatcagctcaattactattagtttgtggaaacgtcggagatggaaaatctcatatactttcctatttaaacaaagaattgagggatgatataaataaatttaagattcataatgatgctactgaatcttttaatccaaaagagaattctaatgagacattaaatagagttttaaatggttttagagatgaacatataaatgaatcttctgataaaatcatattagctattaacctagggactttaagtaatttcttagaagaacatggtgaagattacggaaaatttaaagcatatatagataacaataaaatattagattctcatattatagaaacggataatcaattgagtaattcgttctttcatcatgttaattttacggattatcatatgtattctctgacatctgaagggccaaaatctagaataatttcaactttacttgaaagaataattactgacaatccaaaaaatttaattttccaagcttataaaaatattaaagatgaagattggagtaatgattgtccaattaaatacaattttgagtttttaatgaattctgaaaatggagaagcattaatgaatttaattgttcaagcaatagttaagaataaggagattgtttctgtaagatcattattgaactttcttttttga

SEQ ID NO: 24418 - protein, 275 aa, Unknown
  Obtained from environmental sample
  misc_feature (1)..(275): Xaa is any amino acid
MQHPLAKELQKLSESSKHAIADGNSNKLSEFSEYLHIKRDVEDELKNKIETCLQNSSAQLLLVCGNVGDGKSHILSYLNKELRDDINKFKIHNDATESFNPKENSNETLNRVLNGFRDEHINESSDKIILAINLGTLSNFLEEHGEDYGKFKAYIDNNKILDSHIIETDNQLSNSFFHHVNFTDYHMYSLTSEGPKSRIISTLLERIITDNPKNLIFQAYKNIKDEDWSNDCPIKYNFEFLMNSENGEALMNLIVQAIVKNKEIVSVRSLLNFLF

SEQ ID NO: 24419 - DNA, 615 bp, Unknown
  Obtained from environmental sample
  misc_feature (1)..(615): n is a, c, g, or t
atggagtgcagatgggatgaaatttatccttcaggaagtaataaaaaagttgtttgtcttttaattggtgctactagcgaaacaaagcaggcagaggtttttaacgaaatcatgaatgagatagattacatttttggcaatttaaataaacgcaatcctattactatgaaaaatttaaagttgaaaccaactttagagaaaattagaaaggaaatgcacacaagaattggtgtttttaaaagttcttacttaatgaacaattggctcattacttttttcggacaatattattttaagttttttaaggctggtaaattgtatttgtacagagttacacaactttctgacacaattatgttagatggttctataaatactgtaatttctggtgatgaaaaacaattaggtaaattaagattttttctggatactttagaaacgcaaaagaaaattatttatggttttcataaaacgtacgcttctattctgtcttgttatgtagaagatagagagaaaaaacatattcattttgtagatggtacagaaggtggttatacaactgcttctgctgagtataaaataaaattaagaaaacagtatatctcaagtttttag

SEQ ID NO: 24420 - protein, 204 aa, Unknown
  Obtained from environmental sample
  misc_feature (1)..(204): Xaa is any amino acid
MECRWDEIYPSGSNKKVVCLLIGATSETKQAEVFNEIMNEIDYIFGNLNKRNPITMKNLKLKPTLEKIRKEMHTRIGVFKSSYLMNNWLITFFGQYYFKFFKAGKLYLYRVTQLSDTIMLDGSINTVISGDEKQLGKLRFFLDTLETQKKIIYGFHKTYASILSCYVEDREKKHIHFVDGTEGGYTTASAEYKIKLRKQYISSF

SEQ ID NO: 24421 - DNA, 558 bp, Unknown
  Obtained from environmental sample
  misc_feature (1)..(558): n is a, c, g, or t
atgaaaatatttgtaaaattcgatttgcattcagtatgtacaaaggtgttagaaaacacacttaacagctcaggaattaaacatactatgcttggttttggtgaagtagacctgttagattctccaagtaaagaaactatggaggagtttgctaaaaagttaggcgaatatcatatagaaatagtgcaagaccagaaaagtattttagtgcaaaaaataaaagatactattatagatatggtttttaatgacgataataatttacatgtaaaaagttctgtatatttatcggaagcattagatcatagttatggatatttagccaatttattttctgaagttacgtatacatctatagaaaattttataattctccagaaaatagaatatacaaaacaactaattttaaaagaaaatttaagtttgactgaaattgcatttaaattaaattactcaagtgttgcacatttaagtactcaatttaaaaaaaccactgggattacaccttcctcttttcaaagaataatagcaaaaagaaaagaattacttaaaaaataa

SEQ ID NO: 24422 - protein, 185 aa, Unknown
  Obtained from environmental sample
  DOMAIN (130)...(174): Bacterial regulatory helix-turn-helix proteins, AraC family
  misc_feature (1)..(185): Xaa is any amino acid
MKIFVKFDLHSVCTKVLENTLNSSGIKHTMLGFGEVDLLDSPSKETMEEFAKKLGEYHIEIVQDQKSILVQKIKDTIIDMVFNDDNNLHVKSSVYLSEALDHSYGYLANLFSEVTYTSIENFIILQKIEYTKQLILKENLSLTEIAFKLNYSSVAHLSTQFKKTTGITPSSFQRIIAKRKELLKK

SEQ ID NO: 24423 - DNA, 456 bp, Unknown
  Obtained from environmental sample
  misc_feature (1)..(456): n is a, c, g, or t
atgatagatagtgatattgcacaactttacggagtaactacacnaaggctaaatgaacaagtaaaaagaaataaaactcgttttccaaataattttatgtttgaattaacaaaagaggaaaagaaagaggttatcgcaaattgcgaccaccttaaaaatttaaaattctcaccagttttaccaaaggtttttacagaacacggaataatgatggttgctaatgttttaacaagtgaaagagcaatacaggtaagcatccaaataatagaagtgtttataaaaatgcgtgaaatcttaacagataatttaagtttgaaacttgatattgaagaaatcaaaaagaagttatctaatcatagcaagaatatagaattggtttttaactatttggatgaattgattgataaaaaagagaaaccacgaactcaaataggctacaaaaaagatagaaagtaa

SEQ ID NO: 24424 - protein, 151 aa, Unknown
  Obtained from environmental sample
  misc_feature (1)..(151): Xaa is any amino acid
MIDSDIAQLYGVTTXRLNEQVKRNKTRFPNNFMFELTKEEKKEVIANCDHLKNLKFSPVLPKVFTEHGIMMVANVLTSERAIQVSIQIIEVFIKMREILTDNLSLKLDIEEIKKKLSNHSKNIELVFNYLDELIDKKEKPRTQIGYKKDRK

SEQ ID NO: 24425 - DNA, 354 bp, Unknown
  Obtained from environmental sample
  misc_feature (1)..(354): n is a, c, g, or t
gtgattaatgatatcaaagatgccatggaagggatgctttcgcctgaaatgaaagaagaaattactggtaacgcagaaataagagagacctataaaatttctaaagttggtaccattgctggttgtatggttactgatggtaaattatttagaaattctaaaataagaattatcagagatggtgttgttgtttttacgggtgaatttgcatcactaaaacgttttaaagacgatgcaaaagaagtagcaaaaggatatgactgtggaatacaaattaaaaactttaatgaaattaaagaattagatgtgattgaagcttataaagaagtcgctgtaaaaaagaaattaaaataa

SEQ ID NO: 24426 - protein, 117 aa, Unknown
  Obtained from environmental sample
  DOMAIN (37)...(105): Elongation factor Tu domain 2
  misc_feature (1)..(117): Xaa is any amino acid
MINDIKDAMEGMLSPEMKEEITGNAEIRETYKISKVGTIAGCMVTDGKLFRNSKIRIIRDGVVVFTGEFASLKRFKDDAKEVAKGYDCGIQIKNFNEIKELDVIEAYKEVAVKKKLK

SEQ ID NO: 24427 - DNA, 777 bp, Unknown
  Obtained from environmental sample
  misc_feature (1)..(777): n is a, c, g, or t
atgggcaatgccaaaaagaaagatgtaaaattagagttgttagtagcaactatgtttcagacatctatggattttctatcaaatatgtttccaaatagttcttttaaaaactataacatcctgataattaatcaaacagatcaatctcacattttggagtcgactgtagataatattagagtgataaatagttttgaaaaaggtttggctaaaagccgaaacatggcaataaaaaatacgattggtcagttatgtttaattgtagacgatgatgttaaatttaaaccagattttgataaaattattttagaagcatataatagtaatcctaatgcagctattataacttttaaaatggaagattttgaaggtaatttatttaaaaattatcctcaagttaagtgtcatgatttagagtccattaaagaagttaattctgtagtgattacgtttaacactaaattaataaagcaaaacagcctactttttaatgtcaattttggattagggtccacttttgaaaccgcagacgaatatatttttatgcgagaggctttaaaattaaaaatgcagactatatttgagcccaaggtaatattgtcgcatccgttttttagttcaggcaaagactctggaaatgacaaattagtatatgccagaagtgccttatattacaaatattctggtgtattgngatacttaaaactatgtaaatatttatacattgtacataagcaaggtgcaataaaaacaaatcaaattattaaaaaattttaa

SEQ ID NO: 24428 - protein, 258 aa, Unknown
  Obtained from environmental sample
  DOMAIN (13)...(180): Glycosyl transferase
  misc_feature (1)..(258): Xaa is any amino acid
MGNAKKKDVKLELLVATMFQTSMDFLSNMFPNSSFKNYNILIINQTDQSHILESTVDNIRVINSFEKGLAKSRNMAIKNTIGQLCLIVDDDVKFKPDFDKIILEAYNSNPNAAIITFKMEDFEGNLFKNYPQVKCHDLESIKEVNSVVITFNTKLIKQNSLLFNVNFGLGSTFETADEYIFMREALKLKMQTIFEPKVILSHPFFSSGKDSGNDKLVYARSALYYKYSGVLXYLKLCKYLYIVHKQGAIKTNQIIKKF

SEQ ID NO: 24429 - DNA, 384 bp, Unknown
  Obtained from environmental sample
  misc_feature (1)..(384): n is a, c, g, or t
ttgtggattaaatttggtttaattggcaaaatcgcttttaacccaaaaataacgatgctatataacttttttgatcaatctagtttatcaaatcgtgattataatgaggacagatatttactaattaataattataagaatgaagcacagaacaacgcttcattaaaaaagtatttagacataaatagatatgcattagtcattcgttataaattattagaccaacctattgacgctaaaaaagtaaagcaagacatcgattttaaaaatttaaactataaacaaaaagtccttgtaaattgtccttcctctattttaattggattaaaaaagcttcatagttttttaataaaaaataacatttacttatcagcttttaagtaa

SEQ ID NO: 24430 - protein, 127 aa, Unknown
  Obtained from environmental sample
  misc_feature (1)..(127): Xaa is any amino acid
MWIKFGLIGKIAFNPKITMLYNFFDQSSLSNRDYNEDRYLLINNYKNEAQNNASLKKYLDINRYALVIRYKLLDQPIDAKKVKQDIDFKNLNYKQKVLVNCPSSILIGLKKLHSFLIKNNIYLSAFK

SEQ ID NO: 24431 - DNA, 438 bp, Unknown
  Obtained from environmental sample
  misc_feature (1)..(438): n is a, c, g, or t
ttgaaaagtcttaaaatgaaattaaaatcaacgactgtaaacgcagtatctattatagaaatacctaaaatcactgatgaagaaggacgtggtaatttgtcagttatagaaaaagattgcgttccatttgatatcaaacgcgtgtattatttatacgatgtacctagtgatgcttatagaggaggtcatgctcataaagctttatttcagtttttgatacccttaagtggtagttttgatgtgattttaaaagatggtaaaaacactaaaacagtcagtttaaataagcctaataaagggttgatgattgtaccaggtatttggagagaacttgaaaatttttcttcaggagcagtatgtttagtcttagcatcagaggtttacaatgaagaggattatgttagagattatagcgaatttgaattacttaaaagctga

SEQ ID NO: 24432 - protein, 145 aa, Unknown; identical to SEQ ID NO: 22860
  Obtained from environmental sample
  DOMAIN (14)...(145): WxcM-like, C-terminal
  misc_feature (1)..(145): Xaa is any amino acid

SEQ ID NO: 24433 - DNA, 663 bp, Unknown
  Obtained from environmental sample
  misc_feature (1)..(663): n is a, c, g, or t
ttgatcggctcgagggaagctgccagtgttgtagaagcttccaaactattacaaaagcaacaaccagatattttatttctagacattatgttaggagatggtactggatttgatattttagaaattgtaccaaacttaaattctaaaataatatttgtgactgcaagtgatgaatatgccattaaagcttttaaattcgcagcaatagattatatcttaaaaccttattctatagaggatttatcgaatgctatagagaaagctaagattcaaattcaaccaaagaaagaacaactaaatgtattaaaacaattagtttcagaaccaaatcacaaaccaagaaaagtatcattgcatacttcagaaaaaattattgtggtaaatatcgaagatataattcgttgtaaagccgacaataattatactactttctatttaaatgatacatcaaaaatattagtatcgaaaactttaaaatattatgcagatattttaaaagaggtcaattttttaagagttcatcaaagtcatttagtaaataaaaactatataaaagaatttataaagtctgatggaggttatttaattttaaatgatgcatcaaatatcccagtatcagtaagaaaaaagagcgaaattatagaagctttaaagaataaataa

SEQ ID NO: 24434 - protein, 220 aa, Unknown
  Obtained from environmental sample
  DOMAIN (1)...(93): Response regulator receiver domain
  misc_feature (1)..(220): Xaa is any amino acid
MIGSREAASVVEASKLLQKQQPDILFLDIMLGDGTGFDILEIVPNLNSKIIFVTASDEYAIKAFKFAAIDYILKPYSIEDLSNAIEKAKIQIQPKKEQLNVLKQLVSEPNHKPRKVSLHTSEKIIVVNIEDIIRCKADNNYTTFYLNDTSKILVSKTLKYYADILKEVNFLRVHQSHLVNKNYIKEFIKSDGGYLILNDASNIPVSVRKKSEIIEALKNK

SEQ ID NO: 24435 - DNA, 399 bp, Unknown
  Obtained from environmental sample
  misc_feature (1)..(399): n is a, c, g, or t
gtggtaaatatttattatatttgtatctgtataatgaaagaagaagataaacatagaacacatagagttataaaggtatttaaggatactggattaaaccaaagacagttttcggagctcattggagtttcacaacagttggtgagtgctgttgttaattttacgaaaaaacctaatgaaactattttattagcaattatagataatattgaaggaatagatccaatgtggctatttactggctctggagaaaataaaacaaattacactccattaaaagttcaatcccctattgaagaaactattttaaacattgttagaaaacaatttgatgagttgtcttttgacattattaaaaaactatcaaatattgaagattctgtgaaagattctaaataa

SEQ ID NO: 24436 - protein, 132 aa, Unknown
  Obtained from environmental sample
  misc_feature (1)..(132): Xaa is any amino acid
MVNIYYICICIMKEEDKHRTHRVIKVFKDTGLNQRQFSELIGVSQQLVSAVVNFTKKPNETILLAIIDNIEGIDPMWLFTGSGENKTNYTPLKVQSPIEETILNIVRKQFDELSFDIIKKLSNIEDSVKDSK

SEQ ID NO: 24437 - DNA, 897 bp, Unknown
  Obtained from environmental sample
  misc_feature (1)..(897): n is a, c, g, or t
gtggtttgggtgggattgtattatttttcaaaacgatttaaagaggttacncattgtgaaataaacagtgaattatctaaaattgtagcacataattataaagttttacaagcaaaaaacattaattgtatcgcaaccgatggtattgcgtatttaaaaaataaacccacaacatattcggcgatntacgtcgatccttctcgtagaaacgagagcaaaggcaaagtatttatgttaagcgattgcttaccaaatataccagagcatttagatcttctttttaaccaagccaatattatacttataaaaacttcaccattattagatttaagtattggtattaacgaattaaaatatgttaaaacaatatactgtgttgctttaaataatgaggttaaggaattattatggttgctagagaaaggatataatggaaacatttgtattaaaaccgttaatattacaaaggaaagacagcagacttttaattttaacttagaagacgaagcgcttttagaagcagactacagtaagccactcacctatttgtacgaacccaatgccgctattttaaaatctggtgcgtttaatactatagcagaaaaattacaattaaaaaaactacacaaacattctcatttatacactagcgaacaattaatcgcatttcctgggcgatcattcaaaattgaaactgttttagattacaatataaaacagtttaaaaaaggtttcaaattaaagaaagccaatgttacgacacgcaatttccctgatacagtaagtaccattcgaaagaaattaaaattaaatgatggtggcgaaaattacttatttttcaccaccaattataaagataaaaaaatcattgtgagttgtaagaaaatagagtattaa

SEQ ID NO: 24438 - protein, 298 aa, Unknown
  Obtained from environmental sample
  misc_feature (1)..(298): Xaa is any amino acid
MVWVGLYYFSKRFKEVTHCEINSELSKIVAHNYKVLQAKNINCIATDGIAYLKNKPTTYSAXYVDPSRRNESKGKVFMLSDCLPNIPEHLDLLFNQANIILIKTSPLLDLSIGINELKYVKTIYCVALNNEVKELLWLLEKGYNGNICIKTVNITKERQQTFNFNLEDEALLEADYSKPLTYLYEPNAAILKSGAFNTIAEKLQLKKLHKHSHLYTSEQLIAFPGRSFKIETVLDYNIKQFKKGFKLKKANVTTRNFPDTVSTIRKKLKLNDGGENYLFFTTNYKDKKIIVSCKKIEY

SEQ ID NO: 24439 - DNA, 597 bp, Unknown
  Obtained from environmental sample
  misc_feature (1)..(597): n is a, c, g, or t
ttgaatgaatctatattaaatactgcaaatcaagagtttataactaaaaatataaacactactattacttctttacttttaaaagaagctaaaaatatgcgctttgatatcaaggcacttattgaacaaattgaagccaagaaaagggctgaaaagaaactgccaacctggttttctactcaaaatatttactacccgaacaaattaaatatagaacaaacctcgtctgaagctaccgctttatttaagtctaagatagtatctggcgattgtttaatagatctcactggtggttttggtgtggattgttattatttttcaaaacgatttaaagaggttacccattgtgaaataaacagtgaattatctaaaattgtagcacataattataaagttttacaagcaaaaaacattaattgtatcgcaaccgatggtattgcgtatttaaaaaataaacccacaacatattcggcgatttacgtcgatccttctcgtagaaacgagagcaaaggcaaagtatttatgttaagcgattgcttaccaaatataccagagcatttagatcttctttttaccaagccaatattatacttataa

SEQ ID NO: 24440 - protein, 198 aa, Unknown
  Obtained from environmental sample
  misc_feature (1)..(198): Xaa is any amino acid
MNESILNTANQEFITKNINTTITSLLLKEAKNMRFDIKALIEQIEAKKRAEKKLPTWFSTQNIYYPNKLNIEQTSSEATALFKSKIVSGDCLIDLTGGFGVDCYYFSKRFKEVTHCEINSELSKIVAHNYKVLQAKNINCIATDGIAYLKNKPTTYSAIYVDPSRRNESKGKVFMLSDCLPNIPEHLDLLFTKPILYL

SEQ ID NO: 24441 - DNA, 375 bp, Unknown
  Obtained from environmental sample
  misc_feature (1)..(375): n is a, c, g, or t
gtgtttacagtggctcgaaattctattttagattattggaaagccaccaatcaaacttttgaaattgccaattttgaaactgaaacgcttcctctagaaaattctcatacagaaaaagattgtttaagaggtattttaaaaagcttgcctaaaaaatatagagatcctttgtttttatctgacattaaaggttttaaacaacaagaagttgcccaacaattgcaacagagtttatcgactacaaaatctcagattcagagtgctcgaaaattaattgcacaaggttttatggattgttgtggctttgtggtgaatgatgaaggtaatttggttggcgaaattcaagaaaaagcagattgtaaaatttgtaattga

SEQ ID NO: 24442 - protein, 124 aa, Unknown
  Obtained from environmental sample
  misc_feature (1)..(124): Xaa is any amino acid
MFTVARNSILDYWKATNQTFEIANFETETLPLENSHTEKDCLRGILKSLPKKYRDPLFLSDIKGFKQQEVAQQLQQSLSTTKSQIQSARKLIAQGFMDCCGFVVNDEGNLVGEIQEKADCKICN

SEQ ID NO: 24443 - DNA, 531 bp, Unknown
  Obtained from environmental sample
  misc_feature (1)..(531): n is a, c, g, or t
ttggcgaacaaaaaagcagatttagagttagcactagctttaggcttagacgaaaaagagcgttcagagaatattatgatcgttgaccttgtacgaaatgatctctctaaaaccgccataaaaggaactgtaaaagtcgaagaattatgcaaagtatattcatttgatcaggtgcaccaattaatatccacggttacttcgttgatcgatcaaaaaacagacagtatagatgtcattgaaagccttttcccaatgggaagtatgacgggtgctccaaaaatttcggctatgaaaattattgaggagcaagaagtttctaaacgtggattatattcaggagcagttggttattttacaccaaccaatgatttcgattttagtgtagtaataagaagtattttgtataataataccgaaaaatacttgtcttattctgttggtggtgccattacttcaaagtctgacccagaaaaggaatatcaggaatgtttattaaaggcgatagcaatgaaaaaggctcttaaaaattaa

SEQ ID NO: 24444 - protein, 176 aa, Unknown
  Obtained from environmental sample
  DOMAIN (1)...(174): chorismate binding enzyme
  misc_feature (1)..(176): Xaa is any amino acid
MANKKADLELALALGLDEKERSENIMIVDLVRNDLSKTAIKGTVKVEELCKVYSFDQVHQLISTVTSLIDQKTDSIDVIESLFPMGSMTGAPKISAMKIIEEQEVSKRGLYSGAVGYFTPTNDFDFSVVIRSILYNNTEKYLSYSVGGAITSKSDPEKEYQECLLKAIAMKKALKN

SEQ ID NO: 24445 - DNA, 921 bp, Unknown
  Obtained from environmental sample
  misc_feature (1)..(921): n is a, c, g, or t
ttgaccgatcaggaaattaaagatctcaacaaggaactaaaagcgatattacaaagtattgaaaaaggagaatttatcattgaagattcattcgaggatgtacactctaaagttgagtttttgttaacgcaaaagctaggagttaccggtaaaaagatccacacagctcgttccaggaatgatcaggtattggtcgatgtacatttgtatttaaaagatgaaatcattgaaattaaaaaacaaataaatgatttatttaatttattgatctcaaaagcagaggaacataaagatatcatgctcccagggtatactcatttccaagtggccatgccatcttcttttgggttgtggttttccgcctatgctgaaagtttgatcgacgatgtatatatgttaaattctgcctataagataaccaaccagaatccattgggatcagcagcaggttatggaagctcctttaatattgacagggaatttacaacggaattattgggttttgaaaccttaaaatataatgcggtggctgcacagatgagtagaggcaaaacagaaaaagcggttgctgccggactaagtgctgtagcaggtacgatgtcaaaatttgcaatggacatttgtttgtatatgagtcagaactttaattttatttcttttccggatgaatttactactggttctagtattatgcctcataaaaagaatcctgatgtatttgaattgatcagaggaaagtgcaacgtaatacaagcgctaccgtatgaaataacattaatcactaataaccttccaagtggttatcatagagatctgcaattactaaaagaaggcttgttacctgctattcaacttttagatcttgtctggaaatgttttattttcaattcaaaatataaaagtggaccaacaatttattag

SEQ ID NO: 24446 - protein, 306 aa, Unknown
  Obtained from environmental sample
  DOMAIN (2)...(252): Lyase
  misc_feature (1)..(306): Xaa is any amino acid
MTDQEIKDLNKELKAILQSIEKGEFIIEDSFEDVHSKVEFLLTQKLGVTGKKIHTARSRNDQVLVDVHLYLKDEIIEIKKQINDLFNLLISKAEEHKDIMLPGYTHFQVAMPSSFGLWFSAYAESLIDDVYMLNSAYKITNQNPLGSAAGYGSSFNIDREFTTELLGFETLKYNAVAAQMSRGKTEKAVAAGLSAVAGTMSKFAMDICLYMSQNFNFISFPDEFTTGSSIMPHKKNPDVFELIRGKCNVIQALPYEITLITNNLPSGYHRDLQLLKEGLLPAIQLLDLVWKCFIFNSKYKSGPTIY

SEQ ID NO: 24447 - DNA, 876 bp, Unknown
  Obtained from environmental sample
  misc_feature (1)..(876): n is a, c, g, or t
gtgttgtttataactataaatttcattattatgaaaatattgaggtatgtactacttttagtattattgatagttgttgccggatcaatttatatagcgacattagacaactcctacgaagttagcagaactaagattatgaaggttcctgttcaagttgtctataataacgtgaatgattataagaattggccttcatggtcaccatggttagaaaaagatacactaactcaacttacctatggcgaaattgctacaggcaaaggagcatcttattcttggaagagtgataataaaaatgttggtgaaggaagcatggaaacaattgatgctacttcgtttgaatctataaatcaaagaatgaattcgattacgccttgggaatctcaatctgatatttactgggcgtttagacctgtagatgatgatactgaagttacctggggtatgaaaggagagttgggttttggagaaaaagcatatatatccttaaaaggtggaatggataaaatggtaggtcctgattatgaaaaaggcttgtctaaattagatagcgttttacaagttaatatgaaaaagtatagtattcatgttaacggacttacaacaagaggtggaggctactacctttataatactacttcatgtaaaatggatganatgtcaaaaaaaatgaaagaaatgctgcctattttaggtacgtatgtcgaaaaaaataaaataacaacagcagggccattgttcaccttatatcatcagtttgatcctgaaaataacgctgttattttttcatgtgctgtaccggtagctgaaagggtaattacagaggcaagtagtgggattcaaacgggaatgttaaaaccttttaagccataa

SEQ ID NO: 24448 - protein, 291 aa, Unknown
  Obtained from environmental sample
  misc_feature (1)..(291): Xaa is any amino acid
MLFITINFIIMKILRYVLLLVLLIVVAGSIYIATLDNSYEVSRTKIMKVPVQVVYNNVNDYKNWPSWSPWLEKDTLTQLTYGEIATGKGASYSWKSDNKNVGEGSMETIDATSFESINQRMNSITPWESQSDIYWAFRPVDDDTEVTWGMKGELGFGEKAYISLKGGMDKMVGPDYEKGLSKLDSVLQVNMKKYSIHVNGLTTRGGGYYLYNTTSCKMDXMSKKMKEMLPILGTYVEKNKITTAGPLFTLYHQFDPENNAVIFSCAVPVAERVITEASSGIQTGMLKPFKP

SEQ ID NO: 24449 - DNA, 558 bp, Unknown
  Obtained from environmental sample
  misc_feature (1)..(558): n is a, c, g, or t
ttgttacgctttaaggctactttttctgaaatggaatctttttttcatggaaaatcttcgggattagatcctcttaatagttatttaagcttaccaattttaataaattctaaagaaaatattgaagctacaggtataccaacgcaaagtagcgatggtcaaggtgctgtgtttttgttagactctggtattattggagaaactgctccaatggtaagtatctttatggaaaacatgaagcaagaagggtttagaacaatgcttaaaaatcaatttataaagcacacagatgcgtgtgtagatgactttttaaaaggagatataaaatccctgtttaaaaataccaagcagttatctaaagtagtgttaaataactttaaaccaatgattccggctcaattccatgagttatggaaaaacggaatagagactaatgactattacttaaaactttgtggttctggtggtggaggttatatcttaggttttacacctgatattaaaaaagcgcaattagccttaaaagactataaattagaagtggtttataatttttaa

SEQ ID NO: 24450 - protein, 185 aa, Unknown
  Obtained from environmental sample
  misc_feature (1)..(185): Xaa is any amino acid
MLRFKATFSEMESFFHGKSSGLDPLNSYLSLPILINSKENIEATGIPTQSSDGQGAVFLLDSGIIGETAPMVSIFMENMKQEGFRTMLKNQFIKHTDACVDDFLKGDIKSLFKNTKQLSKVVLNNFKPMIPAQFHELWKNGIETNDYYLKLCGSGGGGYILGFTPDIKKAQLALKDYKLEVVYNF

SEQ ID NO: 24451 - DNA, 861 bp, Unknown
  Obtained from environmental sample
  misc_feature (1)..(861): n is a, c, g, or t
atggatttatcacgttttttattaaaaaactatcaaaataagctaaataacggaagtgtaacttggtcttctccaagtaatattgcactagttaaatattggggcaaaaaagaacatcaaattccagaaaacccatcaatcagttttactttagattcttgtaaaacaattactgagttgcactatattaaaaagcaaaaaggtaataatagttttgattttaaggtttttttagatgaagaattaaagcctgactttcatcctaaaatcgaaacgttttttaagcgtattgaaagttatgtgccttttttaaaagaatttgagtttactattaaaactaaaaacacgtttcctcatagttctggtattgcatcttccgcatcaggtatgagcgctttagctttgtgtataatgagcatagaaaaacaattaaatccagaattatctcaagcgcattttatccaaaaagcatcctttttagcaagattaggatcaggtagtgcttgtaggagtttggaaggcgatttagtagtttggggtaaacacccaaaaattaaagatagtagcgatttgtttggtgtaaaatatccgtataaagttcacgatatttttaaaaactataacgatactatattattggttgataaaggagaaaaacaggtgagtagcacagttggtcataatttaatgcatggacacccatttgctagccaacgttttgatcaagcagtagacaacataactgcaatcaaatcaattttagaaacaggggacttaaatcaatttattgctttagtcgaaagtgaaagcttgacgctacacgctatgatgatgacaagtatgctttattttattttatga

SEQ ID NO: 24452 - protein, 286 aa, Unknown
  Obtained from environmental sample
  misc_feature (1)..(286): Xaa is any amino acid
MDLSRFLLKNYQNKLNNGSVTWSSPSNIALVKYWGKKEHQIPENPSISFTLDSCKTITELHYIKKQKGNNSFDFKVFLDEELKPDFHPKIETFFKRIESYVPFLKEFEFTIKTKNTFPHSSGIASSASGMSALALCIMSIEKQLNPELSQAHFIQKASFLARLGSGSACRSLEGDLVVWGKHPKIKDSSDLFGVKYPYKVHDIFKNYNDTILLVDKGEKQVSSTVGHNLMHGHPFASQRFDQAVDNITAIKSILETGDLNQFIALVESESLTLHAMMMTSMLYFIL

SEQ ID NO: 24453 - DNA, 849 bp, Unknown
  Obtained from environmental sample
  misc_feature (1)..(849): n is a, c, g, or t
ttgcaaaactacaaaatttatacctttaggatcatgaatcaaatgaaaccaattatttttttaacgcttttaacaattatatgctttattggatgtaattcaaccactaaaaaacaggaaacaatgcagtttaaatctggaaaaattgtaattgcccaccgtggcgcttcaggatatctacccgaacataccctcgaggctaaagccatggcgtacgctatgcaaccggactttttggaacaggatctagtactttctaaagataatgttcctattgtaattcatgatattcatttagaaacagttactgatgttgctgataaatttcctcaacgggatcgcaaagatggacgctattatgtaattgatttcaattatgatgaattgttgcaattaaatgttgctgaaagatttgatcctaacactaaaaaagcggtttaccctaaacgatttcctttatggaaatcgaatttcaaattacattcattacaggatgaaattgaattaattcaagggttgaataaaagtaccggtcataatattgggatttatcctgagataaaagaacctgattttcaccataaagaaggaaaagatatttcaaaaatcgttttgaaaattttgacaaattatgggtatgccactaaaaaagacaactgtatcttacaatgttttgatgctaaagaattgaaaaaaataaggcaagaattgaagtctgaattgtttttagttcagttgactgaaaataaaaatgatgaaagaaatttaaaagaattcgctacatatgcagatggggtagggccatggtataaacatctcgtttctggaaaagatgataagggcaattga

SEQ ID NO: 24454 - protein, 282 aa, Unknown
  Obtained from environmental sample
  DOMAIN (53)...(280): Glycerophosphoryl diester phosphodiesterase family
  misc_feature (1)..(282): Xaa is any amino acid
MQNYKIYTFRIMNQMKPIIFLTLLTIICFIGCNSTTKKQETMQFKSGKIVIAHRGASGYLPEHTLEAKAMAYAMQPDFLEQDLVLSKDNVPIVIHDIHLETVTDVADKFPQRDRKDGRYYVIDFNYDELLQLNVAERFDPNTKKAVYPKRFPLWKSNFKLHSLQDEIELIQGLNKSTGHNIGIYPEIKEPDFHHKEGKDISKIVLKILTNYGYATKKDNCILQCFDAKELKKIRQELKSELFLVQLTENKNDERNLKEFATYADGVGPWYKHLVSGKDDKGN

SEQ ID NO: 24455 - DNA, 765 bp, Unknown
  Obtained from environmental sample
  misc_feature (1)..(765): n is a, c, g, or t
ttgaaagaacctagtagaagtcttgagcttacttctacaaaagaacagcttgatgatattgctaaactaatgagcacagctaatattgcaatcaaaaagcataatgatattgtagataattatgcaactgaaagaaacaagttagtaaatgaaatttggaaatttatcattgaagataatcgcactcgaattgagttttttgtcaaacacaaaaatgggttacaaaaaggaattgataatattacaaaaaaggtaactaaacttcgtgatgactataaaaagcttgacaaagagataaaggagttaactaaaaatgttacgagcatacagccttctgtagatgaaataaatcaaactttaaaatcttttggctttcaaaattttgagattgttccttctcaaattggaactaatcaatatcaaattcaaagagcagatggagaattagcagaatccactttgagtgaaggagaaattacatttattacttttttatactttttgcaattggtaaaaggaagtacaaacgaaacagatataactgacgaaagaatacttgtaattgacgacccaatttcaagtttagatagtaatgttttatttgttgtaagttctttgctaaaagaaataaccaaaggaataagaaataatcaaggaaacataaagcaactaattctattgactcataatgtttactttcataaagaagtatcatttataaatggcagaacaaaagaatgcaatgaaactaatttttggatttaa

SEQ ID NO: 24456 - protein, 254 aa, Unknown
  Obtained from environmental sample
  misc_feature (1)..(254): Xaa is any amino acid
MKEPSRSLELTSTKEQLDDIAKLMSTANIAIKKHNDIVDNYATERNKLVNEIWKFIIEDNRTRIEFFVKHKNGLQKGIDNITKKVTKLRDDYKKLDKEIKELTKNVTSIQPSVDEINQTLKSFGFQNFEIVPSQIGTNQYQIQRADGELAESTLSEGEITFITFLYFLQLVKGSTNETDITDERILVIDDPISSLDSNVLFVVSSLLKEITKGIRNNQGNIKQLILLTHNVYFHKEVSFINGRTKECNETNFWI

SEQ ID NO: 24457 - DNA, 987 bp, Unknown
  Obtained from environmental sample
  misc_feature (1)..(987): n is a, c, g, or t
ttggttttagcagatgaaactttgctgcctgttaccttaaattcgttgcccaaaaatgtagatgcaatcaatattacaatggggtatcctttaaaagatataccaacaacgagtttgttattctctatttttcagttgtttatatcccaagaaaaattgcaaaaaagcgttttgaatgagttttattataaagatgtaattcgcttttttaaacatcaatctatttatggtttaattgctaagattgataatttcactgaggcaattgcaaaagataaccagacatttattacaaaaagtcatatagaagatttgctaaaagaagaaaaaattgaagtaaaaaatattattttaaagctgtttgaggcttttgattctgttgagaattttatggatagaattttggctttaatcgatcttttaaaagcggaagtaaatcctttagaaaaagaatatctattccgtttttatactgtttttacgcagttgcaaaccttgcaaaatgagtttcattattttacagatttaaaaaccttatcgctattttttaatcaactaatatcttcagaaagtttgtcttttcaaggagaacctttaaaaggtttacagttgatgggaatgttagaaacgcgtgttttagattttgagaatatcattttagtatctgcaaacgaaggtattttgccagccaatagtcagcaaaatacgtttattccttttgatgtaaaagtcgaatatggtttgccaacctacagagaaaaagatgctattttttcgtatcacttttttaggttgatgcaaagagcaaagaacgtttttattttgtacaatacagaacatgatatttttggaagtggagaaaaaagtagatttgttacngcattagaaatgatggagacagatattgttcaaaaaatattttcgccaaaagtggtcgctccaaatgccgaaataaaaaccatccaaaaaaatgaggtgggtttttaa

SEQ ID NO: 24458 - protein, 328 aa, Unknown
  Obtained from environmental sample
  misc_feature (1)..(328): Xaa is any amino acid
MVLADETLLPVTLNSLPKNVDAINITMGYPLKDIPTTSLLFSIFQLFISQEKLQKSVLNEFYYKDVIRFFKHQSIYGLIAKIDNFTEAIAKDNQTFITKSHIEDLLKEEKIEVKNIILKLFEAFDSVENFMDRILALIDLLKAEVNPLEKEYLFRFYTVFTQLQTLQNEFHYFTDLKTLSLFFNQLISSESLSFQGEPLKGLQLMGMLETRVLDFENIILVSANEGILPANSQQNTFIPFDVKVEYGLPTYREKDAIFSYHFFRLMQRAKNVFILYNTEHDIFGSGEKSRFVTALEMMETDIVQKIFSPKVVAPNAEIKTIQKNEVGF

SEQ ID NO: 24459 - DNA, 822 bp, Unknown
  Obtained from environmental sample
  misc_feature (1)..(822): n is a, c, g, or t
atgactaaccaagttggtttatatgagaagaaataccctgcaaattgggttgttatgcaaaatcgtattctacaagcgttttatgaaatgacacttgatgaaaaacggttgctgttgcttgctagttcagtagtgcgtttgatagatgccactgaaaaagacactatagagataaccgcgaaagcatttgcagaggcttgcaacattcaagtggattctgcttatactcaattaaaagatgctagtgaaacgatgatgaggcgattttttagctatagaaatgaacgcggtagccgtgtcaatgtacagtgggtcatcagatcaatatatgaagatggctatgtgtctctatgttttacagatgaagtgctactgatgttgaaggtttttgatgaaaataatccattcactaaatataaaaaagaagatgtacttaaactgaagggtgaatattcaatagatatataccatctggccaaaaaacatgaggcaatgagctcgtggacaatgtcacttgaagaaattagagaggagctagctctttctaaatcttacgaacgtattaacaacctaaaaagtcgagtcatcaacccaagcgttgaagaaataacagaaaagtcagatattaaaatcacctatgaaaacgttaaacgtggtcgtaccgtcacaggactaaaatttaatgtcaaagctaagcccaccaagaaaaaaagtctggaggacttaaatcagaataatgagaatagagatataccatccttaaccgtcaaacagatcgaccgttttgcgcctctattggctaactatgccccattttggtag

SEQ ID NO: 24460 - protein, 273 aa, Unknown
  Obtained from environmental sample
  DOMAIN (13)...(229): Initiator Replication protein
  misc_feature (1)..(273): Xaa is any amino acid
MTNQVGLYEKKYPANWVVMQNRILQAFYEMTLDEKRLLLLASSVVRLIDATEKDTIEITAKAFAEACNIQVDSAYTQLKDASETMMRRFFSYRNERGSRVNVQWVIRSIYEDGYVSLCFTDEVLLMLKVFDENNPFTKYKKEDVLKLKGEYSIDIYHLAKKHEAMSSWTMSLEEIREELALSKSYERINNLKSRVINPSVEEITEKSDIKITYENVKRGRTVTGLKFNVKAKPTKKKSLEDLNQNNENRDIPSLTVKQIDRFAPLLANYAPFW

SEQ ID NO: 24461 - DNA, 942 bp, Unknown
  Obtained from environmental sample
  misc_feature (1)..(942): n is a, c, g, or t
ttgctaaaatttaaaaagcaatatcaanccagaaaccttctggtcgcattagaacgcgaagcaaaaatgatgctttcttntggtaaagaaatgtattcaaaaacactgaaaacaaataatcctgattcatattttacattgatggacattctttctggattatatcattcagaccaaaagtttgcaatagatgaaattaaacgtctaattaaagatgataataaagacttaaataaattaggaatacaatctatcgtaaaaattgatttggtagctaaaaccaaaccaaaagcatttataaattggattgaaaagcagtttgctaccataagcaagtccgaaaatcatttaaatctttggtcagcaatattttttacagttagaaataaaagaactgagataaaaagtgcagatacaattatagataggttatcaagtattaagactatcgatattcaattagagctcatttactttttagattataatatagatttagaaaaggaattacatctgtttaaaaaataccttccactattacttcatattgatattgaacacgcaggcgcatataatcaattggcataccgattagaaaatgtagcaaaagctaatttaaacttagttgttgattttataacagattgggtagcgatgagtcctgataatgctagaaaaattgaatatttcagtcatttgctaaatacactttgtgatgatttttattctgactttcaaaagctatacaccaactggttaaataaagataatcccaattttcatattgccatttttgaaatgaatagtgccaggtatatgaggaatttatcaggattaatggtttcagaagaagtgctgaatgatctatcagattatgatattgaatatatcacttataaaatactcgctttcgtttatgataaggacacctcaattccttag

SEQ ID NO: 24462 - protein, 313 aa, Unknown
  Obtained from environmental sample
  misc_feature (1)..(313): Xaa is any amino acid
MLKFKKQYQXRNLLVALEREAKMMLSXGKEMYSKTLKTNNPDSYFTLMDILSGLYHSDQKFAIDEIKRLIKDDNKDLNKLGIQSIVKIDLVAKTKPKAFINWIEKQFATISKSENHLNLWSAIFFTVRNKRTEIKSADTIIDRLSSIKTIDIQLELIYFLDYNIDLEKELHLFKKYLPLLLHIDIEHAGAYNQLAYRLENVAKANLNLVVDFITDWVAMSPDNARKIEYFSHLLNTLCDDFYSDFQKLYTNWLNKDNPNFHIAIFEMNSARYMRNLSGLMVSEEVLNDLSDYDIEYITYKILAFVYDKDTSIP

SEQ ID NO: 24463 - DNA, 894 bp, Unknown
  Obtained from environmental sample
  misc_feature (1)..(894): n is a, c, g, or t
atggcaacaatcaattattatttagatacagctgataaaaaaggtttgtctccaattcatttaagaataaactgcaatggaaaacaaataaaaatttctactggagaaaaaattgctccaaaggattttgacaaaaaaattaaacaagtcaaaaactcttcagataaacatatcgaaataaaccattatttagcttatttaaaagatagagcggatgagttattgaataagtcttacaagaaaaactatactaataaagagataaaaaatactctaaatgattatgtaaatgcatataaagaagaccataatgtaaatatcttaagggaacaaatatctctttatggtaaaccttttactttcgttgatttatttgcaggagctggagggtttagtgaaggttttatccaagcggaacataataataaattctttgactttcttgttgcaaatgatattaatgaaaattccgaattaacgcatatagtcagatataaccatcaattaggtttagatgctgattttttatgtcaagacattacagaaccagattttttagacaatctactatctaaaactaaagacaaaaaagttgatgttgtttgtggaggaccaccttgtcagagttttagtctagcagggaaaagaaaaaagtttgataaaaaagatgatttattttctcattatttagaagtaattaaagtgcttcaaccaaagtattttataatggagaatgtaaaaggaattttaacaaaagaaaaaggaaaaataaaagaacttattctaaaagaaattaactcgatagttgatattaaagaaattccaactttaacatcttttattaaatctttaaagaaaactaatattgaaaataactttcttttagattgttaa

SEQ ID NO: 24464 - protein, 297 aa, Unknown
  Obtained from environmental sample
  DOMAIN (119)...(297): C-5 cytosine-specific DNA methylase
  misc_feature (1)..(297): Xaa is any amino acid
MATINYYLDTADKKGLSPIHLRINCNGKQIKISTGEKIAPKDFDKKIKQVKNSSDKHIEINHYLAYLKDRADELLNKSYKKNYTNKEIKNTLNDYVNAYKEDHNVNILREQISLYGKPFTFVDLFAGAGGFSEGFIQAEHNNKFFDFLVANDINENSELTHIVRYNHQLGLDADFLCQDITEPDFLDNLLSKTKDKKVDVVCGGPPCQSFSLAGKRKKFDKKDDLFSHYLEVIKVLQPKYFIMENVKGILTKEKGKIKELILKEINSIVDIKEIPTLTSFIKSLKKTNIENNFLLDC

SEQ ID NO: 24465 - DNA, 591 bp, Unknown
  Obtained from environmental sample
  misc_feature (1)..(591): n is a, c, g, or t
atgaaattgggagaacgacaagcgattgcatttgtacataaagacaaaaatcataagcatattcatctatatgtaaatcgtatcgattttaaaggggtagcctataatgacagctttattggtaaacgcagtcaattagctgctgagaaagtagcagaaagcatgcaactcaccaccgttaaacaagtacaatttgaaaaggaattcaatctgaaagaaattagatctgaaatcaaaaggagacatgatttaagccttaaacaattctctcctggatcttatgatgattatgtaaaagcaatgcagacaaacggtgttaaagtcattccatcaataaataatcaaaacaagttacagggatttcgatttcagttcagtggacacaatcttaagggtagtgagattcatcgcaacatgtctcttggtaatattggaaaaagtattgcagctgttcctggagctgaaatttttaaaggggataagaaaagcatcaatctattaggaaaaacgcttgaattgtccggaaaactggcatggaaaattgctaaaaaattgatcaaaaaaacaatcgatcagggtataggctattaa

SEQ ID NO: 24466 - protein, 196 aa, Unknown
  Obtained from environmental sample
  misc_feature (1)..(196): Xaa is any amino acid
MKLGERQAIAFVHKDKNHKHIHLYVNRIDFKGVAYNDSFIGKRSQLAAEKVAESMQLTTVKQVQFEKEFNLKEIRSEIKRRHDLSLKQFSPGSYDDYVKAMQTNGVKVIPSINNQNKLQGFRFQFSGHNLKGSEIHRNMSLGNIGKSIAAVPGAEIFKGDKKSINLLGKTLELSGKLAWKIAKKLIKKTIDQGIGY

SEQ ID NO: 24467 - DNA, 315 bp, Unknown
  Obtained from environmental sample
  misc_feature (1)..(315): n is a, c, g, or t
atgacaaaaattgaagaattaacagaattattagtaaacgaaatcaacgatttcaataaaggaattataaaactggaaaagatcagtgatcaaatcagtacaactaaaatccgtctggatgtaacggagtataaatctattattgaaaaccatgaacaaaagatgaatgatcagataaggtcacaggaactatttgagagttggtttaaggctttattaaaaacagcaaaaatatatcctaattgggctgtgattgnatttgtactctctcttttgtttgggnaatggatcatttgtttattccttataagttaa

SEQ ID NO: 24468 - protein, 104 aa, Unknown
  Obtained from environmental sample
  misc_feature (1)..(104): Xaa is any amino acid
MTKIEELTELLVNEINDFNKGIIKLEKISDQISTTKIRLDVTEYKSIIENHEQKMNDQIRSQELFESWFKALLKTAKIYPNWAVIXFVLSLLFGXWIICLFLIS

SEQ ID NO: 24469 - DNA, 591 bp, Unknown
  Obtained from environmental sample
  misc_feature (1)..(591): n is a, c, g, or t
atgaaaaaaatactactaattgccatatttttggtgtcttgggtttcaactgcccaaattaatttaactggaattgtaaaagattctattggagctcctttagaaatggggaatgtaattgcattagatactgttgctaaaagaattgcttcttatggttttacagatgctaatggaagttttaaactagaattagcaagaaacacaacttataatattaaaataagttatgtaggttttaaagaaatcagcgaatttataagaacaggagataaagacatcactaaaaattataccatggttgaagacaacatgttagatggtattaatatcgtttctaaaatgcctgttagaataaaaggtgatactattatttatgatgcagattcttttaaaaatggttctgaaagaaaactaaaagatgttttagaaaaattaccaggagttgaaattaatgatgctggtcaaattgaagtagaaggaaaggctgtcgaaaaaataatggtagatggtaaagagttttttagtggtgatacaagattggctacagaaaacattccatcgaatgcagtagataaaattcagttttaa

SEQ ID NO: 24470 - protein, 196 aa, Unknown
  Obtained from environmental sample
  SIGNAL (1)...(18)
  misc_feature (1)..(196): Xaa is any amino acid
MKKILLIAIFLVSWVSTAQINLTGIVKDSIGAPLEMGNVIALDTVAKRIASYGFTDANGSFKLELARNTTYNIKISYVGFKEISEFIRTGDKDITKNYTMVEDNMLDGINIVSKMPVRIKGDTIIYDADSFKNGSERKLKDVLEKLPGVEINDAGQIEVEGKAVEKIMVDGKEFFSGDTRLATENIPSNAVDKIQF

SEQ ID NO: 24471 - DNA, 738 bp, Unknown
  Obtained from environmental sample
  misc_feature (1)..(738): n is a, c, g, or t
ttgtggtcatactttaagatgagcgtctatgataagagtactgataatttgaataatatcgactattggctaaactttggcgtttttggtaaacgtgaattcctgacagacaagtacagtgatagaaattcttatgtagatcctgattcaaataaagtagtctcttcttttcgtagcgcagcttctgaggttgcggctttggctatagatatgagaaaaaatgatattaaaattattatcaaaaatagtataacaagcgagtgtgacataacggtagagattatctcatacttaccgattagtgaaaaggacactattagctataaattaacaacattctatacgcctaaagaattgcagccttattccaatgctgatgtttcctcttattttaaagataaagtaactattaatgactctgtccctttaaacaaaatacttaaactcgaaactcgagatgacgttttcgcacgtattggtcaaacttctaggacgaatcagaatattaaagttgagctaccaaaagggttgtcaagctatatgtatactcaaacagaaggtggatataagcttttactgaagtttgtaattcatgagccaagttttgagtttgctagagttgactttagtttatctaatgctgcttatgacaaagaatctggtactacctatactcagaaaagatctaagtctaaaaccgtagaagaaaaaccttatgtgttaatgcgagatcgttaa

SEQ ID NO: 24472 - protein, 245 aa, Unknown
  Obtained from environmental sample
  misc_feature (1)..(245): Xaa is any amino acid
MWSYFKMSVYDKSTDNLNNIDYWLNFGVFGKREFLTDKYSDRNSYVDPDSNKVVSSFRSAASEVAALAIDMRKNDIKIIIKNSITSECDITVEIISYLPISEKDTISYKLTTFYTPKELQPYSNADVSSYFKDKVTINDSVPLNKILKLETRDDVFARIGQTSRTNQNIKVELPKGLSSYMYTQTEGGYKLLLKFVIHEPSFEFARVDFSLSNAAYDKESGTTYTQKRSKSKTVEEKPYVLMRDR

SEQ ID NO: 24473 - DNA, 474 bp, Unknown
  Obtained from environmental sample
  misc_feature (1)..(474): n is a, c, g, or t
atgaaactcttaaaaaaaatactattcgctttagttattttattagctatagctcagtttttcggaccagaaaaaaatttaggcaacttagaatcggttaacgcttttttagcagaaaccaatccgccagaaaacgttaaagcgattttgaaggaatcgtgttttgattgccatacaaacacaacaagatatccgtggtatagtaacataacgccaattaattattggttggcagagcatattaaagacggaaaaaaagatttagatttctctacttgggatgataattcagtaaaacgaaaagatcacaagtttgaagaaattatagaaatggttgagcaaagagaaatgcctttaccaagttatacgtacacgcacagtgaggcaaaattaagcgattctcaaattcaagagattatagagtgggcaaaccaagtgcgtttaggctatgtgttagtaccactcccagaataa

SEQ ID NO: 24474 - protein, 157 aa, Unknown
  Obtained from environmental sample
  SIGNAL (1)...(18)
  misc_feature (1)..(157): Xaa is any amino acid
MKLLKKILFALVILLAIAQFFGPEKNLGNLESVNAFLAETNPPENVKAILKESCFDCHTNTTRYPWYSNITPINYWLAEHIKDGKKDLDFSTWDDNSVKRKDHKFEEIIEMVEQREMPLPSYTYTHSEAKLSDSQIQEIIEWANQVRLGYVLVPLPE

SEQ ID NO: 24475 - DNA, 474 bp, Unknown
  Obtained from environmental sample
  misc_feature (1)..(474): n is a, c, g, or t
atgagctttaataaagtttacgagaaagaactttcttttcaggcaaatcggcgcaaagcgaccgtagaattcattaacataattagcgatctttggtatgataagtcaatagaactcgtaattttcagaaatcagctgcttaaccgaaatgttagcgatattctaaatcttcacgaatatgcgggagaatttgtagaaaaacccatttcaatatttgatacggtagaaatcgcaaaagcaatccaggatatggatctaccacctgctaaacttgatattggcaaattaacttacgaatatcatttagaagaccagggacatcttaatgcaatggcttttgtttctgacaaattgaaggatgcaaaaaatatgacaaagttattccaaaagacgttgtgctttatggttttgggcgcattggtcgtttggttgccaggggaacttatgggcagaatgggtaaggcagtcagttag

SEQ ID NO: 24476 - protein, 157 aa, Unknown
  Obtained from environmental sample
  misc_feature (1)..(157): Xaa is any amino acid
MSFNKVYEKELSFQANRRKATVEFINIISDLWYDKSIELVIFRNQLLNRNVSDILNLHEYAGEFVEKPISIFDTVEIAKAIQDMDLPPAKLDIGKLTYEYHLEDQGHLNAMAFVSDKLKDAKNMTKLFQKTLCFMVLGALVVWLPGELMGRMGKAVS

SEQ ID NO: 24477 - DNA, 675 bp, Unknown
  Obtained from environmental sample
  misc_feature (1)..(675): n is a, c, g, or t
ttgaataaggatgagagtatttttgaagataaacatgttcttaaaaccaaattagatcgattagttttagaagttattgaagcagaacagtctggaacagaaaataatgaaacagacatagaagaagaaattagcccatttaatcctgaagacataaaagtacacgccaaacagtttagtttgagacttgtatacgatatgattaagattggagatattgacttgtcaccagattttcaaagaaattttgtttggaacaattcccagaaatcaagacttattgaatctattctattaagaataccgttaccaatgttttatttttctgaggatgatgaaggtcgaattacaattgtagatggattgcaaagattaactacaataaaagagtttatggataatcaatttcctttgaagagtcttgaatatttagggaacagttgcgaaggcaagtatttttttgattcaggaaataaagaaggtattgatgcaaaatatgtaagatggtttaatcaaacacaattttcagtgaatgtaattgatccatcttctcctcctaaagttaaatatgatatttttagaagaataaatacaggtggtaaacctttaaataatcaggaaattagaaactgcttagcaagtaaagtattgagggagattttaataaaatggtag

SEQ ID NO: 24478 - protein, 224 aa, Unknown
  Obtained from environmental sample
  misc_feature (1)..(224): Xaa is any amino acid
MNKDESIFEDKHVLKTKLDRLVLEVIEAEQSGTENNETDIEEEISPFNPEDIKVHAKQFSLRLVYDMIKIGDIDLSPDFQRNFVWNNSQKSRLIESILLRIPLPMFYFSEDDEGRITIVDGLQRLTTIKEFMDNQFPLKSLEYLGNSCEGKYFFDSGNKEGIDAKYVRWFNQTQFSVNVIDPSSPPKVKYDIFRRINTGGKPLNNQEIRNCLASKVLREILIKW

SEQ ID NO: 24479 - DNA, 318 bp, Unknown
  Obtained from environmental sample
  misc_feature (1)..(318): n is a, c, g, or t
atgaaaaatgctgagtttttgtcggggaaaaaatatgcttttagaaaaattagaccttacgacttacagccatgggcaaaaaaacaattaataaacaaggcgctttttgttagttgttctgttttattagctgatattgatcatgaggttttaattgaaaaaaatcaaaaaaataaattacttaagcttttggcttccgaaatagagaatgatattgagttattaaattatttgtcctatggtactaatagtagaaacaacttattgtatgtttttagagcaatagaaaatctaatagaaaaatatatatatatataa

SEQ ID NO: 24480 - protein, 105 aa, Unknown
  Obtained from environmental sample
  misc_feature (1)..(105): Xaa is any amino acid
MKNAEFLSGKKYAFRKIRPYDLQPWAKKQLINKALFVSCSVLLADIDHEVLIEKNQKNKLLKLLASEIENDIELLNYLSYGTNSRNNLLYVFRAIENLIEKYIYI

SEQ ID NO: 24481 - DNA, 447 bp, Unknown
  Obtained from environmental sample
  misc_feature (1)..(447): n is a, c, g, or t
gtgcctattggtgttgttgaaactattaaaacaggtagagatatgaccgtagtttcatacggttcaacacttaaattagttgaagatgcagctaaagaattaactaaggtcgatattgatgttgaaattattgatgctcaaacattattaccttttgatatagatcatgatgttgtaaaaagtatccaaaagaccaataggctggttattatagacgaagatgtgcctggtggtgcttcagcctatttattagataatattataaacaaacaaaatgcttatcaatatttagatagtaaacctgttacaataacgtccaaaagccatagaactgcttatggttctgatggtgattatttttcaaagccatctatcgaagatatttttgaaggtatctatgatattatgaacgagggcaatcctctgaagtacaaaaaactttattaa

SEQ ID NO: 24482 - protein, 148 aa, Unknown
  Obtained from environmental sample
  DOMAIN (4)...(128): Transketolase, C-terminal domain
  misc_feature (1)..(148): Xaa is any amino acid
MPIGVVETIKTGRDMTVVSYGSTLKLVEDAAKELTKVDIDVEIIDAQTLLPFDIDHDVVKSIQKTNRLVIIDEDVPGGASAYLLDNIINKQNAYQYLDSKPVTITSKSHRTAYGSDGDYFSKPSIEDIFEGIYDIMNEGNPLKYKKLY

SEQ ID NO: 24483 - DNA, 723 bp, Unknown
  Obtained from environmental sample
  misc_feature (1)..(723): n is a, c, g, or t
atgataggtgagtcctgggaagtatctgacgttaataatgacgaaacgactgtattagaaggtccacttcaagggttgactttaaaacaattaatccaaaaatataaaggcgattttttaggcgaaaccgtttatactacatttggaaacaacttccctttgttaattaaatttattgatgcaaaaacgcctttatcaatacaagttcatccaagtaacgaagtcgctaaatcacgacacaattcttttggaaaaaacgaaatgtggtatgttatgcaagccgaaaaagaggctgaattaatcattggatttaaagaaaacttatctccagaacaatatgaacaacatttaaaggatggtaagctattagacgtaatgaaccatgaagttgtaagtaaaggagatactttttatattccaacaggacgtgtccatgctattggagctggtgttttgctagccgaaatacaacaaacatctgacattacatacagaatttacgactacgacagagttgataatagtacaggtgaaaaaagagaattacataacgatttagctaaggatgtcatagatttttccgtacacgacacctacaaaacacactataacanaacgactaaccaatctaatgatttagttcattcagcctattttaaaagcaattttattaaaattgatggtacactaaataaagattacagcaatatagattcgttttaa

SEQ ID NO: 24484 - protein, 240 aa, Unknown
  Obtained from environmental sample
  DOMAIN (1)...(237): Phosphomannose isomerase type I
  misc_feature (1)..(240): Xaa is any amino acid
MIGESWEVSDVNNDETTVLEGPLQGLTLKQLIQKYKGDFLGETVYTTFGNNFPLLIKFIDAKTPLSIQVHPSNEVAKSRHNSFGKNEMWYVMQAEKEAELIIGFKENLSPEQYEQHLKDGKLLDVMNHEVVSKGDTFYIPTGRVHAIGAGVLLAEIQQTSDITYRIYDYDRVDNSTGEKRELHNDLAKDVIDFSVHDTYKTHYNXTTNQSNDLVHSAYFKSNFIKIDGTLNKDYSNIDSF

SEQ ID NO: 24485 - DNA, 645 bp, Unknown
  Obtained from environmental sample
  misc_feature (1)..(645): n is a, c, g, or t
ttgttaatctattccaaacctacctattatatgagcaaatgtgaacaatgtattgtacgtcaatttaactcattaaaagaactctctagagaagaacttctaagagtttctgcttgtaaaacaagtagatttataaaaaaaggagaaactattttcgaagaaaacgaacatttagatggtgttttttgtattaaagatggtatttgtaaagtttctaaaatgagtgcaaatggtagaaaccaaattttaaatttggtaacaaaaggcagtttattaggggaaagatctttggtttctgatgaagtttcaaacctaaaagctgttgcattagaagacatggaagtttgttttgtgccaaaatctgaaattatgttggatctacaaaaaaaccctaatttttctatgagcgttttaaaagtgatggctagcaacttaaaacaagcagataatttgattgttgatatggctcaaaaaactgtaaaacaacgtttggctgaagctttattatacttgcataaaaattttaattttactgatgatgattttatagatgtgaatctttctcgagaagattttgcagatatcattggtgcagctacagaatctacaattcgcttattatcagactttaaaaagaaagtttaa

SEQ ID NO: 24486 - protein, 214 aa, Unknown
  Obtained from environmental sample
  DOMAIN (39)...(132): Cyclic nucleotide-binding domain
  misc_feature (1)..(214): Xaa is any amino acid
MLIYSKPTYYMSKCEQCIVRQFNSLKELSREELLRVSACKTSRFIKKGETIFEENEHLDGVFCIKDGICKVSKMSANGRNQILNLVTKGSLLGERSLVSDEVSNLKAVALEDMEVCFVPKSEIMLDLQKNPNFSMSVLKVMASNLKQADNLIVDMAQKTVKQRLAEALLYLHKNFNFTDDDFIDVNLSREDFADIIGAATESTIRLLSDFKKKV

SEQ ID NO: 24487 - DNA, 453 bp, Unknown
  Obtained from environmental sample
  misc_feature (1)..(453): n is a, c, g, or t
atgaaaaatattttcacaaaagaagtttccacagaagtaatagaaagaattgaaaatttaacttctgaaacgcaaccaatttggggtaaaatgtctgtagcacaaatgttagcacattgctgtgtaacttatgaaatggtatttacagatagacacccaaggccaaatgcgtttacaagatttatgatgaaaaccttgataaaaaacattgtaacttcagaaaaaccttatgttaaaaatgggagaactgctcgtcaatttttaattgtggaagaaaaagattttgtatcagaaaaaaagcgtttaatcaattttattgctcaaacccaagaattaggagaacaaaaatttgaaggaaaagaatctcattcctttggtaaattaacagctaaagaatggaataatatgttctataaacatttagatcatcatttaaatcaatttggggtttga

SEQ ID NO: 24488 - protein, 150 aa, Unknown
  Obtained from environmental sample
  misc_feature (1)..(150): Xaa is any amino acid
MKNIFTKEVSTEVIERIENLTSETQPIWGKMSVAQMLAHCCVTYEMVFTDRHPRPNAFTRFMMKTLIKNIVTSEKPYVKNGRTARQFLIVEEKDFVSEKKRLINFIAQTQELGEQKFEGKESHSFGKLTAKEWNNMFYKHLDHHLNQFGV

SEQ ID NO: 24489 - DNA, 753 bp, Unknown
  Obtained from environmental sample
  misc_feature (1)..(753): n is a, c, g, or t
atgaacgagataagaacgattgtttcagatattaaaaaaggagatataaaacccatttattttttaatgggagaagagccttattatattgataaaatatctgactatatagaagaaaaggttttagatgaagcagaaaaaggctttaatcagcaaataatgtatggtagagatgcaagtatagaagatatagttgcctctgcaaaacgttatccaatgatggctgaaaaacaggttctaattgtaaaagaagctcaagatttaagcagaaatatcgagaaattggttgcttatgctctaaatccacagccaaccacagttttggtgatcaactataaatacaaaaagttagataagcgtaaaaaactgcacaaagctattgcaaaatcgggtttaatttttgaaagtaaaaaattatatgacaatcaagtttcagactggattagaagagttctaagtggaaaaaaatatcaaatagagccaaaagcagctcanatgttggtagaatttttaggaactgatttaagtaaaatagctaatgaattagataagctaatgctaattctgcctcaagaaagtattattactgataaacatattgaagagaatatagggatttctaaagactttaataattttgagttacaaaaagcagttggaacaaaagacataaaaaaagccaacagaattattaattattttgtggaganccaaagaataatccacagtaatgacgatttctttgctgaatag

SEQ ID NO: 24490 - protein, 250 aa, Unknown
  Obtained from environmental sample
  misc_feature (1)..(250): Xaa is any amino acid
MNEIRTIVSDIKKGDIKPIYFLMGEEPYYIDKISDYIEEKVLDEAEKGFNQQIMYGRDASIEDIVASAKRYPMMAEKQVLIVKEAQDLSRNIEKLVAYALNPQPTTVLVINYKYKKLDKRKKLHKAIAKSGLIFESKKLYDNQVSDWIRRVLSGKKYQIEPKAAXMLVEFLGTDLSKIANELDKLMLILPQESIITDKHIEENIGISKDFNNFELQKAVGTKDIKKANRIINYFVEXQRIIHSNDDFFAE

SEQ ID NO: 24491 - DNA, 333 bp, Unknown
  Obtained from environmental sample
  misc_feature (1)..(333): n is a, c, g, or t
ttgctaaaaagcacgggcaagctgatacgattacagacaagatttttaaaaagtattcatgttcagcgcgcaccactgactgaaattaaagatttaaaaaaattattagatataaatggcattagtagcgatacgtttgatcaagatattgccagtatgccaattattgcagctgaacaagcaatgcaagataaacaaaataaatactcaaaattaggtgcgttaacaggcgttcctacttttattgtaaacgacaaatataaaatcaatctaaataccatcaagagccaagaagagcttgatgagttagtttcatttttactcgcactataa

SEQ ID NO: 24492 - protein, 110 aa, Unknown
  Obtained from environmental sample
  misc_feature (1)..(110): Xaa is any amino acid
MLKSTGKLIRLQTRFLKSIHVQRAPLTEIKDLKKLLDINGISSDTFDQDIASMPIIAAEQAMQDKQNKYSKLGALTGVPTFIVNDKYKINLNTIKSQEELDELVSFLLAL

SEQ ID NO: 24493 - DNA, 366 bp, Unknown; identical to SEQ ID NO: 23711
  Obtained from environmental sample
  misc_feature (1)..(366): n is a, c, g, or t

SEQ ID NO: 24494 - protein, 121 aa, Unknown; identical to SEQ ID NO: 23712
  Obtained from environmental sample
  misc_feature (1)..(121): Xaa is any amino acid

SEQ ID NO: 24495 - DNA, 336 bp, Unknown
  Obtained from environmental sample
  misc_feature (1)..(336): n is a, c, g, or t
ttggttaacaaacattttagtttggtcaaactgtacattcatttggtagaaaccttcatctgtattttgaatggcatctctgttttttccatttccattggtgccaaaatacccaacaacatcggatgcgttattaataaaaaccgagctgtatttaacggaattggcattgtctattttgtagtttacgtttgccatagctgttgttgttgtgccatattcatactcttcagcactatccacaaaggcttttttctcggtaagcgtaaaatctcttgtagttccttggcggtattcaaaattgttttcaaaagaaccggtagcaaaaatgcttaa

SEQ ID NO: 24496 - protein, 111 aa, Unknown
  Obtained from environmental sample
  misc_feature (1)..(111): Xaa is any amino acid
MVNKHFSLVKLYIHLVETFICILNGISVFSISIGAKIPNNIGCVINKNRAVFNGIGIVYFVVYVCHSCCCCAIFILFSTIHKGFFLGKRKISCSSLAVFKIVFKRTGSKNA

SEQ ID NO: 24497 - DNA, 816 bp, Unknown
  Obtained from environmental sample
  misc_feature (1)..(816): n is a, c, g, or t
atggcttcggaaagtttggcgtataaagaagggtttcttcatcaacctattgtggatatttgggcgtatctatttaaggataaacttttggaagcgtttcctgaattaatttttcctcataaaaaacttatagtccatcctgtaattgaagcagctcagccatatgcgtataagcagaaaggaatatttagatcctttgtgggatttgtaaatagtctatttcaaggaaaatttcgaaatattattgagcgcatccaagtggttttgggtataaagcgcgatccgttggatactttcaaatggattgtgaacaaggctacacggagcaattttaaacttacggtattcttccttttgggaaatgcgctgtcgtttaacgaaagtatgaacacccatcgacagaaattcaaaatgctgataaaatttgtatcggactacaaagacgtgggccttatcttttcattcaattcattgagcgattatgaaatgctgaaaagcgaaaagcgccggatgcaggaaataaccaatcgttccctcgccagctctatgaattctgagtttttggtaaaccttcctgacatataccgccatttggtagaacttgaagtgaagcgtgattttacaatggtatttcgcgacacagttggtttccgtgccggcacctgcacgccatttctattttatgatttggattatgaaataaaaacccctttgattatacatccttcggcaatgaccactttggcgtttcaaaaaaatacgcttcagatattgaaaaaaccgttaatactacgattgctgctgtggaaaaagtaa

SEQ ID NO: 24498 - protein, 271 aa, Unknown
  Obtained from environmental sample
  misc_feature (1)..(271): Xaa is any amino acid
MASESLAYKEGFLHQPIVDIWAYLFKDKLLEAFPELIFPHKKLIVHPVIEAAQPYAYKQKGIFRSFVGFVNSLFQGKFRNIIERIQVVLGIKRDPLDTFKWIVNKATRSNFKLTVFFLLGNALSFNESMNTHRQKFKMLIKFVSDYKDVGLIFSFNSLSDYEMLKSEKRRMQEITNRSLASSMNSEFLVNLPDIYRHLVELEVKRDFTMVFRDTVGFRAGTCTPFLFYDLDYEIKTPLIIHPSAMTTLAFQKNTLQILKKPLILRLLLWKK

SEQ ID NO: 24499 - DNA, 837 bp, Unknown
  Obtained from environmental sample
  misc_feature (1)..(837): n is a, c, g, or t
ttgtggctggcacgatggtataaaattcctctagttggatttggaacctataaatgcacagagcaagaagggatagattccgtatctactgctttatctaaaggctatcggttattagacacagctgctatttacggaaatgaagaagctgttggcaaaggtattaaagctagtggtattgatagaaaagatatatatatcaccacaaaactttggcgagaaaatttaggctatcaatctgctaaggaccaatttaataaatccttgcaacgattaaatgtagactatattgatttatacttaatacattggcctgctaacgctaaaaactacgataattggcaacacgctaatgcagaaagttggcgcgcaatggaagaattacaagctgaaggtaaaattaaatccataggagttagtaattttttccaagaacatttggaagcgttatttaaaactgcaaaggttattcctgctgttaatcaaattgagtttcatcctgggtattggcagaaagaattaaccgaatactgtcaattaaaaaatataactgttgagtcttggtcgcctttagctcgaggaaaagtatttgataaccaacttttaaaagacattgccaaagcacatcaaaaatcggtgtcacaaatatgtcttcgttggattactcagcataacgttattattattcctaaatctaattcgccagaaagaattgaagagaatattaatatttttgattttgaactgtctgcggacganatgaaacaaataaacaatctcccaaaaatggggtttagtggagagcatcctaatttttggcctgatcgtattagttaa

SEQ ID NO: 24500 - protein, 278 aa, Unknown
  Obtained from environmental sample
  DOMAIN (3)...(262): Aldo/keto reductase family
  misc_feature (1)..(278): Xaa is any amino acid
MWLARWYKIPLVGFGTYKCTEQEGIDSVSTALSKGYRLLDTAAIYGNEEAVGKGIKASGIDRKDIYITTKLWRENLGYQSAKDQFNKSLQRLNVDYIDLYLIHWPANAKNYDNWQHANAESWRAMEELQAEGKIKSIGVSNFFQEHLEALFKTAKVIPAVNQIEFHPGYWQKELTEYCQLKNITVESWSPLARGKVFDNQLLKDIAKAHQKSVSQICLRWITQHNVIIIPKSNSPERIEENINIFDFELSADXMKQINNLPKMGFSGEHPNFWPDRIS

SEQ ID NO: 24501 - DNA, 933 bp, Unknown
  Obtained from environmental sample
  misc_feature (1)..(933): n is a, c, g, or t
atgagtaattcggttagtaaaagatatgcacaaagaggtgtttctgcatcaaaggaagatgttcacaatgcgataaagaacatagacaaaggtttgtttcctaaagcgttttgtaaaatagtaccagattatttaacaaacgatgatgactattgtctcattatgcatgcagatggagcaggtacaaaatcgtcattagcttatatgtattggaaagaaactggagacctttcagtttggaaaggtatagcgcaagatgcattaataatgaatattgatgatctaatatgtgttggagcaactgataacattatgttgtcttctacaattggtagaaataaaaacttaattcctggagacgttatttctgcaataataaacggaaccgaagaattaatagaagatttaaaatcgtttggtgttactattcattctacaggtggtgaaacagcagatgttggagatttggtaagaactattattgtcgattctacagttactgctaggttaaaacgcagtgatgttattgataatgctaatattacagaaggcgatgttattgttggtttagaatcttttggcccagcctcttacgaaacggaatataatggaggtatgggaagtaatggacttacttctgcaagacacgatgtgttttcaaagtatttagctgaaaagtatcctgaaagtttcgacgctgctgtgccaaaagacttagtgtattcagggcatacaaaactgaccgaattcagtgaaaactccccaatagatgcaggtaaatttggtatgtcaccaacccgtacgtattgctccgattataaaagcaattttaaacacctattaaaagtgaaacaatttcagggaaaggggccattgcacggggtggaaccccaaacccaagaatcctccatttttaaagaaaacctttcaaaa

SEQ ID NO: 24502 - protein, 311 aa, Unknown
  Obtained from environmental sample
  misc_feature (1)..(311): Xaa is any amino acid
MSNSVSKRYAQRGVSASKEDVHNAIKNIDKGLFPKAFCKIVPDYLTNDDDYCLIMHADGAGTKSSLAYMYWKETGDLSVWKGIAQDALIMNIDDLICVGATDNIMLSSTIGRNKNLIPGDVISAIINGTEELIEDLKSFGVTIHSTGGETADVGDLVRTIIVDSTVTARLKRSDVIDNANITEGDVIVGLESFGPASYETEYNGGMGSNGLTSARHDVFSKYLAEKYPESFDAAVPKDLVYSGHTKLTEFSENSPIDAGKFGMSPTRTYCSDYKSNFKHLLKVKQFQGKGPLHGVEPQTQESSIFKENLSK

SEQ ID NO: 24503 - DNA, 696 bp, Unknown
  Obtained from environmental sample
  misc_feature (1)..(696): n is a, c, g, or t
atgaaagaaaatccccagtatgatgagatagacctcaaatttgtaaatgcagtagatgaagtgatcgctgtaaattctgagttaggcattaaacccaacaatgatagctcaatcggcaaagaggtatatcccactaatagaagtatagtttctgcagtaagaagtagatcgaagcatattccgcatttagctctcatcaattttgctaagcgttttaatgtagatatgaattacttctacaatgaaaccccattgcaatatcagccaccaactatcacaaatattactgtaaagaaaaacggaataagtagtactggagataacgcgactaatattcacgcaggtaatggaaagataaaaggaatcaacaatgctgaggctggctcaaagaacaccttagtagaagttgtagaagtcaatacaatgattaacaactttatatctcaaatagatggcgaacgagtaaaacagttcctgactattatctcaaaaatacaagtggagagcaaatcttcatcaaaaaaattagaatgtattttaatagagaaatcagaagaaataaaagaaatgcgtatttcatttaaagaagaaatgggagagctaagagaagagcttaaagagacgcgtgagaaacttgatatttctctaaaaagagaagtggatttattgagagagctattaaacgaaaggaaatga

SEQ ID NO: 24504 - protein, 231 aa, Unknown
  Obtained from environmental sample
  misc_feature (1)..(231): Xaa is any amino acid
MKENPQYDEIDLKFVNAVDEVIAVNSELGIKPNNDSSIGKEVYPTNRSIVSAVRSRSKHIPHLALINFAKRFNVDMNYFYNETPLQYQPPTITNITVKKNGISSTGDNATNIHAGNGKIKGINNAEAGSKNTLVEVVEVNTMINNFISQIDGERVKQFLTIISKIQVESKSSSKKLECILIEKSEEIKEMRISFKEEMGELREELKETREKLDISLKREVDLLRELLNERK

SEQ ID NO: 24505 - DNA, 984 bp, Unknown
  Obtained from environmental sample
  misc_feature (1)..(984): n is a, c, g, or t
ttgactaaaaataaaatagaagacacaatggaatctgccatgaaacgttctaaccgatggaaacggatgattaaagcagataaatccgagaaggaaatccgtaaatccttcgaaactaaaaccgagatgactgttttttcctggaaaggagatattgacaccattatgtctccaagagattcaataagatattacaaacatttcttacaaacaggtgtgctttctgtcgagcctcaaaccggccatgtaaaagcttgggttggtggtattaattataaacattttcaatatgaccacgtaaaacaagggtcacgtcaggttggttcaactttcaaaccttttgtatacgccacagccattaatcaattacaattatctccttgcgaagaatttacaaatacacagtatactattcctaaaggaaagtatggattgcccgaagattggactccaagaaattctagtggagaatatggaggagtaagaacgcttaaaaacgccttagctaattctgtaaacgtgatcactgcacagcttattgataaagcaactcccaccaatgtagttcggttggcacagaatttaggtataaaaagtgaaattccaccagtaccttccattgctttaggaagtgtggatttaactttatatgaaatggttggtgcttatagcacttttgccaataaaggtatgtatgttgaacccatgatgatcttaggcattgaagataaaaacggtactgtattagatgattttactcctaacactaaagaagttttgagcgaagaatcagcttataccattatcaatttattggagggtgttacaactgccggtaatggtcaacgattacggagttcggcaggcgtttatcctgatagtggtgaatctggctatcctaataaaatcacaaaccctattgccggtaaaaccgggactacccaaaaccaatcagatggatgggttatgggggattggtcctga

SEQ ID NO: 24506 - protein, 327 aa, Unknown
  Obtained from environmental sample
  DOMAIN (71)...(309): Penicillin binding protein transpeptidase domain
  misc_feature (1)..(327): Xaa is any amino acid
MTKNKIEDTMESAMKRSNRWKRMIKADKSEKEIRKSFETKTEMTVFSWKGDIDTIMSPRDSIRYYKHFLQTGVLSVEPQTGHVKAWVGGINYKHFQYDHVKQGSRQVGSTFKPFVYATAINQLQLSPCEEFTNTQYTIPKGKYGLPEDWTPRNSSGEYGGVRTLKNALANSVNVITAQLIDKATPTNVVRLAQNLGIKSEIPPVPSIALGSVDLTLYEMVGAYSTFANKGMYVEPMMILGIEDKNGTVLDDFTPNTKEVLSEESAYTIINLLEGVTTAGNGQRLRSSAGVYPDSGESGYPNKITNPIAGKTGTTQNQSDGWVMGDWS

SEQ ID NO: 24507 - DNA, 342 bp, Unknown
  Obtained from environmental sample
  misc_feature (1)..(342): n is a, c, g, or t
atgcataaactagataacatctgcgaggcttttggaatagaaacgcctttaaagtcaattgaaacgttacaatctggacatataaacgatacatatttggtcgcccaacaaaatgacgagaagtttatcattcaaaagttaaacagtcttgtttttaaagatgccaaagctgttattgccaataaaattgtggtttcaaaacatttacatgcgaattacaaaaaaacaaactcacattatcagtcggtaaattatttaaaaacgacgcagaatgcctatatatttcaggatgaaacgtgctattggaatgttatgcaatttattcccctcgagccgatctga

SEQ ID NO: 24508 - protein, 113 aa, Unknown
  Obtained from environmental sample
  misc_feature (1)..(113): Xaa is any amino acid
MHKLDNICEAFGIETPLKSIETLQSGHINDTYLVAQQNDEKFIIQKLNSLVFKDAKAVIANKIVVSKHLHANYKKTNSHYQSVNYLKTTQNAYIFQDETCYWNVMQFIPLEPI

SEQ ID NO: 24509 - DNA, 768 bp, Unknown
  Obtained from environmental sample
  misc_feature (1)..(768): n is a, c, g, or t
gtggatataagcagttacaataactatctattaatgatggctatgggaacactttccgaagaaaaaatacaggaaaaaaagattacgaaaatcgttttttcgcacccactgtttaatgatgtttttgaaaaggaagttgcaaattttcagtatccgaaagttaattccttttacagtatttcaacaaatgccacgtctgcaattggttttgaggacaaccaaccatttttgcttcaaaagcacaaggcttatttgttcactgcggcaatcaacaaagtgaattcaaactttcagaattcgcctttggtggtgccagctatatacaatatggccttgcaaagcttgcctttgtcgcgattgtactataccattggggaacaaaattcaatcgcaatccctgtgaaattgggagccgatgaaattctgactataaaggacagtacggcacagttcattccgcttcagcaaacaaaagccaatttcgttttaatgacaacgacggacgaacccaacaaagccggtaattatcagattgtgaaagaaaatgagtttttggaaaatataagttacaactattccagaaatgaaagtaaattgcaatatctaaatcccgaagattgggaaggcgcgcaaatctataaaaccgtggatgacctatttgattctattaacgaagcaaattccattaacagtttttggaaatggtttgctatttttgcattgctgtttttactttttgaaatgcttatcttaaaattctacaaatga

SEQ ID NO: 24510 - protein, 255 aa, Unknown
  Obtained from environmental sample
  misc_feature (1)..(255): Xaa is any amino acid
MDISSYNNYLLMMAMGTLSEEKIQEKKITKIVFSHPLFNDVFEKEVANFQYPKVNSFYSISTNATSAIGFEDNQPFLLQKHKAYLFTAAINKVNSNFQNSPLVVPAIYNMALQSLPLSRLYYTIGEQNSIAIPVKLGADEILTIKDSTAQFIPLQQTKANFVLMTTTDEPNKAGNYQIVKENEFLENISYNYSRNESKLQYLNPEDWEGAQIYKTVDDLFDSINEANSINSFWKWFAIFALLFLLFEMLILKFYK

SEQ ID NO: 24511 - DNA, 378 bp, Unknown
  Obtained from environmental sample
  misc_feature (1)..(378): n is a, c, g, or t
ttgggttatggagataattttcaatctgtgttgatgagcaacgcaattcgcgaaatgaaacgttttattaaaaaagttcataaaatgaaacgaaatattaatgattctgcttatttaggcgatttgttagtaacaggatattctacctttagtagaaatagaatgtttggaaatatgattggaaaaggttacactgtaaaatctgcacaacatgaaatgagcatgattgcagaaggctattatgctactaaaagtgcgtataaaataaaagaagaaaaaggtgcaaaaactccaattatagatgctgtttacggaattttatatgaccataaagatcctaaaaaagtatttaaaaagttgactaataaattggattag

SEQ ID NO: 24512 - protein, 125 aa, Unknown
  Obtained from environmental sample
  DOMAIN (1)...(120): NAD-dependent glycerol-3-phosphate dehydrogenase C-terminus
  misc_feature (1)..(125): Xaa is any amino acid
MGYGDNFQSVLMSNAIREMKRFIKKVHKMKRNINDSAYLGDLLVTGYSTFSRNRMFGNMIGKGYTVKSAQHEMSMIAEGYYATKSAYKIKEEKGAKTPIIDAVYGILYDHKDPKKVFKKLTNKLD

SEQ ID NO: 24513 - DNA, 339 bp, Unknown
  Obtained from environmental sample
  misc_feature (1)..(339): n is a, c, g, or t
ttgtttaatattttagcaacttcttttaataatgaggttgtatttttaaacgtaaaatcgcacaaatctgaacgtacaattacgtttcctaaatctaaagcaagtctctttatattttntctgatacgcaattcacttgcaggcgaaagcctattaatagccatcattacagcaccaacttttacatctttttttaagcttgcagaaacttctggtaaaataattcgtgctaaagaagacacattaatcaatttttcgtgtaaagcttcttctataaaaggtgtttttctgatcgtactttctacaacttcctgtatggttttcattgataaagtttaa

SEQ ID NO: 24514 - protein, 112 aa, Unknown
  Obtained from environmental sample
  misc_feature (1)..(112): Xaa is any amino acid
MFNILATSFNNEVVFLNVKSHKSERTITFPKSKASLFIFXLIRNSLAGESLLIAIITAPTFTSFFKLAETSGKIIRAKEDTLINFSCKASSIKGVFLIVLSTTSCMVFIDKV

SEQ ID NO: 24515 - DNA, 921 bp, Unknown
  Obtained from environmental sample
  misc_feature (1)..(921): n is a, c, g, or t
ttgttggtaaaccagagtttgctaaaaagtcaagaaacgaacagtttttctttgtcaataacccgttttattaaaagtgcctatttaaatcatgctattaactcagcttttgaaggcttacttaaagatggtgcacagcctagttattatttaaatttgacggtaaatccgcaaacaatagatataaatattcatccaactaaaaccgaaattaagtttgatgacgaacatacattatacgctatattaagatctgcagtaaaacatagtttagggcagtttaatattgctccagttttagattttgacagagatgcaaatttggatacgccatacagttaccagcaaaaaggaatgccaagtgtggaggtggatcgtacatttaatccttttaaagaggaaacacctaaagttaaaaatgtctctaactacaaaaaagaatctgttgctacagcaagttgggacagtttatatgttggtttagaatctaaaggaacaaaaaccaatacagagtttagtgaagtgcattttgaaagcgaaccaaataccgagagcttttttaaaaatgaaaatgaagtagaaacaaagcaatccacttatcaattaaataataaatttataataagtaccataaaatctggaatgttagttatagatcagcatcgcgcacaccaacgtgtattgtatgaagattatttaagacatattacaattaaggaaggtgtaagccaacaactattatttccgttagacctacacttttcaaagcaagaaatagcattaataaatcaattaaaagacgacttggagtctacaggttttgttttttcatctattaaagatgaaacagtagaaataacaggtgtaccagttaaagtgcccgaaagtgaagtatccctaatcttagagccattaaattag

SEQ ID NO: 24516 - protein, 306 aa, Unknown
  Obtained from environmental sample
  DOMAIN (4)...(92): DNA mismatch repair protein, C-terminal domain
  misc_feature (1)..(306): Xaa is any amino acid
MLVNQSLLKSQETNSFSLSITRFIKSAYLNHAINSAFEGLLKDGAQPSYYLNLTVNPQTIDINIHPTKTEIKFDDEHTLYAILRSAVKHSLGQFNIAPVLDFDRDANLDTPYSYQQKGMPSVEVDRTFNPFKEETPKVKNVSNYKKESVATASWDSLYVGLESKGTKTNTEFSEVHFESEPNTESFFKNENEVETKQSTYQLNNKFIISTIKSGMLVIDQHRAHQRVLYEDYLRHITIKEGVSQQLLFPLDLHFSKQEIALINQLKDDLESTGFVFSSIKDETVEITGVPVKVPESEVSLILEPLN

SEQ ID NO: 24517 - DNA, 588 bp, Unknown
  Obtained from environmental sample
  misc_feature (1)..(588): n is a, c, g, or t
atggaagaatctaaaggtaattttatatcgaatcaaaatatagatgcagacaccatcaatattagagaagaactagaaaaatatgtcatcaattggaagtggtttcttttagcgatcattatttctatattaggagcttttctatatttacgatataccatccctacgtatactgccacaacttctattttgataaaagataataataaatcagggatttcctctgaattggctgcgtttgaagatttaggcattattggaggaggatcttccaataatcctgaaaatgaaattgaaatcttaaaatctagaaaaataatcggcaaagttgttgatgaactggatctagaagtttcttattttgcagaagggagagtcaagaaaagtgaagtgtatataaagaagccattagaaatagcgtttttaagtaaaaaccctgtatatgctgtaaaagatacttcttttataatttctgttttagacaataaaaagtttgagtttagaaacatcgaagatgagttctcatccgtgtcaagttttgatgaactcaataatagttcttttggtgtttttaaagtggtgccctaa

SEQ ID NO: 24518 - protein, 195 aa, Unknown
  Obtained from environmental sample
  DOMAIN (17)...(159): Chain length determinant protein
  misc_feature (1)..(195): Xaa is any amino acid
MEESKGNFISNQNIDADTINIREELEKYVINWKWFLLAIIISILGAFLYLRYTIPTYTATTSILIKDNNKSGISSELAAFEDLGIIGGGSSNNPENEIEILKSRKIIGKVVDELDLEVSYFAEGRVKKSEVYIKKPLEIAFLSKNPVYAVKDTSFIISVLDNKKFEFRNIEDEFSSVSSFDELNNSSFGVFKVVP

SEQ ID NO: 24519 - DNA, 792 bp, Unknown
  Obtained from environmental sample
  misc_feature (1)..(792): n is a, c, g, or t
atgtcttgggagggcattgctaaggaaggaggagtgaaatttaaaaagggaaagaaaccagaaaagctacttaaacgctgtattgaactaacgacaaatgagggtgatttagtttttgattctttcttagggtcaggaactacagctgcagttgcacacaaattaaatagaaaatatattggtattgagttaggtgagcaggcaaaaacacattgtttttctcgcttaaaatcagtagtaaataaggaccaaacaggtatcagcaaagctataaactggcaaggcggaggcggtttcaaattctatacccttgcacccagtttattaaagcaagataagtttggcaattgggtcattagccaagagtacaatgccgatatgttggcagcagcaatggcaaagcaagagggttttaaataccaacctcacgaaagcagctattggaaacaagggcaaagctccgagcaagattttatttttaccacgacacagtttcttactgtagaagccttagacagcatcaaagacgaaatgcaaccaggcgaaactttgctcatttgttgtaagtctttccaaaaagaatgcaaaggcaagtttggcaacatcaccatcaaaaaaattcctttaatgcttttaggcagatgcgaatatggtaaagaagattatagcttgaatattatcaagatgcctgtagaagataaaaacgaagaatcagaggataatattgaagaaatcagcgtacaagccattagagataaaaacaaatcaaccgaccaaacctcattattttaa

SEQ ID NO: 24520 - protein, 263 aa, Unknown
  Obtained from environmental sample
  misc_feature (1)..(263): Xaa is any amino acid
MSWEGIAKEGGVKFKKGKKPEKLLKRCIELTTNEGDLVFDSFLGSGTTAAVAHKLNRKYIGIELGEQAKTHCFSRLKSVVNKDQTGISKAINWQGGGGFKFYTLAPSLLKQDKFGNWVISQEYNADMLAAAMAKQEGFKYQPHESSYWKQGQSSEQDFIFTTTQFLTVEALDSIKDEMQPGETLLICCKSFQKECKGKFGNITIKKIPLMLLGRCEYGKEDYSLNIIKMPVEDKNEESEDNIEEISVQAIRDKNKSTDQTSLF

SEQ ID NO: 24521 - DNA, 351 bp, Unknown
  Obtained from environmental sample
  misc_feature (1)..(351): n is a, c, g, or t
ttgaaacaagggcaaagctccgagcaagattttatttttaccacgacacagtttcttactgtagaagccttagacagcatcaaagacgaaatgcaaccaggcgaaactttgctcatttgttgtaagtctttccaaaaagaatgcaaaggcaagtttggcaacatcaccatcaaaaaaattcctttaatgcttttaggcagatgcgaatatggtaaagaagattatagcttgaatattatcaagatgcctgtagaagataaaaacgaagaatcagaggataatattgaagaaatcagcgtacaagccattagagataaaaacaaatcaaccgaccaaacctcattattttaa

SEQ ID NO: 24522 - protein, 116 aa, Unknown
  Obtained from environmental sample
  misc_feature (1)..(116): Xaa is any amino acid
MKQGQSSEQDFIFTTTQFLTVEALDSIKDEMQPGETLLICCKSFQKECKGKFGNITIKKIPLMLLGRCEYGKEDYSLNIIKMPVEDKNEESEDNIEEISVQAIRDKNKSTDQTSLF

SEQ ID NO: 24523 - DNA, 471 bp, Unknown
  Obtained from environmental sample
  misc_feature (1)..(471): n is a, c, g, or t
atggccgaaatatttggagcaccatttattttatattctaaaaaccttaataaatcgtttagaaacgcgtgcaacaaattaggaaaacccatcttactttatgaaggtggaaaatcttttgatttagacaatacggttactaatacaggtgttaatggtgcaaaacgcatcatgaatcattttgggatgttacgcagacaatttaaggttacagaacctaaaaaagagtgtgttaaaataaccgaaagctcttggatgcgtgctaaacactctggtatgtttaaagcaactataaaagttggtatagaggttaaaataggtgatgacataggaaacataacagatccttatggtaaatttaatcactttgttaaagcaaaacactctggttatataattaatattaatcaatcacctattgtttatcaaggtgacgcattgtttcatatctctacagaagtcttaaaatag

SEQ ID NO: 24524 - protein, 156 aa, Unknown
  Obtained from environmental sample
  misc_feature (1)..(156): Xaa is any amino acid
MAEIFGAPFILYSKNLNKSFRNACNKLGKPILLYEGGKSFDLDNTVTNTGVNGAKRIMNHFGMLRRQFKVTEPKKECVKITESSWMRAKHSGMFKATIKVGIEVKIGDDIGNITDPYGKFNHFVKAKHSGYIININQSPIVYQGDALFHISTEVLK

SEQ ID NO: 24525 - DNA, 594 bp, Unknown
  Obtained from environmental sample
  misc_feature (1)..(594): n is a, c, g, or t
atgaatagaattaaaccctttctgattttactttttcttacgagtttaacttatagtcaggatgtgaaaatgacaacagaatattcgtctgaaaatcaagatacggctgatttacttcaatttgagaatattgatttttataaagtaaagtttattggaaaaaatatctctgaaaaaaattatgtgctgatagctaaagaaatatgggatggaaaattaaaaagtaccgacactataattgacacttcaaaatatccgaaaacatctgaatctaaatcagatactttaaaattaaaagttattgctaaacggacatttgaacctaaattgaaattgtggttccgattcccaaaattcggaattaacaaaaaatatgacgcaataatgtcggacgactatagtttgagagatactggaattagcgaaagtattgaatatggtaaaaacttttacgcctttacctatatgttaccttatgaaaaaggagattataaatattggtgcgcagtcgaagatagtggtaaggatatagaaaattgggggaaagaatttggaataaaacactatgttatatttgaaatgaaatttgaataa

SEQ ID NO: 24526 - protein, 197 aa, Unknown
  Obtained from environmental sample
  SIGNAL (1)...(19)
  misc_feature (1)..(197): Xaa is any amino acid
MNRIKPFLILLFLTSLTYSQDVKMTTEYSSENQDTADLLQFENIDFYKVKFIGKNISEKNYVLIAKEIWDGKLKSTDTIIDTSKYPKTSESKSDTLKLKVIAKRTFEPKLKLWFRFPKFGINKKYDAIMSDDYSLRDTGISESIEYGKNFYAFTYMLPYEKGDYKYWCAVEDSGKDIENWGKEFGIKHYVIFEMKFE

SEQ ID NO: 24527 - DNA, 690 bp, Unknown
  Obtained from environmental sample
  misc_feature (1)..(690): n is a, c, g, or t
gtgttttacaatttcatgactacgactaaggacatttttacaattacaactcctgatcagtttaaggcaaaagccttagaggtgtttcgttttcagtttgaaaacaatacaatctatcgttcgttttgcgacttactgtatattaatccaagtgatatctcagacttgcacgagattccgtttttacccatacaattttttaaatctcatcaggtattaagtacaactaaccctattgaaactactttttcaagtagtggtactacaggacaaattaccagtaagcatttggtatctgacttaagcgtgtatgaaactagttttaaattaggttttaagcatttttatggtaatgtaaaagattataccattttagccttattacccaattatttagaacgcgaaggctcctctttagtttatatggtagaccatttaattaaagactccaataagccacaaagtggtttttacttaaataaattaagacaattaaaggacacactaattgcattggatcatgctgaagaaaaggtgttacttattggggtatcctttgcgctattagatttaaagatttgcacactttttacctttaacatactattattattggaaactggtggtattgaaaagaccttccttaaaaaagtgattaaaaaaaaaatttcccccaccccccttaaaagc

SEQ ID NO: 24528 - protein, 230 aa, Unknown
  Obtained from environmental sample
  misc_feature (1)..(230): Xaa is any amino acid
MFYNFMTTTKDIFTITTPDQFKAKALEVFRFQFENNTIYRSFCDLLYINPSDISDLHEIPFLPIQFFKSHQVLSTTNPIETTFSSSGTTGQITSKHLVSDLSVYETSFKLGFKHFYGNVKDYTILALLPNYLEREGSSLVYMVDHLIKDSNKPQSGFYLNKLRQLKDTLIALDHAEEKVLLIGVSFALLDLKICTLFTFNILLLLETGGIEKTFLKKVIKKKISPTPLKS

SEQ ID NO: 24529 - DNA, 375 bp, Unknown
  Obtained from environmental sample
  misc_feature (1)..(375): n is a, c, g, or t
atgaaagaaaagataaaaaaaaatgctgtagatttttataaaatggcttatgaaggaaatccaagaaaagcaacggaattatatgttggtgcggaatatatccaacataatcctgatgtagaaaacggaattgaaggatttattgaatattttgagcgaatgcaaaccgaatatccaaataaatcaattgaatttgtgagagtaatagcggaaaacgatttggttgctctacatactcatcaaatttggcctgataacgatgaatatgtgacaatggatttctttagatttgataagagcggaaaaatcgttgagcattgggattcgattcagcaaataccgaaaaattccgccaataaaaacaaaatgtattaa

SEQ ID NO: 24530 - protein, 124 aa, Unknown
  Obtained from environmental sample
  misc_feature (1)..(124): Xaa is any amino acid
MKEKIKKNAVDFYKMAYEGNPRKATELYVGAEYIQHNPDVENGIEGFIEYFERMQTEYPNKSIEFVRVIAENDLVALHTHQIWPDNDEYVTMDFFRFDKSGKIVEHWDSIQQIPKNSANKNKMY

SEQ ID NO: 24531 - DNA, 480 bp, Unknown
  Obtained from environmental sample
  misc_feature (1)..(480): n is a, c, g, or t
ttgcatttaattgatagaaaagatattacattgaaaattgcaggtgattataatacctatcaaaaaaaattaagcgaattagttgagcgtaaaggtctccaaaatagaatagaatttttgggaatgatatctggtaataaaaaagaagagttatataaaaatgcatttttgtttgtttccccttctagggcagaagcaataggtatagtaaatcttgaagccgcaagatttaaaacgccagtaattacctcttataatactggtttagacaagggttgggcttcaaacgggggcatgttaattaatcctaatgaaaatgaattaacagaagcattaaatacagcattaaattggacagatgaagaaagaaattataatggtcagaaactttttaattttgtgaaaatgaattattcttgggaagaaagaattatcgattggataaaactttacaaacaaataattgaaaaaaacttatga

SEQ ID NO: 24532 - protein, 159 aa, Unknown
  Obtained from environmental sample
  DOMAIN (1)...(133): Glycosyl transferases group 1
  misc_feature (1)..(159): Xaa is any amino acid
MHLIDRKDITLKIAGDYNTYQKKLSELVERKGLQNRIEFLGMISGNKKEELYKNAFLFVSPSRAEAIGIVNLEAARFKTPVITSYNTGLDKGWASNGGMLINPNENELTEALNTALNWTDEERNYNGQKLFNFVKMNYSWEERIIDWIKLYKQIIEKNL

SEQ ID NO: 24533 - DNA, 450 bp, Unknown
  Obtained from environmental sample
  misc_feature (1)..(450): n is a, c, g, or t
atgagaatattaattactggaggctctggatttattggcacaaatttggtcgaattttataaagataattatagcgttgtcaatgctgatatagtaaagcccagaaatatggatcacgataaatactggaaacaaattgatattttgaaatttgatgaattatatgatttttgctcaaattttagaccagaatttatagtacatatggctgctcgcacagatttagatgggaaaagtattgaagcgtatgaagcaaatattgccgggagtaaaaaacatcatagaagttgcagagaaattacaaaacgtaaagaaaaatatatttgcttccctctaggcttgtatgtaaaattggctaccaccccaaagatgaatatgattattggtccacaaacattttatggaaaaaggaaaaatggttgggtgaaaaaaatccttaggaaagtttaa

SEQ ID NO: 24534 - protein, 149 aa, Unknown
  Obtained from environmental sample
  misc_feature (1)..(149): Xaa is any amino acid
MRILITGGSGFIGTNLVEFYKDNYSVVNADIVKPRNMDHDKYWKQIDILKFDELYDFCSNFRPEFIVHMAARTDLDGKSIEAYEANIAGSKKHHRSCREITKRKEKYICFPLGLYVKLATTPKMNMIIGPQTFYGKRKNGWVKKILRKV

SEQ ID NO: 24535 - DNA, 519 bp, Unknown
  Obtained from environmental sample
  misc_feature (1)..(519): n is a, c, g, or t
atgaaaaaactaatccttatttgcgcacttttaataagtgttttcagtactgcacaaaataatcctctaatagataacgcacaatttagtgtgttaaccatcggccctggaacgtctttaaacgatgcttttggtcacagtggatttcgtataaaaacagcattttctgacgacgtttataattatggaatgttcgattttgatgcccctaacttctatttaaattttgcaaaaggcaaactggattattatatgggagccaacagttttaaacgctttaaagacgtttatatttggcaaaacagaacgataaaagaacaaatactaaaccttacaccaacacaaaaaaacgagttatatgcgtatttaattcacaatttaaaacctgaaaataagtattatgcctatgatttcttttttgataattgtgctacgcgtattcgcgatgtttcagaaaaagcgtggcacggcaatttagaatacaccacaccaaaatcttataaagaagaaaacgtttag

SEQ ID NO: 24536 - protein, 172 aa, Unknown
  Obtained from environmental sample
  SIGNAL (1)...(18)
  misc_feature (1)..(172): Xaa is any amino acid
MKKLILICALLISVFSTAQNNPLIDNAQFSVLTIGPGTSLNDAFGHSGFRIKTAFSDDVYNYGMFDFDAPNFYLNFAKGKLDYYMGANSFKRFKDVYIWQNRTIKEQILNLTPTQKNELYAYLIHNLKPENKYYAYDFFFDNCATRIRDVSEKAWHGNLEYTTPKSYKEENV

SEQ ID NO: 24537 - DNA, 873 bp, Unknown
  Obtained from environmental sample
  misc_feature (1)..(873): n is a, c, g, or t
atgctaaggattttatccagtttaaagcttcgtttttatatgaaagtgctaaaaacgatccanttaaaaaggccgaaaaccattagagatattgtaaatagtattgctaaaattccggatagaattaaaacagaaatttacatccaagagtgcgcaaggataatggatataagtgaagaggttttattttctactctagcgcaaatgactaataaagagcaaaatgaggcagcgaaacaacctcaaaacccgcaagcttttgaagttattaaaagtcaaccagcagttaaaaaggttgatgtgcaatataccttagagcgaaaaattattgagatactactactttacggaaacagaaaagaagattttgaagacttagttttaaaagaagcagacaatggtcagttagagttagaaccagttgttcaagaagctaaagtgtttgaaaaaatatacttagacttacaagaagacgaaatggaatttttaaacccacagtttaaagatatttattttgcaataattgaagctttaaatcaaaatcctgaatttaaaatagaaagcattattaacacaatagatcctgttttagcctcagaaatcacatctattttaatggaggatgagcgttatgcgttatccgattggcatcgtaataatatttttccaaaaacaaaaatagactctgttgcgcaattagttagcgagactattttgactttacgttgctttttaattgatcaaaaagtattacagtttcaaaaagaaacattagaagatagaaacactataaaccgagaaatccttgaagaagtcaaggattactcaggtttaaaaatgttgttgtcaagaaagctaaatagagctttataa

SEQ ID NO: 24538 - protein, 290 aa, Unknown
  Obtained from environmental sample
  misc_feature (1)..(290): Xaa is any amino acid
MLRILSSLKLRFYMKVLKTIXLKRPKTIRDIVNSIAKIPDRIKTEIYIQECARIMDISEEVLFSTLAQMTNKEQNEAAKQPQNPQAFEVIKSQPAVKKVDVQYTLERKIIEILLLYGNRKEDFEDLVLKEADNGQLELEPVVQEAKVFEKIYLDLQEDEMEFLNPQFKDIYFAIIEALNQNPEFKIESIINTIDPVLASEITSILMEDERYALSDWHRNNIFPKTKIDSVAQLVSETILTLRCFLIDQKVLQFQKETLEDRNTINREILEEVKDYSGLKMLLSRKLNRAL

SEQ ID NO: 24539 - DNA, 465 bp, Unknown
  Obtained from environmental sample
  misc_feature (1)..(465): n is a, c, g, or t
atgtttaaaaatctagaagaaaaagaaatagaatacattttagaaaacaattatattggacaattaggttatatatataacaatactccgtttgtaatcccaataacctatttttttgacaaagaaaagcatacaattatatgttactctggagatggtcataaaatgaatgctatgcgtaaaaatccaactgtgtcaatgttagtttctgatgtagaaaatgttactaattggaaatctgtattagtacacggtaaatttgaacaacactttggtagtgatgctaaagcctatttgcataaattttctttgggaataaaggatattattttagaaaaagaacatagtaaagctaactttataagtgatttttctagtaaaatttataaggatgatattcctgctgtgtttttaattaatatagaatctataacaggaaaaaaaagattagactttaaagcctaa

SEQ ID NO: 24540 - protein, 154 aa, Unknown
  Obtained from environmental sample
  DOMAIN (5)...(94): Pyridoxamine 5'-phosphate oxidase
  misc_feature (1)..(154): Xaa is any amino acid
MFKNLEEKEIEYILENNYIGQLGYIYNNTPFVIPITYFFDKEKHTIICYSGDGHKMNAMRKNPTVSMLVSDVENVTNWKSVLVHGKFEQHFGSDAKAYLHKFSLGIKDIILEKEHSKANFISDFSSKIYKDDIPAVFLINIESITGKKRLDFKA

SEQ ID NO: 24541 - DNA, 453 bp, Unknown
  Obtained from environmental sample
  misc_feature (1)..(453): n is a, c, g, or t
atggtaaaattaagtaatgcatttgtttttaaaggcctggtttataactactctagagattttccatttattggggacgagtttaattggccaatacgttatggttctgatatcgatttagcaaaatccataattataaaagcagcaacaacaacattagcagaatatacaaaagcatctaaagatcaatggaaagaagtcgttaataaatattatatagaagatgcaatggtagagcctactttagcaaccacactaacagataattggattaaatttaatttaaggtatatcgtagattataaaaaacgaagaataacaaaacacatattaaatgatttaattaggacagaaattgaagcaaccaatggtaaagttgttttagcttcacaaactattgagttaattaaaatacctgatttaaaagtagaaacaaacactaaaaaacactaa

SEQ ID NO: 24542 - protein, 150 aa, Unknown
  Obtained from environmental sample
  misc_feature (1)..(150): Xaa is any amino acid
MVKLSNAFVFKGLVYNYSRDFPFIGDEFNWPIRYGSDIDLAKSIIIKAATTTLAEYTKASKDQWKEVVNKYYIEDAMVEPTLATTLTDNWIKFNLRYIVDYKKRRITKHILNDLIRTEIEATNGKVVLASQTIELIKIPDLKVETNTKKH

SEQ ID NO: 24543 - DNA, 570 bp, Unknown
  Obtained from environmental sample
  misc_feature (1)..(570): n is a, c, g, or t
ttgtattttgaatataaattgtacagagccaatcgtaccaccaaaataaatgcagaacactttgaggcttttgcaagtctaaattatccggatttggcagaaagcggtgtgcacctaaaagttaataacgagtatttatttaaacctaacacgagaaaagatctagttgtacataaggatttagactcaaatattgcattagtaaaactgtttccaggaatttcaagaaaccttttagaaagtatttttaaaaccgaaggactaaaaggagtgatattggaaacctatggcgcaggaaactgcacaacaaaagattggtttttgcagttattaaaggagaccataaataaaggtgtgccaattataaatgtaacgcaatgttccggaggaagtgtcttaatgggacaatatgaaactagtgaaaagttaaagcgaataggtttaatctcaggaaaagatatcactacagaagcagcattgtgtaaattaatgtatttattaggagaaaatatatctcctaacttattcaaaaccatatatgaaacgtctttacgtggagaaatgtcttaa

SEQ ID NO: 24544 - protein, 189 aa, Unknown
  Obtained from environmental sample
  misc_feature (1)..(189): Xaa is any amino acid
MYFEYKLYRANRTTKINAEHFEAFASLNYPDLAESGVHLKVNNEYLFKPNTRKDLVVHKDLDSNIALVKLFPGISRNLLESIFKTEGLKGVILETYGAGNCTTKDWFLQLLKETINKGVPIINVTQCSGGSVLMGQYETSEKLKRIGLISGKDITTEAALCKLMYLLGENISPNLFKTIYETSLRGEMS

SEQ ID NO: 24545 - DNA, 423 bp, Unknown
  Obtained from environmental sample
  misc_feature (1)..(423): n is a, c, g, or t
gtggtagcttctattgttcaaaaagaaacagctaaagtagacgagcgtaanagagtcgctggggtttatatgaaccgctatctaaacggttggaaattagacgccgatcctactgttatttatgctataaagaaagaaagcaaagattttgataccgttattaagcgtgttttgtacaaagacttagaaatcgaatcgccttataatacttataagtataaagagctgcctccaggacctattgctatgcccgatatttcctctatcaatgcagtacttaatttcgaaaagcacgactactattattttgtagccaatccagaaaatcctggctaccatatgttcgctaaaaccttaaggcagcacaataataacagacaagcttacgtacgttggattaacaaaatgggaattaataggtga

SEQ ID NO: 24546 - protein, 140 aa, Unknown
  Obtained from environmental sample
  DOMAIN (1)...(132): Aminodeoxychorismate lyase
  misc_feature (1)..(140): Xaa is any amino acid
MVASIVQKETAKVDERXRVAGVYMNRYLNGWKLDADPTVIYAIKKESKDFDTVIKRVLYKDLEIESPYNTYKYKELPPGPIAMPDISSINAVLNFEKHDYYYFVANPENPGYHMFAKTLRQHNNNRQAYVRWINKMGINR

SEQ ID NO: 24547 - DNA, 1071 bp, Unknown
  Obtained from environmental sample
  misc_feature (1)..(1071): n is a, c, g, or t
ttgatcggcgaggcaaatgagaacttatttagcagtgtaccaaagaattggcatattttagttacagatattcaaggatcatctaaagctgtagcagaaggcaaacataatgatgtaaacctaacagctactggtagtattattgcagttttaaacgctttaaaaaaatcgcatccaagtttaagaattccttatttttttggtggtgatggagcaacttttatggtaccatcatcaatcatagacgaattaatgattgttttaaaagattatagtttgcacattaaaagaacattaggattagatttaagagtaggtagcttaattgtagatgatgtttatcaacataaatatacgttaagaatatcaaaattaaaagtaaacaattacttaacaactcctgtaattcttggaaatggtttaaaatatgctgaatctaaaattaaagagcaatttacaaaagaggagaatttaaaagataaagatattaagatagatttagaaggaatggagtgcagatgggatgaaatttatccttcaggaagtaataaaaaagttgtttgtcttttaattggtgctactagcgaaacaaagcaggcagaggtttttaacgaaatcatgaatgagatagattacatttttggcaatttaaataaacgcaatcctattactatgaaaaatttaaagttgaaaccaactttagagaaaattagaaaggaaatgcacacaagaattggtgtttttaaaagttcttatttaatgaacaattggctcattacttttttcggacaatattattttaagttttttaaggctggtaaattgtatttgtacagagttacacaactttctgacacaattatgttagatggttctataaatactgtaatttctggtgatgaaaaaccattaagtaaattaagattttttctggatactttagaaacgcaaaagaaaattatttatggttttcataaaacgtacgcttctaataaggtcttggtatggnggaagattggggaggaaaaaccctttttcctttttgtaaatgggtacaaaaaaggtggttaa

SEQ ID NO: 24548 - protein, 356 aa, Unknown
  Obtained from environmental sample
  misc_feature (1)..(356): Xaa is any amino acid
MIGEANENLFSSVPKNWHILVTDIQGSSKAVAEGKHNDVNLTATGSIIAVLNALKKSHPSLRIPYFFGGDGATFMVPSSIIDELMIVLKDYSLHIKRTLGLDLRVGSLIVDDVYQHKYTLRISKLKVNNYLTTPVILGNGLKYAESKIKEQFTKEENLKDKDIKIDLEGMECRWDEIYPSGSNKKVVCLLIGATSETKQAEVFNEIMNEIDYIFGNLNKRNPITMKNLKLKPTLEKIRKEMHTRIGVFKSSYLMNNWLITFFGQYYFKFFKAGKLYLYRVTQLSDTIMLDGSINTVISGDEKPLSKLRFFLDTLETQKKIIYGFHKTYASNKVLVWXKIGEEKPFFLFVNGYKKGG

SEQ ID NO: 24549 - DNA, 765 bp, Unknown
  Obtained from environmental sample
  misc_feature (1)..(765): n is a, c, g, or t
atgtattgtagtaaaggtgagctttctcattcttttgaaaagcaatctaaaaaattaactgttgaagagtttcaaacaagtatcattgctaatattgagtcttctgcaaacgtattagaacttaagagtggcatcaacataaaaagtactttaatttctgtaaatacaactttagagaattctagtatcaacaacagattaagagaaatttttatcaacaataaaaaagatgatttcttttattgtggttcttataactttaaaatttctgaaactataaagcaaattgatgctattaaaaatgaaggaattgtaagaactttattaattaatggttttgtaaatgttgtgttggctttagaaattgagcaacataatatagatattaataattctgaaattagatctgcatctttaactaaaaatgaaatgagtattgttaaagaaatgtctgattatattcaaaattattacgatactaacctgcaaattaatgagttagaaagaaaatctggcttaacagctgcaaaattacaagaaggttttaaacttttacatggtttaacaatttgtgaatatgttaaatatgtaagacttacaaaagctgaagaattaatttctacaaccgatttaagtatctctgaaattgtatacagtttaggttttagtagtagaagttatttctctaaaatattcaaagaaaagtataattgttcaccagtaacttataagaaaaaacacaaaatggtggcaatatctgcataa

SEQ ID NO: 24550 - protein, 254 aa, Unknown
  Obtained from environmental sample
  DOMAIN (201)...(245): Bacterial regulatory helix-turn-helix proteins, AraC family
  misc_feature (1)..(254): Xaa is any amino acid
MYCSKGELSHSFEKQSKKLTVEEFQTSIIANIESSANVLELKSGINIKSTLISVNTTLENSSINNRLREIFINNKKDDFFYCGSYNFKISETIKQIDAIKNEGIVRTLLINGFVNVVLALEIEQHNIDINNSEIRSASLTKNEMSIVKEMSDYIQNYYDTNLQINELERKSGLTAAKLQEGFKLLHGLTICEYVKYVRLTKAEELISTTDLSISEIVYSLGFSSRSYFSKIFKEKYNCSPVTYKKKHKMVAISA

SEQ ID NO: 24551 - DNA, 864 bp, Unknown
  Obtained from environmental sample
  misc_feature (1)..(864): n is a, c, g, or t
ttgccaattggcggaaaagaaaaacagttagtggtatttgacagccaagggcagttattagcgcaccccaatttaacccaatcaagttatgcacaatatggtaaagcaggtaaaaaactactccctgaggactttattgatcccacattacaagtaattgtagatgatgcgattaaaatgcaacggtctgaatatgccgactcattcaaattaaataatgaagcgtatattattaatattcataaaatagatggcttagattggtatgtaggggtatataaaaaacgttcttcaacattctcagcattagcagatttaaagatgaagttttttgggctatttatactctatgccattttagtcgccttactcttacatcaagcactttatcagctagtacttaggcgtatacattctttggtttatgccgttacaaactttggtcaaggccagttacaaatagaatttccaaaagaaaacaaagatgaaataggcactctcaacggctcatttaaagacatgaccattgaaattagaaagctaatagatgggcttaaccagcgtattattgaaaaagaaattgcagaaaaagcagccaggcgactatccaaagccgtggcgttttctggtactggtgtggtgatcaccgataaaaactttgtcattgaatacgtaaaccctaaaatgcttgaaatgaccagcttttcagaggaacattttaatcgagcgcctttattaagcattattgcaagcgaaatggctatattaattgatgatatagatgttgatttacgcagtcgttattgttggcgtggcgacaccttaattgaaagcaataaaaagcggctatttgggtttctttaa

SEQ ID NO: 24552 - protein, 287 aa, Unknown
  Obtained from environmental sample
  DOMAIN (111)...(180): HAMP domain
  misc_feature (1)..(287): Xaa is any amino acid
MPIGGKEKQLVVFDSQGQLLAHPNLTQSSYAQYGKAGKKLLPEDFIDPTLQVIVDDAIKMQRSEYADSFKLNNEAYIINIHKIDGLDWYVGVYKKRSSTFSALADLKMKFFGLFILYAILVALLLHQALYQLVLRRIHSLVYAVTNFGQGQLQIEFPKENKDEIGTLNGSFKDMTIEIRKLIDGLNQRIIEKEIAEKAARRLSKAVAFSGTGVVITDKNFVIEYVNPKMLEMTSFSEEHFNRAPLLSIIASEMAILIDDIDVDLRSRYCWRGDTLIESNKKRLFGFL

SEQ ID NO: 24553 - DNA, 462 bp, Unknown
  Obtained from environmental sample
  misc_feature (1)..(462): n is a, c, g, or t
ttgaaaacaaaatcgctttataaaacttctgaagttcgtcaaaatctaatggatttttatgattccaaaatgaactctttaggattagattatgaagatctttttgtagatacacatgctggcaaaacccatatcattaaaataggcaaggattctaatccacctattgttttactccatggaattaatgcaggagctcctgttgcggtagagcccttaaaaggactcgctgaaaactatcttatttatgccattgataccattgggcaaacaacaaaaagtgccgaaacaaggctcgatctttccaacgatgactacggtaaatggctttcagaaactttagatctattaaacttgaaaaaaattccagttataggtgcttcatatggaggttttcttcttcaaaaactaatcatttctgatcctgaaaaagtatctaaagcaattttcttagtcctctga

SEQ ID NO: 24554 - protein, 153 aa, Unknown
  Obtained from environmental sample
  misc_feature (1)..(153): Xaa is any amino acid
MKTKSLYKTSEVRQNLMDFYDSKMNSLGLDYEDLFVDTHAGKTHIIKIGKDSNPPIVLLHGINAGAPVAVEPLKGLAENYLIYAIDTIGQTTKSAETRLDLSNDDYGKWLSETLDLLNLKKIPVIGASYGGFLLQKLIISDPEKVSKAIFLVL

SEQ ID NO: 24555 - DNA, 450 bp, Unknown
  Obtained from environmental sample
  misc_feature (1)..(450): n is a, c, g, or t
atgaaaacgaaagatcaaattaaacaatctgcacggaaactctttaatgagagaggggtgatgaatgtgacattaagagatgtcgcaaatgatttagataaaagctatggaaacataacctatcactttagtaaaaaggaagtgttaattgaaaacctgtatcaagatatgtttgaggaattacaagtaataaatatgaacgtaactgaagataaaagtaatttgttagctaagattattaaagctccttttaaaacttttgatcttactatgaagtatatctttttttatatggattttatcgaaatcangaggaatttcaatgaactttataaaatgatcgaagataataataaaggtaggatgccgatatgggaagtattctttaatagaattacagaatcaaaattctatccaactgatttaaagaaagaagatttgttttcttga

SEQ ID NO: 24556 - protein, 149 aa, Unknown
  Obtained from environmental sample
  DOMAIN (7)...(53): Bacterial regulatory proteins, tetR family
  misc_feature (1)..(149): Xaa is any amino acid
MKTKDQIKQSARKLFNERGVMNVTLRDVANDLDKSYGNITYHFSKKEVLIENLYQDMFEELQVINMNVTEDKSNLLAKIIKAPFKTFDLTMKYIFFYMDFIEIXRNFNELYKMIEDNNKGRMPIWEVFFNRITESKFYPTDLKKEDLFS

SEQ ID NO: 24557 - DNA, 306 bp, Unknown
  Obtained from environmental sample
  misc_feature (1)..(306): n is a, c, g, or t
ttgttatacaaatccgttggcaataatttaaacaaaacgaaaatgaagaaaattttactattaacattaacaattttaatttcaaatttatcaatcggtcaagaaattccacaattgaaattaacacagaacggagttgaacctattgttgtagaagttgacagcttgagtgctagcgaaatttataacaaagctcaaaattgggttcaagaaacttacaaaaatccagacaaggttttaaaagcaaatattgcgaatgaaaaaattagaattgacggatttgcaaatggagcttggtggttttaa

SEQ ID NO: 24558 - protein, 101 aa, Unknown
  Obtained from environmental sample
  misc_feature (1)..(101): Xaa is any amino acid
MLYKSVGNNLNKTKMKKILLLTLTILISNLSIGQEIPQLKLTQNGVEPIVVEVDSLSASEIYNKAQNWVQETYKNPDKVLKANIANEKIRIDGFANGAWWF

SEQ ID NO: 24559 - DNA, 564 bp, Unknown
  Obtained from environmental sample
  misc_feature (1)..(564): n is a, c, g, or t
ttggaaatagacaacaccaaaattgaatcacatattttaaaagcgaaagaaggcaatcaatcttcttttcgttttttgttgaatactttttggggtgatgtttataattatcagctaaaaaaaacaagaagtgaaaatgaagctgaagatattgccatccaaactttttctaaagcttttgataaaatacatacgtttgatgataattatgtttttaaaacatggttaattgccatttctaaaaatgtttatatcgatattttacgaaagaaaaaaacttccatttttacagaaaccaccaaagaacaagaagaaaaaatttatttggttgttgatgaaaatcccacaccagaagataaaattattggagaacaaaatttagcaaaattgttacgagatattaaacaattaaaacctaaataccaagaagtaatacagttacgttattttcaagaattgagttacaaagaaatttctacacaaattaatgaacctatgaataacgtanaagtaaaattattacgtgctaaaaagttgttggcagccattattaagaagggttaa

SEQ ID NO: 24560 - protein, 187 aa, Unknown
  Obtained from environmental sample
  DOMAIN (26)...(93): Sigma-70 region 2
  misc_feature (1)..(187): Xaa is any amino acid
MEIDNTKIESHILKAKEGNQSSFRFLLNTFWGDVYNYQLKKTRSENEAEDIAIQTFSKAFDKIHTFDDNYVFKTWLIAISKNVYIDILRKKKTSIFTETTKEQEEKIYLVVDENPTPEDKIIGEQNLAKLLRDIKQLKPKYQEVIQLRYFQELSYKEISTQINEPMNNVXVKLLRAKKLLAAIIKKG

SEQ ID NO: 24561 - DNA, 846 bp, Unknown
  Obtained from environmental sample
  misc_feature (1)..(846): n is a, c, g, or t
ttgcagatcaatctatactgtaatatgctattagtttatacacataaaataacacctagagtaaagtatgtttttaaacaaatttgtactagaattttaggagtgcctgttagttttactactgttattgaagagtttattgcacatgatagtttaaaaatgtcttatacaagacagcctttaagtaacgagatttttgtgcgtagcaatgagttgctatttgagcaaggattatcagatattgacataacagtcttaccttgggaagacacaaaatgtttttttccaacaggagataaaagtgcagtaccatttgatatttttgcagcctctttttatttaattagtaggtatgaagaatatttaccacatcttaaagacgagtttggacgctacacagcagaagagagtttagcctataaaaacaattttttagaccaacctgtagtagatatttgggcatacaaatttaaagctattttacaagccacttatccagattttagctttccaggacaaaagtatactgtaattcctgttattgatgttcctatggcttacgagtataaattaaaaggaataatgcgcactgtaggaggtacgtttaaagatttttttacttttaaatttagacgcttgtacgagcgttattcggttttaaccggttttaagcgtgatccattggataattacaagtatattattaataagcaaaaagcttcaaaatataagtttgtgtttttctttttattaggcgatttttcaacctatgataaaaatatcaatcctcaaaagcaaaagtttatttcgtttatcaaaacacatttgcgaattattgcaaaataa

SEQ ID NO: 24562 - protein, 281 aa, Unknown
  Obtained from environmental sample
  misc_feature (1)..(281): Xaa is any amino acid
MQINLYCNMLLVYTHKITPRVKYVFKQICTRILGVPVSFTTVIEEFIAHDSLKMSYTRQPLSNEIFVRSNELLFEQGLSDIDITVLPWEDTKCFFPTGDKSAVPFDIFAASFYLISRYEEYLPHLKDEFGRYTAEESLAYKNNFLDQPVVDIWAYKFKAILQATYPDFSFPGQKYTVIPVIDVPMAYEYKLKGIMRTVGGTFKDFFTFKFRRLYERYSVLTGFKRDPLDNYKYIINKQKASKYKFVFFFLLGDFSTYDKNINPQKQKFISFIKTHLRIIAK

SEQ ID NO: 24563 - DNA, 975 bp, Unknown
  Obtained from environmental sample
  misc_feature (1)..(975): n is a, c, g, or t
atgatggaacaaatggaaccgagtttacctgaaacttatttagaaaacattaaagatagtgtttggactaataaacttaccgtttattatcatctaaataacaaaattgaatttgataaactttacttatctattccgtttccatatcaaatgaaagaagatatggtagaattgaaaataggaatattgttgaagaatcacctacggcaagatgcaaaaaaagtattatttaatgcaatcaactaccacaaagactcggctggtagaatcccgaaattcatcagaagattaaagaacaaacttgctgatgaaattgatattaagtttcttcaaaacaatttcaatgaaatctttgcatcccaacccaaaaccctcattcaaatattcccagatagattaaatgcagaaaataaattgggaagttttattactaaagaaatggcactagcaagtagtaaaatgcttgataaaatcaactcagttcgtgatgttgggttagaagacaaatacaatgatctggtacagctagctttagaggcaagggtagctcaatggggatggcaggtcaaagatcaaaccagaggaggtttttcagctaataagaaaaaatacaatccgggcgagagagatattattgtatgtgattccaatagtgatgctttaattgtttgcgaagcgtttatatggagagatagacgtaccgctgagagccatatcaaaaagatttttaattatcatcataaacgaaaaaatttcataatcttaatttatgacaagagaaagtatgaaaattttgattctagctggaaaagatataaagaagaagtattaccagatatatcttaccctgtgggtttcgatttaataaaaacgaatggaaagagtttaagtataactcaacaggaaattaaagtaggttcccttcaaacaccggaaaaaacacaaggaattttccctaataaggatcaattctaa

SEQ ID NO: 24564 - protein, 324 aa, Unknown
  Obtained from environmental sample
  misc_feature (1)..(324): Xaa is any amino acid
MMEQMEPSLPETYLENIKDSVWTNKLTVYYHLNNKIEFDKLYLSIPFPYQMKEDMVELKIGILLKNHLRQDAKKVLFNAINYHKDSAGRIPKFIRRLKNKLADEIDIKFLQNNFNEIFASQPKTLIQIFPDRLNAENKLGSFITKEMALASSKMLDKINSVRDVGLEDKYNDLVQLALEARVAQWGWQVKDQTRGGFSANKKKYNPGERDIIVCDSNSDALIVCEAFIWRDRRTAESHIKKIFNYHHKRKNFIILIYDKRKYENFDSSWKRYKEEVLPDISYPVGFDLIKTNGKSLSITQQEIKVGSLQTPEKTQGIFPNKDQF

SEQ ID NO: 24565 - DNA, 750 bp, Unknown
  Obtained from environmental sample
  misc_feature (1)..(750): n is a, c, g, or t
atgacccactttgctcctccacgagatggtaatgattttaaacgtgaatttaaatcgaaaaatatagaaggtacacttgtcgataatagagtctatcaaactttgaatcaaacaaatatgttattaatatgcccaaatgggcatttatccgatataccttggtctaaatacttaaactggaaacttaatcacagaaatgaagagcctgaagccaaagatttattaggttatgatggttgttgtacaaaaccagaattaatttggactgaaagcaagaataaatctgaagggtatgggagtatttttattcattgtaataattgtggttcaggtaaagatcaatcttttaaagttaatttagaaggtataaatagtattaaaccaaaatgtaaaggtgaaaagccttgggaacaaaaattagatagttattcaattcctaatgaaaattgttcagaagagatgcgaatcgctctggtaactgcaaataatgtttattatgccagtggtttttcaagtttatatattccaatgcatctagcggagaataaatcanaagaattgattgatgctttaattgtatgtaatgataaatttaatcgaacattaggtacaaaatttgagaaaacaaaagaagaatggtttaataaaaatgttgatgaagagtttttagaaatagactgtggaataaatatctcagatttatcatttttcattgatgaaactatttcacaattgggaattgaggtttaa

SEQ ID NO: 24566 - protein, 249 aa, Unknown
  Obtained from environmental sample
  misc_feature (1)..(249): Xaa is any amino acid
MTHFAPPRDGNDFKREFKSKNIEGTLVDNRVYQTLNQTNMLLICPNGHLSDIPWSKYLNWKLNHRNEEPEAKDLLGYDGCCTKPELIWTESKNKSEGYGSIFIHCNNCGSGKDQSFKVNLEGINSIKPKCKGEKPWEQKLDSYSIPNENCSEEMRIALVTANNVYYASGFSSLYIPMHLAENKSXELIDALIVCNDKFNRTLGTKFEKTKEEWFNKNVDEEFLEIDCGINISDLSFFIDETISQLGIEV

SEQ ID NO: 24567 - DNA, 540 bp, Unknown
  Obtained from environmental sample
  misc_feature (1)..(540): n is a, c, g, or t
atgctagtaaaaaatttcacacatatattagggaatcacgatgaatggtgttatcaatatttaaaaaacaataaaaccccaactgcatggacaacgcaaggtggagcaatcacaatgaatgcctataaagaaaacccagaattaaaagaaaaacacattaagttttttgaaaaagcaaagttatattttattgatgcagactcaagactatttgttcatggaggatacaacccaagaattccatttcaacaacaaaaatacagtaaggaaatacttatttgggacagatcattaatatcgaccgctattgaatttaatcgaacaaaccaaagttttaaagaattctctgagatatttattggtcatactccaactcaatttatagaagaatcaaaaccaataaagttaactaatttatggatgcttgatacaggaatacatcaatcaggaaaacttacaattatgaatattgaaacaaaagaatactggcaatcgacagcaaaagataattcaataaacttaaatcaacaagatgaatag

SEQ ID NO: 24568 - protein, 179 aa, Unknown
  Obtained from environmental sample
  misc_feature (1)..(179): Xaa is any amino acid
MLVKNFTHILGNHDEWCYQYLKNNKTPTAWTTQGGAITMNAYKENPELKEKHIKFFEKAKLYFIDADSRLFVHGGYNPRIPFQQQKYSKEILIWDRSLISTAIEFNRTNQSFKEFSEIFIGHTPTQFIEESKPIKLTNLWMLDTGIHQSGKLTIMNIETKEYWQSTAKDNSINLNQQDE

SEQ ID NO: 24569 - DNA, 699 bp, Unknown
  Obtained from environmental sample
  misc_feature (1)..(699): n is a, c, g, or t
atgaaacaatttagatctcgtcaaatccaaatgcttgttgcaacagacgttgctgcacgtggtattgatgtagatgatattacacacgtaattaactaccaattaagtgacgaaatagaaacttacacacaccgttctggtcgtacaggtcgtgcaggtaaaactggtgtatcaatggtaattgtttcaaaaagtgaagtacgtcgtttaaaaagtatcgaacgtattatcaatcaaaaatttgaattaaaagaaattcctaacggaatggaaatttgcgaagtacaattaatgtctttagcaaacaaaatacataacacagaaattaatcacgaaattgacaagtatttagaggacatcaacacgttgtttgctgatacgtctaaagcagagttaattaaaaaattcttttctgtagagtttacacgtttctttaattactatcaaaaatctaaaaacctaaacgttacagctggagactctggacgtgatggtggtcgtgaaggaagatcacaatcttctggaagtgctgcacgttactttattaacgttggagaaaaagatggttatgactggatgaaattaaaagatttcttaaaagaagttttagatctaggtcgtgatgatgtatttaaagttgatgttaaagaaacattctctttctttaatactgaaaaagaacaccaagaaaaagtctag

SEQ ID NO: 24570 - protein, 232 aa, Unknown
  Obtained from environmental sample
  DOMAIN (1)...(53): Helicase conserved C-terminal domain
  misc_feature (1)..(232): Xaa is any amino acid
MKQFRSRQIQMLVATDVAARGIDVDDITHVINYQLSDEIETYTHRSGRTGRAGKTGVSMVIVSKSEVRRLKSIERIINQKFELKEIPNGMEICEVQLMSLANKIHNTEINHEIDKYLEDINTLFADTSKAELIKKFFSVEFTRFFNYYQKSKNLNVTAGDSGRDGGREGRSQSSGSAARYFINVGEKDGYDWMKLKDFLKEVLDLGRDDVFKVDVKETFSFFNTEKEHQEKV

SEQ ID NO: 24571 - DNA, 930 bp, Unknown
  Obtained from environmental sample
  misc_feature (1)..(930): n is a, c, g, or t
atgattaggatttgctttaaaataattaaacaactttttacacaactaattaaacagccaaaaaaattaatgtcttttatcacattaacatcagatttcgggactaaagaccattttgttggggctgtaaaaggagctatatattctgaattggcagatgctaaaattgttgatattacacatgaaatatcaccttttaacattacagaaactgcttatattttaaaaaattcttacaaaagttttcctaaaggaaccattcatattgtaggtgtagattctgaattaagtgcagataataaacatattgctatttctttagatgatcatttttttgtatgtcctgataatggactaatctctatgatagcttcagaaatacaaccaacaaaaattgttgaaattaatattcatgacagagtagaaagtagttttcctgtgttagatgtttttgtaaaagttgcctgttttattgcacgaggtggaaatttaacagtgattggtaaagaaattaaggaatataaaaagttagttgaaattcagccgaaagtaaatcaagaacaaaaccaaattattggaggtgttatatatattgataattatggaaatgtaattaccaacatcagcaaaaaaatgtttaacgatgtaggcaaaggacgtacttacaaaataaatgcttcacgttatacttttaccaaaatatataataaatacaacgaaattacagagaatgactctacaaataccatgcaatttgatggtgataaattaaccctttttaattctgctggttttttagaaattgctgtttacagaagtaatttaaaaacagttggtggtgcatcaacattacttggtatggattatagagaccctgtaattattgagttttttatggaatcgaaaccagaatactcttctttaaattaa

SEQ ID NO: 24572 - protein, 309 aa, Unknown
  Obtained from environmental sample
  DOMAIN (26)...(297): Protein of unknown function DUF62
  misc_feature (1)..(309): Xaa is any amino acid
MIRICFKIIKQLFTQLIKQPKKLMSFITLTSDFGTKDHFVGAVKGAIYSELADAKIVDITHEISPFNITETAYILKNSYKSFPKGTIHIVGVDSELSADNKHIAISLDDHFFVCPDNGLISMIASEIQPTKIVEINIHDRVESSFPVLDVFVKVACFIARGGNLTVIGKEIKEYKKLVEIQPKVNQEQNQIIGGVIYIDNYGNVITNISKKMFNDVGKGRTYKINASRYTFTKIYNKYNEITENDSTNTMQFDGDKLTLFNSAGFLEIAVYRSNLKTVGGASTLLGMDYRDPVIIEFFMESKPEYSSLN

SEQ ID NO: 24573 - DNA, 555 bp, Unknown
  Obtained from environmental sample
  misc_feature (1)..(555): n is a, c, g, or t
ttgaaattaaaaaaaaataccctgttttttttatcgcttttatttgcgtgtcattttttgtgcgctcaaaattatgacagcatttataataagatttcagaaaatttattaaggttcgaaagtactattgttattaaaaaagttgatagtattttaggtgaagaaaaaatacctgacattgtaaaaaatgatttaaaatcattaagagtagaagctttggctcaattaagtttttttacaccagctttaaaacttgcaaatgaaattttatcaaacaaaaataatgttagtgaaaaagcagagataagaatatctatacaaaaagccttgatttttgagttttttggaaaaccaaaagaaacaattctagaactaaatagattagaagaaatttataaaaatagagagaaagatagattttatgggcaatatttatttagaaaatcttcttattatagggttttaaaaccgggttgtaaaaagcggatagtttggcattatactatgctaataaagctgcagattttggtaataaaaataaatactatgatgtaa

SEQ ID NO: 24574 - protein, 184 aa, Unknown
  Obtained from environmental sample
  misc_feature (1)..(184): Xaa is any amino acid
MKLKKNTLFFLSLLFACHFLCAQNYDSIYNKISENLLRFESTIVIKKVDSILGEEKIPDIVKNDLKSLRVEALAQLSFFTPALKLANEILSNKNNVSEKAEIRISIQKALIFEFFGKPKETILELNRLEEIYKNREKDRFYGQYLFRKSSYYRVLKPGCKKRIVWHYTMLIKLQILVIKINTMM

SEQ ID NO: 24575 - DNA, 630 bp, Unknown
  Obtained from environmental sample
  misc_feature (1)..(630): n is a, c, g, or t
gtgtattcaggcgtagaaattttaaagcatataaacctttatgaatatgaactgaatgaagcatatcatctactcggctttcttaaaaattacgatgaagaaatctctgaagaagttgaattagttgctaataaacttatagaaaacattaaaactatttgctttattacagcctgtttccttgatgtagctacttcactaaaaggattaacaaatattgaatcaaactgggaacgaaaattctatttgaaaaatggttttgttgcgatttatgaatcaatgcttacatttaataagcaccaaaagagcatctatggattaatcaaaaatgactttccaactttattagaagattataggaacattactgataacataaaaaaagtcaaaaaagaacataattaccaatccttaatttcaaattttagaaataaagctggagctcattacgatgaagattttgagacatattttgaacatttgaaaagtattgacaaacctgaaagcgtaaaaactgtgttggatttttctcatattctaatgtcattaattatattttggagtgatttaattgatgtttttagaaacgaaacgcaagaaaaaatggaaataataacgagaaaaaactaa

SEQ ID NO: 24576 - protein, 209 aa, Unknown
  Obtained from environmental sample
  misc_feature (1)..(209): Xaa is any amino acid
MYSGVEILKHINLYEYELNEAYHLLGFLKNYDEEISEEVELVANKLIENIKTICFITACFLDVATSLKGLTNIESNWERKFYLKNGFVAIYESMLTFNKHQKSIYGLIKNDFPTLLEDYRNITDNIKKVKKEHNYQSLISNFRNKAGAHYDEDFETYFEHLKSIDKPESVKTVLDFSHILMSLIIFWSDLIDVFRNETQEKMEIITRKN

SEQ ID NO: 24577 - DNA, 489 bp, Unknown
  Obtained from environmental sample
  misc_feature (1)..(489): n is a, c, g, or t
atgttaatgctaaaagctaataagaaaaagatctgtattgtggtgtcctccttaggtaagggtggagcagagcgctcttctggcttattatctcagatgctttataatactggttatgatgtccatgttgtgagtgtactaaatgatattgagtttccttttaaaggagaattactcaatttaggagagcttaaagatttaaatgacacttcttatggaagatggcaacgcttacgaattttgaaagcctatttaaaaactcataattttgattatattatagataacagaacgcgaattggttttataaaagaatatgtaatctctcaatttatttttaatcctaaaaaaacgatttattgtgttcgaagttataacgtgaacttatacgtcaatcctaatcgatttttaggaaaactaatttacagtaacgcctataaaattgttggtgtttctaaacttatttgcccatactcgagccgattctga

SEQ ID NO: 24578 - protein, 162 aa, Unknown
  Obtained from environmental sample
  misc_feature (1)..(162): Xaa is any amino acid
MLMLKANKKKICIVVSSLGKGGAERSSGLLSQMLYNTGYDVHVVSVLNDIEFPFKGELLNLGELKDLNDTSYGRWQRLRILKAYLKTHNFDYIIDNRTRIGFIKEYVISQFIFNPKKTIYCVRSYNVNLYVNPNRFLGKLIYSNAYKIVGVSKLICPYSSRF

SEQ ID NO: 24579 - DNA, 495 bp, Unknown
  Obtained from environmental sample
  misc_feature (1)..(495): n is a, c, g, or t
atgagaaaaaatatgctaataattatttttgtgtttctaacgacaatttcgtttggacaagttttgccgtggaagtatttaggtcaaactccaccaggtaagtcagcacaattattcgcccccgatataataaatcatttggcgcatagtagtccaagctttactcctaatggcaaacaaatttattggtctactgttagtgagaatgatgagacacgaaaaatattctatgtggaatatgaaaattacaaatggtctgaaccaatgattgccaatttttcgggtaaatatcatgatgaccatccttttgtcaccgataatggcaaaaagctattttttgcatccaagagacctaagacaaaaaatggaaatcaggaaaacgacatctggattttagataaaacaaagcaagggtgtggtgaaccaaaaacaattaataatttgattggattttggacacctaccttaacacgcaaagggacaatttatttctga

SEQ ID NO: 24580 - protein, 164 aa, Unknown
  Obtained from environmental sample
  SIGNAL (1)...(19)
  misc_feature (1)..(164): Xaa is any amino acid
MRKNMLIIIFVFLTTISFGQVLPWKYLGQTPPGKSAQLFAPDIINHLAHSSPSFTPNGKQIYWSTVSENDETRKIFYVEYENYKWSEPMIANFSGKYHDDHPFVTDNGKKLFFASKRPKTKNGNQENDIWILDKTKQGCGEPKTINNLIGFWTPTLTRKGTIYF

SEQ ID NO: 24581 - DNA, 348 bp, Unknown
  Obtained from environmental sample
  misc_feature (1)..(348): n is a, c, g, or t
ttgctaagaataaatgacagacagcattactatgtgttgccacttgctaaagatgacaatctgaaaattcaagtatctganggagaagaaaagatatttccaataagtataacaggattgctttatgcaatagggttcaataaaagctttctgaaaaaatattggctgctgtcaggtggattctataatgatagatttagtcttttaattgaaacagataatgaaaaggttctacttgattcgaatgggagaaactttaaaggagcattgaaatattttgaaaaaagtgaattgaggacaaaaatatcatttgaaaatgtcggtattactaccggtaacaaaagctaa

SEQ ID NO: 24582 - protein, 115 aa, Unknown
  Obtained from environmental sample
  misc_feature (1)..(115): Xaa is any amino acid
MLRINDRQHYYVLPLAKDDNLKIQVSXGEEKIFPISITGLLYAIGFNKSFLKKYWLLSGGFYNDRFSLLIETDNEKVLLDSNGRNFKGALKYFEKSELRTKISFENVGITTGNKS

SEQ ID NO: 24583 - DNA, 429 bp, Unknown
  Obtained from environmental sample
  misc_feature (1)..(429): n is a, c, g, or t
atgaaaatatatacaaaaactggtgataatggcacaactgccctatttggtggttcaagagttaaaaaatacaatttgcgcatagaaagttatggaactgtagatgaattgaactcttacattggtttgattaaagaccaagacattagcacagattcaaaagatgctttgttgaaaattcaaaacgaattgttcactttaggtgcaatgttggcaactccaccagaaaaagaaaccttaaaatctggtaaagagcgtttaaatattcctaaaatcgatgaagattctatactttttctagaaaatgaaattgataaaatggatgcagtattgcctcaaatgactcattttattttacctggaggccatcaagctgtgtcattctgtcacgttgcaagatgtgttgcagacgtgcagaacgtttcctga

SEQ ID NO: 24584 - protein, 142 aa, Unknown
  Obtained from environmental sample
  DOMAIN (3)...(142): Cobalamin adenosyltransferase
  misc_feature (1)..(142): Xaa is any amino acid
MKIYTKTGDNGTTALFGGSRVKKYNLRIESYGTVDELNSYIGLIKDQDISTDSKDALLKIQNELFTLGAMLATPPEKETLKSGKERLNIPKIDEDSILFLENEIDKMDAVLPQMTHFILPGGHQAVSFCHVARCVADVQNVS

SEQ ID NO: 24585 - DNA, 429 bp, Unknown
  Obtained from environmental sample
  misc_feature (1)..(429): n is a, c, g, or t
ttggcattcgcccttttgtgtacgatttttattaccaaaggattgtatcaacaaaaaataaaaaataacgaagttttagatgttaatgagctaaaaaatctatcaaaaaaacaattgataattttcactaaaattgtgaatatttttgagattaaaaatattgattttgatataaattcctttgtagaaaacaaaaattcaacttataaaatgctctttacaaaagatttatcaactttaaaaaacatcaattttaagcttttaaattctcatcatatcattattgttgatcaaattcatcagcaaaaaaaagagtggcaaaacatcattaatttacaagatgcaacagttacaatagatctgttttattttggattaattttctttagaaaagaacaagtaaaagaacattttattataagaagttaa

SEQ ID NO: 24586 - protein, 142 aa, Unknown
  Obtained from environmental sample
  misc_feature (1)..(142): Xaa is any amino acid
MAFALLCTIFITKGLYQQKIKNNEVLDVNELKNLSKKQLIIFTKIVNIFEIKNIDFDINSFVENKNSTYKMLFTKDLSTLKNINFKLLNSHHIIIVDQIHQQKKEWQNIINLQDATVTIDLFYFGLIFFRKEQVKEHFIIRS

SEQ ID NO: 24587 - DNA, 819 bp, Unknown
  Obtained from environmental sample
  misc_feature (1)..(819): n is a, c, g, or t
atggatcagtctaagaaaacaacacatagttttctaatggaagggattcgattagctaatgaatgcgacttaaaatataagaccagtaagaatcaacgattactcgttgaactaacacttatgcaacttgcctctatcacttttgatggagaaaaaaaaaactctaagcacttcataattcctccgtcgtattttaaagcacgaggtattgcacctgtttctgttacaaaaccaaaagttgaaaccgttaaaaaggaagaaaagcctatagcaaacgataaacaaaacatttttaaagctactgctaatgtggttaatgaacctataagcattcctaaaatatccattaatcaacctaagaaatcaacatcgggattatctttaagaagtattagagaaaagaaggaacatcaattacgtcaaatggaagtggttattgatgaagacaacctccctacagaacccgttacacaagaagctttaacagaagcctggaaagcatacacacaaaaaatggatgcaaaaggagaaaaaattatggcttctatcttacaaatggaccaacccacactaaaaaatggcactaccatttgtttaacttattcaaacaacaccaataaaatagaattagaacgtgcagagtttcctttaatgacctttctaaagaaaacactactaaattacgatcttaaactagacattaccgtaaatgaggaagtggcaaaaaaatacgccttcacacctcaagaaaaatacgaaaaattaaaagagaaaaatcctaatattgaagtattacgaaaaatttggtccgagccataa

SEQ ID NO: 24588 - protein, 272 aa, Unknown
  Obtained from environmental sample
  misc_feature (1)..(272): Xaa is any amino acid
MDQSKKTTHSFLMEGIRLANECDLKYKTSKNQRLLVELTLMQLASITFDGEKKNSKHFIIPPSYFKARGIAPVSVTKPKVETVKKEEKPIANDKQNIFKATANVVNEPISIPKISINQPKKSTSGLSLRSIREKKEHQLRQMEVVIDEDNLPTEPVTQEALTEAWKAYTQKMDAKGEKIMASILQMDQPTLKNGTTICLTYSNNTNKIELERAEFPLMTFLKKTLLNYDLKLDITVNEEVAKKYAFTPQEKYEKLKEKNPNIEVLRKIWSEP

SEQ ID NO: 24589 - DNA, 543 bp, Unknown
  Obtained from environmental sample
  misc_feature (1)..(543): n is a, c, g, or t
atgcgaataatatccggattatttaaaggtagacgtattaccgctcctaaaaaattacctgtaagaccaacaacagatatggctaaggaagcgctatttaacatcttaaataaccaatattattttgatgatatctcagtactagacttgttctctggcacaggaaatataagttacgaatttgcatctagaggcacagaacatattacagcagtagacgacaactatggttgtattaagtttataaacgaaacggcagaagcttttgagatgacaattagcactgtaaaaagtgatgtgtttaaatttctagaaaaatctaagcaaaagcatactattatatttgccgatccaccatacaattttgatactgaagcattttcaaaaattccagaattagtatttgaaaaccaattattggaggacgaaggccttttaatagttgagcattctaagcacactgatttaagcacattaaaacaatactcacattctaaaagctatggtggtaatatgtttagcttttttgattattcagattaa

SEQ ID NO: 24590 - protein, 180 aa, Unknown
  Obtained from environmental sample
  DOMAIN (1)...(177): Conserved hypothetical protein 95
  misc_feature (1)..(180): Xaa is any amino acid
MRIISGLFKGRRITAPKKLPVRPTTDMAKEALFNILNNQYYFDDISVLDLFSGTGNISYEFASRGTEHITAVDDNYGCIKFINETAEAFEMTISTVKSDVFKFLEKSKQKHTIIFADPPYNFDTEAFSKIPELVFENQLLEDEGLLIVEHSKHTDLSTLKQYSHSKSYGGNMFSFFDYSD

SEQ ID NO: 24591 - DNA, 564 bp, Unknown
  Obtained from environmental sample
  misc_feature (1)..(564): n is a, c, g, or t
gtggtatacgcagatagtttattatttatttcattagatgtatatcttggaaaagacaataaaatttattctgacttccctaattatgtaaaaaataattttactaatgaccacatggtagttgatgtcgcaaaggctatttctaacgtacagattccattatcttcggatagatcttttatatcaagaattatacaagaaggtaaaaaaatgtatttgttagatgcatatttaccaacatattctgatgctttaaagattggttttacacaagaacagatagattgggctgattttaatgatgaggacatttggaaatattttgtgcaaaaccagcttttatttagtactgatcaagaattatcaaaaagatttatagatgaagccccattctctaagttttatcaagcaaacgataacgattctcctggaagagttggcgtttggataggatggcagatagtaagaacatacatgaaaaataataatacttcattaaatgaattattaaaaactaatgatgaagctatctttaaaaagtcaaaatataaaccttctaaataa

SEQ ID NO: 24592 - protein, 187 aa, Unknown
  Obtained from environmental sample
  misc_feature (1)..(187): Xaa is any amino acid
MVYADSLLFISLDVYLGKDNKIYSDFPNYVKNNFTNDHMVVDVAKAISNVQIPLSSDRSFISRIIQEGKKMYLLDAYLPTYSDALKIGFTQEQIDWADFNDEDIWKYFVQNQLLFSTDQELSKRFIDEAPFSKFYQANDNDSPGRVGVWIGWQIVRTYMKNNNTSLNELLKTNDEAIFKKSKYKPSK

SEQ ID NO: 24593 - DNA, 369 bp, Unknown
  Obtained from environmental sample
  misc_feature (1)..(369): n is a, c, g, or t
atgtctaaaaatacttctgagataaagttcattatagaactggatgaaaataagatacctgtgaaactaanatggaatgcagaagatggtggtatttctaatgaagatactaaggcttttttgatttccgtgtgggattctaaaaaaaaggaaaccttaaaaatggatctttggactaaagatatgcctttagacgaaatgaaacatttcttttctcaaacattactttccatgtctgacactttttacagtgctactaatgatgagaaaatgaccgctactatgcgagatttttgcaaatattttggcccaaaaattaaagctcttaaaaaaatagcctttactaattttataaccgaaatcccttaa

SEQ ID NO: 24594 - protein, 122 aa, Unknown
  Obtained from environmental sample
  misc_feature (1)..(122): Xaa is any amino acid
MSKNTSEIKFIIELDENKIPVKLXWNAEDGGISNEDTKAFLISVWDSKKKETLKMDLWTKDMPLDEMKHFFSQTLLSMSDTFYSATNDEKMTATMRDFCKYFGPKIKALKKIAFTNFITEIP

SEQ ID NO: 24595 - DNA, 405 bp, Unknown
  Obtained from environmental sample
  misc_feature (1)..(405): n is a, c, g, or t
ttgggaggaaatgatgcttttaaactaaactctcctgatttatggatgttaaatgtgaatcatttaatcagagatttgaaaagaaaattcccaaaaacgcctatttattttacaaatatgcctccaataaaagagtttcctgcatttaccagcatcataaaatttgtgattggaaatttggtagaaattttaggaaatagattgtacagaaaaacaaaaaacaaagaaaatgtacactataataaagaaattataaattttgaaacttggaaaaaacgttataatttagaaggtgatattgcttctttttttagtgatggtgtacatccatcaaaattaacgtatcaaatttggggaaaagatatggctacttttatcatgaatacaaaaagctttacatcatga

SEQ ID NO: 24596 - protein, 134 aa, Unknown
  Obtained from environmental sample
  misc_feature (1)..(134): Xaa is any amino acid
MGGNDAFKLNSPDLWMLNVNHLIRDLKRKFPKTPIYFTNMPPIKEFPAFTSIIKFVIGNLVEILGNRLYRKTKNKENVHYNKEIINFETWKKRYNLEGDIASFFSDGVHPSKLTYQIWGKDMATFIMNTKSFTS

SEQ ID NO: 24597 - DNA, 303 bp, Unknown
  Obtained from environmental sample
  misc_feature (1)..(303): n is a, c, g, or t
ttgaaatcgcagggtaaattaggggataacaaacttgtttttgcaaataattcggaaaaagatatcattcttaaaaatgaatttcaaaccatgttgggtgataattttattaatatcctgtcggaagatacggttggaggcatagcgcatggacgcatcacagagaaattcttaaaaaattgcggactggcctatgataaaccattttacatttgtggcccaccgccaatgatggaagccgtagaagagcagttagcgcatttgaatgtgtctaaagatcagatggtgaccgaagcgttttaa

SEQ ID NO: 24598 - protein, 100 aa, Unknown
  Obtained from environmental sample
  DOMAIN (1)...(84): Oxidoreductase NAD-binding domain
  misc_feature (1)..(100): Xaa is any amino acid
MKSQGKLGDNKLVFANNSEKDIILKNEFQTMLGDNFINILSEDTVGGIAHGRITEKFLKNCGLAYDKPFYICGPPPMMEAVEEQLAHLNVSKDQMVTEAF

SEQ ID NO: 24599 - DNA, 300 bp, Unknown
  Obtained from environmental sample
  misc_feature (1)..(300): n is a, c, g, or t
atggacagcattcggctcgagatccaccttcgtgttactatgcgaccaaaatttaaaagtgtaattaagtcctttttagcattgcaagtttatgtggcaaccataatggctgttaattatgtattaaattctaattacttctatttaaatagaaagccagaatctgcttcggcactggattatttaggtgattatccgtattatttacttgttgtagaattaatattaatcccgtttttcttattaatttatttaccgttttatttaatcggtaataaaaagaaactgacatccaaatag

SEQ ID NO: 24600 - protein, 99 aa, Unknown
  Obtained from environmental sample
  misc_feature (1)..(99): Xaa is any amino acid
MDSIRLEIHLRVTMRPKFKSVIKSFLALQVYVATIMAVNYVLNSNYFYLNRKPESASALDYLGDYPYYLLVVELILIPFFLLIYLPFYLIGNKKKLTSK

SEQ ID NO: 24601 - DNA, 408 bp, Unknown
  Obtained from environmental sample
  misc_feature (1)..(408): n is a, c, g, or t
ttgaatttaaaattaaaacaacccattgtatttttcgatttagaaacaactggagttaatattgccaaagatagaattgtagaaatatctattttaaaagtgtttcctaatggaaataaagaaagtaaaacttggttggtaaatccagaagtggaaataccagcagaatctacagcagttcatggaattacaaatgaaaaagtagctggagaaccaacttttaaagaattagcgaataaagttaatgagatgattaaaggttgtgatttagctggttttaattcgaatagattcgatattcctttattggcagaagaattaatgcgagttggaatcgattttgatatgaatggaagaaaagccattgatgtgncagtaattttccataaaaaggacaaagaacattag

SEQ ID NO: 24602 - protein, 135 aa, Unknown
  Obtained from environmental sample
  DOMAIN (9)...(135): Exonuclease
  misc_feature (1)..(135): Xaa is any amino acid
MNLKLKQPIVFFDLETTGVNIAKDRIVEISILKVFPNGNKESKTWLVNPEVEIPAESTAVHGITNEKVAGEPTFKELANKVNEMIKGCDLAGFNSNRFDIPLLAEELMRVGIDFDMNGRKAIDVXVIFHKKDKEH

SEQ ID NO: 24603 - DNA, 780 bp, Unknown
  Obtained from environmental sample
  misc_feature (1)..(780): n is a, c, g, or t
ttgtggtatgcaaatattagttttttaaattctgataaaggaatttcatctaatgaagatggaactttcttaatgaatttagataaaaaatacttagattctaaagtgcatatttcttgtttaaattataaagacactattgttgttgccaaagatttatacaaaaaaaagttgtttttaaatcctatttcagaagttttgaatgaaatagtattgacaaaaaaaatagataaaagtgtaactttggatgaagtaaaaaagaaagttgaggcaatacatacttcaggaatgagaatgattgctaagtattttccgaattctaaagaaaacaaatgttgtaattatatttctaccatagaaattcatttttcgaaaaggcattcaaaacaatctaaatttagatttagaatttttgataaagatgaaaaaactgggaatcctaaaaacgatttgttaaaaataaatattccacttactttaaaacctggagatttagaattaacggttaatttagaagattacaatattgaaatgccagaaaatggagtgtttattgctttcgaaaagctttttattccctttaatgaatatggcaaaaatgagcaagatgaaaatagtgaggttttgtattcgcctgttgtaggttttacaaaatatcctaaaaagaaagaaaatgatttgtatttttatgtaaaaggaaattggcaaaaatgggcattaagtaaagtgaaatcttacaagaaatatgctccttcaatttctttaacacttacaaattga

SEQ ID NO: 24604 - protein, 259 aa, Unknown
  Obtained from environmental sample
  misc_feature (1)..(259): Xaa is any amino acid
MWYANISFLNSDKGISSNEDGTFLMNLDKKYLDSKVHISCLNYKDTIVVAKDLYKKKLFLNPISEVLNEIVLTKKIDKSVTLDEVKKKVEAIHTSGMRMIAKYFPNSKENKCCNYISTIEIHFSKRHSKQSKFRFRIFDKDEKTGNPKNDLLKINIPLTLKPGDLELTVNLEDYNIEMPENGVFIAFEKLFIPFNEYGKNEQDENSEVLYSPVVGFTKYPKKKENDLYFYVKGNWQKWALSKVKSYKKYAPSISLTLTN

SEQ ID NO: 24605 - DNA, 348 bp, Unknown
  Obtained from environmental sample
  misc_feature (1)..(348): n is a, c, g, or t
atgaagaaagtatattttttgcaaacttgtgatacctgcaaacgaattttaaaggaagtaaatacagaaggttttgaaaagcgtgaaattaaatcgaacccaatttctgaaaatgaattggctgaaatgtacgcgctttctgaaagttatgaagccttgattaataaacgtgcaagattgtatgcttctttaggtttaaaggataaaaacttgtctgaaagtgattttaagaaacatcttttagaagaatatacgtttttaaaacgtcctgtttttctagttgatggtgaaatatttattggaaacagtaaaaaagttatagaaaaattaaaagagaagattggctaa

SEQ ID NO: 24606 - protein, 115 aa, Unknown
  Obtained from environmental sample
  DOMAIN (5)...(112): ArsC family
  misc_feature (1)..(115): Xaa is any amino acid
MKKVYFLQTCDTCKRILKEVNTEGFEKREIKSNPISENELAEMYALSESYEALINKRARLYASLGLKDKNLSESDFKKHLLEEYTFLKRPVFLVDGEIFIGNSKKVIEKLKEKIG

SEQ ID NO: 24607 - DNA, 492 bp, Unknown
  Obtained from environmental sample
  misc_feature (1)..(492): n is a, c, g, or t
atgaagaacgtactttttattttaataatgacattcggaattttgagttgcaacgctcaaaatcaacgtgagaaggaagaaaaaataagaactgaaatcaatgcggaatttgataaaagtgtatcggaatgcaacgcaggaattgattctgtaactgactttaatggaaaaaacgaattttggaatatttgtgatttaaaaaataacaagcgtattataaccattgagtcgtacaagggaaatacttactatcaagaaatctatttcgtaaaaaaaggagatttggtttatgcaaaagaaacagaaaactatatgccaaagaatcattttactcaaatggcgtggaattgtgaattctatgtagaaaaaagagaattaattgcattaatgtcacttggacatggaaaaacagaagatgataactggaatccagaaatcatttttgaaatgtataaaaaccgaataacccaattaaagaaaataaagaaataa

SEQ ID NO: 24608 - protein, 163 aa, Unknown
  Obtained from environmental sample
  SIGNAL (1)...(19)
  misc_feature (1)..(163): Xaa is any amino acid
MKNVLFILIMTFGILSCNAQNQREKEEKIRTEINAEFDKSVSECNAGIDSVTDFNGKNEFWNICDLKNNKRIITIESYKGNTYYQEIYFVKKGDLVYAKETENYMPKNHFTQMAWNCEFYVEKRELIALMSLGHGKTEDDNWNPEIIFEMYKNRITQLKKIKK

SEQ ID NO: 24609 - DNA, 330 bp, Unknown
  Obtained from environmental sample
  misc_feature (1)..(330): n is a, c, g, or t
atgacagtagatttgtgcccaaattgtgggtcagaccattacattaaaagcggaattgttaatgataggcaacgttataagtgcaaaaaatgcaactatttcttctctgttaataaaataggtaagaagatagacgactactacngtaataaatcgttacagttatacttagaaggcttaacctatcgggaaaatgaacgcattttaggaatttctcatgtaagcatcatgaattgggtgaaaaagtacaacataaaacgcccataccattcccaatacccaccancatataagattttaaacgcatcggaagtaggctttttattttag

SEQ ID NO: 24610 - protein, 109 aa, Unknown
  Obtained from environmental sample
  misc_feature (1)..(109): Xaa is any amino acid
MTVDLCPNCGSDHYIKSGIVNDRQRYKCKKCNYFFSVNKIGKKIDDYYXNKSLQLYLEGLTYRENERILGISHVSIMNWVKKYNIKRPYHSQYPPXYKILNASEVGFLF

SEQ ID NO: 24611 - DNA, 381 bp, Unknown
  Obtained from environmental sample
  misc_feature (1)..(381): n is a, c, g, or t
ttgacttttttgaaaaacctatattttattcatttaaataaaaaacaaaatagtcgtgatggtatgcacatttataaagctaacaaacacgacttagcaaatacaataaaagctattaatgcaataacaagtaatgttattaaaagcgaaacgctagaagatttaaaaaatttaatagaacagcacgaaaccattataagtactataacaaatcaaactaaagttaagaacaccctttttagcgattttaatggtagtataaaaagtttgggtgcttggggaggcgattttattttagtcgcaagtaaaaccaatccaacagactattttaaagctaaaggttttaatactatattaaattataaagacatggtcttataa

SEQ ID NO: 24612 - protein, 126 aa, Unknown
  Obtained from environmental sample
  misc_feature (1)..(126): Xaa is any amino acid
MTFLKNLYFIHLNKKQNSRDGMHIYKANKHDLANTIKAINAITSNVIKSETLEDLKNLIEQHETIISTITNQTKVKNTLFSDFNGSIKSLGAWGGDFILVASKTNPTDYFKAKGFNTILNYKDMVL

SEQ ID NO: 24613 - DNA, 375 bp, Unknown
  Obtained from environmental sample
  misc_feature (1)..(375): n is a, c, g, or t
atgcaaaccttttatagtcacggaaaattattacttactgcagagtatgttgtacttgatggcgctaaagccttagcagttcccactaaatttggtcaacaattaacagtggagtctattgataaacctcaaattatatggacaagtttggaccacaacaacgccatttggtttgaagatatatttaaattagatgaaattaaagtcggttacctttctcgtaatcccatctctgataggctaattcaaatcctaaagactataaaacagttaaaccctgaatttttaacttgtaaaacaggttttaaaataaccacaatacttgagtttcctaaaaattgggggattgggtacatcctctactttaataaataa

SEQ ID NO: 24614 - protein, 124 aa, Unknown
  Obtained from environmental sample
  misc_feature (1)..(124): Xaa is any amino acid
MQTFYSHGKLLLTAEYVVLDGAKALAVPTKFGQQLTVESIDKPQIIWTSLDHNNAIWFEDIFKLDEIKVGYLSRNPISDRLIQILKTIKQLNPEFLTCKTGFKITTILEFPKNWGIGYILYFNK

SEQ ID NO: 24615 - DNA, 471 bp, Unknown
  Obtained from environmental sample
  misc_feature (1)..(471): n is a, c, g, or t
atgatagattcaagttttatccaatttcaattgtcttataaattattaaatcaaaatattgaaaaacaaacatttctttcatataaaattttggaatcaaaatcaaaattggactcaacaaacatctataaatacaagtatttttctgattttattgattttttcgatagaggcacatttgactattacgaagtagatgaaccagttgaagatgtgcataatgtttggcttttgtaccaaaattataaccgcacaggtaatgatgatgtcgaccgatacgaaacttcacgttatcatcaagaaaatgcgtcaaacgactttattttcataattgatagtattaacgttatagaaaattcattaaaaaaagttgaagtttattattcatttaaatgtatcggagtaaatccatacggcgaacaattaataatggataatggaaagggaaaatccacatttgaatttaattaa

SEQ ID NO: 24616 - protein, 156 aa, Unknown
  Obtained from environmental sample
  misc_feature (1)..(156): Xaa is any amino acid
MIDSSFIQFQLSYKLLNQNIEKQTFLSYKILESKSKLDSTNIYKYKYFSDFIDFFDRGTFDYYEVDEPVEDVHNVWLLYQNYNRTGNDDVDRYETSRYHQENASNDFIFIIDSINVIENSLKKVEVYYSFKCIGVNPYGEQLIMDNGKGKSTFEFN

SEQ ID NO: 24617 - DNA, 780 bp, Unknown
  Obtained from environmental sample
  misc_feature (1)..(780): n is a, c, g, or t
atggcagaattttggtggggaatttggccaaactcagctattagaaagcataaaaaatattatcctgcttgtcaaagtagatgcaaacctattttaaaccacatgttaaatggtgttgaaatggaacaaaatttattattagaaaatttatccgaagacaaaaaacttgagattatttttgaagatgatgttttaattgtggttaataaaccagctgaatttttatctgttcctggtaaaaccattcaagattctgtgtatagcagaattaaagagaaatatccaacagcaactggcccattaattgtgcatagattagacatgtctacctctggtattttattgttaaccaaaaccaaagaagccaacaaagttttacaaagtcagtttataaccagaactgtaaaaaaacgttatgttgctttgttaaatggagatttatcaacaaaaaaaggcactataaaattgccaattagagtcgatttagatgacaggccaaaacaattagtagattttgtgcatggaaaaaatgcagaaactaattgggaaatcatcaacaatgaaaatggaaaaactcgggtttatttttatccaattactggtagaacccatcaattaagagtgcatgcagctcataaaaatggtttaaacactcctattttaggtgatgatttatatggaaagaaagcaaatagattgcatttacatgcgcagtttattgaatttacacatccaacaaccaacaaaaaaatgagttttacagttgatgctgatttttaa

SEQ ID NO: 24618 - protein, 259 aa, Unknown
  Obtained from environmental sample
  DOMAIN (64)...(212): RNA pseudouridylate synthase
  misc_feature (1)..(259): Xaa is any amino acid
MAEFWWGIWPNSAIRKHKKYYPACQSRCKPILNHMLNGVEMEQNLLLENLSEDKKLEIIFEDDVLIVVNKPAEFLSVPGKTIQDSVYSRIKEKYPTATGPLIVHRLDMSTSGILLLTKTKEANKVLQSQFITRTVKKRYVALLNGDLSTKKGTIKLPIRVDLDDRPKQLVDFVHGKNAETNWEIINNENGKTRVYFYPITGRTHQLRVHAAHKNGLNTPILGDDLYGKKANRLHLHAQFIEFTHPTTNKKMSFTVDADF

SEQ ID NO: 24619 - DNA, 399 bp, Unknown
  Obtained from environmental sample
  misc_feature (1)..(399): n is a, c, g, or t
atgatacatcagcgctccttttgggaaggtatggaacgttttatagctattttattggaacatgcgggaggaaatttcccgctgtggttaaagccaaatcaagtttctatattaactcttagtgagaaatacgagaaatacggtgaaaaagttttaactttgctagaaaatcacgaaattcgcgcacttgtagataacagaagcgagaccattggtaagaaaattagagaggctgaaatgagtaaaacgccttatatgattatcattggggaacaagaggaagcagaaaacaagatatctgtaagacaacatggtggtgaagatttaggcacgattagtgtagatacctttgcagaaattgttaaaacggagataaataaaacaaaaagacaattttaa

SEQ ID NO: 24620 - protein, 132 aa, Unknown
  Obtained from environmental sample
  DOMAIN (34)...(124): Anticodon binding domain
  misc_feature (1)..(132): Xaa is any amino acid
MIHQRSFWEGMERFIAILLEHAGGNFPLWLKPNQVSILTLSEKYEKYGEKVLTLLENHEIRALVDNRSETIGKKIREAEMSKTPYMIIIGEQEEAENKISVRQHGGEDLGTISVDTFAEIVKTEINKTKRQF

SEQ ID NO: 24621 - DNA, 444 bp, Unknown
  Obtained from environmental sample
  misc_feature (1)..(444): n is a, c, g, or t
ttgataaacattaaattaaaagatattgatttagaaaataagacaattaaaattttaggtaaaagaaataaagaacgtattattcctttgttaaacatggtaatggatagtgtagtcatttataagttagaaagaaataaattagaaactattacagataatgagtatttgtttttaacaaaaaaaggagttaaagtatatgaaactcttgtctacagaattataaatgattattttagtaaagcttcaactaaggtgaagaaaagtccacatattctaagacattcttttgctacacacttattaaatcaaggtgcagagttaaatgcagtcaaagaactattagggcattctagtttagcagctactcaagtttatacgcacaatagtatcgctgaattaaaaaaagtatacgcaaaagcgcaccctagaagtaaaaaataa

SEQ ID NO: 24622 - protein, 147 aa, Unknown
  Obtained from environmental sample
  DOMAIN (1)...(136): Phage integrase family
  misc_feature (1)..(147): Xaa is any amino acid
MINIKLKDIDLENKTIKILGKRNKERIIPLLNMVMDSVVIYKLERNKLETITDNEYLFLTKKGVKVYETLVYRIINDYFSKASTKVKKSPHILRHSFATHLLNQGAELNAVKELLGHSSLAATQVYTHNSIAELKKVYAKAHPRSKK

SEQ ID NO: 24623 - DNA, 639 bp, Unknown
  Obtained from environmental sample
  misc_feature (1)..(639): n is a, c, g, or t
gtgttaggtaaagatgtgttagcaacacatcaatttaaattggatacgattttagttgataatgaaagaaaaatttataaaattaagatagataaaagtgaggattttgttggtttagacacagaaggcatttataacgaaggttatattgcagaaggttggatgtacatttattgggataattttgcaattaaaaaaattgaatatcaattaaaagcaggatctaatgcgcaaaaaagtagaagtaaaaccttatttgatacgcaaataaaccataaactagttatatcctacatggaatatcaagatagaatgtatccaaattatatctattacgaaactccaaaacttgtcaatgttggttataagccagtaggtaaaattgataaagaagaggaagcgctttttaataaagaagaacggttttattatacagtacaagaaattttgtttactgagataattcaagatcaagaacaagtgcaagcagctttaaatcaagactgggattcggatattttttctataaaaccttacgataaaacattttgggaaaactacaatacattactagaaagtgaagaagatgaaaagttaattaaggatttaactaaacgttccacactttttaaacaataa

SEQ ID NO: 24624 - protein, 212 aa, Unknown
  Obtained from environmental sample
  misc_feature (1)..(212): Xaa is any amino acid
MLGKDVLATHQFKLDTILVDNERKIYKIKIDKSEDFVGLDTEGIYNEGYIAEGWMYIYWDNFAIKKIEYQLKAGSNAQKSRSKTLFDTQINHKLVISYMEYQDRMYPNYIYYETPKLVNVGYKPVGKIDKEEEALFNKEERFYYTVQEILFTEIIQDQEQVQAALNQDWDSDIFSIKPYDKTFWENYNTLLESEEDEKLIKDLTKRSTLFKQ

SEQ ID NO: 24625 - DNA, 393 bp, Unknown
  Obtained from environmental sample
  misc_feature (1)..(393): n is a, c, g, or t
ttgctgtccacctcagggcgtgttgttaccagccggtcagaaaagtatcgagaacagactgagatatggttaaaaaagtataaagtagaatacgagtatttaattatgcaagatttacctggtaaagaaggaggacaaaagcaaattagtcatgcaaagcataaagctttattttatcaaaaaagtagtgcagagctttttattgaaagcgactataagcaaagtattgaaattaatcatatcactaaaaaaccagttttttgtgcagctagtaaccaaataattaacaacggcttttataatctaaagcatgaagcagttacaagcttaaaagaacggttggcttcgtttatacctcgtggcataaaaaatcagattaaaaaattatattaa

SEQ ID NO: 24626 - protein, 130 aa, Unknown
  Obtained from environmental sample
  misc_feature (1)..(130): Xaa is any amino acid
MLSTSGRVVTSRSEKYREQTEIWLKKYKVEYEYLIMQDLPGKEGGQKQISHAKHKALFYQKSSAELFIESDYKQSIEINHITKKPVFCAASNQIINNGFYNLKHEAVTSLKERLASFIPRGIKNQIKKLY

SEQ ID NO: 24627 - DNA, 324 bp, Unknown
  Obtained from environmental sample
  misc_feature (1)..(324): n is a, c, g, or t
atgtataagacggaagttgttaaaattattgggttgtatccagaaaattatccagctcttgaagatcatgcctatttttttaaagtaattaaacattttaaaactatggtgctgccagagttattgttagagtatgaggttaatccaaatagtatttctaatttaaaaagaaagcagcaaactaaaagcagaattaaactacttaaggataattataattatacatttactgcaactttaggtttggttagagcttttgcgactagtctaatacctaaaagtattttactatactttaaaaaaacttttttttataataaatga

SEQ ID NO: 24628 - protein, 107 aa, Unknown
  Obtained from environmental sample
  misc_feature (1)..(107): Xaa is any amino acid
MYKTEVVKIIGLYPENYPALEDHAYFFKVIKHFKTMVLPELLLEYEVNPNSISNLKRKQQTKSRIKLLKDNYNYTFTATLGLVRAFATSLIPKSILLYFKKTFFYNK

SEQ ID NO: 24629 - DNA, 438 bp, Unknown
  Obtained from environmental sample
  misc_feature (1)..(438): n is a, c, g, or t
atgtcaattaaagtagaaaacataactaaggtttatggctcgcagaaggctttaaacaatatttcttttgaaattaatcgtcccgaaattgtcggttttttaggtcctaatggcgcaggaaaatctacaatgatgaaaatcttaacaacttacatcaatcctacatcaggcgatgcggaagttaatggacatcatattttaactgacacaaaaaatgttcaaaaaagtgttggctatttaccagaacacaaccctttatatttagaacaatatgtaagagaatatttaagctttaaacgctatgtctataatgttgacaaatcgcgtattgaagaagttattacgcttactggattacaccctgagcacataaaactattggacaactatccaaaggttacagacacgtgttggtttagcaaacgccttactacataa

SEQ ID NO: 24630 - protein, 145 aa, Unknown
  Obtained from environmental sample
  misc_feature (1)..(145): Xaa is any amino acid
MSIKVENITKVYGSQKALNNISFEINRPEIVGFLGPNGAGKSTMMKILTTYINPTSGDAEVNGHHILTDTKNVQKSVGYLPEHNPLYLEQYVREYLSFKRYVYNVDKSRIEEVITLTGLHPEHIKLLDNYPKVTDTCWFSKRLTT

SEQ ID NO: 24631 - DNA, 351 bp, Unknown
  Obtained from environmental sample
  misc_feature (1)..(351): n is a, c, g, or t
atgaagaaaaaaatactgattgtcgatgatgatcccaatattgttgattacctggtcacactatttgaagacaacggatacgaaacctactcggccggaaacgcccaggatgggtttgaagtggcaaaaaaagaagtgccggacctgatcaccctggacctggaaatgcccggcgaatggggcctccgcttttatcggaagatgagcgctgaaaaaagcctgaagaatattcccgtagtggttatcaccgggttttccggcagcgagcttgctatcggaaaagcggtggccagcctgacgaaaacctttgacccagatgatttgctgggtatcgtccaagaatccctctaa

SEQ ID NO: 24632 - protein, 116 aa, Unknown
  Obtained from environmental sample
  DOMAIN (3)...(115): Response regulator receiver domain
  misc_feature (1)..(116): Xaa is any amino acid
MKKKILIVDDDPNIVDYLVTLFEDNGYETYSAGNAQDGFEVAKKEVPDLITLDLEMPGEWGLRFYRKMSAEKSLKNIPVVVITGFSGSELAIGKAVASLTKTFDPDDLLGIVQESL

SEQ ID NO: 24633 - DNA, 579 bp, Unknown
  Obtained from environmental sample
  misc_feature (1)..(579): n is a, c, g, or t
atgaagttaaaaaaatacatagctttgatgcttttttgtttatttattggttttgtttttagtcaagaacaagagcaggaaaataattataaagccttaaaatttaagaatttttcgttaaaagaaggtttgtctcaaagttctgtgctttgtattttacaagataaaaaaggatttttgtggtttggaacgcgtgatggtttaaataaatacgatggaaatgagtttaagatttttagacacaattctcaagacagcactagtttaagtaacaactttattaaagcattgtacgaagatgctaaagggaatttatgggtaggcactattgatggttttaacaaatttaatcaagaaacaaattcgttcgagcgttacacaattgaaacagaaaaaaaagactttgataattttgaaatttggagcatcgtagaagataaagatgagtatttatggctaggcactagcttaggaataaaaaaatttgatactaacaaaggcgtacttgcagaatatgtttataatgaatctgataaaaacctatttaatataccagtacgctctctcgagccgatctga

SEQ ID NO: 24634 - protein, 192 aa, Unknown
  Obtained from environmental sample
  SIGNAL (1)...(19)
  DOMAIN (88)...(111): Two component regulator propeller
  misc_feature (1)..(192): Xaa is any amino acid
MKLKKYIALMLFCLFIGFVFSQEQEQENNYKALKFKNFSLKEGLSQSSVLCILQDKKGFLWFGTRDGLNKYDGNEFKIFRHNSQDSTSLSNNFIKALYEDAKGNLWVGTIDGFNKFNQETNSFERYTIETEKKDFDNFEIWSIVEDKDEYLWLGTSLGIKKFDTNKGVLAEYVYNESDKNLFNIPVRSLEPI

SEQ ID NO: 24635 - DNA, 534 bp, Unknown
  Obtained from environmental sample
  misc_feature (1)..(534): n is a, c, g, or t
ttgaggattttaaagggggttttggatgcttcccaacattttagtggttatgggaagcaaaaatggttgtcatttttttgggcccgccaggatttggaaatttttaaaaataggtttaaaggctatagggcagctttaaagaaaattagcctatcttttaaaaaagataatgtaatagtttctagattaatggagaatgatggctctataaacgctaaaaaacttttagataataatttagattttgacggtattttttcagcaaacgatgtcgctgccattggtgctatgaaatatttaatagncaaaggtgttaaaattccagaagatgttgctattgtaggttttagtaacgaacctatttcaacagttattaatcctgctttaacaacaattaaccaaccagggtttgaaatgggtaaaaaagcaacagatttattgttgaaacatataaaaaaacaaatcggacttttaaaatcgcaaacaattataatggattcaaatttaattgaacgtcaatcatcaaaaaaatga

SEQ ID NO: 24636 - protein, 177 aa, Unknown
  Obtained from environmental sample
  misc_feature (1)..(177): Xaa is any amino acid
MRILKGVLDASQHFSGYGKQKWLSFFWARQDLEIFKNRFKGYRAALKKISLSFKKDNVIVSRLMENDGSINAKKLLDNNLDFDGIFSANDVAAIGAMKYLIXKGVKIPEDVAIVGFSNEPISTVINPALTTINQPGFEMGKKATDLLLKHIKKQIGLLKSQTIIMDSNLIERQSSKK

SEQ ID NO: 24637 - DNA, 864 bp, Unknown
  Obtained from environmental sample
  misc_feature (1)..(864): n is a, c, g, or t
atgagcaaagctaaactagacagtacacaggaatacgatttaatttgtgttggaggcggaattatgagtgctactttggcattaatgtccaagattttaaaaccggatttaaaagtattgattgtcgagcgtcttagtgaggtggctcaggaaagttctgctgcttggaataatgcaggtacaggacattctgcactctgcgaacttaattattgtcctgaggaagatggaaaagtcgttattgaaaaagccataaaaatttgtcagcagtttgaagagtctaaacagttttggagctatttagtggagcttggtttaattgatgatcctgatagttttattgctgcagtaccacatcatagttgggttttaggtgaagaaaatgctacatacttagagcagcgttttaacaccatgaaacatcattttatgtttgatactatccaatttacaaaggataagagtaaaatgaaagactggtttccgttaattatgaataacagagatgaggatgaggtgatggctgcatccagaattgacagaggtacagaggttaattatggaacgttaacaaaaacattattcaatattttagaaaccaaatttgatacaccagtgtattgtaatatggaagttatagatattgatccaagtccagatattgattggacggtagagatggaaaatcttaaaactaaccaaaaatataatctagaatctaaacatgtttttattggagcaggaggaggaagtcttctttttatacaaaaggtagaaattgaagaaaaagaaggatatggtggtttttcctatagtggcgaagggttagtttgtaaaaatgaagactttattaaacagccttaa

SEQ ID NO: 24638 - protein, 287 aa, Unknown
  Obtained from environmental sample
  DOMAIN (8)...(286): Malate:quinone oxidoreductase (Mqo)
  misc_feature (1)..(287): Xaa is any amino acid
MSKAKLDSTQEYDLICVGGGIMSATLALMSKILKPDLKVLIVERLSEVAQESSAAWNNAGTGHSALCELNYCPEEDGKVVIEKAIKICQQFEESKQFWSYLVELGLIDDPDSFIAAVPHHSWVLGEENATYLEQRFNTMKHHFMFDTIQFTKDKSKMKDWFPLIMNNRDEDEVMAASRIDRGTEVNYGTLTKTLFNILETKFDTPVYCNMEVIDIDPSPDIDWTVEMENLKTNQKYNLESKHVFIGAGGGSLLFIQKVEIEEKEGYGGFSYSGEGLVCKNEDFIKQP

SEQ ID NO: 24639 - DNA, 414 bp, Unknown
  Obtained from environmental sample
  misc_feature (1)..(414): n is a, c, g, or t
atgggaatattccattattacgatattggaaatacagaaatttacgtttttgatgattttattattaaacaagtaaaagaaggtgtttttatagacatacaagatgttaagcaattagtagaaataattgacaaacattttaaatctaaaaaatttggatttatttctaatcgtgttaactcgtatacaattaaccccttaacttattccgaagccaataaaatcgataatttgattgtttttgctgtaataacaaacgacgctaaaatgcgtgaaacctctgagtttgaaaataaatttcataataaaccatttagtgtttttgaaaatttaagcgatgctatactctggattaatgacgcacttaaacaaaacaacaatcaaaccactagcacttccttaaaagaaaagtaa

SEQ ID NO: 24640 - protein, 137 aa, Unknown
  Obtained from environmental sample
  misc_feature (1)..(137): Xaa is any amino acid
MGIFHYYDIGNTEIYVFDDFIIKQVKEGVFIDIQDVKQLVEIIDKHFKSKKFGFISNRVNSYTINPLTYSEANKIDNLIVFAVITNDAKMRETSEFENKFHNKPFSVFENLSDAILWINDALKQNNNQTTSTSLKEK

SEQ ID NO: 24641 - DNA, 465 bp, Unknown
  Obtained from environmental sample
  misc_feature (1)..(465): n is a, c, g, or t
ttggttacaggacgaccagacgctgcgttagatggtgtatataaattatctgaatacaatggtgatccaagaaataaactctctgaaaacattataaaagtatcactaccgtttaaaaaacaagtgtatcgcatgattgataacgatggacaattttatggcgcagatgctgtcgcgatttatgccgaaggtgagattgatcaaatggaacactcttttgatgtaaccaaacaaataaatattaaggcgttaaaaaaagagccattattagagctagtaatggaggatggtaagcgtgtaatacctgcaagaacggttaacgaaattgctgaatattcgcaatcgcgtttagctcaacttccggatgaatataaacgttttcaaaatccgcatacctataaaattggattaagtagtcaacttaaaaaggaacgaaatgatctaattaacaaacataaaaactaa

SEQ ID NO: 24642 - protein, 154 aa, Unknown
  Obtained from environmental sample
  misc_feature (1)..(154): Xaa is any amino acid
MVTGRPDAALDGVYKLSEYNGDPRNKLSENIIKVSLPFKKQVYRMIDNDGQFYGADAVAIYAEGEIDQMEHSFDVTKQINIKALKKEPLLELVMEDGKRVIPARTVNEIAEYSQSRLAQLPDEYKRFQNPHTYKIGLSSQLKKERNDLINKHKN

SEQ ID NO: 24643 - DNA, 633 bp, Unknown
  Obtained from environmental sample
  misc_feature (1)..(633): n is a, c, g, or t
gtgcagcatataaaaatgaaaaataccgtaaaatttatacttattacattattttcaatttttgctatatttagaattggaaaatggacaggtattctacaaaattttttaataaccactgtcagtaatgaaccagcgttgaatattggagatcgagttttgggaacaaaccttattgaaccggaaaaatttgatttaattctatacaaaacacctaataatcttgaacaatctgaaatatggagtcatagattatgtgggacttcaaacgacacaattcttattaaggatggaactttatttataaatggaataaatgttgaccaaaatcttcaactaaaacattcatatataacctatagaaataaacttcctcttataatagaaaagactaatattaatcagtccaattattttatgtttaatgcggattcaattattattcaattgacaaaaaaggaagctgaattttttggtatttcaaatagatatattaaaaaaggaactgatgaagaaattcgaaaaatatatgatcagaattggaatgaggataattttggtcctttaattattcctaaagactttttgtttgttcttggtgataatagaaataatagcctcgagccgatctga

SEQ ID NO: 24644 - protein, 210 aa, Unknown
  Obtained from environmental sample
  misc_feature (1)..(210): Xaa is any amino acid
MQHIKMKNTVKFILITLFSIFAIFRIGKWTGILQNFLITTVSNEPALNIGDRVLGTNLIEPEKFDLILYKTPNNLEQSEIWSHRLCGTSNDTILIKDGTLFINGINVDQNLQLKHSYITYRNKLPLIIEKTNINQSNYFMFNADSIIIQLTKKEAEFFGISNRYIKKGTDEEIRKIYDQNWNEDNFGPLIIPKDFLFVLGDNRNNSLEPI

SEQ ID NO: 24645 - DNA, 306 bp, Unknown
  Obtained from environmental sample
  misc_feature (1)..(306): n is a, c, g, or t
atgaaaaagcagcaaaaaataaagtactggcaagccatttttgagcagcaagagtctagcgcgttaactaccattcaattttgtcgtgataacaacattaacgcatcgactttctatgtttggcgtaaacgcctttctgacgaaacgataagggttaaaaagcaacaggtgatcccgtttgttattcatgagcaagcctttacacacccttcaatcattaaactcaccacaccaaacggctatcaaatagacttcgagtcgacattagctaaccaaacgctagccaaattattgagcgtactgtga

SEQ ID NO: 24646 - protein, 101 aa, Unknown
  Obtained from environmental sample
  misc_feature (1)..(101): Xaa is any amino acid
MKKQQKIKYWQAIFEQQESSALTTIQFCRDNNINASTFYVWRKRLSDETIRVKKQQVIPFVIHEQAFTHPSIIKLTTPNGYQIDFESTLANQTLAKLLSVL

SEQ ID NO: 24647 - DNA, 702 bp, Unknown
  Obtained from environmental sample
  misc_feature (1)..(702): n is a, c, g, or t
atgtgtggtattgttggatatataggtcatagagaagcttattctattgtaatggaaggcttaaaacgattagaatacagaggttatgatagtgcaggtattgcgctatatgatggcactgacatcaaattatctaagactaaaggtaaagtcgctgatctagaagaacgtgtaaaagaagaaatcacaactgaaggaacaattggaataggtcatacaagatgggcaacccatggtgtaccaaatgatgtaaattctcatccacattattctaattcaggtgatctagttataattcataacggaattattgaaaattacgactcgataaaaacagaacttataaaaagaggttacgtttttaaatcagatacagatacagaagtcttaataaatctgattgaagaagttaagaaaaaacaaaacgtaaaattaggtaaagctgtacaactagcacttaacgaggttgttggagcttatgctattgctgtttttgacaaaaacaaaccaaacgaaattgtcgttgctaaactaggtagtcctttagcaatcgaaattggagaagacgagttttttatagcaagtgatgcctctccttttattgaatacactaaaaatgctatttatcttgaagatgaagaaatggctattgggcgtcgaaataaaaaaataaaaatccgaaaaatcagggacgattcctga

SEQ ID NO: 24648 - protein, 233 aa, Unknown
  Obtained from environmental sample
  DOMAIN (2)...(136): Glutamine amidotransferases class-II
  misc_feature (1)..(233): Xaa is any amino acid
MCGIVGYIGHREAYSIVMEGLKRLEYRGYDSAGIALYDGTDIKLSKTKGKVADLEERVKEEITTEGTIGIGHTRWATHGVPNDVNSHPHYSNSGDLVIIHNGIIENYDSIKTELIKRGYVFKSDTDTEVLINLIEEVKKKQNVKLGKAVQLALNEVVGAYAIAVFDKNKPNEIVVAKLGSPLAIEIGEDEFFIASDASPFIEYTKNAIYLEDEEMAIGRRNKKIKIRKIRDDS

SEQ ID NO: 24649 - DNA, 726 bp, Unknown
  Obtained from environmental sample
  misc_feature (1)..(726): n is a, c, g, or t
atggaacaaaataaacaagtttttgatagtgtattagacctaataggtaatacaccaatgataaaactaaaaaaaattacttcaggttttaaagggaattatctagcaaaggttgaagcctttaatccaggtcattcatcaaaagatagaatcgctttatacatattagagcaagcagaaaagcaaggtatacttaaaccaggagacacaataattgaaactacatcaggtaatacaggatttagtattgcaatggttagtgtaattaaaggttatgattgtatcttggcagttagttcaaaatcttcagcagataagattgacatgttaaaaaacatgggagctaaagtatatgtttgtccagcaaacgttagtgcagatgatccaagaagttattatcaagtagcaaaacgattacacgaagaaattaaaggatctgtttatattaatcaatactttaatcaactaaatattgatgcacattacaattctactggaccagaaatatggaaccagacagaaggtaaaataacgcatttagttgcatgtagtggtacaggaggaacaatttctggaacagctaagtatttaaaagagcaaaatccaaacattaaggttattggtgttgatgcttatggttcggtattaaaaaaatatcacgaaactagagagtttgacgataaagaaatttatccatacagaattgaaggtttaggaaaaaattaa

SEQ ID NO: 24650 - protein, 241 aa, Unknown
  Obtained from environmental sample
  DOMAIN (11)...(241): Pyridoxal-phosphate dependent enzyme
  misc_feature (1)..(241): Xaa is any amino acid
MEQNKQVFDSVLDLIGNTPMIKLKKITSGFKGNYLAKVEAFNPGHSSKDRIALYILEQAEKQGILKPGDTIIETTSGNTGFSIAMVSVIKGYDCILAVSSKSSADKIDMLKNMGAKVYVCPANVSADDPRSYYQVAKRLHEEIKGSVYINQYFNQLNIDAHYNSTGPEIWNQTEGKITHLVACSGTGGTISGTAKYLKEQNPNIKVIGVDAYGSVLKKYHETREFDDKEIYPYRIEGLGKN

SEQ ID NO: 24651 - DNA, 750 bp, Unknown
  Obtained from environmental sample
  misc_feature (1)..(750): n is a, c, g, or t
gtgtataaaaccaagtctaaaaagtatttagtaattggaagttcaagtacgcaaacaaccgaatatagatttttagatgccaatacacctgatggtgaatttaaaatttttcaagagcgcgaaagaaaccttgaatattcaatagctcactatcaagataatttttacatcattacaaataaggatgaagcaaccaattttaaacttcaaaaagtagccgaaaccaatacagataaggctaattgggaggatgttattccgcatcgtaaagatgtattattagaagatattgagatttttaaagattatttaattgtaaacgaacgtgaaaatggtttaaatcaattaagaattattagttgggatggtaaagaagactattatttagattttgaaagtgaaacctacacagcagacataggtaataatccagattttgatagcaactatttaagatactcttttaattctttaacaacaccaagctcgataatcgattatgatttaaagactaaaacaaaaacggtaaaaaaagagcagcaagtattagatgattcatttaataaagacaattatatatcacaaagggtttgggcaacagctaaagatggcgtaaaaataccaatgtctgtagtgtatagaaaaggaacaaaacttgacggaaatagtccgttattacaatatgcatatggctcatatggagcaacaatagaccccttatttttcttcaatacgaccttagcctgttag

SEQ ID NO: 24652 - protein, 249 aa, Unknown
  Obtained from environmental sample
  misc_feature (1)..(249): Xaa is any amino acid
MYKTKSKKYLVIGSSSTQTTEYRFLDANTPDGEFKIFQERERNLEYSIAHYQDNFYIITNKDEATNFKLQKVAETNTDKANWEDVIPHRKDVLLEDIEIFKDYLIVNERENGLNQLRIISWDGKEDYYLDFESETYTADIGNNPDFDSNYLRYSFNSLTTPSSIIDYDLKTKTKTVKKEQQVLDDSFNKDNYISQRVWATAKDGVKIPMSVVYRKGTKLDGNSPLLQYAYGSYGATIDPLFFFNTTLAC

SEQ ID NO: 24653 - DNA, 792 bp, Unknown
  Obtained from environmental sample
  misc_feature (1)..(792): n is a, c, g, or t
atgtcaacgaaaatatgtgggatgcagaaaaaagcatcaattgaaggtactataaatcaacaaactcttattcagcaaaataatgaaaagggtatcaatgaagcgctaaatacggcgattcaaaaacaagggcctgttcatattaatattccgtttaatgaacctttatatgatagcgttgaagaactatcggtatcacctataaattatgttccaactgaaaatcattcaaaaactgaagatctttcggcttttataaacgagtggaatcaagccaaacggaaattggtattagtaggtgtaaacgccccaaacactgtggagcaaaagtatttagaccaattagcggcctatgagagcgttttggtattaacggaaagcacctcgaatattcatcataaaaattttataccaagtatagacaaattaataggtgccttaacttctgaagaatttgaagaccttcagcctgattttttattaacttttggaggtttaattatttctaaaaaaataaaacaatttctccgtaaatatcaaccgaaacaacattggcatatcggggagcataatgccaacgatacttttttcatattaaataaaatttttaaaggttctgtaaatgatttcttttctcaatttttgagtaaaacaaaaactgttgaaagtaattatcaatcattttggttaaacgaaatgcaaaaaagacgagaaaatcatacggattatgttactactataccgtattcagattttaaagtttttaatttggttttaaaaagntatacctag

SEQ ID NO: 24654 - protein, 263 aa, Unknown
  Obtained from environmental sample
  misc_feature (1)..(263): Xaa is any amino acid
MSTKICGMQKKASIEGTINQQTLIQQNNEKGINEALNTAIQKQGPVHINIPFNEPLYDSVEELSVSPINYVPTENHSKTEDLSAFINEWNQAKRKLVLVGVNAPNTVEQKYLDQLAAYESVLVLTESTSNIHHKNFIPSIDKLIGALTSEEFEDLQPDFLLTFGGLIISKKIKQFLRKYQPKQHWHIGEHNANDTFFILNKIFKGSVNDFFSQFLSKTKTVESNYQSFWLNEMQKRRENHTDYVTTIPYSDFKVFNLVLKXYT

SEQ ID NO: 24655 - DNA, 774 bp, Unknown
  Obtained from environmental sample
  misc_feature (1)..(774): n is a, c, g, or t
atgaaaaaactatcgccagcattattaattcttctttttttaattcctaatttcttacaggcgcagacaccactagacacacttagcctaaaatccatctttcatgagccttaccttcccggtaatcgcccctcattagtgtcattctctattgatggaaagcatttatattataattggaaggagcatagtgattccagcaatgccatgtatcaagtagatcttaaaggaaaaaacacccagagagctcctgaagatattgtaagatcttatacactttctccagatggaaagaaagtgatctatcaaaaaagaggtgatattgctattgcagacgcagactttaaaaatgaacgcgtaataatcgcatcaaaaggttttgattataacgccacctggaatagtgatgggtctgaagtagctttcatcgccaatggcgacgtttggattgcgggagtaaaagaacctagtattaaacaaattaccagcaaaaaggaaaaagatcctggttacagaatcgcagagtggtcaaatacagggaaattattagttgctcaaagtgataactctgacagcaaagaatactatttccctgaatatgtaggaacttatgttaaaacaggaagcactcgtcgtggtattggctcatttattttatctgtaatagaccttaaaactggaaaagtaaccaaacttcttgatggtaaagggtttccgagaacagacttgagcacctctggaagatatgcagctctcgatctcgagccgatctga

SEQ ID NO: 24656 - protein, 257 aa, Unknown
  Obtained from environmental sample
  SIGNAL (1)...(21)
  misc_feature (1)..(257): Xaa is any amino acid
MKKLSPALLILLFLIPNFLQAQTPLDTLSLKSIFHEPYLPGNRPSLVSFSIDGKHLYYNWKEHSDSSNAMYQVDLKGKNTQRAPEDIVRSYTLSPDGKKVIYQKRGDIAIADADFKNERVIIASKGFDYNATWNSDGSEVAFIANGDVWIAGVKEPSIKQITSKKEKDPGYRIAEWSNTGKLLVAQSDNSDSKEYYFPEYVGTYVKTGSTRRGIGSFILSVIDLKTGKVTKLLDGKGFPRTDLSTSGRYAALDLEPI

SEQ ID NO: 24657 - DNA, 306 bp, Unknown
  Obtained from environmental sample
  misc_feature (1)..(306): n is a, c, g, or t
atgtgcgtaatggaagtaaaaccaattggtgttntccatatggcagatgaaaaaggtcctgatgaaaagataatttgtgtaccagttacagatcctatttggaatagctgtaatgatatcgaggatttaaatccacatagaataaaagaaattactcacttttttcaagtgtataaagacttagagaaaaagaaagttgatgttggtggatggggagatgctaaagaggcatatgaaatcttaaacaaatgtgtagagcgttatgaaaatagcgagcataaaacaaatggagattttactatctaa

SEQ ID NO: 24658 - protein, 101 aa, Unknown
  Obtained from environmental sample
  DOMAIN (2)...(90): Inorganic pyrophosphatase
  misc_feature (1)..(101): Xaa is any amino acid
MCVMEVKPIGVXHMADEKGPDEKIICVPVTDPIWNSCNDIEDLNPHRIKEITHFFQVYKDLEKKKVDVGGWGDAKEAYEILNKCVERYENSEHKTNGDFTI

SEQ ID NO: 24659 - DNA, 891 bp, Unknown
  Obtained from environmental sample
  misc_feature (1)..(891): n is a, c, g, or t
atgacttatcgctatcaatctgacaaagacctcaaacctaagcaaaaaacttatcaaattggtatttataagccagccaaacaagctattgactctacctttaaaccagaggtgtcgctgaaagaggcgcggctggcacgtgataaagctcaggcactgctcagtgatggcgttgatcctactgaacacaaaagtcatgaaaagaataactttgagcaaaaagatttattcagagttatcgctaagagctatattaacgaaagatctagcactacacccaagaatgttcaaaaactccataattatttagataagcatatttcacctcatattggtgactaccctattgcctctattactgcacaggatgtcataaaaactgggctagcaatccaaacctatttcgaagagcgaggtaaatggacaacagatacttcgcacaagtgcgttgccttgatcagctcagtcttcgagtacgctatcaatacattaggctacgacatcatcaacatcgcttatggtcgcaacaaagcattaagacctcataagcctgagcgtatgaaagcgatcgagcaacatcaattccctgagctactacgcaatattgatcaatacggtgcagataatccaaacgcgcatcaacagactattgctggcatgcaactgatgacgttatgctttgttagaacgaaagagctaaggttttttgaatggtcagagattgattatcataaaaatgtttggcgtatcccagcacgtaagatgaaaatgcgccaagatcatattatcccactatcgccccaagcaatggctattatcgagcgcatgcgacctttgacagaaaaaacggggtacgtcttttacaattttgagcgtaataaacccttatag

SEQ ID NO: 24660 - protein, 296 aa, Unknown
  Obtained from environmental sample
  misc_feature (1)..(296): Xaa is any amino acid
MTYRYQSDKDLKPKQKTYQIGIYKPAKQAIDSTFKPEVSLKEARLARDKAQALLSDGVDPTEHKSHEKNNFEQKDLFRVIAKSYINERSSTTPKNVQKLHNYLDKHISPHIGDYPIASITAQDVIKTGLAIQTYFEERGKWTTDTSHKCVALISSVFEYAINTLGYDIINIAYGRNKALRPHKPERMKAIEQHQFPELLRNIDQYGADNPNAHQQTIAGMQLMTLCFVRTKELRFFEWSEIDYHKNVWRIPARKMKMRQDHIIPLSPQAMAIIERMRPLTEKTGYVFYNFERNKPL

SEQ ID NO: 24661 - DNA, 426 bp, Unknown
  Obtained from environmental sample
  misc_feature (1)..(426): n is a, c, g, or t
atgggcatagtaaaaaaagcaaacgaagcactattgtacatagacagtaattgcgtaatgttagctgggttaactgaagaaactggcggtaattgttttttatccacacagcatatcaaagaaacatcgtctatgatttatcgcattaacttaagtgcactttcaaaagtgaaaattagtgatatcacaacagctaagcaaatcaagttgcaaatgttgttagatgaagatggaaaacgtagtctcggtttttatagcgataaagactctgtcaatccatatcaatgtattgatgatattgaacttgcacctgaaaaaatgaacaaggtaatagaagctaaaaaagcattggagaaaaaacttgggaaacgtggggaagactttagtgatccacaacttcctggtgtggggtttgatgatgtttaa

SEQ ID NO: 24662 - protein, 141 aa, Unknown
  Obtained from environmental sample
  misc_feature (1)..(141): Xaa is any amino acid
MGIVKKANEALLYIDSNCVMLAGLTEETGGNCFLSTQHIKETSSMIYRINLSALSKVKISDITTAKQIKLQMLLDEDGKRSLGFYSDKDSVNPYQCIDDIELAPEKMNKVIEAKKALEKKLGKRGEDFSDPQLPGVGFDDV

SEQ ID NO: 24663 - DNA, 807 bp, Unknown
  Obtained from environmental sample
  misc_feature (1)..(807): n is a, c, g, or t
gtgtttgaagcaggattattaaaattaaaatgtcatttaatagacgcattgccacaaccaggtggacaatgctcagagatatatcctaaaaaacctatttatgatattccagcctatccagaaattcttgcaggagatttaacccataagttaatggagcaatgcaagcaatttgaaccaggttttacacttggcgagcgtgcagaaacgattgacaagcaagaggatggaacctttatagtaaccactaataaaggtacaaaacatcacgctcctgtagtggcaatagcaggtggattaggtagttttgagcctcgtaaacctattattgataatctagctaattacgaagataaaggggttgaatacattatcaaagaacctgagttttatagagataaaaaagtagtcattgcaggtggaggagattcagctttagattggagtatctacctaagcgatatcgcttcagaagtaaccttaatccatagacgaaacgagtttagagggcatttagattcagtagaaaaagtacaagaattaaaaaatgctggcaagattaatttaatcactccagctgaggttattggagtagaagggattaataaggtagaggctattactataaaacaagatgccaaaacctttaaaaaagaatgtgatcattttgtaccactttttggattgtcaccaaaattaggacctattgcagattggggtttagagatagaaaaaaatgcaatcaaggtggataatagcttggattacaaactaacattcaggtatttttgctattggagatgttaa

SEQ ID NO: 24664 - protein, 268 aa, Unknown
  Obtained from environmental sample
  DOMAIN (2)...(261): Pyridine nucleotide-disulphide oxidoreductase
  misc_feature (1)..(268): Xaa is any amino acid
MFEAGLLKLKCHLIDALPQPGGQCSEIYPKKPIYDIPAYPEILAGDLTHKLMEQCKQFEPGFTLGERAETIDKQEDGTFIVTTNKGTKHHAPVVAIAGGLGSFEPRKPIIDNLANYEDKGVEYIIKEPEFYRDKKVVIAGGGDSALDWSIYLSDIASEVTLIHRRNEFRGHLDSVEKVQELKNAGKINLITPAEVIGVEGINKVEAITIKQDAKTFKKECDHFVPLFGLSPKLGPIADWGLEIEKNAIKVDNSLDYKLTFRYFCYWRC

SEQ ID NO: 24665 - DNA, 426 bp, Unknown
  Obtained from environmental sample
  misc_feature (1)..(426): n is a, c, g, or t
atgtgtggaattgtaggagtattgcattttgaaaaagatcgcccaattagaaaggatgagttgaaaaaaatgaccgatataattgaacatagaggcccggatggagaaggattctatatcaataaaaatattggacttggccatcgccgactagcaattattgatttagaaacggggaatcaaccacttataagtgatgataaatataaaatattggtatttaatggcgaaatatataattatattgagattagagaagaattaataaacaaaggatatgaattccgtaccgaatctgacactgaagttattttgaaatcctacgaagaatggggttatgattgtcaaaataaatttaatggaatgtgggcctttgctttatgggatgaaattaaacaagaattattttgtcaagagatagaatag

SEQ ID NO: 24666 - protein, 141 aa, Unknown
  Obtained from environmental sample
  DOMAIN (2)...(110): Glutamine amidotransferases class-II
  misc_feature (1)..(141): Xaa is any amino acid
MCGIVGVLHFEKDRPIRKDELKKMTDIIEHRGPDGEGFYINKNIGLGHRRLAIIDLETGNQPLISDDKYKILVFNGEIYNYIEIREELINKGYEFRTESDTEVILKSYEEWGYDCQNKFNGMWAFALWDEIKQELFCQEIE

SEQ ID NO: 24667 - DNA, 411 bp, Unknown
  Obtained from environmental sample
  misc_feature (1)..(411): n is a, c, g, or t
gtgaaaaaaaattattcactttttaaaaaagccatagataatattcaaaataatgagattgaggaaatattttttaaagatgtgccacatgaaaaaaccatatattactttaattcttcggatgttgttgtattaacatctttacatgaaggatctccaaatgtaataaaggaggcaatggcttgtaacataccaattgtatcaactgatgtaggtgatgtgagggaaataataaatgaaacggaaggttgttttataacaagtttcgatcctattgatgtttcaaataaaataaaattggcactagactttaataaacgaacgaatgggagagagaaaatcgaatatctggaatctagtgttatagctgaaaaaattattcagttttatcataaaacattaaataagtaa

SEQ ID NO: 24668 - protein, 136 aa, Unknown
  Obtained from environmental sample
  DOMAIN (2)...(116): Glycosyl transferases group 1
  misc_feature (1)..(136): Xaa is any amino acid
MKKNYSLFKKAIDNIQNNEIEEIFFKDVPHEKTIYYFNSSDVVVLTSLHEGSPNVIKEAMACNIPIVSTDVGDVREIINETEGCFITSFDPIDVSNKIKLALDFNKRTNGREKIEYLESSVIAEKIIQFYHKTLNK

SEQ ID NO: 24669 - DNA, 444 bp, Unknown
  Obtained from environmental sample
  misc_feature (1)..(444): n is a, c, g, or t
atgaaaaagattatttttaaaatattaagatattcgggtataccatttttatttcgagaaattttacaaaagaataaagttaccatattaatgtttcacgatatttctgaggagattgcagaaatgtcgttttcttatttaaatcaaaaatacaatatcattgatttgaattattttcttaaaaaatgtcaagataaaaatagaaatgaactccctaataaatctttgattataacttttgatgatgggcatattggtaattataaaatgctccctagtcttgaaaaatattcaattccaataactatttttttgtgctctggtattattaatacaaataggaatttttggtttaaattcccaaaacttgaccaaccatcagatgaatttaagagattttctaatattgaaaggttatctgaattgcataaaatttggttttga

SEQ ID NO: 24670 - protein, 147 aa, Unknown
  Obtained from environmental sample
  misc_feature (1)..(147): Xaa is any amino acid
MKKIIFKILRYSGIPFLFREILQKNKVTILMFHDISEEIAEMSFSYLNQKYNIIDLNYFLKKCQDKNRNELPNKSLIITFDDGHIGNYKMLPSLEKYSIPITIFLCSGIINTNRNFWFKFPKLDQPSDEFKRFSNIERLSELHKIWF

SEQ ID NO: 24671 - DNA, 696 bp, Unknown
  Obtained from environmental sample
  misc_feature (1)..(696): n is a, c, g, or t
ttggaagttgaattgataaaaataaaccaacaattaatagatgttgagagtagtaaagcaaccttaattgaaacattgtccagtatcattgggcaacaattggatgcttccactacattccaaaacactttggtagaaacccaagtctcatctgaattaacccgacccgaattagacctatttcaacttaaaaaagatgaaattgaaagcaacgaggcgcttatagcgaaacaaaattctccaaagttattaggatttgcgacgggtggttatggcaatcctggattgaatatgctcgataattcctttcagacattttatacggttggtgtgaaattgaattggaatgtattcgattggaattccaacaaaaaacagcgtgaatctttatctattactaaagatattatagatactgaaaccgaaacctttaaacttaacaccaacacggaactgaatcagcaatacaacgacatcgagaagattgaagcgtttgtaatttctgatttagagattataaatttaagaaaagaggttttgaaatcggcagactctcaactcaaaaatggggtcatcacctcatcggcatacataaccgaactcactgatttatacgaagacgaaaacacattgatcaaacacaaaattcagttacaactggcaaaagccaattacaatgtcattaaaggacattaa

SEQ ID NO: 24672 - protein, 231 aa, Unknown
  Obtained from environmental sample
  misc_feature (1)..(231): Xaa is any amino acid
MEVELIKINQQLIDVESSKATLIETLSSIIGQQLDASTTFQNTLVETQVSSELTRPELDLFQLKKDEIESNEALIAKQNSPKLLGFATGGYGNPGLNMLDNSFQTFYTVGVKLNWNVFDWNSNKKQRESLSITKDIIDTETETFKLNTNTELNQQYNDIEKIEAFVISDLEIINLRKEVLKSADSQLKNGVITSSAYITELTDLYEDENTLIKHKIQLQLAKANYNVIKGH

SEQ ID NO: 24673 - DNA, 873 bp, Unknown
  Obtained from environmental sample
  misc_feature (1)..(873): n is a, c, g, or t
atgaccgaaaatattaatcgagaaattacactcttaaaaccagaagatgttttcttgataattgatcgcgtaaagcaaaaatttgattttccaattcattttcatccagaatacgagttaaattttattttaaatggaagaggaattagaagagttgtaggaagctctatggaagaaattggcgatgttgaactcgttttagtaggttctaatttagaacatggttgggaaacatataactgtaaaagaaataaaatttatgaaattaccattcagtttcatgaaaatttatttagtgaaaaattactctctttaaaaaactttaaaccaataaaagatttatttgcaagatctaaacaaggtgtgctttttgatgaaaaaacagccatccatttaatgtcaaaaataaaagcactttcatcaaaaaatggtattgatgattttgtaaaacttttaaaacttcttgaagaacttgccaattcaaaaaaccaacgtatactttctactaatatagaaagaaacaaccaatttgaaggcagtgaaaaaattaaaaaagtgcatgattttttaaacgaaaattatgcacgaaaaatctctttacatgaaatttctgatttggtaaatatgagtcaaagctcttttaatcgctttataaaanaaagaacaggaaaaacgtttatcgagtttacaaatgatacaagaattagttacgcaacanaatttttagtagaaacagatttatcaattggagaaatagggtataaatgtggtttttatagcattgcaaattttaatcgattttttaaaaaatctaaaaacattacaccaagtaaatttaaatcagaatttnaatcaattacacgatttcaataa

SEQ ID NO: 24674 - protein, 290 aa, Unknown
  Obtained from environmental sample
  DOMAIN (237)...(281): Bacterial regulatory helix-turn-helix proteins, AraC family
  misc_feature (1)..(290): Xaa is any amino acid
MTENINREITLLKPEDVFLIIDRVKQKFDFPIHFHPEYELNFILNGRGIRRVVGSSMEEIGDVELVLVGSNLEHGWETYNCKRNKIYEITIQFHENLFSEKLLSLKNFKPIKDLFARSKQGVLFDEKTAIHLMSKIKALSSKNGIDDFVKLLKLLEELANSKNQRILSTNIERNNQFEGSEKIKKVHDFLNENYARKISLHEISDLVNMSQSSFNRFIKXRTGKTFIEFTNDTRISYATXFLVETDLSIGEIGYKCGFYSIANFNRFFKKSKNITPSKFKSEFXSITRFQ

SEQ ID NO: 24675 - DNA, 393 bp, Unknown
  Obtained from environmental sample
  misc_feature (1)..(393): n is a, c, g, or t
ttgcgaatggtgttttctgattgtacatatatagttacagaatctccttttacangtaattctgcagatgatgcagaactaattaatgcagntgtggtatcagaaattttctncaaccttcctgaatatttaattaacttgttgttgaaatgtacattttttgacttttttcctttgcagaaaattacagttagaagaaaaacgattggaaaaaaagatttagacttttgttataaattttaccagaataaaataagaaaaattattgctggatttttacggaaattatccaaatttggaattattatacctttaaaaaaaaacctatttaaaacgtggattgatttaattccgattaaatttacctggggaaaggttttaaaatttttaaaa

SEQ ID NO: 24676 - protein, 131 aa, Unknown
  Obtained from environmental sample
  misc_feature (1)..(131): Xaa is any amino acid
MRMVFSDCTYIVTESPFTXNSADDAELINAXVVSEIFXNLPEYLINLLLKCTFFDFFPLQKITVRRKTIGKKDLDFCYKFYQNKIRKIIAGFLRKLSKFGIIIPLKKNLFKTWIDLIPIKFTWGKVLKFLK

SEQ ID NO: 24677 - DNA, 621 bp, Unknown
  Obtained from environmental sample
  misc_feature (1)..(621): n is a, c, g, or t
atgaagcagattaaaacgctacttttcgattttggagacgtatttatcaatttagataaatctgctactttacagcatttagcacaatttggaataacgaagttatcgcctgaacaaattaaaaaaaacaaagcttatgaagtggggaaattatcttcagaagattttatttcttactaccacactaatctcaaggataataacgcttccgcggaagcgataacaacggcatggaattccattttattagactttcctttacagcgattagagtttcttaaagagctgaaaaaaaaaggggaatttcaattaatattattgagcaataccaatgagctacatatttcatggattaaagaacacgtaaatttttacgaagaatttaaaagctactttgatgcattttatttgtctcacgagatcaacttgagaaagccaaatgccaatatttatcaatttgttttagaccaacatcaattaaaacctgaagaagttttatttattgacgataccaaagagaatacaggtgcagcaaaatctctaggttttcatgtgtggaatatcaatcctgagacagaagatgtaacctctttattcaaaactaatcagcatttattttga

SEQ ID NO: 24678 - protein, 206 aa, Unknown
  Obtained from environmental sample
  DOMAIN (4)...(191): haloacid dehalogenase-like hydrolase
  misc_feature (1)..(206): Xaa is any amino acid
MKQIKTLLFDFGDVFINLDKSATLQHLAQFGITKLSPEQIKKNKAYEVGKLSSEDFISYYHTNLKDNNASAEAITTAWNSILLDFPLQRLEFLKELKKKGEFQLILLSNTNELHISWIKEHVNFYEEFKSYFDAFYLSHEINLRKPNANIYQFVLDQHQLKPEEVLFIDDTKENTGAAKSLGFHVWNINPETEDVTSLFKTNQHLF

SEQ ID NO: 24679 - DNA, 609 bp, Unknown
  Obtained from environmental sample
  misc_feature (1)..(609): n is a, c, g, or t
ttggaaaaagacgtttacaaaaccattcaccaaccaagcgaagaagttttatttaaagacaagggcagtaaatttttcggatatgcttttccggttaaaaccgaagaagagataaaactacatatagaggagcttaagacgaaacatcaccaagctagacattggtgttatgcttggcaattaggaaaaaactatgaacattatagagctaatgatgacggcgagccaggaaactctgcaggaatgccgatttacggacaattacaatcatttgaagtcaccaatattttagttgttgtagtacgttattttggtggtaccaagctaggtgttggcggactgatcaatgcttacaaaaccaccgctcaaatggctttggaaaattcgaacattttaaccaaaaccatagatgtggaatatgaagtctcttttgattatcccaatatgaataaagtgatgcgggtaataaaagaaaaaggcctgcatgtaaagaatcaaattttagaacttgactgtaaagtttatcttttaataagagaaaaagaggccgaagctatttttaaaaaatttgatagtatttacggaattaaaattaaagaaatagaataa

SEQ ID NO: 24680 - protein, 202 aa, Unknown
  Obtained from environmental sample
  DOMAIN (20)...(127): Uncharacterized protein family UPF0029
  misc_feature (1)..(202): Xaa is any amino acid
MEKDVYKTIHQPSEEVLFKDKGSKFFGYAFPVKTEEEIKLHIEELKTKHHQARHWCYAWQLGKNYEHYRANDDGEPGNSAGMPIYGQLQSFEVTNILVVVVRYFGGTKLGVGGLINAYKTTAQMALENSNILTKTIDVEYEVSFDYPNMNKVMRVIKEKGLHVKNQILELDCKVYLLIREKEAEAIFKKFDSIYGIKIKEIE

SEQ ID NO: 24681 - DNA, 876 bp, Unknown
  Obtained from environmental sample
  misc_feature (1)..(876): n is a, c, g, or t
ttgatatggtattatttctctttgcccaagcagttattcaatgaaccactttcaacagtcattgaaagtgcagaaggtgaattactaggtgcgaaaattgcacaagacgagcaatggcgcttcccttataatgatagtgttcctaaaaagtttcaggaatgtattgttgagtttgaagatgggtacttttttaaacaccccgggtttaatcctgtttcaattgtaaaagcattttggaaaaatataaaatcgaattccattaaacgaggaggcagtactttaacacaacaagttatacgactatctcgtaaaggaaaacaaagaacttattttgaaaaagctattgaaattatattggctacacgactggaggttagacatagcaagcaagaaatattagctttgtatagttctaatgctcctttcgggggaaatgttgttggattagatatagcttcttggcgttattttggcagaactccaatcgaactctcttgggcggaaagtgcaactttagcggtattacccaatgcgccaagtttgatatatccaggtaaaaatcagcaacgactatttagaaaacgaaatagattgctaaaaaagatgcttgacaataataagattgatgagtttacgtatcaattagctattcaagaactattacctcaaaaaccttttacattgcctcaaattgcaccacatttactgcaaagggtaagtaaaacatctcaaggtgaacgaataaaaaccagcattaaaattggcttgcaacaacgagcaaatgacattgtgaaaacccattataatagtttacaacaaaatcaaatatacaatatttcggtgttggttttagatgttaaatctagaaaagtatag

SEQ ID NO: 24682 - protein, 291 aa, Unknown
  Obtained from environmental sample
  DOMAIN (19)...(188): Transglycosylase
  misc_feature (1)..(291): Xaa is any amino acid
MIWYYFSLPKQLFNEPLSTVIESAEGELLGAKIAQDEQWRFPYNDSVPKKFQECIVEFEDGYFFKHPGFNPVSIVKAFWKNIKSNSIKRGGSTLTQQVIRLSRKGKQRTYFEKAIEIILATRLEVRHSKQEILALYSSNAPFGGNVVGLDIASWRYFGRTPIELSWAESATLAVLPNAPSLIYPGKNQQRLFRKRNRLLKKMLDNNKIDEFTYQLAIQELLPQKPFTLPQIAPHLLQRVSKTSQGERIKTSIKIGLQQRANDIVKTHYNSLQQNQIYNISVLVLDVKSRKV

SEQ ID NO: 24683 - DNA, 882 bp, Unknown
  Obtained from environmental sample
  misc_feature (1)..(882): n is a, c, g, or t
ttggcagcagatattatagacaatgcttttgatcaatttacaaaaaagcattataaaaaattaatgcaaaaatttgatattacagagttacaacttaaagatgccattcatgaaattgaacgtttaaatccaaaacccggaggatcatacgctggaaacaacagaattgtagaacacgtcgtgcctgattttgctataaaaattgttgatggcgagttagagcttactttaaatggtcgtaatgcgccagaattacatgtttctagagaatatagtaacatgatgaaaggttataaagaaagtaaagataaaagtaagtcgcaaaaggatgcagttatgtttataaaacaaaaactagatgcagccaagtggtttatagatgctataaaacagcgtcaacaaactttatttgttacaatgagtagcatcatgcattaccaaaaagaatattttttaacaggtgatgagcgcaatctaaaaccaatgatattaaaagatattgctgacgagattgaaatggatgtatcaacagtatcacgtgtggctaatagcaaatacgtagatacaccttacggaactaagttgataaaagaatttttctctgaatcgatgactaacgatcaaggtgaggaagtatccacaagagaaattaaaaaaatattagaaactgtcattgaagaagaaagcaaaaagaaaccgcttacagatgaagctttagctaaaatattaaaagaaaaagctatcctattgcacgacgtacagttgctaaatatagagagcaattggatataccagttgctagattgcgtaaaaaaatataattacgtaaatctatccagtaaaacttatacctacactgctattaataaacactgtttttaa

SEQ ID NO: 24684 - protein, 293 aa, Unknown
  Obtained from environmental sample
  DOMAIN (112)...(251): Sigma-54, DNA binding domain
  misc_feature (1)..(293): Xaa is any amino acid
MAADIIDNAFDQFTKKHYKKLMQKFDITELQLKDAIHEIERLNPKPGGSYAGNNRIVEHVVPDFAIKIVDGELELTLNGRNAPELHVSREYSNMMKGYKESKDKSKSQKDAVMFIKQKLDAAKWFIDAIKQRQQTLFVTMSSIMHYQKEYFLTGDERNLKPMILKDIADEIEMDVSTVSRVANSKYVDTPYGTKLIKEFFSESMTNDQGEEVSTREIKKILETVIEEESKKKPLTDEALAKILKEKAILLHDVQLLNIESNWIYQLLDCVKKYNYVNLSSKTYTYTAINKHCF

SEQ ID NO: 24685 - DNA, 834 bp, Unknown
  Obtained from environmental sample
  misc_feature (1)..(834): n is a, c, g, or t
atgttctatggtaatgataaaatcattaagtcaaacggccataaaaagaaacatagaacatgtgattgtcatcgagttttgatttcaccaacagcacaaatattaaaaagcgaagaacataaaaaagcatttttcgctggtattgctcaatgtggaagcgtttggacatgccctgtttgtgctgcaaaaataaatgaacgcaaagctagtgaaatgcgattagcagcaagtcaaagagaagctttaggtttgcatttttcattgctaacatttacagcacctcacaccgcttcagatccaattgatcagcttgtaaaaaaaatgagtgattccctttcacggtggtggcggggcgcgccagccaagcgatttaaggagcgttacggcatagtcggccatattcgttcttttgagattcgtcacggctctaatggttggcaccctcattttcatataattatcgttagcaacatcaagctacctaaaacgctgcgtaaaggttacatgccacttcctattgaagatcagcatgaagactttcaatggatgcttaaacgttggcagttaatgacaacacgttctgggcttgattgccctaacgagtacggcatggacttgcaaggcggtgataaagccggagagtacattactaaatttggttctgatggcgacattgttaaaacatctgcaggcgacaacgttacttgggatatgatggacgaagttactaaaggcaacactaaaaaaggtaaggctggctctttgtcaccttgggacatacttcgcaaagcatcggatgaagaaaatccagatgaaaagcataaatacgtctga

SEQ ID NO: 24686 - protein, 277 aa, Unknown
  Obtained from environmental sample
  misc_feature (1)..(277): Xaa is any amino acid
MFYGNDKIIKSNGHKKKHRTCDCHRVLISPTAQILKSEEHKKAFFAGIAQCGSVWTCPVCAAKINERKASEMRLAASQREALGLHFSLLTFTAPHTASDPIDQLVKKMSDSLSRWWRGAPAKRFKERYGIVGHIRSFEIRHGSNGWHPHFHIIIVSNIKLPKTLRKGYMPLPIEDQHEDFQWMLKRWQLMTTRSGLDCPNEYGMDLQGGDKAGEYITKFGSDGDIVKTSAGDNVTWDMMDEVTKGNTKKGKAGSLSPWDILRKASDEENPDEKHKYV

SEQ ID NO: 24687 - DNA, 531 bp, Unknown
  Obtained from environmental sample
  misc_feature (1)..(531): n is a, c, g, or t
atgaaatttaaaccagaacttagtgttaatcaaaaaatagaacttccatttaaaagttctgtttctttatatataaagcgagaggatttaattcatccaattatatctggtaataaatatagaaaattaaaatataatatcgctttcgcggaaacgcttaatcaggatactttactgacttttggtggtgcattttctaatcatattgcagcagtagcagaagctggacgtgtttatggcttaaaaacaattggaattattagaggtgaagagcttaacgacaaggtcttggatagcccaactctaaagtttgcacagtcttgtggtatgcaatttaaatttataagtcgtgaagcatttagactaaaaggaacacagtcgttttacgaaaaaattaaaaaagaatttggtgacttttatttaattcctgaaggcggaaccaatgatttggctgtaaaaggatgcgaagaaattttgacggaaacagaccgtaaatttaattacatatgtgcttccgtaggaacaggctga

SEQ ID NO: 24688 - protein, 176 aa, Unknown
  Obtained from environmental sample
  misc_feature (1)..(176): Xaa is any amino acid
MKFKPELSVNQKIELPFKSSVSLYIKREDLIHPIISGNKYRKLKYNIAFAETLNQDTLLTFGGAFSNHIAAVAEAGRVYGLKTIGIIRGEELNDKVLDSPTLKFAQSCGMQFKFISREAFRLKGTQSFYEKIKKEFGDFYLIPEGGTNDLAVKGCEEILTETDRKFNYICASVGTG

SEQ ID NO: 24689 - DNA, 339 bp, Unknown
  Obtained from environmental sample
  misc_feature (1)..(339): n is a, c, g, or t
atgataatagtatctaaatatttagtacctaaaggttatacaggtatgactgtttttccgtttatatttttaaaatctaaagttttaaaacagagtgagaccttggtcaatcacgaaaaaattcacttaaaacagcaattagagttattaatagtaccgttttatatctggtatggtttagagtttgtttttaggtatatccaacataaaaattggtatttagcttacaaaaatataagctttgaaagagaagcctattgtaatgacctaaatcttgagtatctaaaaactagacgtttttggcaatttttaaagtatcttagcaagcatgaaatttaa

SEQ ID NO: 24690 - protein, 112 aa, Unknown
  Obtained from environmental sample
  misc_feature (1)..(112): Xaa is any amino acid
MIIVSKYLVPKGYTGMTVFPFIFLKSKVLKQSETLVNHEKIHLKQQLELLIVPFYIWYGLEFVFRYIQHKNWYLAYKNISFEREAYCNDLNLEYLKTRRFWQFLKYLSKHEI

SEQ ID NO: 24691 - DNA, 897 bp, Unknown
  Obtained from environmental sample
  misc_feature (1)..(897): n is a, c, g, or t
ttgcctttaggaaaaatgattggtgtgacaggcgtttcaggaagtggtaaatccactttaatcaacgaaaccctctaccctattcttaatgcctattattttaatggtgttaaaaagccgatgccgtacaaaagcattaaaggtttagaacatttagacaaagtgattgacattaaccaatcaccaataggaagaactcctcgaagtaatccggcaacttataccaaaacttttgatgaaataagaagcttgtttgctaaaatacccgaagccttaattagaggctacaaacctggtcgttttagttttaacgtgaaaggaggacgttgtgaaacttgccaaggaggtggtttgcgcgttattgaaatgaatttcttaccagacgtttatgtagaatgtgaaacttgccaaggcaaacgttttaatcgtgaaaccttagaaattcgttataaaggtaagtccattagcgatgttttaaatatgacgattgaagaagctgttggattctttgagcacatcccaaaaatccacagaaaactaaaaactatcaaagacgtaggactaggttacattactctaggtcaacaaagcacaacactatctggtggagaagcccaacgtataaaactcgctacggaattaagtaaacgcgatactggaaatactttttatattctagacgaacctactacaggtttacattttgaagacattagagtcttaatgaaagtacttaataaactagccgataaaggcaatactgttttaattattgagcataatctcgatgtgattaaaaccgtagactacattatagatattggttatgaaggncggaaaanngtggtggagaagtggttgctaaagggcacccccgaaacaaattataaaggataa

SEQ ID NO: 24692 - protein, 298 aa, Unknown
  Obtained from environmental sample
  DOMAIN (4)...(275): ABC transporter
  misc_feature (1)..(298): Xaa is any amino acid
MPLGKMIGVTGVSGSGKSTLINETLYPILNAYYFNGVKKPMPYKSIKGLEHLDKVIDINQSPIGRTPRSNPATYTKTFDEIRSLFAKIPEALIRGYKPGRFSFNVKGGRCETCQGGGLRVIEMNFLPDVYVECETCQGKRFNRETLEIRYKGKSISDVLNMTIEEAVGFFEHIPKIHRKLKTIKDVGLGYITLGQQSTTLSGGEAQRIKLATELSKRDTGNTFYILDEPTTGLHFEDIRVLMKVLNKLADKGNTVLIIEHNLDVIKTVDYIIDIGYEGRKXVVEKWLLKGTPETNYKG

SEQ ID NO: 24693 - DNA, 579 bp, Unknown
  Obtained from environmental sample
  misc_feature (1)..(579): n is a, c, g, or t
ttgatttctagtattgaggtggttgatacatttccttttcctgatgattcaatagctcaatacaaagattgggtagagcaaaatgatatagtttgtttaatttntgatgaacaaatgcataatgattctgaaggaggaaaaggtcctgttggttatagaggaaatcagctcgttttagagataagaaaatattttaaagatattccaatctatgtaataacgtcacataaaaacgatgatgacttacaggaaaagtttagtgaatttgaagatataataggtagagaagaatttattaatgatggtgagaaatatgtaaagaggtttattcgtgcaagtcaaagttttttagatgaaaatatttcagagctttcagaattaaagcatttgtcagagttagtagcatcaggtaagagtgacgaaaatgatttaatacgtttgaaagcgttacaacttaagctaaatgttcaaattgatagtggtttaggtgaaaggaaggattggttagatgagtatgaaagtaaaattcaatttttagaagaacttcagaagaaaattgaaaataaaatcaaggagtag

SEQ ID NO: 24694 - protein, 192 aa, Unknown
  Obtained from environmental sample
  misc_feature (1)..(192): Xaa is any amino acid
MISSIEVVDTFPFPDDSIAQYKDWVEQNDIVCLIXDEQMHNDSEGGKGPVGYRGNQLVLEIRKYFKDIPIYVITSHKNDDDLQEKFSEFEDIIGREEFINDGEKYVKRFIRASQSFLDENISELSELKHLSELVASGKSDENDLIRLKALQLKLNVQIDSGLGERKDWLDEYESKIQFLEELQKKIENKIKE

SEQ ID NO: 24695 - DNA, 330 bp, Unknown
  Obtained from environmental sample
  misc_feature (1)..(330): n is a, c, g, or t
ttgacaccattcttaatgcatataaagtcaatgaaatatttgcttacgttattttttttgacactacttgttagttgtaatacccgtgaagaaaatagcacgacgcatttcggtggacaaataattaatcctaaatctgataaagtttacctttattatggggaaaaattattagactctgctaaattgaatcaaagtaataaattcttaattgatattgattcattaaaaactggactttacaaatttatgcatggcccagaaatacaatatatctatttagaacctaaagatagtttgttgatacgcataaacacatgggatttttga

SEQ ID NO: 24696 - protein, 109 aa, Unknown
  Obtained from environmental sample
  misc_feature (1)..(109): Xaa is any amino acid
MTPFLMHIKSMKYLLTLFFLTLLVSCNTREENSTTHFGGQIINPKSDKVYLYYGEKLLDSAKLNQSNKFLIDIDSLKTGLYKFMHGPEIQYIYLEPKDSLLIRINTWDF

SEQ ID NO: 24697 - DNA, 378 bp, Unknown
  Obtained from environmental sample
  misc_feature (1)..(378): n is a, c, g, or t
ttgattatgatagcacaagataaagaagcacacgaagacattttaaaacaatctattaaacatttaaagtttttagggtatgaaaatattaaagcggatttagatggatatgaatcgcctaaatcttttattaaaaagaaaaacagcttagttatcacacctgacattacagcttataagcgtaccaaaaaatatttttttgaattaggattaaaaagcgaaaaacctaaactattaaaaacaaaatggcgactattagacgtagttaccagaatgaaagaccatcgttttaaaattattacaactaaaggacattatagttttacgaataaaatattaagtgatttaaatattgaaaaatctttaatcaaattataa

SEQ ID NO: 24698 - protein, 125 aa, Unknown
  Obtained from environmental sample
  misc_feature (1)..(125): Xaa is any amino acid
MIMIAQDKEAHEDILKQSIKHLKFLGYENIKADLDGYESPKSFIKKKNSLVITPDITAYKRTKKYFFELGLKSEKPKLLKTKWRLLDVVTRMKDHRFKIITTKGHYSFTNKILSDLNIEKSLIKL

SEQ ID NO: 24699 - DNA, 519 bp, Unknown
  Obtained from environmental sample
  misc_feature (1)..(519): n is a, c, g, or t
ttgaacgaacgcattatagagttaacggaaataaacccaaaagatttctttggcacccaaaacagtacaatagagcagttaaaaagatattttcctaaaataaaaattgttgctcgaggatctaaattaaaaatttatggcgagtcagatattttagatgaatttgaaattcgttttgaacgtttggtaaaatattttgatcgttataataaattagatgaaaatagtattgagcgtattttaacatctaatggtaatgaagagaaaaccatttccaaaaaaaatgcaaaagatattttagtgcatggtgttaatggaaaaatgatcaagccacaaaccgaaaaccaacgtaaaatggttgtagaaatggctaaaaacgatatgctttttgctgttggaccctgcagaacaggtaaaacatatacagctgttgctttggctgtaaaagcattaaaagaaaaagaatttgggcgtattattttaacaagaccagctgtaaaatctggtgaagatttttag

SEQ ID NO: 24700 - protein, 172 aa, Unknown
  Obtained from environmental sample
  misc_feature (1)..(172): Xaa is any amino acid
MNERIIELTEINPKDFFGTQNSTIEQLKRYFPKIKIVARGSKLKIYGESDILDEFEIRFERLVKYFDRYNKLDENSIERILTSNGNEEKTISKKNAKDILVHGVNGKMIKPQTENQRKMVVEMAKNDMLFAVGPCRTGKTYTAVALAVKALKEKEFGRIILTRPAVKSGEDF

SEQ ID NO: 24701 - DNA, 702 bp, Unknown
  Obtained from environmental sample
  misc_feature (1)..(702): n is a, c, g, or t
ttggggcttgtttacttttaccgaaaaagttacgacgataccgtaatgttgattaataaaaatatgtcttcaattattgataaaaaacaagttgaagctcagcaaatgtatccgcattatttcgaacgttttaaaaccgatggagtagagcacaatatgtacataggcgaatctattactaaaaaagattcgtttaacgaaatctatttaaagaatttaagactttggcagctacaagtaatgtgcgaaatggaaaatgcattttataataaaaaacatatatatcccattgctttagatgtggcttctatgattttagtgtttaatcagccgttatcaatacgttttagagcagacgagcgtcagtttgatgtggatggaacttacaatgcgcgttacgaagtcgttaaaaagcgcgtggataaagctaatattaaaggaacggacattagagcaactgaaaaaggaaaattaaccatagtatattctacgaaagatgtggaacatgagtatttagattacgtgaaatttttacaggctaaaaatattttagatactgaattagaaatagtggaattagaagatttacaaggtgtaacgggcttaaaagccatacgtgtaaatattttatacagtaacactacagaaaatgagcaaacattttacacgtatgatgatcttatgaaaaagattacagcctaa

SEQ ID NO: 24702 - protein, 233 aa, Unknown
  Obtained from environmental sample
  misc_feature (1)..(233): Xaa is any amino acid
MGLVYFYRKSYDDTVMLINKNMSSIIDKKQVEAQQMYPHYFERFKTDGVEHNMYIGESITKKDSFNEIYLKNLRLWQLQVMCEMENAFYNKKHIYPIALDVASMILVFNQPLSIRFRADERQFDVDGTYNARYEVVKKRVDKANIKGTDIRATEKGKLTIVYSTKDVEHEYLDYVKFLQAKNILDTELEIVELEDLQGVTGLKAIRVNILYSNTTENEQTFYTYDDLMKKITA

SEQ ID NO: 24703 - DNA, 645 bp, Unknown
  Obtained from environmental sample
  misc_feature (1)..(645): n is a, c, g, or t
gtgcttccaggagatccagcacaaatgatgttgggtcaaaatgaggatagtcagcaactagcaattatcaaaaaaaaatacggttttgataagcctgttgctacgcaatatttgtattatttaaacgatttgtctccagtatcatttcactcaaaaacagaaggtgactacacctatttaagtcaaaataaatacgcagcaacacaactatttgcaattggcaatactacaatggttgttaaatttccatacctacgcgagtcttttacaaagcaaggtaaaaaagtaagccaagtattatcagagacgttacccaatacgtttgtattggcagtttcagcaatactaatcgcaatctttttaggtgttatattaggcgtggtttctgcattaaaaaaagatacttttttagataaaaccattcaaatattaagtaccttaggtatgagtgtaccatcctttttcagcgccatattatttgcatggttatttggatttgtattgcataaatacaccaatctagaaatgacaggaagtctttacgagttggatgattttggcgaaaaaatgcacgtaaaatggaaaaacttaatcctaccagcaatcgtattagggataaggccattagcagtcgtgatacaataa

SEQ ID NO: 24704 - protein, 214 aa, Unknown
  Obtained from environmental sample
  misc_feature (1)..(214): Xaa is any amino acid
MLPGDPAQMMLGQNEDSQQLAIIKKKYGFDKPVATQYLYYLNDLSPVSFHSKTEGDYTYLSQNKYAATQLFAIGNTTMVVKFPYLRESFTKQGKKVSQVLSETLPNTFVLAVSAILIAIFLGVILGVVSALKKDTFLDKTIQILSTLGMSVPSFFSAILFAWLFGFVLHKYTNLEMTGSLYELDDFGEKMHVKWKNLILPAIVLGIRPLAVVIQ

SEQ ID NO: 24705 - DNA, 684 bp, Unknown
  Obtained from environmental sample
  misc_feature (1)..(684): n is a, c, g, or t
atggtttgttcatntacggccctagaataccgtaattttataacagcattcgaatccaaattaatgatgagcacaaaaaaagaagaaacagaacttttcgggttccattcctatttagtgaaaaccgtaggaatgactaagggtgaggcagttaaaattgctgctgatttgaagcatttaaaatttcagaaaggagagattcttttaaaaactggcgacctttgccaacactctttttttgtggaaaaaggcctgttgaggtcctatatgctcgatgaatcgggaaaggaacacgtaatccagtttgcgcccgaaaattggtttattgttgataggagcagcgtctatttcaacgacccttctgaaagttatattgaagccatagaggacactgaagtagttatgattggtgaagattttatttgcagtgcaagccaaacaagccctgtttttagtaagtttaacgataaattattgcacaaccatattcggcaaatgcagaaacgcatcaatcttttgcttggtgctacggcagaaaaacgttatttgagttttataaaaatgtatccagatcttttgctgagagtgccgcaatggatgattgcttcttacttgggaattaccccggaaagtttaagccgggttaggaaagaattggcgcataaaaactttaaaacaaattaa

SEQ ID NO: 24706 - protein, 227 aa, Unknown
  Obtained from environmental sample
  DOMAIN (56)...(150): Cyclic nucleotide-binding domain
  misc_feature (1)..(227): Xaa is any amino acid
MVCSXTALEYRNFITAFESKLMMSTKKEETELFGFHSYLVKTVGMTKGEAVKIAADLKHLKFQKGEILLKTGDLCQHSFFVEKGLLRSYMLDESGKEHVIQFAPENWFIVDRSSVYFNDPSESYIEAIEDTEVVMIGEDFICSASQTSPVFSKFNDKLLHNHIRQMQKRINLLLGATAEKRYLSFIKMYPDLLLRVPQWMIASYLGITPESLSRVRKELAHKNFKTN

SEQ ID NO: 24707 - DNA, 750 bp, Unknown
  Obtained from environmental sample
  misc_feature (1)..(750): n is a, c, g, or t
atgaagctaactacacacattattatattaataataccttttntntgtttcgcacagaaaaaaaaatctggtagaattgtatataactataaagcaggaaaggaaatttttaactcgcaaaaaaagagtcaaaatgtaaaaacaatatttaaaggttttagtgaaaatttagaaaaaagcgaggacaaaatatcatttgaacttatatttaatcaaaatgaatcttattacaaaataataaagaaattagaatcagattatgataagggtttaaattttgccattttaattactggaggtaatgaagaagtctatatcaacgttaaaaatagtttaaaaattaaaaaaatagaagcgtttgataatcaatatttagtaaatagtgattttagagacagatggaaattaactcaggaatcaaaaaaaataggtcaatatatttgttataaagctctcttaataaaaaatattacagatttttatggaaagaagaaaaagttaataactgaagcttggtattcgcctgaaatccctgtaaacttcggacctaaagggtatggtaaccttcctggattaattttagaactgcatcaaggaagtattatttactatgctcaaataatagaattaaataaagataaaagcattatcataaataaaccgataaatggaaaaatgatttctgaagaagatttttctagtttatttaaagaagctgataaaaaaagaaggaaaaggagttcaaattaa

SEQ ID NO: 24708 - protein, 249 aa, Unknown
  Obtained from environmental sample
  SIGNAL (1)...(18)
  misc_feature (1)..(249): Xaa is any amino acid
MKLTTHIIILIIPFXCFAQKKKSGRIVYNYKAGKEIFNSQKKSQNVKTIFKGFSENLEKSEDKISFELIFNQNESYYKIIKKLESDYDKGLNFAILITGGNEEVYINVKNSLKIKKIEAFDNQYLVNSDFRDRWKLTQESKKIGQYICYKALLIKNITDFYGKKKKLITEAWYSPEIPVNFGPKGYGNLPGLILELHQGSIIYYAQIIELNKDKSIIINKPINGKMISEEDFSSLFKEADKKRRKRSSN

SEQ ID NO: 24709 - DNA, 375 bp, Unknown
  Obtained from environmental sample
  misc_feature (1)..(375): n is a, c, g, or t
ttgttttttcctaatggagaggaccaagacaaaattttttattcaccgcaagtatctagttttgaaaaaataaaagtcggaaaattatctttaggacaattacgctatcttgagttattgattattggaaacctaaatcataaattcttaatgttggacgaaccgttttcaatgattgagccgatttataaagatgtgataaaagttttattactcgaacttaaaaaatcaaaaggtataatattgactgaccattattataatgacgttcttgaaataacagataaaaatttcgttataaaagacgcaaaaaaaattgaaataaaggacaaaaacgatttggtaaaatatgaatatttgaactcaaatgaataa

SEQ ID NO: 24710 - protein, 124 aa, Unknown
  Obtained from environmental sample
  misc_feature (1)..(124): Xaa is any amino acid
MFFPNGEDQDKIFYSPQVSSFEKIKVGKLSLGQLRYLELLIIGNLNHKFLMLDEPFSMIEPIYKDVIKVLLLELKKSKGIILTDHYYNDVLEITDKNFVIKDAKKIEIKDKNDLVKYEYLNSNE

SEQ ID NO: 24711 - DNA, 471 bp, Unknown
  Obtained from environmental sample
  misc_feature (1)..(471): n is a, c, g, or t
atgacaaattattttaaaagaatcttatttattggattcgcttttttttacacaataattcacgctcaaacacaagaaattgtaaaatacaccgcttctaataagggtaaattctttattagttggggaggaaatagaggtgctttttcaaaatcagatattagatttaaaggtgacgactatgattttacaattaaagatgccacagcgaaagacaaaccaaaaggttggcacgtagattatataaatccgactaggatgactatccctcaaaccaattttaagttgggctatttcatttcggatcattataccgtttcatttggtgtagaccacatgaaatatgtaatgaatagaaatagaaacagaactgttgacggctacattaacttgcccgatagtgaggcaggtagaatttataatggtgattttaataatgaaaatctatttgttatcgaaagactttattga

SEQ ID NO: 24712 - protein, 156 aa, Unknown
  Obtained from environmental sample
  misc_feature (1)..(156): Xaa is any amino acid
MTNYFKRILFIGFAFFYTIIHAQTQEIVKYTASNKGKFFISWGGNRGAFSKSDIRFKGDDYDFTIKDATAKDKPKGWHVDYINPTRMTIPQTNFKLGYFISDHYTVSFGVDHMKYVMNRNRNRTVDGYINLPDSEAGRIYNGDFNNENLFVIERLY

SEQ ID NO: 24713 - DNA, 543 bp, Unknown
  Obtained from environmental sample
  misc_feature (1)..(543): n is a, c, g, or t
ttgattatgaaagacttgaaagaattcagcatacagtttgtaggattaaaagaaggtaaacacgagtttaagtactcaattgataataagttctttgaagcttttaattttgatgaatatgtaagttcatctatagaagtttctttaaattttgtaaaaaaaagcacattatttgagctggtttttattgctgaaggttctgtagaagttccttgtgacgtaaccaatgagttatatgaccaagaaatagattcagaattaccattagtagtaaagtttgggccagaatttaatgatgaaaatgaggagattttaatattacctcatgaagcttatgagtttaatgtagctcaatttatttacgaaatgattgttttagcagttcctaacaaaagagtacatccaaaagtattagatggcacaatggaatctgaagcattaacgaagttaaaagaactagagataaaaaaagtaaaaactgtagaaattacagacccaagatgggataaattaaagaatttaataacagaaaaaaagacataa

SEQ ID NO: 24714 - protein, 180 aa, Unknown
  Obtained from environmental sample
  DOMAIN (16)...(173): Uncharacterized ACR, COG1399
  misc_feature (1)..(180): Xaa is any amino acid
MIMKDLKEFSIQFVGLKEGKHEFKYSIDNKFFEAFNFDEYVSSSIEVSLNFVKKSTLFELVFIAEGSVEVPCDVTNELYDQEIDSELPLVVKFGPEFNDENEEILILPHEAYEFNVAQFIYEMIVLAVPNKRVHPKVLDGTMESEALTKLKELEIKKVKTVEITDPRWDKLKNLITEKKT

SEQ ID NO: 24715 - DNA, 918 bp, Unknown
  Obtained from environmental sample
  misc_feature (1)..(918): n is a, c, g, or t
atgaaaagttatctaaatggagcaatgtatggaaataaggtgttgaattatctgctatggcaatatgaaaattcaatacaaaacaagggttacagcattaaaaatttctcaattgaaaatgagcaaatcgaacatatttcgccacagacaccaacaaatggagaacctttagaaactggatatgacgttgacgaacaaaatgaatattcagaagatttcttaacgaataaaataaatagtttagggaatttaatgcttatttcaggttcacataatgcatctattggaaataaaccattttctcataaagttaaatcttataatcaaaatccacttttaaaccaacaagcagaaataaaagattacgcaactattgaaaatgaaaattctttttggaggtcagattcaattttaaatagacataattatattgtcggatttgcgacaaaaatttggagttttgataatataaatttgaaccatttaaaacacgaattggaagaaattgaggagttagaaattcaaatctcttctgacttggaaaataaattaaaagaaccaaataacttaaaaaccaaaagtaacggaaagttaccaatagaattgagtcctaatttggagtctgaatttatacctcttttacttgaaaagaaacaagcatatattactacatattacgagaatggaatatcggaacaaaaagtttggaaagtaagaagttttaaagaaagttctggagttatgggaaatttaaggtcacgtccagaatttagacctggaaaatggcaagaaagggaattaaaaatgttacgtttcataaagaaattgagtagaaaaaatacgaaatggcaacacgtatataattattgctggcttctcgcctactacgaaagtccctcgcgactttctggtcggtaa

SEQ ID NO: 24716 - protein, 305 aa, Unknown
  Obtained from environmental sample
  DOMAIN (43)...(146): Protein of unknown function (DUF1524)
  misc_feature (1)..(305): Xaa is any amino acid
MKSYLNGAMYGNKVLNYLLWQYENSIQNKGYSIKNFSIENEQIEHISPQTPTNGEPLETGYDVDEQNEYSEDFLTNKINSLGNLMLISGSHNASIGNKPFSHKVKSYNQNPLLNQQAEIKDYATIENENSFWRSDSILNRHNYIVGFATKIWSFDNINLNHLKHELEEIEELEIQISSDLENKLKEPNNLKTKSNGKLPIELSPNLESEFIPLLLEKKQAYITTYYENGISEQKVWKVRSFKESSGVMGNLRSRPEFRPGKWQERELKMLRFIKKLSRKNTKWQHVYNYCWLLAYYESPSRLSGR

SEQ ID NO: 24717 - DNA, 561 bp, Unknown
  Obtained from environmental sample
  misc_feature (1)..(561): n is a, c, g, or t
gtgaagtcctataaatttatcatatcaggaggtggaacaggagggcatatttaccctgcgattgccattgctaacgaattaaaaataaagtatccaaatgctgaatttttatttgtgggggcaaaggatagaatggaaatgcagaaagtgccagaagcgggatatgtaattaaaggattatggatttcgggattgcaacgaagtttgtcttttaaaaatttgatgtttccatttaaattaatttcgagcttgttgacttctaaaaaaatattaaaatcttttattcctgatgttgctattgggacaggaggttatgcaagtgcgccgttgttaaaagtggcttcaaataaaggaataccctgtttaatacaagagcaaaattctcatgcaggaattacgaacaaatggttgagcaataaagtgaaaagtatttgtgttgcttatgagggaatggggcaattctttccttctgaaaaaattaaacttacaggaaacccagttcgacaagatttaatcgatatagattctaaaagaggagaaggcttgaattactttaagtga

SEQ ID NO: 24718 - protein, 186 aa, Unknown
  Obtained from environmental sample
  DOMAIN (6)...(146): Glycosyltransferase family 28 N-terminal domain
  misc_feature (1)..(186): Xaa is any amino acid
MKSYKFIISGGGTGGHIYPAIAIANELKIKYPNAEFLFVGAKDRMEMQKVPEAGYVIKGLWISGLQRSLSFKNLMFPFKLISSLLTSKKILKSFIPDVAIGTGGYASAPLLKVASNKGIPCLIQEQNSHAGITNKWLSNKVKSICVAYEGMGQFFPSEKIKLTGNPVRQDLIDIDSKRGEGLNYFK

SEQ ID NO: 24719 - DNA, 324 bp, Unknown
  Obtained from environmental sample
  misc_feature (1)..(324): n is a, c, g, or t
atgaataagcgtcacatatccatcctaatgcttgccatgacggcactattatcaggctgtgatcaatcgtcgcaagacccgaatgtcatgctgtcagaagggcaaaaagacccaatcaaacagctggagatcacctcaaaaattgatcatagtaaacttggctatcagcaaaccttttatgtgccgatttactctgacatttataccgatagagacaatcgtaaggtcttgctgtctgcgactttgagtgtgcgtaataccaccttaaaaaatcactttatatncataaaatcgattactacgatacccgtggggctttcgtaa

SEQ ID NO: 24720 - protein, 107 aa, Unknown
  Obtained from environmental sample
  SIGNAL (1)...(19)
  misc_feature (1)..(107): Xaa is any amino acid
MNKRHISILMLAMTALLSGCDQSSQDPNVMLSEGQKDPIKQLEITSKIDHSKLGYQQTFYVPIYSDIYTDRDNRKVLLSATLSVRNTTLKNHFIXIKSITTIPVGLS

SEQ ID NO: 24721 - DNA, 303 bp, Unknown
  Obtained from environmental sample
  misc_feature (1)..(303): n is a, c, g, or t
gtgtataatcaagaagcagaagatgtaaagctgatagaatcttttaaagcaattcaggatatttgcgatttaaatgatattgagttactgttagtattttctccaaggttaagatgttttaatcttagtttttataatcaatttataaaaatggtaaataaagagaaaaatgtgattgtttacgatacgcttgatgtgggctataaaaaccctttgtattacagagatccttctcaccttcttaaaaatggcgccaaaattttcacctcagaaattagtgattttataaactcaaataaataa

SEQ ID NO: 24722 - protein, 100 aa, Unknown
  Obtained from environmental sample
  misc_feature (1)..(100): Xaa is any amino acid
MYNQEAEDVKLIESFKAIQDICDLNDIELLLVFSPRLRCFNLSFYNQFIKMVNKEKNVIVYDTLDVGYKNPLYYRDPSHLLKNGAKIFTSEISDFINSNK

SEQ ID NO: 24723 - DNA, 978 bp, Unknown
  Obtained from environmental sample
  misc_feature (1)..(978): n is a, c, g, or t
atgaaaaaatatacatcatcaaaaaaaataattggtgttcttttagtggcaacgatttttttatcgttttcatttaagtcgaaattctttgaagttgccaaacaaatagaaatttacaattctttattcaaggagttgaatatgtattatgttgatgaaataaacccagctgaattaacagatttagctataaaaaacaccttaaaagatttagatccttacactaatttttacaacgaacaagatgtagaagatgccagaattagaagagaaggagaatatgctggtgttggaatttctgttttttacacacaagaaggtattgaaataagtgagatttttaaaggtttttctgctgataaagctgatttaaaagttggtgatgttattgtttttgcaaatggacaatcacttaaaaatatggagagagaacagctttctatatttttaaaaggtacaccagacacaaaattatccatagaaattaaacgtcaaggagaaattttaaaaaaggaattaaaaagagaaaaggtagaaataaatcctgttcctttttatgaaatgattgatgaagaaacaggttacataactttaactcgttttaataatcaagcatcatctgaagtgaaaaaagcttttaaagacttgaaaaaacaaggaatgaaaaagctagtgtttgatttgcgctcaaatcctggaggatcttttatggaatctatcantattgcaaacttttttattcccaaaagcaaagtattagtcactacaaaagccaaaattaaaaaatggagtaatacttataaaacattcaacgaaacctttagatttagaaatacaattttgggaataaaaaatggaatttctgcctcaacctctgaaaatgtaattggttcctttgcaaaatttgaacagaacttgttattatgggaaaaacgtccttttggaaaggggtttagttcccgctcaaaaaaaaattga

SEQ ID NO: 24724 - protein, 325 aa, Unknown
  Obtained from environmental sample
  DOMAIN (192)...(325): Peptidase family S41
  misc_feature (1)..(325): Xaa is any amino acid
MKKYTSSKKIIGVLLVATIFLSFSFKSKFFEVAKQIEIYNSLFKELNMYYVDEINPAELTDLAIKNTLKDLDPYTNFYNEQDVEDARIRREGEYAGVGISVFYTQEGIEISEIFKGFSADKADLKVGDVIVFANGQSLKNMEREQLSIFLKGTPDTKLSIEIKRQGEILKKELKREKVEINPVPFYEMIDEETGYITLTRFNNQASSEVKKAFKDLKKQGMKKLVFDLRSNPGGSFMESIXIANFFIPKSKVLVTTKAKIKKWSNTYKTFNETFRFRNTILGIKNGISASTSENVIGSFAKFEQNLLLWEKRPFGKGFSSRSKKN

SEQ ID NO: 24725 - DNA, 570 bp, Unknown
  Obtained from environmental sample
  misc_feature (1)..(570): n is a, c, g, or t
atggtaagaaaattggtcatgattatgttgctaattttttacatattaatatgcagttttttcagaaaccctaaacctatcactgtcgaaaatcttgatcaaatcatcgctccggctgatggtaaagttgtagttattgaggaagttattgaaaaagaattttttaaggacaaacgcagacaaatatcaatttttatgtctccgctaaacgtacatgtaacccgatatccaataagtggtaaagtaatttttagtaaatatcatcccgggaaatatctggtagcatggcaccctaaatcttcagaagaaaatgaaagaacgagtatcgttttagaaaataagactgttggacagattttgtacaggcaaattgccggagcggtagccaggcgaattgttaactacgcctcagagaatgaaaccgtaaaacagggtgacgatgcaggttttataaagtttggttctagacttgatgtctttatacctttggatatgaaagtaaatgttactcttaacgagaaaacaagaggtggcgaaaccgtaattgccgaatatgatgaaaaagcttga

SEQ ID NO: 24726 - protein, 189 aa, Unknown
  Obtained from environmental sample
  DOMAIN (16)...(183): Phosphatidylserine decarboxylase
  misc_feature (1)..(189): Xaa is any amino acid
MVRKLVMIMLLIFYILICSFFRNPKPITVENLDQIIAPADGKVVVIEEVIEKEFFKDKRRQISIFMSPLNVHVTRYPISGKVIFSKYHPGKYLVAWHPKSSEENERTSIVLENKTVGQILYRQIAGAVARRIVNYASENETVKQGDDAGFIKFGSRLDVFIPLDMKVNVTLNEKTRGGETVIAEYDEKA

SEQ ID NO: 24727 - DNA, 810 bp, Unknown
  Obtained from environmental sample
  misc_feature (1)..(810): n is a, c, g, or t
ttgtatttagaacgcttacatgtaaaatctttactatttgaagaggaattgaaatcctcaaataatcattgggaaggattgttgttcaaattgctatgcaaaaattttggtctcaaagttaatggagatgccttttttagtatagcacaatctatagatttttcaattatcaaaaaatgtaatcatgataaattagcattagaagcacttttatttggtcaagctggtttttttgaagtgaataaggaagattcatattttgagttattgaaaagcaggtatctgtatttaagacataaatttgatttagataacaattcggttaattttccaaaatattttagattgagaccttctaatttccctacgatacgattatcacaaatagcagttttattttctgaaaaacaatctttgttttcaagaattatagaagctaaaagtttaaaagattattatgcattatttactatttctgcaaatgaatattgggatagccattttaattttggaatttcttctacaaaaaataaaaaaagactaacccaaaagtttatagacttactattaataaacacgattatacctttaaaatatagttatgcaaaatatatgggtcaagatgcttccgaagaaatcatgaacttagcttcaacaatcccgtctgaggaaaattcaattatcaaaaaattcaatcaattagttccaattgctaaaaacagtttgcaatcccaagcattacttcagcttaaaaacgaatattgtattaaaaataaatgtattcaatgtgctgttggaaattctatttaa

SEQ ID NO: 24728 - protein, 269 aa, Unknown
  Obtained from environmental sample
  misc_feature (1)..(269): Xaa is any amino acid
MYLERLHVKSLLFEEELKSSNNHWEGLLFKLLCKNFGLKVNGDAFFSIAQSIDFSIIKKCNHDKLALEALLFGQAGFFEVNKEDSYFELLKSRYLYLRHKFDLDNNSVNFPKYFRLRPSNFPTIRLSQIAVLFSEKQSLFSRIIEAKSLKDYYALFTISANEYWDSHFNFGISSTKNKKRLTQKFIDLLLINTIIPLKYSYAKYMGQDASEEIMNLASTIPSEENSIIKKFNQLVPIAKNSLQSQALLQLKNEYCIKNKCIQCAVGNSI

SEQ ID NO: 24729 - DNA, 384 bp, Unknown; identical to SEQ ID NO: 21139
  Obtained from environmental sample
  misc_feature (1)..(384): n is a, c, g, or t

SEQ ID NO: 24730 - protein, 127 aa, Unknown; identical to SEQ ID NO: 21140
  Obtained from environmental sample
  misc_feature (1)..(127): Xaa is any amino acid

SEQ ID NO: 24731 - DNA, 666 bp, Unknown
  Obtained from environmental sample
  misc_feature (1)..(666): n is a, c, g, or t
atgctggaatgcgctcgaattcatttagtacaaaaattgaacaaaagtggtgatagtttaatccttgctacagaccataaaaaaataaaacaagtagatatattaaactacgagtatctagagacttttgaaattaataattcaaatgcaaaaattggtttaagtcatctctctataggaaattatgtggtacaagccagaataggcagacactggattgtgatgtacttagaaaaaagagatttaaaagcagaaggtcttaaaaccacagatggtaacattaatagtaatgtaaaagaaatagttactaagaactcaattgcttcagtgtcttcaacgatagatacatctaacttacttcaacttaatgaaaataaaatgtattgggtggtttatgagagtaatacacaatttgcgtcgcatagaaacatgggtttaaaatatgctgatgaaatttatgatttaataaatcaaatagaattagaaatgaaatctgaagtggcaaaagctaataccctacgtgtttatgaggtttttgataaatctgaatttatgcgtaaacagcttaaaaacaaaaattatcataaacgaaaaagttctaaattatttaatgttaatccaatatataattctgaagataaaaggaaatctataactagtttgtaa

SEQ ID NO: 24732 - protein, 221 aa, Unknown
  Obtained from environmental sample
  misc_feature (1)..(221): Xaa is any amino acid
MLECARIHLVQKLNKSGDSLILATDHKKIKQVDILNYEYLETFEINNSNAKIGLSHLSIGNYVVQARIGRHWIVMYLEKRDLKAEGLKTTDGNINSNVKEIVTKNSIASVSSTIDTSNLLQLNENKMYWVVYESNTQFASHRNMGLKYADEIYDLINQIELEMKSEVAKANTLRVYEVFDKSEFMRKQLKNKNYHKRKSSKLFNVNPIYNSEDKRKSITSL

SEQ ID NO: 24733 - DNA, 573 bp, Unknown
  Obtained from environmental sample
  misc_feature (1)..(573): n is a, c, g, or t
gtgaaatccgtgtataaaaatatttacatcttctttataatagcttcactcctatttatttcttgcgataaaaaatctttaatcagtaaagagtttgattgtgattccaaaacctttaataatttagaagttgttgatgatgttaaaaatttattctctgttgatttgccaaaagattggaaagtaaatttatatcaagatgaaatacaatcttctgtttttgctgcagataccacaaaacaactcacagaaactgttttgttagatgtaactttcatcaacaaaaaaataaattttaatgatgcttttttactacaacaagatcaagagtatttagcaaacgaactcatcagaataaaaacaaaagaaatttcttttcttgaaaaacctacaatgtatttggtttataaaggtaaaaaagggaaatttgactatcaagtttgtaatacttttatcaaagtaaacgaatcgaattttatatttgcaaaaaccgaagtttatggagattcaattgtaaaccaacgtttttgcgaagcattttcactgatggagaacatcaacataaaaaattaa

SEQ ID NO: 24734 - protein, 190 aa, Unknown
  Obtained from environmental sample
  misc_feature (1)..(190): Xaa is any amino acid
MKSVYKNIYIFFIIASLLFISCDKKSLISKEFDCDSKTFNNLEVVDDVKNLFSVDLPKDWKVNLYQDEIQSSVFAADTTKQLTETVLLDVTFINKKINFNDAFLLQQDQEYLANELIRIKTKEISFLEKPTMYLVYKGKKGKFDYQVCNTFIKVNESNFIFAKTEVYGDSIVNQRFCEAFSLMENINIKN

SEQ ID NO: 24735 - DNA, 735 bp, Unknown
  Obtained from environmental sample
  misc_feature (1)..(735): n is a, c, g, or t
atgcaaattttagaaactcatattgccaaagaattaaaagaaccaattcgttttcaaaaatacggagttggtatatttaaaacgattccaacaaaatctggaattaaaaaagccattaaaaaagaattaatttttattaatggaatcttagcaaccacctcaaaatatatttctggaggagaaaaaattgagctatttgaatcggaaaattcatcaacttttgaaaggttaaaattagatttagacgttttatttgaagatgattatttagctattatttataaaccagctggcattttagtcagtggcaataaatttgtaaccattgcaaatggcttggctcaaaacctaaaaaaaagcaatcaagttgatgctgtaaaacctcaaccaattcacagattagattacccaacaagtggacttctattaattggaaaaacgagttcagcaattcaacaattaggagatttatttaaaaacaaagaaattcaaaaaacatattttgcaattgctattggcaaaatgcaaacccaaggagaaatcaatttttctgttgaagaaaaagaagcatttacaaaatttgaagttttacaatctgaaaaatctgaacgctttgaatttttaaatttggtaaaattatcacctaaaacaggcagaaaacatcaattaagaaaacatttattagcaattggaaaactcattttgggtgataagatgtatttcttagaaagataa

SEQ ID NO: 24736 - protein, 244 aa, Unknown
  Obtained from environmental sample
  DOMAIN (89)...(229): RNA pseudouridylate synthase
  misc_feature (1)..(244): Xaa is any amino acid
MQILETHIAKELKEPIRFQKYGVGIFKTIPTKSGIKKAIKKELIFINGILATTSKYISGGEKIELFESENSSTFERLKLDLDVLFEDDYLAIIYKPAGILVSGNKFVTIANGLAQNLKKSNQVDAVKPQPIHRLDYPTSGLLLIGKTSSAIQQLGDLFKNKEIQKTYFAIAIGKMQTQGEINFSVEEKEAFTKFEVLQSEKSERFEFLNLVKLSPKTGRKHQLRKHLLAIGKLILGDKMYFLER

SEQ ID NO: 24737 - DNA, 900 bp, Unknown
  Obtained from environmental sample
  misc_feature (1)..(900): n is a, c, g, or t
atgtgggacaaaattttagacattaaaaaatgtcatttacaagcagatccttctaatgctattagaaacgcggtaagagatttttcgattaaaaatgatttagaattttttaatactagaaatcaaactggattgcttcgtaccatgatgattcgtacatcctcaactaaggatattatggttgttattcagttttttaaagaagataaagcgaaacgtgaactattattagattatgttgctgaaacatttccagaaattacttcgttacaatatattattaacgaaaaagctaatgatactatttacgatcaagatgtgatttgctataaaggtgaagaccatatttttgaagaaatggaaggtttaacatttaaaattaatgctaaatctttttaccaaactaattctaatcaagcatttgaattatataaattaactcgtgaatttgccgatttaaatggagacgaactggtttacgatttatatacaggtactggtaccattgcacaatttgtgtctaaaaaagcaaaaaaagtagttggtgtagaggctgttccagatgctattagtgctgcaaaagaaaatgctaaacgcaataatattacaaattgcgagttttttgtaggagacatgaaaaacgtatttaatcaagagtttattaatacacatggtcaacctgacgtgattataacagatccaccaagagatggtatgcataaggatgttgtacagncaatattaaacatagcacctaaaaaggtgggtttacgtagttgtaatagtgcaacacaaagcagagatttggctttnnatgaagcgccatacgtaataactaaagtgccagcagtagatatgttttcgccaactcatcatgttgaaaattattgtactttttag

SEQ ID NO: 24738 - protein, 299 aa, Unknown
  Obtained from environmental sample
  misc_feature (1)..(299): Xaa is any amino acid
MWDKILDIKKCHLQADPSNAIRNAVRDFSIKNDLEFFNTRNQTGLLRTMMIRTSSTKDIMVVIQFFKEDKAKRELLLDYVAETFPEITSLQYIINEKANDTIYDQDVICYKGEDHIFEEMEGLTFKINAKSFYQTNSNQAFELYKLTREFADLNGDELVYDLYTGTGTIAQFVSKKAKKVVGVEAVPDAISAAKENAKRNNITNCEFFVGDMKNVFNQEFINTHGQPDVIITDPPRDGMHKDVVQXILNIAPKKVGLRSCNSATQSRDLAXXEAPYVITKVPAVDMFSPTHHVENYCTF

SEQ ID NO: 24739 - DNA, 780 bp, Unknown
  Obtained from environmental sample
  misc_feature (1)..(780): n is a, c, g, or t
atgtctttggataagatattgacactttctgatatgcatgcacctaataaaaaaaataatacgtctattgtgcaattggcaaatgctgcaggatatgacacctattggatttctaatcaaagaccagtaggtttgcatgagcgtatttcgtcaattattgctaatgcagccaaggaaaaatattttgtcgctacggataattctgatgacattatttatgatgaagcgcttttaccaatattagataaagtattaaaaaagcctagtaagcaaaaaataatattcctgcatctaattggtacgcatggtcgttattctagtcgttttcctgaatcgtatagttactttaaggataatagcttaaatacaaaatttaagcatgacaaagcatttaaattaattaatgaatacgataatgcgattagatataatgataatatagttaattcagttattgataaagttaggcagcaaaacacaaatagttttgtcctttacttttctgatcatggagatgagttatttgatactatagattttattggtcataatgaataccaagcgactagaccaatgtatgaagtgccatttatagcatggttatctgatgaatataaattagattttaatccaaccaagcaatataataactttancaagcgtgcttataatttggaagaatttatctatagctttgctgatttggctaaaataaaattaatcaaatggatagtactaaaagtatttttagtgaccgtttttttagaaaaccgagattaa

SEQ ID NO: 24740 - protein, 259 aa, Unknown
  Obtained from environmental sample
  DOMAIN (1)...(244): Sulfatase
  misc_feature (1)..(259): Xaa is any amino acid
MSLDKILTLSDMHAPNKKNNTSIVQLANAAGYDTYWISNQRPVGLHERISSIIANAAKEKYFVATDNSDDIIYDEALLPILDKVLKKPSKQKIIFLHLIGTHGRYSSRFPESYSYFKDNSLNTKFKHDKAFKLINEYDNAIRYNDNIVNSVIDKVRQQNTNSFVLYFSDHGDELFDTIDFIGHNEYQATRPMYEVPFIAWLSDEYKLDFNPTKQYNNFXKRAYNLEEFIYSFADLAKIKLIKWIVLKVFLVTVFLENRD

SEQ ID NO: 24741 - DNA, 1008 bp, Unknown
  Obtained from environmental sample
  misc_feature (1)..(1008): n is a, c, g, or t
atggctgaggttctttttccaataccgttacgattggcttgggctattaccattcataaaagtcagggcttaactttcgaaaaagctattattgatgccggagcatcatttgctcacggtcaaacatatgttgccttgagtagatgtacatctttagaaggagttattttaaaaacacaaattaaggatagtagtattattaatgataatcgtgtagcaaagtttactaaagatgtagaagagaacctcccaaatgaaacagaattaactaattctcaaaaagaatatcaattaaatttgattgaagatctgtttagttatcaatcgtttttatatcctgtacaacggttaattaaaatttattatgaaaataaaacaagttttaaaggaaatataattgaacctctgaaccaaattaaggacaaagggattgttcttttaatgcaagtagtgacatcttttaaaaaccaactagtaaaattaagcgaaactattgccaatcctgaagaagataaagcaatccaagaacgcattgataaaggaattcattattttattgagcgaactgttgaagatattaagaaaccactagatgcaattactttttcatctgataatcaagctgtaaataaggattttacgaaacagattgatattctcgaagaattattagcaactaaattgacttgtttatcaggtttgtctaatggtttttttgcttcaaaatatttagaattacgagcaagagcagtgttggaaaaaacggagccttcaacaaaaaaaccaaaagaaaaaagagcagaagttacttcaacagatcatcctgttctatttgaacagctaagaattttacgaaaagaattctcagatgaagaaaatgggattgcatatcatatatttacacaagcatcattatttgaaatgtgtgcatatttttccacgaccctgaaagaaattaaatccattaaatggaagggggaaagtgcgtgtagaaaaatatgggaataa

SEQ ID NO: 24742 - protein, 335 aa, Unknown
  Obtained from environmental sample
  misc_feature (1)..(335): Xaa is any amino acid
MAEVLFPIPLRLAWAITIHKSQGLTFEKAIIDAGASFAHGQTYVALSRCTSLEGVILKTQIKDSSIINDNRVAKFTKDVEENLPNETELTNSQKEYQLNLIEDLFSYQSFLYPVQRLIKIYYENKTSFKGNIIEPLNQIKDKGIVLLMQVVTSFKNQLVKLSETIANPEEDKAIQERIDKGIHYFIERTVEDIKKPLDAITFSSDNQAVNKDFTKQIDILEELLATKLTCLSGLSNGFFASKYLELRARAVLEKTEPSTKKPKEKRAEVTSTDHPVLFEQLRILRKEFSDEENGIAYHIFTQASLFEMCAYFSTTLKEIKSIKWKGESACRKIWE

SEQ ID NO: 24743 - DNA, 879 bp, Unknown
  Obtained from environmental sample
  misc_feature (1)..(879): n is a, c, g, or t
ttgttctgggtaaaggtgggggaaataaaagtgaagcggaaccgtgtccgccaaaccctttcaccggttgttaagcagaaaaatgcggtgatcagagacaactacaatgaattggatatacaactggaacaaggttttgcggtggtttttcgggtttacaatgatggttttgcctatcgaatcaggttaaatctcaatggtccggttcacatatatcaggaagaggtccaaataaactttccggataattacaaaatctatttccctgaagagaaaaaactgatcacccatcaggagaggacatttaagaatgtttctttaaaggagatttcagaggattcattctgcagtcttccggttcttctggatatgacagatggtcttaaaatggtaataaccgaagcccatgtggaggattatcccggaatgtacctttcaggtgcaaagggaaatggcttgaaaggattctttcccaaggtggttcttgaagagggactaaaacgggatcgggatccggtggtgaaaaagaggggggattatattgcccggatcaatgggaaacggtttcttccatggcgggtatttgtgatttcaagggaggacaaagaactggttgagagtgaaatgatttacaaattgtcacctccccttcgtttggcagagacatcatggatcanaccgggaaaagtggcttgggattggtggaatgccaataatatttataatgtgccatttaaagcggggatcaatactgaaacctaccggtattatatagactttgcttcagcccatggattggagtatgtgatttttgatgagggttggtatgaattgggaaatctcctgaaaacaaccctgacatggatgttccgggattga

SEQ ID NO: 24744 - protein, 292 aa, Unknown
  Obtained from environmental sample
  misc_feature (1)..(292): Xaa is any amino acid
MFWVKVGEIKVKRNRVRQTLSPVVKQKNAVIRDNYNELDIQLEQGFAVVFRVYNDGFAYRIRLNLNGPVHIYQEEVQINFPDNYKIYFPEEKKLITHQERTFKNVSLKEISEDSFCSLPVLLDMTDGLKMVITEAHVEDYPGMYLSGAKGNGLKGFFPKVVLEEGLKRDRDPVVKKRGDYIARINGKRFLPWRVFVISREDKELVESEMIYKLSPPLRLAETSWIXPGKVAWDWWNANNIYNVPFKAGINTETYRYYIDFASAHGLEYVIFDEGWYELGNLLKTTLTWMFRD

SEQ ID NO: 24745 - DNA, 840 bp, Unknown
  Obtained from environmental sample
  misc_feature (1)..(840): n is a, c, g, or t
ttgcaaggaagtcaaaatcaacaagaatggtttgcgattcttgaagattatcgaattctttcaattaaaaatcaatcgacaaattttaaatttactacattagagtttccagattctaaatttaaatattatcgacttattgtaaaagataatgaacctccacaattagaatctgcacagctttctaattaccaaactatagctggtcattataccacttacaaccttaaaaagttagaaacaacagatgataaaacactgaaaaacaccgttattaatttagagttagagaaagcagtgcctcttagtcagttagatatcaatgtgagcaatacattcgattattatcggccttttaagatagaatataggagagacagtacattaactgaaaaaggttttaaatatcattataaaacgataactagtggcacattaaactcaatggaacagaatctatttaagtttccaagtaccattgcaaaacacttaagggtaaccatttataatgataataaccagccattacgtattgctgatgtttctgccaaaggttatcaatttcaactcatcgtacgatttacagaaccagcaatttatatgctagtttatggttatccttcagccagagaaccagtttatgatattgccaagtttgaaacaaacataccggaagagttaattgctttagaagtgggtaaagaggatgttattcttcatagcttggatcctaaagtttcaccgctatttgaaaatagttattggctatgggctatcattggaattgtcattttattgttgggaggttttacactaaagatgttgaagacgaagcgttag

SEQ ID NO: 24746 - protein, 279 aa, Unknown
  Obtained from environmental sample
  misc_feature (1)..(279): Xaa is any amino acid
MQGSQNQQEWFAILEDYRILSIKNQSTNFKFTTLEFPDSKFKYYRLIVKDNEPPQLESAQLSNYQTIAGHYTTYNLKKLETTDDKTLKNTVINLELEKAVPLSQLDINVSNTFDYYRPFKIEYRRDSTLTEKGFKYHYKTITSGTLNSMEQNLFKFPSTIAKHLRVTIYNDNNQPLRIADVSAKGYQFQLIVRFTEPAIYMLVYGYPSAREPVYDIAKFETNIPEELIALEVGKEDVILHSLDPKVSPLFENSYWLWAIIGIVILLLGGFTLKMLKTKR

SEQ ID NO: 24747 - DNA, 678 bp, Unknown
  Obtained from environmental sample
  misc_feature (1)..(678): n is a, c, g, or t
ttgcaatggaaagatagtaacaccttgctttttagatctaatgatggcaaaacattattagaatctcaattagaagagataaaagacaatgttattgttgttgaagattctttgcactggaaaccaaaccatgtgtatgcttttaatgttaaagataaatctattaaaaggcttaccaataataaaaaaccgacaggtaattatacggtttcacctgatggtaaatggttggtatatagtatgagtagaagtagaagttatgcgtctgatgcccagaaagacccattttattatttaaagaatttagaaacaggtacagtaaaacaggttataactgatagaggttttccaattggtggcattcaatttagcaaagacaataaaggcttttattttctttcagagtttgggtcggaacccaaatggaatgaggccggaattacagagtttttttattatacaattagcacaaattcatatcaaaaggtagatctaaaatgggaaatgggggtaagcagaggttacgaagtgataggtaataatgtaattgtttctttagccaataaaacaggacttagattagcttattttataaagaatactactggttggtcgaaatctaagatcgatttaggagtaaagaacgatcataccattattcatgcgggtgccgaataa

SEQ ID NO: 24748 - protein, 225 aa, Unknown
  Obtained from environmental sample
  misc_feature (1)..(225): Xaa is any amino acid
MQWKDSNTLLFRSNDGKTLLESQLEEIKDNVIVVEDSLHWKPNHVYAFNVKDKSIKRLTNNKKPTGNYTVSPDGKWLVYSMSRSRSYASDAQKDPFYYLKNLETGTVKQVITDRGFPIGGIQFSKDNKGFYFLSEFGSEPKWNEAGITEFFYYTISTNSYQKVDLKWEMGVSRGYEVIGNNVIVSLANKTGLRLAYFIKNTTGWSKSKIDLGVKNDHTIIHAGAE

SEQ ID NO: 24749 - DNA, 630 bp, Unknown
  Obtained from environmental sample
  misc_feature (1)..(630): n is a, c, g, or t
atgactaaagaaatatcaaataataaaagtaggagtgtgggttctttccctttggggaagttagatggggcctcttcagttgtgataattgattacggagcaggaaatataaaaagcattcaatttgcttttaaaagattgggaattgatgctgttttatcaaacaatattgatgaaataaaagctgctgataaagttatttttcctggagttggagaagcaagttctgccatgaaaatgttgcaagaaagtggtttagacaaagtaataccaactttaacacaaccagttttaggaatttgtttaggaatgcaattgatgtgtaattcgtctgaagaaggaaatacaaaaggattgggaatttttgatgttgctattaaaaagttttctaaagaagtaaaagttccacaaatgggttggaatgttatttctgatttaaaatctgatttatttacaggaattaaagacagagaatttatgtatttagtacatagtttttatgctgaaatgtgtgatgaagctatttgcaacacagattatgaaattgaatatgcttcagctttacaaaaagatatttttatggagttcgtttcatcccaagaattctcaaaagcgggagacaaattttaa

SEQ ID NO: 24750 - protein, 209 aa, Unknown
  Obtained from environmental sample
  DOMAIN (28)...(205): Glutamine amidotransferase class-I
  misc_feature (1)..(209): Xaa is any amino acid
MTKEISNNKSRSVGSFPLGKLDGASSVVIIDYGAGNIKSIQFAFKRLGIDAVLSNNIDEIKAADKVIFPGVGEASSAMKMLQESGLDKVIPTLTQPVLGICLGMQLMCNSSEEGNTKGLGIFDVAIKKFSKEVKVPQMGWNVISDLKSDLFTGIKDREFMYLVHSFYAEMCDEAICNTDYEIEYASALQKDIFMEFVSSQEFSKAGDKF

SEQ ID NO: 24751 - DNA, 576 bp, Unknown
  Obtained from environmental sample
  misc_feature (1)..(576): n is a, c, g, or t
atggctggcatttgcatttttctaccaaaaaatcacgcgttacaatttgcaaaaggtgactggattttatttgtagatgctgacgagcgtataccttatgccttgcaacaagaaatttttgaagctataagcagtaataaacatgctggatacaagcttaattttccgcattattacatgaataggtttttataccatcacagtgataatgtgacacgattagtaaaacgtaacaactgtaaatttgaaggtctggtgcacgaaaaactgattattgatggtaccattggacagttaaaaaatcctgtgcttcattttacctataaaggattactacattacataagcaaaaaagatagctatgcatggtttcaggcaaagcaaatgcttaaaaaaggtaaaaaagccacttattttcatttagcatttaaacccttttatcgtttttttagtagttatattttaaggcgtggatttatggatggtattcctggattaaccgttgctagtgttaatgcttatggtgtgttttctaggtatgtaaagttaatgttacttcaaaaaggaattaaataa

SEQ ID NO: 24752 - protein, 191 aa, Unknown
  Obtained from environmental sample
  misc_feature (1)..(191): Xaa is any amino acid
MAGICIFLPKNHALQFAKGDWILFVDADERIPYALQQEIFEAISSNKHAGYKLNFPHYYMNRFLYHHSDNVTRLVKRNNCKFEGLVHEKLIIDGTIGQLKNPVLHFTYKGLLHYISKKDSYAWFQAKQMLKKGKKATYFHLAFKPFYRFFSSYILRRGFMDGIPGLTVASVNAYGVFSRYVKLMLLQKGIK

SEQ ID NO: 24753 - DNA, 546 bp, Unknown
  Obtained from environmental sample
  misc_feature (1)..(546): n is a, c, g, or t
atgaagcatttaaaaacaactttattaatagctacttataattggccagaagcattagatttagttttacaaagcgcattaaaccaaagtcagttacctgatgaagttattattgcaaatgatgggtcaactaatgatactaaagttttaattgatagttttaagacaaaatttgaaattcctttgattcatatttggcaaaaagacgaaggatttaaaaaagcccatattttaaacaaagcaatagcaaaagcatcaggagattatataatccaggtagatggagattgtattatgcatccgcattttattaaggatcatttacaatttgttcaagaaaacacttatttatttggatctagagtaaatatccaaaaagattatttagatactttgtttaagactaaacaaacctctttttcagctttttctaaaggaataaaaaaacgtactcgtgctttacatattccaatgctaagtaaattatataaaccaaatgctgagttttcaagtaaatttagaggttgtaatacctcttatttttaa

SEQ ID NO: 24754 - protein, 181 aa, Unknown
  Obtained from environmental sample
  DOMAIN (7)...(169): Glycosyl transferase
  misc_feature (1)..(181): Xaa is any amino acid
MKHLKTTLLIATYNWPEALDLVLQSALNQSQLPDEVIIANDGSTNDTKVLIDSFKTKFEIPLIHIWQKDEGFKKAHILNKAIAKASGDYIIQVDGDCIMHPHFIKDHLQFVQENTYLFGSRVNIQKDYLDTLFKTKQTSFSAFSKGIKKRTRALHIPMLSKLYKPNAEFSSKFRGCNTSYF

SEQ ID NO: 24755 - DNA, 384 bp, Unknown
  Obtained from environmental sample
  misc_feature (1)..(384): n is a, c, g, or t
atgaaaatattacacagaattggttactatttaggtggattctctattggtttagttttattagcttttttcttaaacggaagaggtgtctcttgcgagtataattatggtccagaaggaagagtcttaaagaatatacgtacaaaaacactacacttctctgcagacagtcaagcacttttagacacaaaagctattgacacctctgcaataagttacatccttaaaaaaggagatgtagatttttctaaaagtgaacctagaaaagaaccttgtggtatgtattttatttatggtgaaactaaagacagtaaaaactacgaattttatatagaaaactgtgatagcattgcaaccttgcaaactataaaagttctagattaa

SEQ ID NO: 24756 - protein, 127 aa, Unknown; identical to SEQ ID NO: 21140
  Obtained from environmental sample
  misc_feature (1)..(127): Xaa is any amino acid

SEQ ID NO: 24757 - DNA, 774 bp, Unknown
  Obtained from environmental sample
  misc_feature (1)..(774): n is a, c, g, or t
gtgaaacgacagacataccgtaagcaaaggcaattgatgacagtttactacagcttgtatgggcaattattagatattaataacctgtacaagggattcaaaaaagtgaaagcagcgaaaggagcggccggaatagataggcagtccatagccgcgttcgccttgaatttagaagaaaacttgaaacaactgcaaggtgaactgcaaagcaagcagtatcgcgcacagccagtcaaacggatagaaataccgaaagatgatggtggtgtgagactgctgggaattccaacagttcgcgaccgcatagtacaacaaacactattgaacattctccaaccgctcttcgacatcgactttcacccatcaagttatgggtacaggccgaaacgaagttgtcatgacgccatcagcaaagccacggtatttattcgtaaatatcaccgtgagtgggtggttgatatggatctgtcgaagtgttttgacctactcgatcacgacttgatcataagcagcgtcaaacgcaaagtgacagacggtagcatcttaaaactgctcaaacagtttttaaaaagcggagtaatgataggcaataattgggaagcgagtgagctaggaagtccacaaggtggtgttatcagtccattgttggcgaatatctacctagatgcatttgctcaagaaatgaaaaagcgaaatcacagaatagtgaggtacgccgacgacatattgatcttatgctgcacagaaaaagcagccaagaatgcactcacctga

SEQ ID NO: 24758 - protein, 257 aa, Unknown
  Obtained from environmental sample
  DOMAIN (74)...(257): Reverse transcriptase (RNA-dependent DNA polymerase)
  misc_feature (1)..(257): Xaa is any amino acid
MKRQTYRKQRQLMTVYYSLYGQLLDINNLYKGFKKVKAAKGAAGIDRQSIAAFALNLEENLKQLQGELQSKQYRAQPVKRIEIPKDDGGVRLLGIPTVRDRIVQQTLLNILQPLFDIDFHPSSYGYRPKRSCHDAISKATVFIRKYHREWVVDMDLSKCFDLLDHDLIISSVKRKVTDGSILKLLKQFLKSGVMIGNNWEASELGSPQGGVISPLLANIYLDAFAQEMKKRNHRIVRYADDILILCCTEKAAKNALT

SEQ ID NO: 24759 - DNA, 777 bp, Unknown
  Obtained from environmental sample
  misc_feature (1)..(777): n is a, c, g, or t
atgagagataaatataaaggcaaagcgtatnttaatgattatataaatacactttataacactcaagaagctttaattaaaaaattaaaaagcgacttagttaaattagaaagaatagcacctgtaaagatgcagttgactaaagattatttgaacatcatttttgctaaatattcaagaggagatgacatgtttaataaagaggtgtattctatttttgaaaacacagtaaatttaatgactgagtattggtcagagcgtcatcaaaatactttatattatttagaaaaaaataaagttatttatttaaaacaatacacattatcttatcatgtcttcatgttaaatatgttatctattggatatttgctaaacgtagatgataagcaatttcaattaataaatgattttatagaaaaagatgaaataaaggattttatatatgattttttattaagaagcaaactacaagataaagcacctattactgattctaattttaaagtattctctgggtttaaagatccattcgtaacaattaaacaaatcataaatactactaataaagatgatgctgtagttaagttaaagtcgtttttagaaaatgagtggttcaaaataataaacaaacataatttatacagttcacacactcataaatttgatgtttactgcggctactggtgttttcctgcagcagcaattgtaaaaattaaaggactagacgatagtagttttagagacaatccatattatccaaaagatttaatacaataa

SEQ ID NO: 24760 - protein, 258 aa, Unknown
  Obtained from environmental sample
  misc_feature (1)..(258): Xaa is any amino acid
MRDKYKGKAYXNDYINTLYNTQEALIKKLKSDLVKLERIAPVKMQLTKDYLNIIFAKYSRGDDMFNKEVYSIFENTVNLMTEYWSERHQNTLYYLEKNKVIYLKQYTLSYHVFMLNMLSIGYLLNVDDKQFQLINDFIEKDEIKDFIYDFLLRSKLQDKAPITDSNFKVFSGFKDPFVTIKQIINTTNKDDAVVKLKSFLENEWFKIINKHNLYSSHTHKFDVYCGYWCFPAAAIVKIKGLDDSSFRDNPYYPKDLIQ

SEQ ID NO: 24761 - DNA, 564 bp, Unknown
  Obtained from environmental sample
  misc_feature (1)..(564): n is a, c, g, or t
ttgattctctttaaacaaatgaataaaccagttattctagtagtcaataaaattgatgattcggatcaacaacaagttgaaaaactggctaaagacctcaatgattattttaaattccacgatactattttcatttctgctctaaatggagacaacgttcctggattgatggaatccatttcaaaattacttttaccaggacctcctttctatccaaaggatgaattgagcgaacatcctgttcggttttttgctgctgaattaattcgtgagcaagttttccttcagtatcacgaagaacttccttactccgctactgttgatatcattatttatgaagaaagaaaagatctcgactacataaatgcggaagtaatcgtaaatagaaactctcagaaagggatgattattggtaaaggtggtaaagcaattaagcaacttggtactgctgccagagaatccattgaagaattcgtaggacgaaaagtcttcttagatttacatgtaaaagtccgcgacaaatggcgtgaaaatgagaatatggttcggaatttcgggtattaa

SEQ ID NO: 24762 - protein, 187 aa, Unknown
  Obtained from environmental sample
  DOMAIN (123)...(187): KH domain
  misc_feature (1)..(187): Xaa is any amino acid
MILFKQMNKPVILVVNKIDDSDQQQVEKLAKDLNDYFKFHDTIFISALNGDNVPGLMESISKLLLPGPPFYPKDELSEHPVRFFAAELIREQVFLQYHEELPYSATVDIIIYEERKDLDYINAEVIVNRNSQKGMIIGKGGKAIKQLGTAARESIEEFVGRKVFLDLHVKVRDKWRENENMVRNFGY

SEQ ID NO: 24763 - DNA, 888 bp, Unknown
  Obtained from environmental sample
  misc_feature (1)..(888): n is a, c, g, or t
atgattaaagttcaaagatatgttataagcctggttgggctttccattattatcacactacaacagatcatctggtctcagaattttagggtgctttcttttctactctggatagcttctttatcacttgttattaatctaatcatttctggaattcattttttttcagattcaaaagaagatcataaaacgacggggtcattattggatagaatttttatggcttcaaaaataataattgggtttgggttattactcagtgctattgttttttgttttgactttattatctctaagtttaggccattggaatacttaaactataagctatttgtcccttttggcgttttgtttgttatcggacggatttttattaaggagaaagaagttaatgaagtcattaaaaattttattattaaatggacgcccgtagtaaaagaatggttagtcatactggaagaaaaatttaatatagcatggcaatgggttatttctagaaaatggctggttggatctattggactcatattattgttattgtttacactccctacactgcttaaatctcctgtagagaaaccgagacttatcacattacatgtcttagacaaagaatatctagaagtagataaggatagtgtcgttataggtagagactatgaccaacgcgtgcatttaaaggtcaacaatctggagagtacaaataaaaatgtattctttgaggtgattcaggaaccaggaaaggatagtttaatgctaggatttgtaggtaggggaagtcattatgaagatgaatttaaaacacagttaatttcgcctgggaactttcgttatttcgatttattaatacatagcgcacaaacaaaaaaactaaaacacaccctttag

SEQ ID NO: 24764 - protein, 295 aa, Unknown
  Obtained from environmental sample
  misc_feature (1)..(295): Xaa is any amino acid
MIKVQRYVISLVGLSIIITLQQIIWSQNFRVLSFLLWIASLSLVINLIISGIHFFSDSKEDHKTTGSLLDRIFMASKIIIGFGLLLSAIVFCFDFIISKFRPLEYLNYKLFVPFGVLFVIGRIFIKEKEVNEVIKNFIIKWTPVVKEWLVILEEKFNIAWQWVISRKWLVGSIGLILLLLFTLPTLLKSPVEKPRLITLHVLDKEYLEVDKDSVVIGRDYDQRVHLKVNNLESTNKNVFFEVIQEPGKDSLMLGFVGRGSHYEDEFKTQLISPGNFRYFDLLIHSAQTKKLKHTL

SEQ ID NO: 24765 - DNA, 660 bp, Unknown
  Obtained from environmental sample
  misc_feature (1)..(660): n is a, c, g, or t
gtgtttttagggtttaatgctttaaatgaagcagaagaaaaaataatacaacaactactacataataaattagcaaccatttattgggacactgacaagcaatttatgaataataaaattcatgacgctggattgtttttaagacaacacaaaaacaaatggagctattttaatgatcatgattttaactggatcaacgaccattactcatctcaaaaaaacattaatatttttggtgtaccaaaaaatataggtcaagcaaaagcaataggaacaatactacaggatttaagtaaaaacgatgccagtttaaaaaatacagctgtagttttaggtgacgaaaacttattaattcccgtattaaattccgtaccagaatccgtttcgacgttaaatataaccatgggatttcctttaaaaaccatcccattagcttctttatttgaacatattttcactttacataaaaagcatgctaatccgttttattacaaggatgttataagtataatttctcatcaatacatacaaccattatttaaaaacgataacgctattaatgttatagagctaatcaataaaaacaatttagtttatctaacagaagctcaaatatcagccttagctcaagacaataaagcgttagtgtcactatgttag

SEQ ID NO: 24766 - protein, 219 aa, Unknown
  Obtained from environmental sample
  misc_feature (1)..(219): Xaa is any amino acid
MFLGFNALNEAEEKIIQQLLHNKLATIYWDTDKQFMNNKIHDAGLFLRQHKNKWSYFNDHDFNWINDHYSSQKNINIFGVPKNIGQAKAIGTILQDLSKNDASLKNTAVVLGDENLLIPVLNSVPESVSTLNITMGFPLKTIPLASLFEHIFTLHKKHANPFYYKDVISIISHQYIQPLFKNDNAINVIELINKNNLVYLTEAQISALAQDNKALVSLC

SEQ ID NO: 24767 - DNA, 561 bp, Unknown
  Obtained from environmental sample
  misc_feature (1)..(561): n is a, c, g, or t
atgaaatttaaaataggagatacagtagatgttttggatgatgttttatctggaattgtaaccttaataaaaggagatgttgttactattgaaaccaatgaaggttttgatttggattttaatgcttcagagctagtgaaaattaaatcttctacgttgagagataatatttttgactcggcttccattaacgaagttttatctgaaaaaactgagaaaaagcgtcattctaccacaagagttaaagctaaagagcgttatcaacctaccatggaagtggatttgcatttgcaccatttagtggataatgaaagaggcatgacaagctacgacaaactgtcaatacagttagatactgcaagacaacaattagaatttgcgataagaaaacgcatccaaaaaattgtttttattcatggcgttggagaaggtgtcttaaaaatggaattagaaaccctatttagcagatacgataacgtaaagtactatgaagccgattataaaaagtatggtttaggtgcaacagaagtatatatcttacaaaacccaaatacaaattaa

SEQ ID NO: 24768 - protein, 186 aa, Unknown
  Obtained from environmental sample
  misc_feature (1)..(186): Xaa is any amino acid
MKFKIGDTVDVLDDVLSGIVTLIKGDVVTIETNEGFDLDFNASELVKIKSSTLRDNIFDSASINEVLSEKTEKKRHSTTRVKAKERYQPTMEVDLHLHHLVDNERGMTSYDKLSIQLDTARQQLEFAIRKRIQKIVFIHGVGEGVLKMELETLFSRYDNVKYYEADYKKYGLGATEVYILQNPNTN

SEQ ID NO: 24769 - DNA, 630 bp, Unknown
  Obtained from environmental sample
  misc_feature (1)..(630): n is a, c, g, or t
atgaagatttttttaaaaaaattagcattcttttttattcctattatactctatgtgataatagttttatccttagatatttttaaaatttttaaagattataataactattataatcaagacatcactactttaaatagaacttacgtatcaacaaagatttttcaaaaaaataaagacagtgtaaattatgatagctttatttttggtagctcaagatctcaagcctttaaaactccaatctggaagcactatttaccagaaaaatcgattccgtttcattatgatgcacatagcgaagatttatatggtatttataaaaaattagaatttttagacgatgtaaattcaccaataaaccatgctttaattattattgatagagccgtattgtctggcaccataaaaagactaaatcacctatacattaacccagtggagtttaatgatgtttcaaaatacgaattttatagcagttttattttagcaaatcttaatccacgatttatgatggcatacgccgatttttactgttttaaaacgtatagaaattatatgaaaaattatgtacgtatggacaaatatccagatacgtttacaccaattttatatgactcttattacggatag

SEQ ID NO: 24770 - protein, 209 aa, Unknown
  Obtained from environmental sample
  misc_feature (1)..(209): Xaa is any amino acid
MKIFLKKLAFFFIPIILYVIIVLSLDIFKIFKDYNNYYNQDITTLNRTYVSTKIFQKNKDSVNYDSFIFGSSRSQAFKTPIWKHYLPEKSIPFHYDAHSEDLYGIYKKLEFLDDVNSPINHALIIIDRAVLSGTIKRLNHLYINPVEFNDVSKYEFYSSFILANLNPRFMMAYADFYCFKTYRNYMKNYVRMDKYPDTFTPILYDSYYG

SEQ ID NO: 24771 - DNA, 642 bp, Unknown
  Obtained from environmental sample
  misc_feature (1)..(642): n is a, c, g, or t
atgaaaaatatactaatactatctccacataccgacgatgctgaactaggttgtggtgcaacgattgcgagatttattgaagagggaagaaatattttatgggtagtattttctactgcagaagaatcattaccaaaagatatgtcggcaaatacattagaattagagtttattgatgtcattaataaactaaatatccctaaggaaaatgcaataataaattattttaaagttcgatatttacatgaaaagcgtcaagaaatacttgaattgttagttaaaataagaaattcttttgatccggatctcgttatcggaccgtccttaaatgattttcatcaagaccatcaaattgttgcaaacgaaatggttagggcctttaagtcaagctcaagtataattagttacgagctgccttggaatcatattacatttaacacacagtgtttttacaaagttgaaaaaagacatattaaaaaaaagatagagattttaaaatcatacaagtctcaactattaaagaataggtcttacttttctgatgaatttataagaggattggcgtgtactagaggaattcaggtaaattcaccctatgctgaggcttttgaagtaataaaatggattaattattttttatga

SEQ ID NO: 24772 - protein, 213 aa, Unknown
  Obtained from environmental sample
  DOMAIN (5)...(127): Uncharacterised LmbE-like protein, COG2120
  misc_feature (1)..(213): Xaa is any amino acid
MKNILILSPHTDDAELGCGATIARFIEEGRNILWVVFSTAEESLPKDMSANTLELEFIDVINKLNIPKENAIINYFKVRYLHEKRQEILELLVKIRNSFDPDLVIGPSLNDFHQDHQIVANEMVRAFKSSSSIISYELPWNHITFNTQCFYKVEKRHIKKKIEILKSYKSQLLKNRSYFSDEFIRGLACTRGIQVNSPYAEAFEVIKWINYFL

SEQ ID NO: 24773 - DNA, 483 bp, Unknown
  Obtained from environmental sample
  misc_feature (1)..(483): n is a, c, g, or t
atgatggattttacaatatcaatatatattgaactattaaaaagtttaaagtcaaaaggttatcattttcaaacttttgaagaatttttgacaaagccggcaaagaaaagtcttgttttaagacatgatgttgatttattgccttataattctcttcgatttgccaaaattcaaagtgatcttggaataaagggaacctattatttcagggctgtaccagaaagttggaatgaagaagtaattacaagcatatcaaaaattgggcacgagataggttatcattatgaatgtttaaccacgtgcaaaggaaatattaaagaaagtattaaagattttgaaaaaaatcttctcgcacttagaaaacttgctccagtttgtactatttgtatgcatggaagccctatgtctaagtttgactcaaaagatttgtggaataagtatgattatcgaaattatgatattattggagaacccatactttga

SEQ ID NO: 24774 - protein, 160 aa, Unknown
  Obtained from environmental sample
  misc_feature (1)..(160): Xaa is any amino acid
MMDFTISIYIELLKSLKSKGYHFQTFEEFLTKPAKKSLVLRHDVDLLPYNSLRFAKIQSDLGIKGTYYFRAVPESWNEEVITSISKIGHEIGYHYECLTTCKGNIKESIKDFEKNLLALRKLAPVCTICMHGSPMSKFDSKDLWNKYDYRNYDIIGEPIL

SEQ ID NO: 24775 - DNA, 420 bp, Unknown
  Obtained from environmental sample
  misc_feature (1)..(420): n is a, c, g, or t
atgattttaataaattcgtttaaattaccaaattgcattgttatcagagctctaaaacatattaggaatcataagatggataataaaataccgttattttcagaattagaagcaacgattaacgaattaattttgcttaacaaatctataatcgtattaacaaacggtaatgtccagcaacaaaagaataaaatgaatcaaatagattggaaagaaatcaaaaaattaaattttgttttcgctaatgagatagccccaaaaccttctccggagagtgttttttctattttgaaagaatcacgttgtgaacgtgaaagaactttatttattggtgattcggaggttgatatgcagtgcgcaaaagctgccagaattgattttctcaatgtgaatattatattaaataaaacaataatataa

SEQ ID NO: 24776 - protein, 139 aa, Unknown
  Obtained from environmental sample
  misc_feature (1)..(139): Xaa is any amino acid
MILINSFKLPNCIVIRALKHIRNHKMDNKIPLFSELEATINELILLNKSIIVLTNGNVQQQKNKMNQIDWKEIKKLNFVFANEIAPKPSPESVFSILKESRCERERTLFIGDSEVDMQCAKAARIDFLNVNIILNKTII

SEQ ID NO: 24777 - DNA, 579 bp, Unknown
  Obtained from environmental sample
  misc_feature (1)..(579): n is a, c, g, or t
atgtctttatataagaaattcctcttggtgacagtaatatcattttgctgtattttttcttcatgtaccagtgaagataatgttgaaatattaacaatcaaagtaaatcattttaaacaatcagggttaggtttttatccgggattattttttttgacccaaacagaagatgagtttggtaataatgattggggcttattttttgatggcattaaaggatttgaatatgaactcggttatgtttataccttaaaagttgaaaagcatattatcgaaaatccatctgcagatggttcttcgtttgaaattcgattaattgatgtgaaatcaaaagagcaggtatctcctgacacaacttttgaaattctactattaaggaaatatgacacctccaatttagactcattcataactggagatctacaatcaggatttatattattggatcaaactaaaattgattgtgagggcatgtgtaatgatctgttagaaaggttaaaacttaatgaagaacttacaggggtatttaagcatcaatcagctggcgtattaaaattagtggaattaaaaaataattga

SEQ ID NO: 24778 - protein, 192 aa, Unknown
  Obtained from environmental sample
  misc_feature (1)..(192): Xaa is any amino acid
MSLYKKFLLVTVISFCCIFSSCTSEDNVEILTIKVNHFKQSGLGFYPGLFFLTQTEDEFGNNDWGLFFDGIKGFEYELGYVYTLKVEKHIIENPSADGSSFEIRLIDVKSKEQVSPDTTFEILLLRKYDTSNLDSFITGDLQSGFILLDQTKIDCEGMCNDLLERLKLNEELTGVFKHQSAGVLKLVELKNN

SEQ ID NO: 24779 - DNA, 789 bp, Unknown
  Obtained from environmental sample
  misc_feature (1)..(789): n is a, c, g, or t
atgtacagttatttagattataagaacattaaaattagataccgatctgaaggtaagggcggggctgtagtgtttttgcatggttttttagaaaacctaacgatgtggaatccctttatgactgaattagcaacgaaaaatcgtatcgtgactattgatctcttaggtcatggtcagaccggttgcttaggctacgtgcatacaatggaacagcaggcagctatcgtagatgctgtactgaatcatttacgtttacgaaaatttatattggttggtcatagtatgggtggatatgttgctcttacattggcagaaatgaatcccgaaagaatcaaaggtttatgcttgatgaattcaactgctttgcctgattctgttgaaaaaaagaaaaaccgtgacagggctataaaagctgttaagcacaataaaaaaacatttattaaagttgcgattcccaatttattttctgaagcaaataaatcagttcacagaaaagaaatctctgaaattattgaagaagcgttgcaaataccaacacaaggtgttatcgcttcattggaaggcatgaagatcagaaaagatcaaaccaaagtgcttaaaatgaatactttcaataaaatgctggtgattggtaaacaggatccggcattaaaatatgaatcattgattaaacaggtgaagaacacgaacgtaaaagtggccgaatttccagacgggcacatgagccacatagaaaacaagacagaattatttcacaccattcggaaatttatttggtcttgtaaataa

SEQ ID NO: 24780 - protein, 262 aa, Unknown
  Obtained from environmental sample
  DOMAIN (13)...(242): Ndr family
  misc_feature (1)..(262): Xaa is any amino acid
MYSYLDYKNIKIRYRSEGKGGAVVFLHGFLENLTMWNPFMTELATKNRIVTIDLLGHGQTGCLGYVHTMEQQAAIVDAVLNHLRLRKFILVGHSMGGYVALTLAEMNPERIKGLCLMNSTALPDSVEKKKNRDRAIKAVKHNKKTFIKVAIPNLFSEANKSVHRKEISEIIEEALQIPTQGVIASLEGMKIRKDQTKVLKMNTFNKMLVIGKQDPALKYESLIKQVKNTNVKVAEFPDGHMSHIENKTELFHTIRKFIWSCK

SEQ ID NO: 24781 - DNA, 846 bp, Unknown
  Obtained from environmental sample
  misc_feature (1)..(846): n is a, c, g, or t
atggcctctctttacggttgtattcttgattcactcacaagcgtttcactatttcttcaacctaaaaaattgaaagtcattgtatttgatgttggtcagggagatgcctcattaattcaaacccctaacggaaaaaatattcttatcgacgcgggtgtatggagtcccaactcaaactcaggaagacaaattttgcttccatactttaaagaaaataatatcacaaaactcgatgctgtattcctttcgcatcctcatgcagaccatattggcggaattcttgacctcattattggtattaaaatagatgctatttataattccggttatgagtatgattctaagctttatcaaaactatatacacttagctagcgaaaagaaaatccctataaattctctaaaagctggacaggaagttaaaattgatgaaagtatcctgattttaacgctcggtcccgaaggtcaaaaattcaacaacgatcccaatcagcattccgtggttctcaatctcatctataaggaaaatgaatttttattcactggagatgccggcgaagatcaggaacaaagattattcgaaaattatggtgctcttctagataccgatttcttaaaagttggtcatcatggtagcagaactagttctgaactcttttttttgaatgaagtaactcctgagatagctgtagtttctgttgcgaacaaaaacagatttcgccatcctcatncagaggcaattcaacgattgaaatctactaatgctgacatctactttactggaagagacaaagctttaatctttgaaagtgatggcaaaaagatcaaacgaattttctgggattga

SEQ ID NO: 24782 - protein, 281 aa, Unknown
  Obtained from environmental sample
  DOMAIN (33)...(236): Metallo-beta-lactamase superfamily
  misc_feature (1)..(281): Xaa is any amino acid
MASLYGCILDSLTSVSLFLQPKKLKVIVFDVGQGDASLIQTPNGKNILIDAGVWSPNSNSGRQILLPYFKENNITKLDAVFLSHPHADHIGGILDLIIGIKIDAIYNSGYEYDSKLYQNYIHLASEKKIPINSLKAGQEVKIDESILILTLGPEGQKFNNDPNQHSVVLNLIYKENEFLFTGDAGEDQEQRLFENYGALLDTDFLKVGHHGSRTSSELFFLNEVTPEIAVVSVANKNRFRHPHXEAIQRLKSTNADIYFTGRDKALIFESDGKKIKRIFWD

SEQ ID NO: 24783 - DNA, 333 bp, Unknown
  Obtained from environmental sample
  misc_feature (1)..(333): n is a, c, g, or t
atggggcataaacctgagcaccatgcacttttccattcaaagaaaaaacttataaccacagcaaaaacacccaatgatagtattaatatagctgttgcaatcccacttgtgttaaaaaaaacatgtctaagaggtacaattacaaatagcagtattatagcaattaagtttaatttaccgttttgtgaaatagtcagttttcttctttttgaaagtttcatatgttttaagaacagtgatgttgacgccatagggcaaacatttctccataatccaactccaactactagaaggagtggagctaccggaattaagatattccaaaataaatga

SEQ ID NO: 24784 - protein, 110 aa, Unknown
  Obtained from environmental sample
  misc_feature (1)..(110): Xaa is any amino acid
MGHKPEHHALFHSKKKLITTAKTPNDSINIAVAIPLVLKKTCLRGTITNSSIIAIKFNLPFCEIVSFLLFESFICFKNSDVDAIGQTFLHNPTPTTRRSGATGIKIFQNK

SEQ ID NO: 24785 - DNA, 303 bp, Unknown
  Obtained from environmental sample
  misc_feature (1)..(303): n is a, c, g, or t
ttgtttaaagtgcctcaggtagtttgctacaaaggtagttgggtgtcttaccaaattggtaaacgagtagtaaaactagattatattagcttagtaaacttaattttggataaagaggttgtaaccgaattaattcagggtgactttaacactaaacgtctaaaaaaagagttagatactatactagatagctatgaacgtactaaatattttatgagttattattacttagaaaaaaaattaggtggaaaaggtgctagtgaaaacacagctgaactgatatacaattacatacacgattaa

SEQ ID NO: 24786 - protein, 100 aa, Unknown
  Obtained from environmental sample
  misc_feature (1)..(100): Xaa is any amino acid
MFKVPQVVCYKGSWVSYQIGKRVVKLDYISLVNLILDKEVVTELIQGDFNTKRLKKELDTILDSYERTKYFMSYYYLEKKLGGKGASENTAELIYNYIHD

SEQ ID NO: 24787 - DNA, 909 bp, Unknown
  Obtained from environmental sample
  misc_feature (1)..(909): n is a, c, g, or t
atggatattggtatattgcaaaccggagcacaaaatataccaatatacccaaccattagtgctgacgattacgaatatgtattaaatcatagcgaatcgattttatgttttgtttccgatattgaagtgttaaataaaataaacaccgtaaaagacaaaacaaatcttaaagacgtatattcttttgatgtgattgaaggttgtaaacattactcagaactattttccttgggtgaagatgatagtaaccaagctgaactagataaaagaaaaaaagaggtacttccttctgatttagccaccataatttatacctctggcactacaggaaaaccaaaaggggtaatgttgtctcacaataatatagtaagcaatgccttggatagtactcctagattaccattaacaaaaggtaaaactaaagttttaagtttccttcctatttgccacattttcgaacgagtattaatttatatataccaatatgcaggtattagtatttattatgcagaaggcttggacaaaattggtgaaaatttaaaagaggttaaacctaacttaatgagtgttgttccaaggttagtagaaaaattatttgataaaatttatgtcaaaggagatgaattatcaggtataaaaaaattcctgttttattgngcagtacatttagctgaaaagtatgagctctatggggccaatggctggtggtacggattgaagcttaaaattgccagaaaactcatttttagcaagtggcaagaagccttaggaggagagttaaccaccatggttttcggtagtgctgcattgcacccaagattatcacgtatattttgtgctgccggtatgtatataatggaaggatatggtttaactgaaacttctccggtcctatcggtaggtatgtaa

SEQ ID NO: 24788 - protein, 302 aa, Unknown
  Obtained from environmental sample
  misc_feature (1)..(302): Xaa is any amino acid
MDIGILQTGAQNIPIYPTISADDYEYVLNHSESILCFVSDIEVLNKINTVKDKTNLKDVYSFDVIEGCKHYSELFSLGEDDSNQAELDKRKKEVLPSDLATIIYTSGTTGKPKGVMLSHNNIVSNALDSTPRLPLTKGKTKVLSFLPICHIFERVLIYIYQYAGISIYYAEGLDKIGENLKEVKPNLMSVVPRLVEKLFDKIYVKGDELSGIKKFLFYXAVHLAEKYELYGANGWWYGLKLKIARKLIFSKWQEALGGELTTMVFGSAALHPRLSRIFCAAGMYIMEGYGLTETSPVLSVGM

SEQ ID NO: 24789 - DNA, 339 bp, Unknown
  Obtained from environmental sample
  misc_feature (1)..(339): n is a, c, g, or t
atgttctacgtcagtgcagactacggcaaacttgcagcaatgtattcggatgatgcaaaaatatttccaaccggagatgatataataatggggcaggaggcaataaagaaaaaatggaccttaccaaaaggagcaaaagtactttcccataaggttgcccccagagagattaaaatcattgacgactacgcttacgactatgggtattatgaaggaagttctacaaacaaagatggtgtattttcaaattggaaaggtaaatacgtgatcgtttggaaaaaggtagattctaattggaaaatttatcttgatatttggaacaggataaataatgattaa

SEQ ID NO: 24790 - protein, 112 aa, Unknown
  Obtained from environmental sample
  misc_feature (1)..(112): Xaa is any amino acid
MFYVSADYGKLAAMYSDDAKIFPTGDDIIMGQEAIKKKWTLPKGAKVLSHKVAPREIKIIDDYAYDYGYYEGSSTNKDGVFSNWKGKYVIVWKKVDSNWKIYLDIWNRINND

SEQ ID NO: 24791 - DNA, 375 bp, Unknown
  Obtained from environmental sample
  misc_feature (1)..(375): n is a, c, g, or t
atgaaatacttagcaaacggntctaaaaacagtagtacgaaacaaagtaatgtggccaacattaacagctctatatactattctttaaaaggtcggacagatcaatacttgccaattcctgtttatttatgtgatgcagaaggtaaaattgtagttaatataaccgtaaatagtaatggtactggttatagaatgcatattatcacaatggctttcaactttctaaaaaatggcaggttttacaaagaaacctggcttttccaaataatgcctaaaggaccccctaaagttttagttaccctccacccaaaaaatcaaaaggcaattttgggaaccctttttaccatttttccggtttttaaccgggaaaaatag

SEQ ID NO: 24792 - protein, 124 aa, Unknown
  Obtained from environmental sample
  misc_feature (1)..(124): Xaa is any amino acid
MKYLANGSKNSSTKQSNVANINSSIYYSLKGRTDQYLPIPVYLCDAEGKIVVNITVNSNGTGYRMHIITMAFNFLKNGRFYKETWLFQIMPKGPPKVLVTLHPKNQKAILGTLFTIFPVFNREK

SEQ ID NO: 24793 - DNA, 474 bp, Unknown
  Obtained from environmental sample
  misc_feature (1)..(474): n is a, c, g, or t
ttgtgtttcgtaaaaattaaaattatgagtaattctcttgaaaaccaagaagtagttaaaaaagtttttacctcttatctgcaagagcataaacacagaaaaacacctgaacgttatgctatactccaagaaatttataatgctgatgagcattttgatatagaatcgctctatattaaaatgaaaaacaaaaattatagagtaagtagagcaactttgtacaatacaatcgatttattattagactgtaatttggttcgtaaacatcaatttgatgggcaatctatggctcgttacgaaaaaagttatttcgataaaaatcacgatcatgtaatttttacagatactggagaagtaaaagagttctgtgatccaagaattcaaattatcaaaaaaacaattgaagatatttttgatattgatattcaaaatcattccctttatttttacggaacaactaagaaaaaagaataa

SEQ ID NO: 24794 - protein, 157 aa, Unknown
  Obtained from environmental sample
  DOMAIN (29)...(150): Ferric uptake regulator family
  misc_feature (1)..(157): Xaa is any amino acid
MCFVKIKIMSNSLENQEVVKKVFTSYLQEHKHRKTPERYAILQEIYNADEHFDIESLYIKMKNKNYRVSRATLYNTIDLLLDCNLVRKHQFDGQSMARYEKSYFDKNHDHVIFTDTGEVKEFCDPRIQIIKKTIEDIFDIDIQNHSLYFYGTTKKKE

SEQ ID NO: 24795 - DNA, 375 bp, Unknown
  Obtained from environmental sample
  misc_feature (1)..(375): n is a, c, g, or t
ttggtggctatctgggttatgggagggggcgcccagggaaaaatccccatccagatgggatcgattactcggcatacaaaattcaggcatccggaagagtatatgaagcaggctttagataatcaggcgaggtctactgaaaagctattaaaaaaagaagatactacttttgagtttatgttgaatattgcacgtttgaaacatggctttacggcagaactttttgaacaaaggacttggttagctttctctgaaatagaagaaaaaatacaatctttaatagaagatgacttgatcctgagtagtaaccgtttttacaaacctagtgagaaaggttatctatttgtaaacgatattgttgatcgttttttgtga

SEQ ID NO: 24796 - protein, 124 aa, Unknown
  Obtained from environmental sample
  DOMAIN (1)...(114): HemN C-terminal region
  misc_feature (1)..(124): Xaa is any amino acid
MVAIWVMGGGAQGKIPIQMGSITRHTKFRHPEEYMKQALDNQARSTEKLLKKEDTTFEFMLNIARLKHGFTAELFEQRTWLAFSEIEEKIQSLIEDDLILSSNRFYKPSEKGYLFVNDIVDRFL

SEQ ID NO: 24797 - DNA, 804 bp, Unknown
  Obtained from environmental sample
  misc_feature (1)..(804): n is a, c, g, or t
atggtggtcaaaaaagacaccattgtttatctaacagataaatttgtaacaggcgaagaacgtaaacttaaagatgtccttaaaaaattaccaggtgtagacgtggatcgtagcggtaatgtcacagttaatggtactaaagtcactaaagttttagtagaaaataaaaccttttttacaggagacagtaaactagcggttaataatattcctgcagatgcagtagataaagttgaggttttagacaattacaatgatgtcgcaatgttaaaaggcttgcaagatagcgatgacatggctttaaacattaagttaaaagaggacaagaaaaaatttatgtttggagatattgaagctggagcaggcgtaaaagaccgctacgtagtgcatccaagtattttttattacagccctaaaaccaatgtaaacattattggtgaccttaataacactggtgtcaaaagttttactattaaagattatttagagtttgaaggaggtataggtaaattgttaagcgatgcaggaaactattttaaactatatcgcagtgattttgcccaatttttagacaatcaagattataagtctagtgccaaccaatttggcgcttttaatatcaggcaatccattaaccaggttacagaattaagcgcttatacgattgttaataacgaaaaaaacaccactgcaagtaatacccataatacctatcaaaatattgacaaccattttacggaccaacgtttgctaataatgcggtggataatttttttacataggaaaagtaactttagagtttaa

SEQ ID NO: 24798 - protein, 267 aa, Unknown
  Obtained from environmental sample
  misc_feature (1)..(267): Xaa is any amino acid
MVVKKDTIVYLTDKFVTGEERKLKDVLKKLPGVDVDRSGNVTVNGTKVTKVLVENKTFFTGDSKLAVNNIPADAVDKVEVLDNYNDVAMLKGLQDSDDMALNIKLKEDKKKFMFGDIEAGAGVKDRYVVHPSIFYYSPKTNVNIIGDLNNTGVKSFTIKDYLEFEGGIGKLLSDAGNYFKLYRSDFAQFLDNQDYKSSANQFGAFNIRQSINQVTELSAYTIVNNEKNTTASNTHNTYQNIDNHFTDQRLLIMRWIIFLHRKSNFRV

SEQ ID NO: 24799 - DNA, 600 bp, Unknown
  Obtained from environmental sample
  misc_feature (1)..(600): n is a, c, g, or t
ttgagaaaaacattgaaattcatattaaaattagtaatcggaataataatttggttgatgttggtcgaaatccaatggacattttttgacagtcattctatcgaaaatttgattttcatagctctcggaatttcccttctactattgattataaaaggaatttattggctttttaaaaagaggcagattttgaaattcgcaccttttggaactttatacttttttgctttttcaataactatgattctaacaaacgtagcttatggaaaaatagccgaaaatcagttctttgaactaatagaagatattgagaaatatagaatcgacaaagggcatatcccaaaaaaactatctgatttaccaagtaaacacactaatgtttacgggctaattccgcacgaatttatttacgaaggatacaaaccgtttgtgtggaatggtatcggatttgacgaaagcgaaattgatagcgaaacggaaaaaatagttggatacaaaacacctatgggatatacaaaataccgaatagctgacgatgaaaatgttttagaaataataaaaaaagctgatgaatttgaaaaaaatattacaaatgaataa

SEQ ID NO: 24800 - protein, 199 aa, Unknown
  Obtained from environmental sample
  misc_feature (1)..(199): Xaa is any amino acid
MRKTLKFILKLVIGIIIWLMLVEIQWTFFDSHSIENLIFIALGISLLLLIIKGIYWLFKKRQILKFAPFGTLYFFAFSITMILTNVAYGKIAENQFFELIEDIEKYRIDKGHIPKKLSDLPSKHTNVYGLIPHEFIYEGYKPFVWNGIGFDESEIDSETEKIVGYKTPMGYTKYRIADDENVLEIIKKADEFEKNITNE

SEQ ID NO: 24801 - DNA, 480 bp, Unknown
  Obtained from environmental sample
  misc_feature (1)..(480): n is a, c, g, or t
atgggaatggctacacgaatttatggctgtataactgaactagattacggacttcctaattctaaaatacagaaccgaattaatactcataatcaagttataattgaaaaattacctacgaaacctgaatggccacctttagtaagaaaaatgttttcgataactgataattctgatttctcaaatgagagtccaaattttgcttacggaggaggaataatccattttggggcaaatttaaaatctgtagaatatgaatgggacgaaatggaagtgaagtttgaaaaaccttttgtcagaactttttctggtctcacgcagaagtcatttttgaaccgaaatacccaggtgtccagacatttgaaatggaagataaaatttggcggattggataaagaaaaaagacattgggaaatgttaaaccggtttgaaaagaaattcctggggatacaaaggggaataaaagatgggataaaataa

SEQ ID NO: 24802 - protein, 159 aa, Unknown
  Obtained from environmental sample
  misc_feature (1)..(159): Xaa is any amino acid
MGMATRIYGCITELDYGLPNSKIQNRINTHNQVIIEKLPTKPEWPPLVRKMFSITDNSDFSNESPNFAYGGGIIHFGANLKSVEYEWDEMEVKFEKPFVRTFSGLTQKSFLNRNTQVSRHLKWKIKFGGLDKEKRHWEMLNRFEKKFLGIQRGIKDGIK

SEQ ID NO: 24803 - DNA, 717 bp, Unknown
  Obtained from environmental sample
  misc_feature (1)..(717): n is a, c, g, or t
atgattaaaacaccaaaacatcttgcctttattttaaaagtggatatcaaagagatacgttcaattctcaatagtatcgacaatttctatagagagaaaattgaaattaaaaaagataagtttggtaaaccaaaattagatgcaaaaggagaacctaaaaaaaggataataaatccaagcacaaaaagattaaaaataattcagactagaatacacaggaacattctgaacaaaattgaaatgccaagttatgcatttggtgctgttaaaggaaaagacaatgttgcaaatgctaaacaacatcaaggaaaaaagtataaattcacaaccgatttaaaagatttttttccatcaataacaaacaaagctgttttcaaaatgtttgtaagtcaaggattttcaccagaagtctcaagcctgcttacgaagttaacaacttataaaggtagaattcctcaaggagcaccaacttcttctactctggctaatttagttttcattaaaactggagatattttacaagaatttgcaaaagaaaacaatgcaactttcacttcattcgttgatgatatgactttttcatctgcaaaggattttaaacataaaattccacagattttagagattatcacgaacgactataaaattagtcataagaaaacgaattactctagaaatccaaatattacgggacttcacccaatgaataaccattga

SEQ ID NO: 24804 - protein, 238 aa, Unknown
  Obtained from environmental sample
  DOMAIN (28)...(234): Reverse transcriptase (RNA-dependent DNA polymerase)
  misc_feature (1)..(238): Xaa is any amino acid
MIKTPKHLAFILKVDIKEIRSILNSIDNFYREKIEIKKDKFGKPKLDAKGEPKKRIINPSTKRLKIIQTRIHRNILNKIEMPSYAFGAVKGKDNVANAKQHQGKKYKFTTDLKDFFPSITNKAVFKMFVSQGFSPEVSSLLTKLTTYKGRIPQGAPTSSTLANLVFIKTGDILQEFAKENNATFTSFVDDMTFSSAKDFKHKIPQILEIITNDYKISHKKTNYSRNPNITGLHPMNNH

SEQ ID NO: 24805 - DNA, 651 bp, Unknown
  Obtained from environmental sample
  misc_feature (1)..(651): n is a, c, g, or t
ttgaaaaagaacaaatccatttttgcctcaaaatacaaacttaaaaaagccttatacgaattgggacctacagggtttccttttgaacgttttgtggcagccatcttggaatattcgggttacacgacacgtgtagatgaaataatgaacggcatctgcgttacccatgaaattgacgtaattgctgaaaaaaatggaacagtcactgtcatcgaatgtaaattccattcagaagagggtcgcaattgcaatgttaaaatccccctctatatccactccagatataatgatgtaaaagcgcattgggccaccaagaaaaatgaaaataggaaacttgataatggttggttagtaaccaatacccgttttactggagatgccattgcctatggcaaatgcgcgggcctttatctattaagttgggacctccctttaaaggacggacttaaggaccgcattgatcgtttagggctatatcccattacggtgtccgccctactcactaatagggaaaaacagtttctgttgagtagggatattgtgctatgcagacaattatggaaggataaattctatttggatcatttaggcatctcccaatccagaaaggaaaaaattctggatgaaattaaacaactctgtaatcactag

SEQ ID NO: 24806 - protein, 216 aa, Unknown
  Obtained from environmental sample
  misc_feature (1)..(216): Xaa is any amino acid
MKKNKSIFASKYKLKKALYELGPTGFPFERFVAAILEYSGYTTRVDEIMNGICVTHEIDVIAEKNGTVTVIECKFHSEEGRNCNVKIPLYIHSRYNDVKAHWATKKNENRKLDNGWLVTNTRFTGDAIAYGKCAGLYLLSWDLPLKDGLKDRIDRLGLYPITVSALLTNREKQFLLSRDIVLCRQLWKDKFYLDHLGISQSRKEKILDEIKQLCNH

SEQ ID NO: 24807 - DNA, 327 bp, Unknown
  Obtained from environmental sample
  misc_feature (1)..(327): n is a, c, g, or t
ttgaactatttgatagagatagccaagatgcaccaagcgtccataagcgttttgcattttaaaaaggaaactaacttggacgaggaccaagagaccaacaaacaactcttggatgatattttgataaacgtgggccatagctttcacacccttacggataaagatgtagcccgaggaataacttcttttgtggagagcagaaacagcgatatgatcgcgttcatcaacaagaaacatttcctttttaacagtatattttctaagccattggtcaaagcaattggctatgatgctacagttcctattttggctttaaacaaatcttaa

SEQ ID NO: 24808 - protein, 108 aa, Unknown
  Obtained from environmental sample
  misc_feature (1)..(108): Xaa is any amino acid
MNYLIEIAKMHQASISVLHFKKETNLDEDQETNKQLLDDILINVGHSFHTLTDKDVARGITSFVESRNSDMIAFINKKHFLFNSIFSKPLVKAIGYDATVPILALNKS

SEQ ID NO: 24809 - DNA, 891 bp, Unknown
  Obtained from environmental sample
  misc_feature (1)..(891): n is a, c, g, or t
ttgctggtgaagaagacattctttggcaaggaaaaaccattgtattttgcaaaaacttcgggcacaacatctggcgcaaaatatattccaattaccaaagaatcgatgccaacacatattaaagcagcaaaaaatgctttgttgttttatatcaaagaaaaaaatgatgcaagttttgtggatggtaaaatgatttttttacaaggaagtcctgttttgcaagataaaaatggcgttaaattgggcagattaagtggaattgttgcacattatgttcctcaatatttactaaaaaacaggttgccaagttgggaaaccaactgtatagaagattgggatactaaagttaatgccattgttgaagaaaccgtaaacgaagatttgtctgtaattagcggaattccttcttgggtacaaatgtattttgaaaaactgattgaaaaaacaagaaaaccgatttcagaaacgtttccaaattttaatttctttatttatggtggtgtaaattttgaaccttataagaataagtttgaaagcttaattggtaaaaaaattgattatatagaattatatcctgcttctgaaggttttattgcctatcaagattcgcaaactgaaaaaggaatgttgttacaattagattctggaattttctatgaatttattcctgcaactgagttttttgatgaaaacccaacaagaatttctttaaaagatgtaaaaatcggcgtaaattatgtcatcattctaaatactactgctggtttatgggggtataatattggtgatactgtagaatttacatcaacaaaaccctacagaataaaagttacaggacgtataaaacattttatatctgcttttggcgaacatgttatggcaaggaagtag

SEQ ID NO: 24810 - protein, 296 aa, Unknown
  Obtained from environmental sample
  misc_feature (1)..(296): Xaa is any amino acid
MLVKKTFFGKEKPLYFAKTSGTTSGAKYIPITKESMPTHIKAAKNALLFYIKEKNDASFVDGKMIFLQGSPVLQDKNGVKLGRLSGIVAHYVPQYLLKNRLPSWETNCIEDWDTKVNAIVEETVNEDLSVISGIPSWVQMYFEKLIEKTRKPISETFPNFNFFIYGGVNFEPYKNKFESLIGKKIDYIELYPASEGFIAYQDSQTEKGMLLQLDSGIFYEFIPATEFFDENPTRISLKDVKIGVNYVIILNTTAGLWGYNIGDTVEFTSTKPYRIKVTGRIKHFISAFGEHVMARK

SEQ ID NO: 24811 - DNA, 837 bp, Unknown
  Obtained from environmental sample
  misc_feature (1)..(837): n is a, c, g, or t
ttgataattaaattatctattcatttaaaattatcaacccaaaaacaaatagccaaagtcctttccgatttagatgccaagatagaagttaacaacaaaataaaccaagaattagaagcgatggcaaaaacgcttaatgattattggtttgtacagtttgattttcctgatgctaatggtaaaccttataaatcgtctggtggtaaaatggtttttaatgaagtgttgaaacgtgagattccagagggttgggaggtaaaagagctttctgagatatctgaattaaaagcaggaggagataaaccaaagtcattcactaaagaacaaacaaaagaaaatacgattcccatatattcaaatggtattactaatgaaggtctatatggttatacaaacgctgctaaaatcaataaggaaagtataactatttctgccagaggtacaattggttactgtgttttaagaaaaactccttttgttcctataatcaggcttatttcagttactcctaataaggctaatgaaatcacatttttatttgaatctataaaaaatttagtttttgaaaattctggttctgtacaacaacaactaacagtgccacaagtatcaaaattgaaattagtttcaccaccaaatcatttcataaaaaaatatgatttatttacaagatcaggtttaaataaaatggaaatcattaaaaaagaaaaccaaaagctctcagaacttcgtgattggttattacccatgttaatgaatgggcaggttactgttgctgaggttgagaatgagttgggtagggttgctgaggataatgtaaaatatggggatgtatga

SEQ ID NO: 24812 - protein, 278 aa, Unknown
  Obtained from environmental sample
  DOMAIN (84)...(224): Type I restriction modification DNA specificity domain
  misc_feature (1)..(278): Xaa is any amino acid
MIIKLSIHLKLSTQKQIAKVLSDLDAKIEVNNKINQELEAMAKTLNDYWFVQFDFPDANGKPYKSSGGKMVFNEVLKREIPEGWEVKELSEISELKAGGDKPKSFTKEQTKENTIPIYSNGITNEGLYGYTNAAKINKESITISARGTIGYCVLRKTPFVPIIRLISVTPNKANEITFLFESIKNLVFENSGSVQQQLTVPQVSKLKLVSPPNHFIKKYDLFTRSGLNKMEIIKKENQKLSELRDWLLPMLMNGQVTVAEVENELGRVAEDNVKYGDV

SEQ ID NO: 24813 - DNA, 405 bp, Unknown
  Obtained from environmental sample
  misc_feature (1)..(405): n is a, c, g, or t
atggataatagtattagtgtttgtataatagacgatgatgaagtatttcaatacactatacttcacactttagaggcgcaccaatctgtagggaaaattacaccttttactgatggggcagaagcaatgacctttattaaagcaaatatgcataaccccaaagagttaccagatgtcatttttcttgacataaatatgccggtaatggatggttacagttttatggacgagtatataaaaaccatatcactaattgaaaaaaaaatcaccatctacatattatcgtcatctgttgacttagtagattttgaaaagactaaaaaaataagtgaagtatctgattatattattaaaccaattcgagaaaatcaattaacaaaaattctatccgaaataaaaaaatga

SEQ ID NO: 24814 - protein, 134 aa, Unknown
  Obtained from environmental sample
  DOMAIN (5)...(134): Response regulator receiver domain
  misc_feature (1)..(134): Xaa is any amino acid
MDNSISVCIIDDDEVFQYTILHTLEAHQSVGKITPFTDGAEAMTFIKANMHNPKELPDVIFLDINMPVMDGYSFMDEYIKTISLIEKKITIYILSSSVDLVDFEKTKKISEVSDYIIKPIRENQLTKILSEIKK

SEQ ID NO: 24815 - DNA, 588 bp, Unknown
  Obtained from environmental sample
  misc_feature (1)..(588): n is a, c, g, or t
atggtaggatctactaatattggaggtaaacgaaatctttttaaaaactttaagtttcttaaaaacgatgatcaaaccacaacagatgtcgatgctattattaacgcttgtaataaaatgggagcttctaatacaggcgcattgattgtcattgaacgtaacaacaacttagacttcttaaccaatacaggagacgaaatgaatattttagtgtctcaacccataattgaaagtatcttttttaaaaatagcccattacacgatggagctattattattgacaataatgttgtaaaagcgacacgtgttattcttcctgttaataacgaaaaaaatattcctgagcgttttgggctacgtcatagagctgctattggcatcactgaaaaaacggacgcggttgcactttgtgtaagtgaagaaacgggtcaaatctcttatattaaaaatggagaatttgaaatgtttaaaaacaccgatgaactcacgcaaaaaacttacaacgaacgactttacggttacgtcgaacttgccannaaagctggcccatannacacactaacgaagaacacccaaaaatttctgtga

SEQ ID NO: 24816 - protein, 195 aa, Unknown
  Obtained from environmental sample
  DOMAIN (33)...(154): Domain of unknown function DUF147
  misc_feature (1)..(195): Xaa is any amino acid
MVGSTNIGGKRNLFKNFKFLKNDDQTTTDVDAIINACNKMGASNTGALIVIERNNNLDFLTNTGDEMNILVSQPIIESIFFKNSPLHDGAIIIDNNVVKATRVILPVNNEKNIPERFGLRHRAAIGITEKTDAVALCVSEETGQISYIKNGEFEMFKNTDELTQKTYNERLYGYVELAXKAGPXXTLTKNTQKFL

SEQ ID NO: 24817 - DNA, 351 bp, Unknown
  Obtained from environmental sample
  misc_feature (1)..(351): n is a, c, g, or t
atgttaccgaaaaaggaggtactatgcgtttgggattatgggattgtgaaattgttagaaaacagcttagtacgttctgtttataataaaaatataattcaagaacggcacagacaccgttacgaatttaacagtgattgtaaagaccaaattgaatctgctggaatgattgcgacaggatttaaccctaaaactaagttggtggaaattgtagaaattccagatcacccttggtttgtaggcgtacaatatcatcctgaatataaaagtaccgtagcaaagccgcatcctttatttatggcatttgttatggctgctaaaaaaatgaataccgctaagaagaaaaaataa

SEQ ID NO: 24818 - protein, 116 aa, Unknown
  Obtained from environmental sample
  misc_feature (1)..(116): Xaa is any amino acid
MLPKKEVLCVWDYGIVKLLENSLVRSVYNKNIIQERHRHRYEFNSDCKDQIESAGMIATGFNPKTKLVEIVEIPDHPWFVGVQYHPEYKSTVAKPHPLFMAFVMAAKKMNTAKKKK

SEQ ID NO: 24819 - DNA, 402 bp, Unknown
  Obtained from environmental sample
  misc_feature (1)..(402): n is a, c, g, or t
gtgattgcctgtttttggcaagcttttccggataaaacaaacgcagaaattgttcaaataattaaggaatcaggtcatttgtttggaactccaactgatcatgaaggatatggtattcccgattttaaaacagcatttaatatcttagcggttaacaatattattaccaccggatttacgttttatcctaacccatttaaagataaaattcaattcaaatttaaagatgatctaactgaattgcaaatctccatatttaatatcttaggaaaaaaattatcaaatagaaaagtatctaaacaaaacccattggtaagtttaaatgatttatctgacggaatttatgttttgagagtaaatcaagaaggacgatctgattcatttaaaattataaagagataa

SEQ ID NO: 24820 - protein, 133 aa, Unknown
  Obtained from environmental sample
  misc_feature (1)..(133): Xaa is any amino acid
MIACFWQAFPDKTNAEIVQIIKESGHLFGTPTDHEGYGIPDFKTAFNILAVNNIITTGFTFYPNPFKDKIQFKFKDDLTELQISIFNILGKKLSNRKVSKQNPLVSLNDLSDGIYVLRVNQEGRSDSFKIIKR

SEQ ID NO: 24821 - DNA, 306 bp, Unknown
  Obtained from environmental sample
  misc_feature (1)..(306): n is a, c, g, or t
atgcagaagattttattaataattgtgatgtttgtatttacaattaaagtttattcacaagattcaatagtcaattatctagataaaaaaggggaaattgtttcgaaaaataacgctgttgaaattgaaacaattgttaaaaaggacacattgtggaaagtaacgaaatattttagaaatagtaaattacaaaatcaaggaccatttttaaaaccgaaaagacaanaaagataccttgtaggcaaagtttattacttttcaataaaacaaggggaaagggtttcagacgatagtaatctcatgann

SEQ ID NO: 24822 - protein, 102 aa, Unknown
  Obtained from environmental sample
  SIGNAL (1)...(19)
  misc_feature (1)..(102): Xaa is any amino acid
MQKILLIIVMFVFTIKVYSQDSIVNYLDKKGEIVSKNNAVEIETIVKKDTLWKVTKYFRNSKLQNQGPFLKPKRQXRYLVGKVYYFSIKQGERVSDDSNLMX

SEQ ID NO: 24823 - DNA, 438 bp, Unknown
  Obtained from environmental sample
  misc_feature (1)..(438): n is a, c, g, or t
atgaaaaattcaatcactttttttatactgctgctaacaataatagttagcgcgtgtaaatcgcaaaaagtagatttttcagaccgttataaatcagaaactctagctgttttaaaccaagcgttttttcctcaatttgataatcaaggattaaattataggcaaatacacgaagtagttagcagttataattacaagcgacaattaccctattttattaaaaaaattaatgattcatttgctagtagtgattttgataatcacttaaaggttacatttaaaaactggaaagttctacctataaaaaatgtaaaaattattgactcaaatgccattaatactttggatcaactaaagtatacaatgctagaagctgaagataattataacgctaataatgctgctgtcaatttaaagtctaccagatgctttgcataa

SEQ ID NO: 24824 - protein, 145 aa, Unknown
  Obtained from environmental sample
  SIGNAL (1)...(18)
  misc_feature (1)..(145): Xaa is any amino acid
MKNSITFFILLLTIIVSACKSQKVDFSDRYKSETLAVLNQAFFPQFDNQGLNYRQIHEVVSSYNYKRQLPYFIKKINDSFASSDFDNHLKVTFKNWKVLPIKNVKIIDSNAINTLDQLKYTMLEAEDNYNANNAAVNLKSTRCFA

SEQ ID NO: 24825 - DNA, 360 bp, Unknown
  Obtained from environmental sample
  misc_feature (1)..(360): n is a, c, g, or t
ttgatgaaaaaggagaaattattaataaagaacctatttgaagggattaaagcggataagaaagtttcgaaaacgggtattacatttagtaaagatcaaaaaacggtatatttttcggctgaaaaatttagaaaaaggaagaataaaaataaaccgcaattatttaaggcaactatagattcattaggaaattggatcaatatcgaaaaattatcttttaatgataagaaattttctgctggcgagcctactcgaagtaaagatggtaagaaactttattttgcttcagatagaccatcttcttatggggggactgatatttttgtagtaaatataaatgagggatggcacttacagtga

SEQ ID NO: 24826 - protein, 119 aa, Unknown
  Obtained from environmental sample
  DOMAIN (69)...(109): WD40-like Beta Propeller Repeat
  misc_feature (1)..(119): Xaa is any amino acid
MMKKEKLLIKNLFEGIKADKKVSKTGITFSKDQKTVYFSAEKFRKRKNKNKPQLFKATIDSLGNWINIEKLSFNDKKFSAGEPTRSKDGKKLYFASDRPSSYGGTDIFVVNINEGWHLQ

SEQ ID NO: 24827 - DNA, 762 bp, Unknown
  Obtained from environmental sample
  misc_feature (1)..(762): n is a, c, g, or t
gtgataattgggccacacagacgtgataatgatgattgggaagataattggataattaatgaggaaagatttaatttattaaaatgtaatgatgcgtctttgttaaattttttatgtgaaatgatacacccagtggtaagaggatatttacacgaagtggataagcttcatcgtatattcaatgatagcctgagtaatgatgggtttgaaattatcgagagaacacgtatctctaatagaccagtttttancggtagaatgaagtttacaggcaaatcatcgatcgagaaaaagggtaacgaaattaaagttatttttaacggtgattacgtttctcaacagattaatttaatggaatcgtcaattgaaacttctccttatcaggctataggagtagcgaaggagttgattgaaactgcttgtaagtcaatatttaaagataggcaagaagagtatgataaaaactgggatttatctaaattaatgaaagaaacgactaagctgcttaaaattacgcctgatgatatatctaacgaagcaaaagcggcaaggtcaataagacagattttaggtagtttatccgctgtcgtacaaggaattgctgaggtgagaaacgaatatggtagcggtcatggtaaagatagtgatttcaaaggtctacaacctaggcacgctaagttagcagttggagcatcatccactttagctatatatttactggaaacacacgcaattagaaagataattaaatttagttgctaa

SEQ ID NO: 24828 - protein, 253 aa, Unknown
  Obtained from environmental sample
  misc_feature (1)..(253): Xaa is any amino acid
MIIGPHRRDNDDWEDNWIINEERFNLLKCNDASLLNFLCEMIHPVVRGYLHEVDKLHRIFNDSLSNDGFEIIERTRISNRPVFXGRMKFTGKSSIEKKGNEIKVIFNGDYVSQQINLMESSIETSPYQAIGVAKELIETACKSIFKDRQEEYDKNWDLSKLMKETTKLLKITPDDISNEAKAARSIRQILGSLSAVVQGIAEVRNEYGSGHGKDSDFKGLQPRHAKLAVGASSTLAIYLLETHAIRKIIKFSC

SEQ ID NO: 24829 - DNA, 303 bp, Unknown
  Obtained from environmental sample
  misc_feature (1)..(303): n is a, c, g, or t
ttgtctggcctgccgacactagtgatcaagaatcggtcgagtaagagcaactacattgacataggtagagtacaggtgagtctatatgttgttaaacaagataaggataaacttcttacattgtttaaatacttaaatatctctgatacattaatcacagatgaagaagtattatcacagttttcgatagataccttaaagataaagaagatggttaccgtaatggtaaaatattcttggagcacgttaaaaggttcagtacagaggagggtgaaggagaacttcacatatacaaactgttga

SEQ ID NO: 24830 - protein, 100 aa, Unknown
  Obtained from environmental sample
  misc_feature (1)..(100): Xaa is any amino acid
MSGLPTLVIKNRSSKSNYIDIGRVQVSLYVVKQDKDKLLTLFKYLNISDTLITDEEVLSQFSIDTLKIKKMVTVMVKYSWSTLKGSVQRRVKENFTYTNC

SEQ ID NO: 24831 - DNA, 303 bp, Unknown
  Obtained from environmental sample
  misc_feature (1)..(303): n is a, c, g, or t
atgattagtataagtaaattcagggtttacctcattgtttttttaattgtgtttccagcaatggtaatagggtcaaccaaatttaccaatcaaattcataaaaacatgaatcaagaattaatacagccaccatatttacaaaaaggagatacggtaatgattttagcaacagccggaattatcaatgattctactatcataaataatggtgttgaattattgaaaanttggggattgaatgtgaaattaagtaactatttatatgaacaaaagcatcattttgcaggaactgataagatanna

SEQ ID NO: 24832 - protein, 101 aa, Unknown
  Obtained from environmental sample
  misc_feature (1)..(101): Xaa is any amino acid
MISISKFRVYLIVFLIVFPAMVIGSTKFTNQIHKNMNQELIQPPYLQKGDTVMILATAGIINDSTIINNGVELLKXWGLNVKLSNYLYEQKHHFAGTDKIX

SEQ ID NO: 24833 - DNA, 555 bp, Unknown
  Obtained from environmental sample
  misc_feature (1)..(555): n is a, c, g, or t
atggaatatccatttagttatctttgtacaataagcgccttgcacaaggccagacttacaagatttcccaatattatgaagggtatatcatcaaaaaggacggcaccaaggaacgaggctatattttatatgacgatgaatctgttaggtattgaaagcgtaacctttaagaaagaacaaaaaggcaaaaaagagcgatttaaaccaaaggatatcgctggctataaagttgccgacaaggtgtatcacacagtgcaatttcaggatattccttttaagaatactaaatttttgatgttggaaaaagagggttgcttaaatatgtattcatacagaacgctttctgaaggagcatggtccaccgtaatgattttgaaaaatgacaagaaagctataaatacacagaactttattatgggttatgcagataaaatggcagaccttgtaaaagaggatcaggaattggccgctaaaattaagaataaggaaaaaggctattcgcttctaaatatagaggcaatagtagatgaatataacagcaattgtaaaaaatag

SEQ ID NO: 24834 - protein, 184 aa, Unknown
  Obtained from environmental sample
  misc_feature (1)..(184): Xaa is any amino acid
MEYPFSYLCTISALHKARLTRFPNIMKGISSKRTAPRNEAIFYMTMNLLGIESVTFKKEQKGKKERFKPKDIAGYKVADKVYHTVQFQDIPFKNTKFLMLEKEGCLNMYSYRTLSEGAWSTVMILKNDKKAINTQNFIMGYADKMADLVKEDQELAAKIKNKEKGYSLLNIEAIVDEYNSNCKK

SEQ ID NO: 24835 - DNA, 531 bp, Unknown
  Obtained from environmental sample
  misc_feature (1)..(531): n is a, c, g, or t
atgatgcacaaagttcacgatgtagtggtgaccaatccaccttttgcaagttgggatgattctaagtttgataaagagcgcatcattcagaaatattttaataaacatcgtggattagcaaaccatattcgtctggagcatttgatggctggattggcgcttcacacgatgaaagatgatggcaaagcggcaatcatcataatgggtcacatctattttggagacgatggtctctttgcaaaataccgtccgtttttcaattggttgtatcgttattacaaggtagacgatgttattaatatgaacagctacaagctctataacaagcaaggtgctgtcacaaaaacaatgttaatactcattggtggtcgtaaaactaaaccttctggagtagcaccaaataagagcgaacaaccacatttagaagatatggtagagacgtttgaagacctctggaagcaaaccagatcgcatatcaaaccaaatatcgacaccatcataaaacagcttaaaaccgcacgtacaacatga

SEQ ID NO: 24836 - protein, 176 aa, Unknown
  Obtained from environmental sample
  misc_feature (1)..(176): Xaa is any amino acid
MMHKVHDVVVTNPPFASWDDSKFDKERIIQKYFNKHRGLANHIRLEHLMAGLALHTMKDDGKAAIIIMGHIYFGDDGLFAKYRPFFNWLYRYYKVDDVINMNSYKLYNKQGAVTKTMLILIGGRKTKPSGVAPNKSEQPHLEDMVETFEDLWKQTRSHIKPNIDTIIKQLKTARTT

SEQ ID NO: 24837 - DNA, 816 bp, Unknown
  Obtained from environmental sample
  misc_feature (1)..(816): n is a, c, g, or t
ttggtggaatacgttccgaagtcaaaagcaccatatcggatgaatacgctcattcctcgtaatatggcttttgaggttcagaagtcgcttaacagtattgtgaagtcgaaagggaacattgataattatgtccgtaaccaattaaagtataaatccaccaaacaattgtggaatggattgggtgcagaacaggttgatgcagttggtttatacctgaagcaatttgagaatgagcaaggaattatcatagcagatcagacaggaataggaaaaggtcggcaggctgctgcggtgatacgacacgcagttatgaacgattatattcctgtctttttcactaagaaaccagacctctttaccgatatgtatcgtgatttgaaagcgattggctttgagaacatcagaccgtttatcgtcaacacggataccaatgccaaaattaaagatgcagatggtaatgtggtttttagtccgctgagtagttctgctcaagctgacttgatttcaaacgaaatagaattcccaacagaaagtccagaatctattgaataccataaaaagattggaaagaagttacctgatcctgataaagtcccaaccatcaaaataccgcttacattagatcatttaccattgggttatgatatgatttttgccacctactctcaagtgcaatctgcacatccatacaaacgaatgtggattgagaaaatggtaaataatggaatcgatggaagcaaaaaacacaagaagctcatcttcattctcgatgagtcgcatatgnctgtgtttcgattccctcgagccgattcttga

SEQ ID NO: 24838 - protein, 271 aa, Unknown
  Obtained from environmental sample
  misc_feature (1)..(271): Xaa is any amino acid
MVEYVPKSKAPYRMNTLIPRNMAFEVQKSLNSIVKSKGNIDNYVRNQLKYKSTKQLWNGLGAEQVDAVGLYLKQFENEQGIIIADQTGIGKGRQAAAVIRHAVMNDYIPVFFTKKPDLFTDMYRDLKAIGFENIRPFIVNTDTNAKIKDADGNVVFSPLSSSAQADLISNEIEFPTESPESIEYHKKIGKKLPDPDKVPTIKIPLTLDHLPLGYDMIFATYSQVQSAHPYKRMWIEKMVNNGIDGSKKHKKLIFILDESHMXVFRFPRADS

SEQ ID NO: 24839 - DNA, 342 bp, Unknown
  Obtained from environmental sample
  misc_feature (1)..(342): n is a, c, g, or t
atgctgaaagaaaagcataatgaaacgccaattcgattaagtaccgttgatagatttcaaggaatggaaaagaatataatcatcgtttcaatggtacgaagcaataaaatcgcatcttttcaaggacaagaatcggattatgatttgtatcccgatttaggttatccacaacaagacagcttaggttttgctcaatcaccgaaccgattaaatgttgctttatcaagagcaaggcgattactaattgtagtgggtaatagtaaacatttttgccccaaaaacccggatttaccaaaaattgggtgtttgaaactatacagcaaaaatgggacaaataattga

SEQ ID NO: 24840 - protein, 113 aa, Unknown
  Obtained from environmental sample
  misc_feature (1)..(113): Xaa is any amino acid
MLKEKHNETPIRLSTVDRFQGMEKNIIIVSMVRSNKIASFQGQESDYDLYPDLGYPQQDSLGFAQSPNRLNVALSRARRLLIVVGNSKHFCPKNPDLPKIGCLKLYSKNGTNN

SEQ ID NO: 24841 - DNA, 669 bp, Unknown
  Obtained from environmental sample
  misc_feature (1)..(669): n is a, c, g, or t
atgaaaaaaaatattgtagtaatcgctattacacttatgtcttgtggtacaactattaatgctgtttatccagaaagactatctgaaaacgatgtacttctagaaaaagaatacacaaaagaaataggtagcccaattgtcactaagggagatttcttacaacaaaaggccttaaaaataactaaaatgaaacctttcaaaattagtatgatgaatttcccttatactatcggtgaaaaactgccaatgaatggtcaaaacaatttatattatttctattacaacaacaatgcttcacaaaataatacctaccaaataggtattgctgaaaacaaaaaaaatggagattttaaagctttcacaaactcatattctggtggtttttacaccaaggaaatacctgattttgaatatgaattaacaaaagcaacacctaaggattgtgatacttgttttaaacaagaattcatatataatggtagagtcgataacgatttaaaatttgtatatcgcgaatatgtagacaatttagcacgttctagttttactcaagaattacaatatgacattaatagtagtaatataattggctttaaaggtttaagaatagaagtcttaaacacaaccaacacatcgattacctacaaagtattaagtccttttaattag

SEQ ID NO: 24842 - protein, 222 aa, Unknown
  Obtained from environmental sample
  misc_feature (1)..(222): Xaa is any amino acid
MKKNIVVIAITLMSCGTTINAVYPERLSENDVLLEKEYTKEIGSPIVTKGDFLQQKALKITKMKPFKISMMNFPYTIGEKLPMNGQNNLYYFYYNNNASQNNTYQIGIAENKKNGDFKAFTNSYSGGFYTKEIPDFEYELTKATPKDCDTCFKQEFIYNGRVDNDLKFVYREYVDNLARSSFTQELQYDINSSNIIGFKGLRIEVLNTTNTSITYKVLSPFN

SEQ ID NO: 24843 - DNA, 423 bp, Unknown
  Obtained from environmental sample
  misc_feature (1)..(423): n is a, c, g, or t
atggcaacatcagtattaaattcagtaaaaccatgtgaggtcacgattaaaagtcgtgacctttgcatggctgaatttaatgcatttaagccaccgtacaatgacgagtcaatggaagagctagccagtcttgcgactattatattggcgcaagaaaaaggaaaaagactttcaaaatatcaacttaaagatcaaataagaattgtcttccagcatgatggcattattaaattttttactcattttaaaaaagaacatggcataaaaaacacaaagattggtgattctaatgatatgagtttttcagcagcgaaattaaaagcgggcgaaatatacaaaaaagacacctctaattacacattcgaatttgtagtgaggaaacaaatagaaaactttcgggcaatttataaacatagcccctag

SEQ ID NO: 24844 - protein, 140 aa, Unknown
  Obtained from environmental sample
  misc_feature (1)..(140): Xaa is any amino acid
MATSVLNSVKPCEVTIKSRDLCMAEFNAFKPPYNDESMEELASLATIILAQEKGKRLSKYQLKDQIRIVFQHDGIIKFFTHFKKEHGIKNTKIGDSNDMSFSAAKLKAGEIYKKDTSNYTFEFVVRKQIENFRAIYKHSP

SEQ ID NO: 24845 - DNA, 444 bp, Unknown
  Obtained from environmental sample
  misc_feature (1)..(444): n is a, c, g, or t
atgcctcaatacaattctagcacttcaattagctaccttaaaggggttggtccttcacgtgcagatttgcttaaaaaggagttagggataagaacctttggcgatttaatcaatttttttccgcaccgatatattgataggactcaattttttaaaatcaatcagctcgaacaaaactctgccgaaatacaaatagtaggaaaaataacttcgataaaaacggtacaacaaaaaagagggagtaggttagttgcaaccttttctgatgcaacaggtacaatagaactggtatggtttagaggagccaaatggataaaggatactataaaggtaaatgtgccttatgtaatttttggaaagaccaactactttaatcgaagttttagtatgccacatcctgaaatggaattggtgggggaatataaaaaaaacttagaacagtga

SEQ ID NO: 24846 - protein, 147 aa, Unknown
  Obtained from environmental sample
  misc_feature (1)..(147): Xaa is any amino acid
MPQYNSSTSISYLKGVGPSRADLLKKELGIRTFGDLINFFPHRYIDRTQFFKINQLEQNSAEIQIVGKITSIKTVQQKRGSRLVATFSDATGTIELVWFRGAKWIKDTIKVNVPYVIFGKTNYFNRSFSMPHPEMELVGEYKKNLEQ

SEQ ID NO: 24847 - DNA, 471 bp, Unknown
  Obtained from environmental sample
  misc_feature (1)..(471): n is a, c, g, or t
ttggcggataaatataaaatcccaataattattaccggatttgaaccacttgatcttgtacagggaatatatatggcagtcaaacaattggaaaaagggatccacaacgttgagaatcaatattcaagagtagttcaagaagaaggaaataaagccgccattgaggttatccaaaaaatatttgaaattggtgacagagaatggagaggaattggtaaaatacctaatagtggttatgtgttaacaaaagagtttaaagattttgatgcagaattaaaatttggaatcagtaatataacagtacctgaaaatcctgattgtattgctggagagattttaagaggaattaaaaaacctcatgaatgcaatcaattcgcaaaaacatgcaatccttctaaccctttaggcgcacccatggtgtcgtcagaaggcgcatgtgcggcttactatcatttttcaaatactatatag

SEQ ID NO: 24848 - protein, 156 aa, Unknown
  Obtained from environmental sample
  DOMAIN (1)...(155): Hydrogenase formation hypA family
  misc_feature (1)..(156): Xaa is any amino acid
MADKYKIPIIITGFEPLDLVQGIYMAVKQLEKGIHNVENQYSRVVQEEGNKAAIEVIQKIFEIGDREWRGIGKIPNSGYVLTKEFKDFDAELKFGISNITVPENPDCIAGEILRGIKKPHECNQFAKTCNPSNPLGAPMVSSEGACAAYYHFSNTI

SEQ ID NO: 24849 - DNA, 582 bp, Unknown
  Obtained from environmental sample
  misc_feature (1)..(582): n is a, c, g, or t
atgatagctcttgatacatctaacccaaacaactacgaatacactacaaaatatttagaaacccacattttaggcggattaaagactaataaattagaaagtttacgagtaacgataagtatacagaaacccaaagaacataatattttaaggcataatattgatttgtacaatgataatcaggtagaaaagtttactcgaaagattgcagaacgattagaaataggaacaagcgtagcaagaagaacactacaagaacttaccaaagagttagagaattacagatttttactgattgaacaatacgaacaattacaccaaccttattttaaagaattatcaggaacagaagaaaaggaagctgtcaaatttttaaagcgaaatgatttactaaaaaagaccaatgaacttattggaaaatctggagtaatcggagaagaacacaagagacaaacaatgtntttaatcttcacttctcgcaaaacaaataatccattgcattgcatcagnttgggcagttctggagttggtaaaacacatttacaatctaaagtatcagagttgatgccagaagaagattaa

SEQ ID NO: 24850 - protein, 193 aa, Unknown
  Obtained from environmental sample
  misc_feature (1)..(193): Xaa is any amino acid
MIALDTSNPNNYEYTTKYLETHILGGLKTNKLESLRVTISIQKPKEHNILRHNIDLYNDNQVEKFTRKIAERLEIGTSVARRTLQELTKELENYRFLLIEQYEQLHQPYFKELSGTEEKEAVKFLKRNDLLKKTNELIGKSGVIGEEHKRQTMXLIFTSRKTNNPLHCIXLGSSGVGKTHLQSKVSELMPEED

SEQ ID NO: 24851 - DNA, 300 bp, Unknown
  Obtained from environmental sample
  misc_feature (1)..(300): n is a, c, g, or t
atgaaaacacctgctgcggtccataagttctccaacaggccattccccgaaaaaatccctgactttgattacgatacgcaaatgaaaattttaaaagttacccaaaatggagccattcgatggaagtcatataattgggtttacctttccgcttcgctccaaggtaaacacatcggagcgctggacattggtaatgggatttggagggtattttatagaaatgtatttttaggttactttgatgaacatgtctttagaaaaaaagaacaatcagtgaggttagaaactaatttagtgtaa

SEQ ID NO: 24852 - protein, 99 aa, Unknown
  Obtained from environmental sample
  misc_feature (1)..(99): Xaa is any amino acid
MKTPAAVHKFSNRPFPEKIPDFDYDTQMKILKVTQNGAIRWKSYNWVYLSASLQGKHIGALDIGNGIWRVFYRNVFLGYFDEHVFRKKEQSVRLETNLV

SEQ ID NO: 24853 - DNA, 300 bp, Unknown
  Obtained from environmental sample
  misc_feature (1)..(300): n is a, c, g, or t
atgcgagtattttttattaattgtttaatggtttttctacttagcagttgtacaagctacgcgcaagaagccattatctggaaaaaatttacaggtgaaattaataacccagaagtccctatgctttttgattattcttatgcaggctataagcttggagaaaaagaaataccaaaaaagtttaaagatttatctgtttttaatgtgttggattttggagccgattcaaatgatactgttttcagaccaagacgcccattcaatcagcctattcatggccgcagaaaaaaaaataaaggg

SEQ ID NO: 24854 - protein, 100 aa, Unknown
  Obtained from environmental sample
  SIGNAL (1)...(21)
  misc_feature (1)..(100): Xaa is any amino acid
MRVFFINCLMVFLLSSCTSYAQEAIIWKKFTGEINNPEVPMLFDYSYAGYKLGEKEIPKKFKDLSVFNVLDFGADSNDTVFRPRRPFNQPIHGRRKKNKG

SEQ ID NO: 24855 - DNA, 507 bp, Unknown
  Obtained from environmental sample
  misc_feature (1)..(507): n is a, c, g, or t
ttgtgttttgagctatatgatgccgcacgaaaaaacccgaatcctttactcaaacgaattaatagagaatacctaattggtgataatgttgaaattggggttgaagtttgtttttttagagatttaatttatgaaaatcaaaaaaagatagggaagtcaggtctacctcaaaaaaggacttttgatctaacaattttttcatctaaagaaattataatactagaggcgaaatccaacgaaggattccaaacaaaacagatgactgattttaaagaggacaaggataacattaaaaaactatttgatattttaaaaataaaagagaaactaaaaatttctttaattgctattcattccagtaaatacaagccttcagacaaaacaaaagattattttgaaacactcattacatgggaagaattagctcaggattattttgataaaaaggatgtctttaaacgtgcaaatgatatttatttgcaaattccggtgaaagtataccactaa

SEQ ID NO: 24856 - protein, 168 aa, Unknown
  Obtained from environmental sample
  misc_feature (1)..(168): Xaa is any amino acid
MCFELYDAARKNPNPLLKRINREYLIGDNVEIGVEVCFFRDLIYENQKKIGKSGLPQKRTFDLTIFSSKEIIILEAKSNEGFQTKQMTDFKEDKDNIKKLFDILKIKEKLKISLIAIHSSKYKPSDKTKDYFETLITWEELAQDYFDKKDVFKRANDIYLQIPVKVYH

SEQ ID NO: 24857 - DNA, 375 bp, Unknown
  Obtained from environmental sample
  misc_feature (1)..(375): n is a, c, g, or t
gtggaagataaggatagagagttattagaaaaaaaccaatcttctattatcgataaagggggatatatttttatgggcttatggaaaaaagatcccgtaggatgttttgccttgattaagaaaaccgataagcgttttgaattaggaaaaatggcagtcaataaatctcatcacggattacagataggtcaaaaattattggtgtatgccattgattttgcaaaaaacaaaaactgggaaacacttgaattatattccagcacgaagcttgacaccgcactgcatatatataagaaatacggatttattaatgttccactagaggataatttagagtatcttagatcagatattaaaatggaactaacactttaa

SEQ ID NO: 24858 - protein, 124 aa, Unknown
  Obtained from environmental sample
  DOMAIN (24)...(103): Acetyltransferase (GNAT) family
  misc_feature (1)..(124): Xaa is any amino acid
MEDKDRELLEKNQSSIIDKGGYIFMGLWKKDPVGCFALIKKTDKRFELGKMAVNKSHHGLQIGQKLLVYAIDFAKNKNWETLELYSSTKLDTALHIYKKYGFINVPLEDNLEYLRSDIKMELTL

SEQ ID NO: 24859 - DNA, 417 bp, Unknown
  Obtained from environmental sample
  misc_feature (1)..(417): n is a, c, g, or t
atgaagaaaattcttgtcatacaaaataaacgcattggtgatgtgcttatcgcatcagtaattgctcaaaatatgaaaactgtttttcctgatagtcaaattgattatctggtgtatgactttacaactggtgttattgaaaacaatccaaacattgataacattatagcagtaaatgaaaaagaattgaagcaatttaaatttatgcaacgcttgattagacgtgttaaaaaaaataactatgatattatttttgacccttactctaaattacaaagtcggattatttgttatttttctggcgctagcatgcgaataggttttcagaaaagaggtaaaaacccttggtttaatttttacactcacactgtccctttattagatgaaaaaaaacatataagtggtaaaagctattga

SEQ ID NO: 24860 - protein, 138 aa, Unknown
  Obtained from environmental sample
  misc_feature (1)..(138): Xaa is any amino acid
MKKILVIQNKRIGDVLIASVIAQNMKTVFPDSQIDYLVYDFTTGVIENNPNIDNIIAVNEKELKQFKFMQRLIRRVKKNNYDIIFDPYSKLQSRIICYFSGASMRIGFQKRGKNPWFNFYTHTVPLLDEKKHISGKSY

SEQ ID NO: 24861 - DNA, 450 bp, Unknown
  Obtained from environmental sample
  misc_feature (1)..(450): n is a, c, g, or t
atgtatgacatgggttggaagcaatttgtaccatttgtagtaacagttgcaggtattgtctttagtgatttattatggggaattgttttaggtttgttagtcggaattgtagtaatattaattaaaagctaccaaaactcacactttctacacatcgaagataatagtaacggaaagcataaaattaaaatgacgtttgctgaagaagttacttttttcaataaaggtgctattttaaaagaattagatagcttaccaaaagacacgtatttagagcttgacgttagaaaaactagatatttagataacgatattatcgaaatattagaagattttgcatttaaagctaaagaaagaaatattgatattcagttaatatcagaacgtggtatagttgaaaatccagatagttttatcgagttttttaaactaagaccaaaatcagcctaa

SEQ ID NO: 24862 - protein, 149 aa, Unknown
  Obtained from environmental sample
  misc_feature (1)..(149): Xaa is any amino acid
MYDMGWKQFVPFVVTVAGIVFSDLLWGIVLGLLVGIVVILIKSYQNSHFLHIEDNSNGKHKIKMTFAEEVTFFNKGAILKELDSLPKDTYLELDVRKTRYLDNDIIEILEDFAFKAKERNIDIQLISERGIVENPDSFIEFFKLRPKSA

SEQ ID NO: 24863 - DNA, 918 bp, Unknown
  Obtained from environmental sample
  misc_feature (1)..(918): n is a, c, g, or t
gtgcaccccggggtgccggtttcggcttggccgggtgctggggattgggggtggcttcccgggttattgtgcggcgatgtggcagggatccggttgttaccgggggcgaataaagttacggctttaggaagtaacgtaaagatcggggcaattccaatgggtgactgtcagacacgtaatccggatatatgcattagagtgccattattgcacttatgcaagaattggaagctttggagatccgtaactattgggcaacgcaacagtataaagtcttttgagnttgaaggattaaaattaaatgtaaagtccttcaagatacctgacacctgtaatagttttgtatatagatatatacgtcctactaaggcaaaacggtcttttgattatgctaatagattaatagattgtggtgtatcaacgcctttccccattgcctacatagaaaacacatctatttttggattaaaatctagttattacattagtaagcatattgattatgattttgagtttagagcgttaatccataatcctcaatttccagaacgtgttaaaattttgcagcagtttgctgcatttacctttaaattgcatgagaataatattgattttttagaccattcgccaggtaatactttaataactaaaaatgctaatggttataatttctatttaattgatttaaacaggatgcgttttaaaccaatgagttttgataatcgtatgcataattttagacgtttatggttgtctaaaactatgattaagatcttggctgaagcttatgccaaattgtataacaagtcctatcaagatacctatgatttaatgcttaagcatagtcgagcatttcaactaaaaattaatagtaaaaaattaagacgtagcggaaggaaaatgcagtttaagaaataa

SEQ ID NO: 24864 - protein, 305 aa, Unknown
  Obtained from environmental sample
  misc_feature (1)..(305): Xaa is any amino acid
MHPGVPVSAWPGAGDWGWLPGLLCGDVAGIRLLPGANKVTALGSNVKIGAIPMGDCQTRNPDICIRVPLLHLCKNWKLWRSVTIGQRNSIKSFEXEGLKLNVKSFKIPDTCNSFVYRYIRPTKAKRSFDYANRLIDCGVSTPFPIAYIENTSIFGLKSSYYISKHIDYDFEFRALIHNPQFPERVKILQQFAAFTFKLHENNIDFLDHSPGNTLITKNANGYNFYLIDLNRMRFKPMSFDNRMHNFRRLWLSKTMIKILAEAYAKLYNKSYQDTYDLMLKHSRAFQLKINSKKLRRSGRKMQFKK

SEQ ID NO: 24865 - DNA, 768 bp, Unknown
  Obtained from environmental sample
  misc_feature (1)..(768): n is a, c, g, or t
ttgattatttggtgtatgactttacaactggtgttatttgaaaacaatccaaatattgataacattatagcagtaaaggaaaaagaattgaagcaatttaaatttatgcaacgcttgattagacgtgttaaaaaaaataactatgatattatttttgacccttactctaaattacaaagtcggattatttgttatttttctggcgctagcatgcgaataggttttcagaaaagaggtaaaaacccttggtttaatttttacactcacactgtccctttattagatgaaaaaaaacatataagtggtaaagctattgaagacaggataaatatgtttaactgcttttttccgttacctgaaaataaaatcgattatgaacctcacatagttttaaacgataaagagcaacaatacaacaagttagaaaaatataataagccagcaattatgctaggtattttaggtagtacgcctcaaaaatccatgccatatcaatatattgttaaattaataaatcatattacaacaacttatgatgttaatgtattatttaattatgcaccacatcaaaaagaagatgctttaaatatttacgaccaatgtcaaaataagtccaatattattattgatatttatgaagatagcattagaggttttataactttaatgaataaatgtctactactagtaggtaacgaaggtggtattgtacacatatccaaagcgttaaacaaaccaacatttacaattttttcgccttatgtttaa

SEQ ID NO: 24866 - protein, 255 aa, Unknown
  Obtained from environmental sample
  misc_feature (1)..(255): Xaa is any amino acid
MIIWCMTLQLVLFENNPNIDNIIAVKEKELKQFKFMQRLIRRVKKNNYDIIFDPYSKLQSRIICYFSGASMRIGFQKRGKNPWFNFYTHTVPLLDEKKHISGKAIEDRINMFNCFFPLPENKIDYEPHIVLNDKEQQYNKLEKYNKPAIMLGILGSTPQKSMPYQYIVKLINHITTTYDVNVLFNYAPHQKEDALNIYDQCQNKSNIIIDIYEDSIRGFITLMNKCLLLVGNEGGIVHISKALNKPTFTIFSPYV

SEQ ID NO: 24867 - DNA, 642 bp, Unknown
  Obtained from environmental sample
  misc_feature (1)..(642): n is a, c, g, or t
gtgggggggcggacgactagtggatcacagaattcggtcgagatcgacacaattggacttggactgctggtgattggtgaagaaaaatgggatcagcatgaaatagatcttattaagaaattcagtaagctcaatataccctatataattatatataacaagatagatctgggtagcccaaatcaatcattcctcgataaggtaaaatcagaatccggtaaaaaccctttcctgttttcgactatcggaaaaaagaactatgacgatcttatcaggcttattaaatcatcgataccggaaagtagtcttaaaataccaaccttactgggggatataataaaacagggcgacctggtattattgattacacccatcgatgtcgaagctcctgaaggaagacttattttaccacaggtacaggcaataagagatatcctggataacgatgcaattgccattgtgctgaaggagcgggagattgacacatttttacaacagacaaaggttaaacctgcacttgctattaccgattcgcagatttttgtaaaagcagatggctctattccacacgatatccctcttacaagttttagtattgcactggcaagactgaaaggcgactttgattattacctcaggtga

SEQ ID NO: 24868 - protein, 213 aa, Unknown
  Obtained from environmental sample
  misc_feature (1)..(213): Xaa is any amino acid
MGGRTTSGSQNSVEIDTIGLGLLVIGEEKWDQHEIDLIKKFSKLNIPYIIIYNKIDLGSPNQSFLDKVKSESGKNPFLFSTIGKKNYDDLIRLIKSSIPESSLKIPTLLGDIIKQGDLVLLITPIDVEAPEGRLILPQVQAIRDILDNDAIAIVLKEREIDTFLQQTKVKPALAITDSQIFVKADGSIPHDIPLTSFSIALARLKGDFDYYLR

SEQ ID NO: 24869 - DNA, 504 bp, Unknown
  Obtained from environmental sample
  misc_feature (1)..(504): n is a, c, g, or t
atgcaaagaccgaatcaagcgtgggtcagcgacattacctatatctggacaaatgagggctggctgtatttagcgggagtcaaagacttatacaccaaagagctggtcggctatgctatcaataagcgaatgaccgcagatctagtatgcaaagcattgaacatggccatcaggaataaacgtccaagcaaagggctaatcgttcactctgacagaggtagccaatattgcagccatacctaccacaagatcattaagcaacatcaatttacaggctcaatgagtggcaaaggcaattgtttcgacaacgcgcccatagaaagcttctggggtgtcttgaagaatgagcttgtgtatcaccaagactataaaacaaggtttgcagccatcaacgatatcattggctatattgagctgtattacaaccaaactagaattcaaaagggcttgggctataaatcgccaagacaggtgtggtttgactcttatcgtcaggctgcgtaa

SEQ ID NO: 24870 - protein, 167 aa, Unknown
  Obtained from environmental sample
  DOMAIN (2)...(160): Integrase core domain
  misc_feature (1)..(167): Xaa is any amino acid
MQRPNQAWVSDITYIWTNEGWLYLAGVKDLYTKELVGYAINKRMTADLVCKALNMAIRNKRPSKGLIVHSDRGSQYCSHTYHKIIKQHQFTGSMSGKGNCFDNAPIESFWGVLKNELVYHQDYKTRFAAINDIIGYIELYYNQTRIQKGLGYKSPRQVWFDSYRQAA

SEQ ID NO: 24871 - DNA, 381 bp, Unknown
  Obtained from environmental sample
  misc_feature (1)..(381): n is a, c, g, or t
atgaacagatcttggtatgtcaacactagctcattacgtatggcaacagactataaggttgctggttctgaagaaatcaacttgcctatagagaactttcgctgcaaattcaccctatatcagaaggaaacggaaatcatgagcccttaccaactcaatttaataaaggccatcattaaaggagaatcaaaacttacttcggtcaaaaccatgaagacctaccgattaggcacgcctagaaacgtaagtaaaaacaaaaccaagtttattaacaatgacattattcataaaataaataaccaatatgaattacttgatcctgcttttgaactttggttcaaacagcagtttttcgatcaaaaacacaaactcattaactaa

SEQ ID NO: 24872 - protein, 126 aa, Unknown
  Obtained from environmental sample
  misc_feature (1)..(126): Xaa is any amino acid
MNRSWYVNTSSLRMATDYKVAGSEEINLPIENFRCKFTLYQKETEIMSPYQLNLIKAIIKGESKLTSVKTMKTYRLGTPRNVSKNKTKFINNDIIHKINNQYELLDPAFELWFKQQFFDQKHKLIN

SEQ ID NO: 24873 - DNA, 606 bp, Unknown
  Obtained from environmental sample
  misc_feature (1)..(606): n is a, c, g, or t
atgcctattgagctaaatgaagtacttaaaaatccagctactttatcaatcttaggggctataggcgcattcgtactttctacttttctagcaccgaggctaggagaagttatcaaagctttagctgcttttattttttttaatattaagcattggagtgcttttatattattgggtgttatttttcattttactctaaatacttcagtttttataaatattttcttaaccataactgttgtaactataatatcagtatttataacgtttaaagatttttcaaacaaaccaactttgttgtaccttggatcgtattacaataatgacaatagctaccttgataagaatattaagacggaaaaaatagatagtatagttgatcaggacatagataattttaagaaacatagttacctaataaaaatgaggataataaaaattaagagtatggacattccaaggttctatactttgatgaaaagctataaaaggttgaattcgttattcaaaaaacttgtacttacaattgtatatttcggttatctnttttgcctgattcagaatctgattctatacctttacagaaggtactctgaataccannnn

SEQ ID NO: 24874 - protein, 202 aa, Unknown
  Obtained from environmental sample
  misc_feature (1)..(202): Xaa is any amino acid
MPIELNEVLKNPATLSILGAIGAFVLSTFLAPRLGEVIKALAAFIFFNIKHWSAFILLGVIFHFTLNTSVFINIFLTITVVTIISVFITFKDFSNKPTLLYLGSYYNNDNSYLDKNIKTEKIDSIVDQDIDNFKKHSYLIKMRIIKIKSMDIPRFYTLMKSYKRLNSLFKKLVLTIVYFGYLFCLIQNLILYLYRRYSEYXX

SEQ ID NO: 24875 - DNA, 705 bp, Unknown
  Obtained from environmental sample
  misc_feature (1)..(705): n is a, c, g, or t
atggaaatagattacagtcaaataaaggtcattggttttgatgctgatgatactttgtggattaacgaaacctattttagagatgcagagttggagtttgctaaattactaagcccatttgaaactgctaataaaatagaccaagaactatttaaaatggagatgaaaaatcttccagtctatggctatggagttaaaggctttgtgttatcaatggtcgaaatggctttggagttatccaataacacagtctcaaatcaaaccatatctagtattttagacattggtaaaacaatgattaataaagaagtagagcttttagaaggtgttgagcaagtattacaacagctttccaaaaagtataaattaatagtcgctacaaaaggcgatttactggatcaagaacgtaaacttgaaaagtcaggtttgttagattattttcaccacattgaagtattaagtgataaaaaagaagcaaactactccaaactattaaaccatttagatataaaaccttcagagtttttaatgataggtaattctttaaaatcggacatactaccattaattaatattaaagcaagcgctattcatgtaccgtttcataccacatggttgcatgagcaggtggacgtaaatgttaatcagtcaaagcaatataaaacaattaaaagtctattcgacttaccacaactattacaataa

SEQ ID NO: 24876 - protein, 234 aa, Unknown
  Obtained from environmental sample
  DOMAIN (8)...(202): haloacid dehalogenase-like hydrolase
  misc_feature (1)..(234): Xaa is any amino acid
MEIDYSQIKVIGFDADDTLWINETYFRDAELEFAKLLSPFETANKIDQELFKMEMKNLPVYGYGVKGFVLSMVEMALELSNNTVSNQTISSILDIGKTMINKEVELLEGVEQVLQQLSKKYKLIVATKGDLLDQERKLEKSGLLDYFHHIEVLSDKKEANYSKLLNHLDIKPSEFLMIGNSLKSDILPLINIKASAIHVPFHTTWLHEQVDVNVNQSKQYKTIKSLFDLPQLLQ

SEQ ID NO: 24877 - DNA, 495 bp, Unknown
  Obtained from environmental sample
  misc_feature (1)..(495): n is a, c, g, or t
ttggcagaagaagacattaacttagatgaggttgtaataaattcggatgaaaatccagcaaatgcaattatcagacagaccattgctgaacgaaaagagaatttaaataaacttaaatcgtttaaagccgagttttactcaagaggattactaaaaatgatcgatgtcccagaaaaaattatgggtcaagaggttggcgatttggatggtgcattagactcgaccagaactggtattgtctatttatcagagacaatatccaaactagaataccaatctcctaaacctattaaagaaactattgttgcttctaaaattagtggagacagcaatggttttagttttaataatgcgactgacgtcgaatttaatttttataaaaacacctttgagttaggtagcgagattgtatctcctattgctgactttgcttttaactattacaaatacaaactagtagggtacgttttacgacgacttaggcaaccttattaa

SEQ ID NO: 24878 - protein, 164 aa, Unknown
  Obtained from environmental sample
  misc_feature (1)..(164): Xaa is any amino acid
MAEEDINLDEVVINSDENPANAIIRQTIAERKENLNKLKSFKAEFYSRGLLKMIDVPEKIMGQEVGDLDGALDSTRTGIVYLSETISKLEYQSPKPIKETIVASKISGDSNGFSFNNATDVEFNFYKNTFELGSEIVSPIADFAFNYYKYKLVGYVLRRLRQPY

SEQ ID NO: 24879 - DNA, 807 bp, Unknown
  Obtained from environmental sample
  misc_feature (1)..(807): n is a, c, g, or t
gtgaacagattaataattttgatattaatattttttagtcaaatctcaattgcacaatcggacaaacaattcatttctgatttcctattggaagatgaattaaaatctggcaatcaattgaaggagtacgaaaaatatgatttcgctaatgtttggaatactacacctaatgaagtcatttttggaattattggcgaagaccaccaacgaattagaataaaacttatatcaataaacaaaaaccaccaaaaaccgaacgaatattatgtatttgggaagtcaatggtaaaagaaaatgtttgtgacttttttggaacgattaaaattaaaaaaattagagaagttaaagaattccattacggagttgacgaaaagtataaaaacaaagacatcaaacaacaaggacttctaatagcggaatatgttttcgatgaagatgctcaacaaaagcatagcggacttttcaaaggtaaattatattcaaaatggtatttaaataaaaatgacaaaattgtttacgatgatattcaaatcatttcagatggatacactaacaatgcatttattggaacttggaaaagttactcaactggaaatgaaaaagaatgtcgatgggccgattggcgagttccaaatgctaattcggattttgatattggagctggcgaatttagtgtttcagaaaaatattggaataaagggtggatgggatatgctttgaaaaaccagcaccgaaaggagcaaatgtcccgagaaaaatcaaataaaaaaccaaagggatggggggaaataaagcccggggcataa

SEQ ID NO: 24880 - protein, 268 aa, Unknown
  Obtained from environmental sample
  SIGNAL (1)...(18)
  misc_feature (1)..(268): Xaa is any amino acid
MNRLIILILIFFSQISIAQSDKQFISDFLLEDELKSGNQLKEYEKYDFANVWNTTPNEVIFGIIGEDHQRIRIKLISINKNHQKPNEYYVFGKSMVKENVCDFFGTIKIKKIREVKEFHYGVDEKYKNKDIKQQGLLIAEYVFDEDAQQKHSGLFKGKLYSKWYLNKNDKIVYDDIQIISDGYTNNAFIGTWKSYSTGNEKECRWADWRVPNANSDFDIGAGEFSVSEKYWNKGWMGYALKNQHRKEQMSREKSNKKPKGWGEIKPGA

SEQ ID NO: 24881 - DNA, 513 bp, Unknown
  Obtained from environmental sample
  misc_feature (1)..(513): n is a, c, g, or t
atgggaaattcaacatatttaataataattgcaatcatttttgttctgacaatttggtttctgattgttaaatattttctttatccattgttttttaaaccgaaaataaggacatctgaaatcattaactttcttgataaaaaacaatgctcaattattgaatataaaaacctgaataaaaaagaaagagaaaggaatatttttactcaaacaaatggattgacatttgacagttttctttctttaaaatctgaatataaaataataggattttctctaaacgaaaagaaatacaaaatatactgggctgaattacaatcttgggttccaccttttggaaaacgagttttgaattttattgaggaaaaagactctgaacttctgaacgaattaaaaaaagaatataatcaagaaattattactgtaactgacaaatgtccagcttgtcaaaatacagtttcggataaattaacagaatgtcccaattgcggattgaatttagtcgctcaatga

SEQ ID NO: 24882 - protein, 170 aa, Unknown
  Obtained from environmental sample
  misc_feature (1)..(170): Xaa is any amino acid
MGNSTYLIIIAIIFVLTIWFLIVKYFLYPLFFKPKIRTSEIINFLDKKQCSIIEYKNLNKKERERNIFTQTNGLTFDSFLSLKSEYKIIGFSLNEKKYKIYWAELQSWVPPFGKRVLNFIEEKDSELLNELKKEYNQEIITVTDKCPACQNTVSDKLTECPNCGLNLVAQ

SEQ ID NO: 24883 - DNA, 786 bp, Unknown
  Obtained from environmental sample
  misc_feature (1)..(786): n is a, c, g, or t
gtgaaccttcaagatgaagataattttgagagtaatttagatttaagagagttaattgagaaatatttgaggtattggaaatggtttttattggcaataatctttagtctttttattgcttatttatatttgaattttgaaaagccaacttatgaagcaactgccacaataaaaattaaaaatgagcaaaaaggtgataaatctgcgttgtctgcttttcaagatttgggtattataacaggttcaaatcaagacgttgaagatgaaatggaaatcttgctttcgaaagatttaatagctgaagttattaaatcactaaaattaaatattcaattttttacagataaaaatcctataagtaatttcttagatgacaacctttcattttcaaccgaatattatgaaagagaaagatatatggatccgccaataaaaattaatttttttattaatgattcaaccttatacagaactaattcgcaatttataatctctgttaattctttaaataattttacttttatagataataaaaattctatcaaaaagaaatattcttttggcgaaagagtagccacaaaatttggggatataatagtaacaccaaatatagttctaaaacaaagtaatttagttggttcgaacgtacttgtcaatatttcttctttaagagatttagctgattcttactcagaaagaattgaaattaaaccaaaatcagttttgtcaagtgttttaagtttaaaagtaactgatggcgtctatcaaaaggcagaagatttttaa

SEQ ID NO: 24884 - protein, 261 aa, Unknown
  Obtained from environmental sample
  DOMAIN (11)...(198): Chain length determinant protein
  misc_feature (1)..(261): Xaa is any amino acid
MNLQDEDNFESNLDLRELIEKYLRYWKWFLLAIIFSLFIAYLYLNFEKPTYEATATIKIKNEQKGDKSALSAFQDLGIITGSNQDVEDEMEILLSKDLIAEVIKSLKLNIQFFTDKNPISNFLDDNLSFSTEYYERERYMDPPIKINFFINDSTLYRTNSQFIISVNSLNNFTFIDNKNSIKKKYSFGERVATKFGDIIVTPNIVLKQSNLVGSNVLVNISSLRDLADSYSERIEIKPKSVLSSVLSLKVTDGVYQKAEDF

SEQ ID NO: 24885 - DNA, 402 bp, Unknown
  Obtained from environmental sample
  misc_feature (1)..(402): n is a, c, g, or t
atgacaaccgtcagacaatggagtgatagaaagaaaaaagtacagctaccattaatctcatcttacgtttttgttaatacaaaagagaatgatttaaaaaatattctaccatataatagtgtagttagagttttgaaacacctagggaaacctgccattattaaagaatatgaaatagagaacctgagaatacttttggaagacactgataatattacttttattagagatactcatcttaaaaaaggggattcagtttttgtagaaaaaggcgtttttaaaggtttaattgcggaatgtagcgaattcaacgggaaacatcgggttattgtaagaattgaagctcttggagatttaatagaggtaaatattccgttgagtcatattaaaaaaaataattga

SEQ ID NO: 24886 - protein, 133 aa, Unknown
  Obtained from environmental sample
  misc_feature (1)..(133): Xaa is any amino acid
MTTVRQWSDRKKKVQLPLISSYVFVNTKENDLKNILPYNSVVRVLKHLGKPAIIKEYEIENLRILLEDTDNITFIRDTHLKKGDSVFVEKGVFKGLIAECSEFNGKHRVIVRIEALGDLIEVNIPLSHIKKNN

SEQ ID NO: 24887 - DNA, 354 bp, Unknown
  Obtained from environmental sample
  misc_feature (1)..(354): n is a, c, g, or t
atgaattataataagctaattataacaaancaacaagctgaaaacattcttatcaagcttntcaatataagtggtaatgctactatattacccggagaagtacgatttaattttaggataacaataaacaatgaagagggttatattctaaagatttccggtcccgatgacgatgaaaactatcttgattttcaacaaccattgtcacacttgtggaagtccatggccaaatattatctcccccgacttctaaaaacaaacttgaacactattctgaaacatgacattcggaaacagaaagtcagtcgtacctggaaccagactattgaatatggatcccataaaaatcgttaa

SEQ ID NO: 24888 - protein, 117 aa, Unknown
  Obtained from environmental sample
  misc_feature (1)..(117): Xaa is any amino acid
MNYNKLIITXQQAENILIKLXNISGNATILPGEVRFNFRITINNEEGYILKISGPDDDENYLDFQQPLSHLWKSMAKYYLPRLLKTNLNTILKHDIRKQKVSRTWNQTIEYGSHKNR

SEQ ID NO: 24889 - DNA, 498 bp, Unknown
  Obtained from environmental sample
  misc_feature (1)..(498): n is a, c, g, or t
atgacagataaggaaaaatattacactttaaaagattttaaatattcttacaatttttacgacaaaatatatcatgtagaaatacttgaaaacagcaaatggagagtttgtaaatatgatttagataggtttaaggaggttattaaccttaaactaaaggataaagaggatttaagaaacaaaccattcaaaccttatctttggtttagtataaagtggagtgtaaagatgtttttaaggtttttagataaacacgaaaaaagaataaattggtttaagaaaaatcttgctttttggataggtattacaatacctattacagcaacttccatcgctctaatatcagtaaaagatgctcgtgaggatcgtcaacaagtattacgaaaaacagagagtatagagaaaataaaaaaagaactaaatatagaaaaagaggtgttaaacgaaagaatacagatgctaacaagtagaatagactctcttcacttaaaaaaatag

SEQ ID NO: 24890 - protein, 165 aa, Unknown
  Obtained from environmental sample
  misc_feature (1)..(165): Xaa is any amino acid
MTDKEKYYTLKDFKYSYNFYDKIYHVEILENSKWRVCKYDLDRFKEVINLKLKDKEDLRNKPFKPYLWFSIKWSVKMFLRFLDKHEKRINWFKKNLAFWIGITIPITATSIALISVKDAREDRQQVLRKTESIEKIKKELNIEKEVLNERIQMLTSRIDSLHLKK

SEQ ID NO: 24891 - DNA, 375 bp, Unknown; identical to SEQ ID NO: 21119
  Obtained from environmental sample
  misc_feature (1)..(375): n is a, c, g, or t

SEQ ID NO: 24892 - protein, 124 aa, Unknown; identical to SEQ ID NO: 21120
  Obtained from environmental sample
  misc_feature (1)..(124): Xaa is any amino acid

SEQ ID NO: 24893 - DNA, 534 bp, Unknown
  Obtained from environmental sample
  misc_feature (1)..(534): n is a, c, g, or t
ttgatagaagaagaaccggttaattttgaatgccatcaaattgtaaaaggagaggttagagatagaaatactactgatttattaccgggagctgaagttattttaagtgataaagatggaaaagtgttggagaccttcattaccaaagaagatgctactttcttttttgaaataaattgtgaaacagaatatgaattaattggtaaaaaattagattatacaccacaatcgaaagtatttacaacatctaatgaggctgacaaagagctcaaattgttaatcctattaggaaaaggagaaatcgattttattgctgatgccgatcgcgaagctaataaaacagaagatgagggtgaagatattaaaccggaaggattacctgatgtattgccagatgagattgtacgtgccagagcaagtacttatattgtaaatatagatccaatttactttgagtttgattcttcatatttaaatagagaagctaagacagaattacaaaaagtagttgatttaatgactaaatatccttaa

SEQ ID NO: 24894 - protein, 177 aa, Unknown
  Obtained from environmental sample
  misc_feature (1)..(177): Xaa is any amino acid
MIEEEPVNFECHQIVKGEVRDRNTTDLLPGAEVILSDKDGKVLETFITKEDATFFFEINCETEYELIGKKLDYTPQSKVFTTSNEADKELKLLILLGKGEIDFIADADREANKTEDEGEDIKPEGLPDVLPDEIVRARASTYIVNIDPIYFEFDSSYLNREAKTELQKVVDLMTKYP

SEQ ID NO: 24895 - DNA, 450 bp, Unknown
  Obtained from environmental sample
  misc_feature (1)..(450): n is a, c, g, or t
ttgtcctgtgctgaacatatttcctatttttacgcaaagctaacggaaaacgataaaataaagatgaaaaacaaaatcaaagcggtcaaagaatttcatatttcttttggtctgggtgtttcagaagatatgattgccgacttaggggaagcaaaaaataatttgcgttttaacctcatggatgaagaaaataaagaatatttagaggctgcacaaaataatgaccttgtagaagtggcagatgcccttggtgatatgttgtatattttatgtggtactattttagaacatggaatgcaatataaaatagaggaggtatttaatgaaatacagcgaagtaacatgagtaaattaggagaagatggtaaacctatatatagagaagacggtaaagtacttaaaggtccaaattattttaaaccaaatattgagattatacttaataaataa

SEQ ID NO: 24896 - protein, 149 aa, Unknown
  Obtained from environmental sample
  misc_feature (1)..(149): Xaa is any amino acid
MSCAEHISYFYAKLTENDKIKMKNKIKAVKEFHISFGLGVSEDMIADLGEAKNNLRFNLMDEENKEYLEAAQNNDLVEVADALGDMLYILCGTILEHGMQYKIEEVFNEIQRSNMSKLGEDGKPIYREDGKVLKGPNYFKPNIEIILNK

SEQ ID NO: 24897 - DNA, 435 bp, Unknown
  Obtained from environmental sample
  misc_feature (1)..(435): n is a, c, g, or t
atgaaaaacaaaaataacaacagaaaaggctttgtatttaaaccatacgaagcaccttcgcaatccacttttgagaagctttttgatatttttaaagaattaattacgcatacttctggagattttgacgaagctatagattggcttcgcgaattagataaagaatataaattaaccactccagaatattcaattgacgattttattgaagatcttaaagaaaaaggttacatacgtgaagaaattaaaccagatggaaacaaagggaatgctattacagcaaagactgagcgtgccattagacaatctgcattggagcaaatatttggtaacatcaaacgtagtggttctggaaaccataaaagtaaaggtgttggaataggagatgagcatacaggcgattttagaactaccaatttgngacagtttggataa

SEQ ID NO: 24898 - protein, 144 aa, Unknown
  Obtained from environmental sample
  misc_feature (1)..(144): Xaa is any amino acid
MKNKNNNRKGFVFKPYEAPSQSTFEKLFDIFKELITHTSGDFDEAIDWLRELDKEYKLTTPEYSIDDFIEDLKEKGYIREEIKPDGNKGNAITAKTERAIRQSALEQIFGNIKRSGSGNHKSKGVGIGDEHTGDFRTTNLXQFG

SEQ ID NO: 24899 - DNA, 303 bp, Unknown
  Obtained from environmental sample
  misc_feature (1)..(303): n is a, c, g, or t
atgactaaattaaaaattgcagttcaaaaatcgggtcgactaaacgaagactccatgaaaattttaaaagagattggtatttctgtagataatggtaaggaccaacttaaggcgtctgctcaaaattttcctttagaagtattttatcttagaaatggcgatatccctcagtatttaagggatggtgtggttgatgctgctattattggtgaaaattgtttacttgagaaaggttacgatctaaaaattgtagagagcttaagattctctaaatgtcaagtgtctatggccgttctaaatcnn

SEQ ID NO: 24900 - protein, 101 aa, Unknown
  Obtained from environmental sample
  misc_feature (1)..(101): Xaa is any amino acid
MTKLKIAVQKSGRLNEDSMKILKEIGISVDNGKDQLKASAQNFPLEVFYLRNGDIPQYLRDGVVDAAIIGENCLLEKGYDLKIVESLRFSKCQVSMAVLNX

SEQ ID NO: 24901 - DNA, 459 bp, Unknown
  Obtained from environmental sample
  misc_feature (1)..(459): n is a, c, g, or t
ttgagcaataggattatatttgggatgagcagggaaaatccttgtttggataatattaggttataccgcagtatgaaacccagatctctttactttgtccttgttttatttttagtatcaagttgttcatatataaaattgagaactgggcaagagcatttatttgtatatccagatgagaatcaggctgttctttttgcgttttccaagactgatagttcagatgtggaacaatataccagactaaaaaaatcaggaaatgaagtattctttgtccttattggagactcagtttctaaacttgactcacttcctgttcagcctagcaaagttaatagaaagagatcaaaactcatttatatctttaaaaatccaaatgtagggaattttgattttgctgaagtgactataaaagataagattgttaaaaagattagaatacatatggcgtatatgtaa

SEQ ID NO: 24902 - protein, 152 aa, Unknown
  Obtained from environmental sample
  misc_feature (1)..(152): Xaa is any amino acid
MSNRIIFGMSRENPCLDNIRLYRSMKPRSLYFVLVLFLVSSCSYIKLRTGQEHLFVYPDENQAVLFAFSKTDSSDVEQYTRLKKSGNEVFFVLIGDSVSKLDSLPVQPSKVNRKRSKLIYIFKNPNVGNFDFAEVTIKDKIVKKIRIHMAYM

SEQ ID NO: 24903 - DNA, 1008 bp, Unknown
  Obtained from environmental sample
  misc_feature (1)..(1008): n is a, c, g, or t
atggtcgcttttaacttaattaaattatacgcaaaacgtaagctagaaaaaggataccaatataaacctgatagctatttacaacacgagctagaggcttcttttttatacgaagatacaccagatcaaattactgcaactgcagatataaaagcagacatggaaagtgagcgtccaatggaccgtttaatatgtggagatgttggttttgggaaaactgaagtagccatacgcgcagcttttaaagcagtggataatggtaaacaagttgcagttttagtaccaacaacagtattagcgtttcaacaccataaaacctttacagaacgcttaaaagactttccggtaactgtggattacgttaaccgttttaggactgcaaaacaaaaaaaggaaaccttagaaaaattagaaaaaggtcacgtcgatatcattataggcacacatcaactagcaagtaaaaatgttaagtttaaagatctaggattgcttattgttgacgaagaacaaaaatttggtgttgctgtaaaagaaaaattaaaaactttaaaggataatgtagacgtattaacgctaacagcaactccaatacctaggacgttgcaatttagtttaatggcagcaagagatttatcagtcattactacaccgccaccaaatcgttatccaatagaaagtaacgtgattagatttacagaggagtctattagagatgctgttagctacgagatagaacgtggtggacaaatcttttttattcacaaccgtattgaaaacattaaagaggttgcagggatgatccaaagacttgtacctgatgctaaaataggtattggtcatggacaacttggaggtaaaaaactagaaagcctgatgcttgggttttatggatggcgaattttgacgtggctgtttagtactactattattggaaagcggttttggatgtaccaaaatggccaacacccatttttaattaacaaacgcccaataaattttgggaattaa

SEQ ID NO: 24904 - protein, 335 aa, Unknown
  Obtained from environmental sample
  DOMAIN (37)...(199): Type III restriction enzyme, res subunit
  misc_feature (1)..(335): Xaa is any amino acid
MVAFNLIKLYAKRKLEKGYQYKPDSYLQHELEASFLYEDTPDQITATADIKADMESERPMDRLICGDVGFGKTEVAIRAAFKAVDNGKQVAVLVPTTVLAFQHHKTFTERLKDFPVTVDYVNRFRTAKQKKETLEKLEKGHVDIIIGTHQLASKNVKFKDLGLLIVDEEQKFGVAVKEKLKTLKDNVDVLTLTATPIPRTLQFSLMAARDLSVITTPPPNRYPIESNVIRFTEESIRDAVSYEIERGGQIFFIHNRIENIKEVAGMIQRLVPDAKIGIGHGQLGGKKLESLMLGFYGWRILTWLFSTTIIGKRFWMYQNGQHPFLINKRPINFGN

SEQ ID NO: 24905 - DNA, 438 bp, Unknown
  Obtained from environmental sample
  misc_feature (1)..(438): n is a, c, g, or t
atggaacttttattccctgacgactatgttaacaatattgccgaaagattaagtctttacacccaattaaacaattttaaaaccgaagctgaattaaccgaatttgagacacaacttattgatcgttttggagagttaccaacacaggttgtagatttaataaatagcgtacgcatcaaatgggtagctaccaaattaggtattgaaaaagtaataatgaaacaaggaaagctaatttgctactttattaatgatcaacaaagcagtttttatcaaagtccaaattttacaaaattactacaatatgtacaaacacattctcaggcttgtaaaatgaaagaaaaacaaaccagaaatggcttacgtttattacttacctttgacaatataaaaacggttaaaaaagctttaactgccttacaaccaatattggaatag

SEQ ID NO: 24906 - protein, 145 aa, Unknown
  Obtained from environmental sample
  DOMAIN (1)...(112): TRCF domain
  misc_feature (1)..(145): Xaa is any amino acid
MELLFPDDYVNNIAERLSLYTQLNNFKTEAELTEFETQLIDRFGELPTQVVDLINSVRIKWVATKLGIEKVIMKQGKLICYFINDQQSSFYQSPNFTKLLQYVQTHSQACKMKEKQTRNGLRLLLTFDNIKTVKKALTALQPILE

SEQ ID NO: 24907 - DNA, 687 bp, Unknown
  Obtained from environmental sample
  misc_feature (1)..(687): n is a, c, g, or t
atgcagactatggattctatgcccaaagaaaagcacataaaaattgcatcagaaacattatttatatacgcaccacttgcccatagactcggactatataatattaaaactgagttagaagatcttggcttaaaatatacggagcctgaggtttataatgatatccttactagaattactgaaagtaaagaagaacagaataaatatattgacgagttttccaacatcttaaaaagttcttttgacaaagaaaattttgaatatgtaattaagggcaggcctaaatctatttattctattcgtagaaaaatgctcgatcacgatgtatcttttgacgaagtatacgacaagtttgccattcgtattatttataattctgatttatcacaagaaaactttaacgcttggaacctctattcaattgtcacagatacttttaaccctaacccaaaaagattacgagattggatttctcagccaaaatcaacaggatatgactcattacatattaccgttatggggcctaaaggcaagtggattgaagttcaaatccgttcagaacgaatggctgaaatagctgacacaggatatgccgcccattttagatataaacctggaagtgatacggaaagtggtctcgaccgttggcttaataaactcaaagaaaccttaaaaattctgatataa

SEQ ID NO: 24908 - protein, 228 aa, Unknown
  Obtained from environmental sample
  DOMAIN (92)...(207): Region found in RelA / SpoT proteins
  misc_feature (1)..(228): Xaa is any amino acid
MQTMDSMPKEKHIKIASETLFIYAPLAHRLGLYNIKTELEDLGLKYTEPEVYNDILTRITESKEEQNKYIDEFSNILKSSFDKENFEYVIKGRPKSIYSIRRKMLDHDVSFDEVYDKFAIRIIYNSDLSQENFNAWNLYSIVTDTFNPNPKRLRDWISQPKSTGYDSLHITVMGPKGKWIEVQIRSERMAEIADTGYAAHFRYKPGSDTESGLDRWLNKLKETLKILI

SEQ ID NO: 24909 - DNA, 462 bp, Unknown
  Obtained from environmental sample
  misc_feature (1)..(462): n is a, c, g, or t
atgcagcacataaatcgctgtgttattttggcctctcaaatcatcttttttgaggaaaaagaaaaatcaaaacaagaggttaagaagcaagatacgaagcgattatcgaaatatgaggcacaacacaatcttcgtcttatatttaccctatctggaacagtatctttttactcagctttccctaaatcatctggtatagcgaatactaaattaggagaagcacctgaattaacaatagcaaaagcacgaaagtttactgatcaaatgaagtatggcgttttaaataatcataatattaaaactgtgtttgatgcttatgaacaaagcttaatagagcgtcataacaccgcacccactaaatttgcagcttcatcgctcagaacatatcaatgcagaataaaaagctcaggcatcatttcccacttaagcgtgcgttccaatctcttacagctggagagttag

SEQ ID NO: 24910 - protein, 153 aa, Unknown
  Obtained from environmental sample
  misc_feature (1)..(153): Xaa is any amino acid
MQHINRCVILASQIIFFEEKEKSKQEVKKQDTKRLSKYEAQHNLRLIFTLSGTVSFYSAFPKSSGIANTKLGEAPELTIAKARKFTDQMKYGVLNNHNIKTVFDAYEQSLIERHNTAPTKFAASSLRTYQCRIKSSGIISHLSVRSNLLQLES

SEQ ID NO: 24911 - DNA, 444 bp, Unknown
  Obtained from environmental sample
  misc_feature (1)..(444): n is a, c, g, or t
ttgacacaattgaatgaatatggggttaaaggaaagacatttaaaagtttgttaccggcaacaaaaatatttacagcttttgatatttttaaagcactctgtattggtgctgatatttgtaattccgctaggggaatgatgattgctttgggttgtattcaggctttgcgatgcgataccaataaatgtcccacaggcgtaactacaaatgacccaagattaatgcgggggttgntggtagaagataagtggaaacgtattaaaaattaccaaggtaaaacagtaaatgactttttagaactttttgctgcagcaggctgtaaaaacctttcagatttaaatagaagctttatctttaaacaagtggaaaccgaaataaaatgttacgaagaaatctatccctcattaaaaggagggaaatttctagaggaaactttcaattaa

SEQ ID NO: 24912 - protein, 147 aa, Unknown
  Obtained from environmental sample
  misc_feature (1)..(147): Xaa is any amino acid
MTQLNEYGVKGKTFKSLLPATKIFTAFDIFKALCIGADICNSARGMMIALGCIQALRCDTNKCPTGVTTNDPRLMRGLXVEDKWKRIKNYQGKTVNDFLELFAAAGCKNLSDLNRSFIFKQVETEIKCYEEIYPSLKGGKFLEETFN

SEQ ID NO: 24913 - DNA, 615 bp, Unknown
  Obtained from environmental sample
  misc_feature (1)..(615): n is a, c, g, or t
ttgattttttcaatgtcaatttcagcacagcaaccccttgacactatttacgccaacgaccagaaaaacgttgccctgttttttcccaaccctatacgacagggtattacgggagcttcccattttgtattcacatataatcgggagaaggaacagtattttggtttgttacaggcaaagtctggaacggaaagcaacctattgaccgttacaagtgatggtagcgtttattcctatattctgaagtattctgaaaaacttccagaactgaattattttatcaatgcaaatgaaagcattggtagcgagcttccaataaagattaagcaaaagccagaagttaagccattgaacgaatatgcaaatagaataacacattttcaaaaattcagcgaatacttattaaaatccaactttgaacgtcttgaaaccaaacgcaagaaaggcatcaaagtacaattgcaaaaaatggcatacgatgcttctgaagtgtacttggtcatagaagttaaaaacaagtccggaatcgattttgaaatagactatctcaacgtatatagaaccaacggaaacaaaaacggaaagcgtcttaccaaagattgcaacaagaagtga

SEQ ID NO: 24914 - protein, 204 aa, Unknown
  Obtained from environmental sample
  misc_feature (1)..(204): Xaa is any amino acid
MIFSMSISAQQPLDTIYANDQKNVALFFPNPIRQGITGASHFVFTYNREKEQYFGLLQAKSGTESNLLTVTSDGSVYSYILKYSEKLPELNYFINANESIGSELPIKIKQKPEVKPLNEYANRITHFQKFSEYLLKSNFERLETKRKKGIKVQLQKMAYDASEVYLVIEVKNKSGIDFEIDYLNVYRTNGNKNGKRLTKDCNKK

SEQ ID NO: 24915 - DNA, 459 bp, Unknown
  Obtained from environmental sample
  misc_feature (1)..(459): n is a, c, g, or t
gtggttataaatgaaaatacgcgacaattaattggaaacttcccgaaaggtttagcggatattactatagaaaacaatgtattatttactccagttctatttagtaattcaatagcatcttacacacttccatcaactattagtgaagctatacctgtaaatgaaaattggaaaagaataaacacaaaagaagaatatttaaagatagctgccgataatttttatggtgacaaagtcgggcaatctgttgctactcacgacggacaaatatttggagtttttggaggtaaagttttgacaggaacttgggattggaagaataactttttcaccagaacaagcaaaatcggagatatggatttagggtatgatgaacttgtaattgaagttacagataccaaaatgcgcttaacacttaagcaaggncagggaatgaccattgtctacaataagaaataa

SEQ ID NO: 24916 - protein, 152 aa, Unknown
  Obtained from environmental sample
  misc_feature (1)..(152): Xaa is any amino acid
MVINENTRQLIGNFPKGLADITIENNVLFTPVLFSNSIASYTLPSTISEAIPVNENWKRINTKEEYLKIAADNFYGDKVGQSVATHDGQIFGVFGGKVLTGTWDWKNNFFTRTSKIGDMDLGYDELVIEVTDTKMRLTLKQGQGMTIVYNKK

SEQ ID NO: 24917 - DNA, 480 bp, Unknown
  Obtained from environmental sample
  misc_feature (1)..(480): n is a, c, g, or t
ttgttttactattctgactggatatataggatcactaagaattccgctgtgccaaatccatggagtgctaaaaaatggacttggaagcatatccccatacttataatcgataaagacaatatccaattgacgtctcagttttatatagctaataaaaattttcagcacgataaagtcataaattatgatgacggtaaagcattttatcttaaccgaattcaaggaagcactattggtttttggatagattacacagaaatatatagtagaaagatgaaaaaccgagggaacagggtgcaaggtctaatatttaataaaaatattccactgtgcgagaggtacaatgttttaaacggtctatactacatagagcagcgtgaaattctaaatattatgaatacttttcataagcaaagaactgatgatattaaatatttgtcgcaagataaccatgataatttaatggatattggctggtaa

SEQ ID NO: 24918 - protein, 159 aa, Unknown
  Obtained from environmental sample
  misc_feature (1)..(159): Xaa is any amino acid
MFYYSDWIYRITKNSAVPNPWSAKKWTWKHIPILIIDKDNIQLTSQFYIANKNFQHDKVINYDDGKAFYLNRIQGSTIGFWIDYTEIYSRKMKNRGNRVQGLIFNKNIPLCERYNVLNGLYYIEQREILNIMNTFHKQRTDDIKYLSQDNHDNLMDIGW

SEQ ID NO: 24919 - DNA, 540 bp, Unknown
  Obtained from environmental sample
  misc_feature (1)..(540): n is a, c, g, or t
atggctatagaaatcgacaggctaattattgactcatcacttgagaaaataaaaagccgaaatctttcagaaaagttttttggtttaaatgttacgccttcaagtgcgcacaacgaccagtttgtaatttggttagaacgccgattattaaaagatacccatattgcatcaaaacttgtttttgaagtaagtgaatttgggctacaacaaaacattaaagcgagtaaacgctttattgacatgattcatcgcgtgggtgctcgcataacagttgagcgttttggtgttggcttaacatcgtttaagtttttccgcgatttaaaaccagactttattaaaatggatgccagttatacccgcggcctagaacatgataaaaacaatcaatattttatgcgcttaatggtcgatttagcacacaggattggtgtaagtgtctttgctgaaggggtcgaaagccaagaagaaaagcacattatagaaaccctgtgcttagatggtgtacaaggttactacatagaaaaacctaaagacatttga

SEQ ID NO: 24920 - protein, 179 aa, Unknown
  Obtained from environmental sample
  DOMAIN (2)...(176): EAL domain
  misc_feature (1)..(179): Xaa is any amino acid
MAIEIDRLIIDSSLEKIKSRNLSEKFFGLNVTPSSAHNDQFVIWLERRLLKDTHIASKLVFEVSEFGLQQNIKASKRFIDMIHRVGARITVERFGVGLTSFKFFRDLKPDFIKMDASYTRGLEHDKNNQYFMRLMVDLAHRIGVSVFAEGVESQEEKHIIETLCLDGVQGYYIEKPKDI

SEQ ID NO: 24921 - DNA, 621 bp, Unknown
  Obtained from environmental sample
  misc_feature (1)..(621): n is a, c, g, or t
ttgtatgccatcattggaggttccgttggaggaggaatagcatgggagttagctgttttaaaaccaaacttagcacagcatgtaataccaattgctacagattggaaagtgacggattggattaccgcaaattgccatattcaggacgcaatcttaaacaattcaaatcagcctttaaaagatgctagaatgcacgctatgactttatatcgtacgccagaatctttgacaaaaaagttttctcgtagtaaaaattcacaatctttatttaaagtccaaagttggttaagttatcatggagaccagttggatagtagatttcatttgtcagcttataaattaatgaatcaaatcctaaaaactattgatataacaaaaggacgattaccatttaaagacgtggcttcagtcattaaaggtcacgtacatattataacaattaatagcgatttgtttttcaaggctgatgaaaactgggaaacttatattgatttaaaatcagtcaaaaaaaacgtaactattggcgaaataaaatctctacatggtcatgatgcttttttaatagaatttgatcagttgtctagcttattaaacccaatttttaaaagtaaagaagtgtaa

SEQ ID NO: 24922 - protein, 206 aa, Unknown
  Obtained from environmental sample
  misc_feature (1)..(206): Xaa is any amino acid
MYAIIGGSVGGGIAWELAVLKPNLAQHVIPIATDWKVTDWITANCHIQDAILNNSNQPLKDARMHAMTLYRTPESLTKKFSRSKNSQSLFKVQSWLSYHGDQLDSRFHLSAYKLMNQILKTIDITKGRLPFKDVASVIKGHVHIITINSDLFFKADENWETYIDLKSVKKNVTIGEIKSLHGHDAFLIEFDQLSSLLNPIFKSKEV

SEQ ID NO: 24923 - DNA, 867 bp, Unknown
  Obtained from environmental sample
  misc_feature (1)..(867): n is a, c, g, or t
ttgtatttggtttcagttttattcggcttttttgctcataaaaatgatgtattaagcggaaccattggttttgaaattaataactttttccaagattatattggtaaaattggaactatattattattagcttttgcttttattagctatttagccattcgttttaaatttacaccacaacgcatagcagctatctttaaaaatgctagaaagaatattaaggacgattttaaagatgattttgttcctgtagataattcgtattcagacgaagctgaagctatgaagtctgcttttgaagtagataaaaaagtagaacctacaatttcaaaccattcaaaaatagaaaccacaaataatatagaactaacgcaagaagttagtacgcctgaggtctcttcaaaagaaataaaaacagaaataacaacgcctgagattgaaatagaagaacctcaagtagaaattgaggtagaatctgttacagaagaaatatcagaaactgataatcttgccaataagttagtagaagattttgggcagtttgatcctactttagaattgggtaaatatcaatttccgcctttagacttacttaaaaagtatgataacgaaggcgttacaatcaaccaagaagaattagaagaaaataaaaaccgaattgttgacactttaaataattacaaaattggaattgctagtattaaagctaccattggaccaacagtcacgttatatgaaattgttccggaagctggaatcagaatttcaaaaatcaaaaatttagaagatgacattgctttatcactgtctgctttaggtatacgtattattgcaccaattcctggcacaaggcaccattgctattnc

SEQ ID NO: 24924 - protein, 289 aa, Unknown
  Obtained from environmental sample
  misc_feature (1)..(289): Xaa is any amino acid
MYLVSVLFGFFAHKNDVLSGTIGFEINNFFQDYIGKIGTILLLAFAFISYLAIRFKFTPQRIAAIFKNARKNIKDDFKDDFVPVDNSYSDEAEAMKSAFEVDKKVEPTISNHSKIETTNNIELTQEVSTPEVSSKEIKTEITTPEIEIEEPQVEIEVESVTEEISETDNLANKLVEDFGQFDPTLELGKYQFPPLDLLKKYDNEGVTINQEELEENKNRIVDTLNNYKIGIASIKATIGPTVTLYEIVPEAGIRISKIKNLEDDIALSLSALGIRIIAPIPGTRHHCYX

SEQ ID NO: 24925 - DNA, 888 bp, Unknown
  Obtained from environmental sample
  misc_feature (1)..(888): n is a, c, g, or t
gtgatatggtttcaggtttatacgggcttttttgctcataaaaatgatgtattaagcggaaccattggttttgaaattaataactttttccaagattatattggtaaaattggaactatattattattagcttttgcttttattagctatttagccattcgttttaaatttacaccacaacgcatagcagctatctttaaaaatgctagaaagaatattaaggacgattttaaagatgattttgttcctgtagataattcgtattcagacgaagctgaagctatgaagtctgcttttgaagtagataaaaaagtagaacctacaatttcaaaccattcaaaaatagaaaccacaaataatatagaactaacgcaagaagttagtacgcctgaggtctcttcaaaagaaataaaaacagaaataacaacgcctgagattgaaatagaagaacctcaagtagaaattgaggtagaatctgttacagaagaaatatcagaaactgataatcttgccaataagttagtagaagattttgggcagtttgatcctactttagaattgggtaaatatcaatttccgcctttagacttacttaaaaagtatgataacgaaggcgttacaatcaaccaagaagaattagaagaaaataaaaaccgaattgttgacactttaaataattacaaaattggaattgctagtattaaagctaccattggaccaacagtcacgttatatgaaattgttccggaagctggaatcagaatttcaaaaatcaaaaatttagaagatgacattgctttatcactgtctgctttaggtatacgtattattgcaccaattcctggaaaaggaaccattggtattgaagtgcctaataaaaatgcannn

SEQ ID NO: 24926 - protein, 296 aa, Unknown
  Obtained from environmental sample
  misc_feature (1)..(296): Xaa is any amino acid
MIWFQVYTGFFAHKNDVLSGTIGFEINNFFQDYIGKIGTILLLAFAFISYLAIRFKFTPQRIAAIFKNARKNIKDDFKDDFVPVDNSYSDEAEAMKSAFEVDKKVEPTISNHSKIETTNNIELTQEVSTPEVSSKEIKTEITTPEIEIEEPQVEIEVESVTEEISETDNLANKLVEDFGQFDPTLELGKYQFPPLDLLKKYDNEGVTINQEELEENKNRIVDTLNNYKIGIASIKATIGPTVTLYEIVPEAGIRISKIKNLEDDIALSLSALGIRIIAPIPGKGTIGIEVPNKNAX

SEQ ID NO: 24927 - DNA, 531 bp, Unknown
  Obtained from environmental sample
  misc_feature (1)..(531): n is a, c, g, or t
atgaacgttaaagtgttatattttttgatacttgttataagtattagttcttgcaaaaaaaacgaatcaacatttgtaaataatgatttagatgctctggatacaattaatattgacgatcaaaaagatataagaagtataggagaaaccttattgccggattcaaaaaaaaaggttgaaaactggagtgaatatgaacaattggatcaattactaacaaaattttacagtatatctccaaccgaagcgttaaacttatctaaagaactctcaacaattacgcaacaattaaaagattctgtaactattgaaagatttacctatcctgatataagtattagaattaatgtgttacataaccatgcgttgaggctaatagatatgtcgactatttcctcaatcaattctctggaagttaaaaacgagattcaaagtattcttgatgcattttcagcattaaatgcaaaaatcaataatattactaaacaagaaaaattagaaaaggaattggaaataattgaattcaattag

SEQ ID NO: 24928 - protein, 176 aa, Unknown
  Obtained from environmental sample
  misc_feature (1)..(176): Xaa is any amino acid
MNVKVLYFLILVISISSCKKNESTFVNNDLDALDTINIDDQKDIRSIGETLLPDSKKKVENWSEYEQLDQLLTKFYSISPTEALNLSKELSTITQQLKDSVTIERFTYPDISIRINVLHNHALRLIDMSTISSINSLEVKNEIQSILDAFSALNAKINNITKQEKLEKELEIIEFN

SEQ ID NO: 24929 - DNA, 702 bp, Unknown
  Obtained from environmental sample
  misc_feature (1)..(702): n is a, c, g, or t
ttgtctaattctataactgcatacagacaaatagcaactgaggacaaagtaaaatttaaaaacaacgtacattttgcaaaagatgtatttaatgaaattaaaagacgagaaaattgtgttgcacttgttttagatatcgagaatttttttcctagtttaaatcataaaaaactaaaactagcttgggcaaaaatattaggacacaaaacattaccaaaagatcactttaatctttttaaagcaactaccagattttcttatgtaagacttaaagatttaaagactaaaaatggtcattttgatgaaaaggagctagcaaaacataaaaaagaaggtaaacacacattttttaatagtattaaagatttaattgattctgatataataattcataaaaatcagaaacaagacgaagataaaaacctaatgggaatacctcaaggtttacctataagcgcattattagctaatatttatatgctggcttttgaccagtctgttataaaacaattaaccttaaaacatgatgtattttacagacgctattccgatgatattgttatgatttgtaatcaaaatcaaataacattaattgaagaatttgtagaaagtgaaatgataaaaaacaaattaaccgtatcgttagaaaaaactgagaaaacactttttaaaataaataaaggacgattaccatcttattaa

SEQ ID NO: 24930 - protein, 233 aa, Unknown
  Obtained from environmental sample
  DOMAIN (34)...(226): Reverse transcriptase (RNA-dependent DNA polymerase)
  misc_feature (1)..(233): Xaa is any amino acid
MSNSITAYRQIATEDKVKFKNNVHFAKDVFNEIKRRENCVALVLDIENFFPSLNHKKLKLAWAKILGHKTLPKDHFNLFKATTRFSYVRLKDLKTKNGHFDEKELAKHKKEGKHTFFNSIKDLIDSDIIIHKNQKQDEDKNLMGIPQGLPISALLANIYMLAFDQSVIKQLTLKHDVFYRRYSDDIVMICNQNQITLIEEFVESEMIKNKLTVSLEKTEKTLFKINKGRLPSY

SEQ ID NO: 24931 - DNA, 873 bp, Unknown
  Obtained from environmental sample
  misc_feature (1)..(873): n is a, c, g, or t
ttgtctaattctataactgcatacagacaaatagcaactgaggacaaagtaaaatttaaaaacaacgtacattttgcaaaagatgtatttaatgaaattaaaagacgagaaaattgtgttgcacttgttttagatatcgagaatttttttcctagtttaaatcataaaaaactaaaactagcttgggcaaaaatattaggacacaaaacattaccaaaagatcactttaatctttttaaagcaactaccagattttcttatgtaagacttaaagatttaaagactaaaaatggtcattttgatgaaaaggagctagcaaaacataaaaaagaaggtaaacacacattttttaatagtattaaagatttaattgattctgatataataattcataaaaatcagaaacaagacgaagataaaaacctaatgggaatacctcaaggtttacctataagcgcattattagctaatatttatatgctggcttttgaccagtctgttataaaacaattaaccttaaaacatgatgtattttacagacgctattccgatgatattgttatgatttgtaatcaaaatcaaataacattaattgaagaatttgtagaaagtgaaatgataaaaaacaaattaaccgtatcgttagaaaaaactgagaaaacactttttaaaataaataaaggacgattacaatcttataaaatagataatgataatagcttaaaagaaaacgtacctttaaactatttaggttctgacttttatggctatcaaacttttattaaatctaaaaacttagataagttttaccgagaaatggagcgaacagttagggaaaacataaaggagttgaaactattaaagaaaaaccna

SEQ ID NO: 24932 - protein, 291 aa, Unknown
  Obtained from environmental sample
  DOMAIN (34)...(254): Reverse transcriptase (RNA-dependent DNA polymerase)
  misc_feature (1)..(291): Xaa is any amino acid
MSNSITAYRQIATEDKVKFKNNVHFAKDVFNEIKRRENCVALVLDIENFFPSLNHKKLKLAWAKILGHKTLPKDHFNLFKATTRFSYVRLKDLKTKNGHFDEKELAKHKKEGKHTFFNSIKDLIDSDIIIHKNQKQDEDKNLMGIPQGLPISALLANIYMLAFDQSVIKQLTLKHDVFYRRYSDDIVMICNQNQITLIEEFVESEMIKNKLTVSLEKTEKTLFKINKGRLQSYKIDNDNSLKENVPLNYLGSDFYGYQTFIKSKNLDKFYREMERTVRENIKELKLLKKNX

SEQ ID NO: 24933 - DNA, 798 bp, Unknown
  Obtained from environmental sample
  misc_feature (1)..(798): n is a, c, g, or t
ttgtttttagataaagccaaaatcactattagtggtaaaatcacgaatacagccataatccttttgggtaaatccgaatcaacacatttcatttctccaagtgtagcacaaatcacctggaaattagatactgaccaaaaagcgtatgagcatttcggtactcctttgtttttatcaatcaatgatgtattaaagcaaatacgtattgtaaggcataagttttttcctaacaatcagctcattgctaccgaagtgttaaactatgatgcagaagtaattttagaagcacttaacaattgtattgcccatcaagactacagttaccattcacgtattctattgactgaaaaagccaataaactcatttttgaaaatgcaggctctttctttgaaggtaaggcagatgattatttattgggtaaaaaaacacccgataaataccgaaataaatttttggcagaagcaatgttcaacctcaatatgatagatagtatgggctacggtattcacaaaatgaccaaaagccaataccaacgctattttcctttaccagattatactaagtctaaaagagacgaagtagtattagaaatttatggaaatgccattgacgagaacttctcaaagctccttattgagcataatgatgaaatgaaccttacagaggtaatccttttggataaagtacaaaaatcgttacccataacagatgatgctgcaaagcttttgaagaaaaaaggatttatagaagcaagaaagcccaactatttatctcctcagccgattcttgatccttag

SEQ ID NO: 24934 - protein, 265 aa, Unknown
  Obtained from environmental sample
  misc_feature (1)..(265): Xaa is any amino acid
MFLDKAKITISGKITNTAIILLGKSESTHFISPSVAQITWKLDTDQKAYEHFGTPLFLSINDVLKQIRIVRHKFFPNNQLIATEVLNYDAEVILEALNNCIAHQDYSYHSRILLTEKANKLIFENAGSFFEGKADDYLLGKKTPDKYRNKFLAEAMFNLNMIDSMGYGIHKMTKSQYQRYFPLPDYTKSKRDEVVLEIYGNAIDENFSKLLIEHNDEMNLTEVILLDKVQKSLPITDDAAKLLKKKGFIEARKPNYLSPQPILDP

SEQ ID NO: 24935 - DNA, 642 bp, Unknown
  Obtained from environmental sample
  misc_feature (1)..(642): n is a, c, g, or t
atggcaaaatacgagcagtataatgactttaaagagtcgtttttggtatggatgggagatgtgccaaaacattgggagataaataagtttaagtggatatttcaagaaaaaactaaaactctaaatccaagtctacccgcaggatcaattagttttggaaacgttgtttataaagatgaaaagaacttatcgcctgatacaaaggcttcatatcaagaagttttgaatggtgagtatcttataaatcctttaaacctcaacttcgatttaaaaagcttaagaactgcgttatcgcaaattgatgtagtagttagtactgggtatattgttctcactgataatggtgaattcaataagcaatacttgcgttggttactatatgagtttgatgttgctcatatgaaaaaattaggctcaggtgttcgccagacaataaactatacagatattgctaatagcttatttttccatcctgaatttaatgagcaagtgcaaattgccaactttctcgactacgaaaccgcccaaatcgataccctaatcgaaaagcagcaacccttaccaactattaaagaaagcgccagcggcattagtcatgccggactaaagcttaaccctgatcgccatgaaagatcggggtnn

SEQ ID NO: 24936 - protein, 214 aa, Unknown
  Obtained from environmental sample
  misc_feature (1)..(214): Xaa is any amino acid
MAKYEQYNDFKESFLVWMGDVPKHWEINKFKWIFQEKTKTLNPSLPAGSISFGNVVYKDEKNLSPDTKASYQEVLNGEYLINPLNLNFDLKSLRTALSQIDVVVSTGYIVLTDNGEFNKQYLRWLLYEFDVAHMKKLGSGVRQTINYTDIANSLFFHPEFNEQVQIANFLDYETAQIDTLIEKQQPLPTIKESASGISHAGLKLNPDRHERSGX

SEQ ID NO: 24937 - DNA, 711 bp, Unknown
  Obtained from environmental sample
  misc_feature (1)..(711): n is a, c, g, or t
atggcaaaatacgagcagtataatgactttaaagagtcgtttttggtatggatgggagatgtgccaaaacattgggagataaataagtttaagtggatatttcaagaaaaaactaaaactctaaatccaagtctacccgcaggatcaattagttttggaaacgttgtttataaagatgaaaagaacttatcgcctgatacaaaggcttcatatcaagaagttttgaatggtgagtatcttataaatcctttaaacctcaacttcgatttaaaaagcttaagaactgcgttatcgcaaattgatgtagtagttagtactgggtatattgttctcactgataatggtgaattcaataagcaatacttgcgttggttactatatgagtttgatgttgctcatatgaaaaaattaggctcaggtgttcgccagacaataaactatacagatattgctaatagcttatttttccatcctgaatttaatgagcaagtgcaaattgccaactttctcgactacgaaaccgcccaaatcgataccctaatcgaaaagcagcaaacccttatccaactattaaaagaaaagcgccaagcggtcattagtcatgccgtgactaaaggcttaaaccctgatgcgccgatgaaagattcgggcgtcgaatggttaggggaagtgcctgagcattggggtggttcacgctttagctttatatag

SEQ ID NO: 24938 - protein, 236 aa, Unknown
  Obtained from environmental sample
  misc_feature (1)..(236): Xaa is any amino acid
MAKYEQYNDFKESFLVWMGDVPKHWEINKFKWIFQEKTKTLNPSLPAGSISFGNVVYKDEKNLSPDTKASYQEVLNGEYLINPLNLNFDLKSLRTALSQIDVVVSTGYIVLTDNGEFNKQYLRWLLYEFDVAHMKKLGSGVRQTINYTDIANSLFFHPEFNEQVQIANFLDYETAQIDTLIEKQQTLIQLLKEKRQAVISHAVTKGLNPDAPMKDSGVEWLGEVPEHWGGSRFSFI

SEQ ID NO: 24939 - DNA, 396 bp, Unknown
  Obtained from environmental sample
  misc_feature (1)..(396): n is a, c, g, or t
atgttcttgaagatcctagaaagtcctggtaatgtccaagaaggcaaaacacaggcaatgcgacattggaaatttaaatcaataggagagattgatccgaaaacaattgtagtatacgttaatgaggctattgagaatgaaaagaaaggtatgcgtttaattcttgggaagaagaaaaagtcagaactaattattcccgagttgctcaaggaagccttagctgaaaacccaaaaatggagaaggcatttattgtcttgtcgccctacaaacagcgagattacgctgaatatatttcaagtgcaaaacaagaaaaaacaaaactatcccgtttggaaaagattataccaatgatcaatgaaggtataggacttaatgacaaataccgaaattgttaa

SEQ ID NO: 24940 - protein, 131 aa, Unknown
  Obtained from environmental sample
  misc_feature (1)..(131): Xaa is any amino acid
MFLKILESPGNVQEGKTQAMRHWKFKSIGEIDPKTIVVYVNEAIENEKKGMRLILGKKKKSELIIPELLKEALAENPKMEKAFIVLSPYKQRDYAEYISSAKQEKTKLSRLEKIIPMINEGIGLNDKYRNC

SEQ ID NO: 24941 - DNA, 534 bp, Unknown
  Obtained from environmental sample
  misc_feature (1)..(534): n is a, c, g, or t
ttgagggatttgtctctgaagaccaaagtaataggaactcttaaatggggctcaccagtttacattgctgaaggcaataatgttttttggattgctagatttaaaaatcactttggccttggattttttaatggaatgttcttgaaagatcctaaaaaagtcctggtaaatgtccaagaaggcaaaacacaggcaatgcgacattggaaatttaaatcaataggagagattgatccgaaaacaattgtagtatacgttaatgaggctattgagaatgaaaagaaaggtatgcgtttaattcttgggaagaagaaaaagtcagaactaattattcccgagttgctcaaggaagccttagctgaaaacccaaaaatggagaaggcatttattgtcttgtcgccctacaaacagcgagattacgctgaatatatttcaagtgcaaaacaagaaaaaacaaaactatcccgtttggaaaagattataccaatgatcaatgaaggtataggacttaatgacaaataccgaaattgttaa

SEQ ID NO: 24942 - protein, 177 aa, Unknown
  Obtained from environmental sample
  misc_feature (1)..(177): Xaa is any amino acid
MRDLSLKTKVIGTLKWGSPVYIAEGNNVFWIARFKNHFGLGFFNGMFLKDPKKVLVNVQEGKTQAMRHWKFKSIGEIDPKTIVVYVNEAIENEKKGMRLILGKKKKSELIIPELLKEALAENPKMEKAFIVLSPYKQRDYAEYISSAKQEKTKLSRLEKIIPMINEGIGLNDKYRNC

SEQ ID NO: 24943 - DNA, 498 bp, Unknown
  Obtained from environmental sample
  misc_feature (1)..(498): n is a, c, g, or t
atgaagcatatacttttgcctaccgatttttctgataattcttggaatgctattaaatatgctatttcacttttcaagaatgagatctgtacttttcatttgttaaacacgtatacgccagttgtgtatagagcagattatgttttcgggtctccagctgagtttggattggcagatgttatgagagacacctctcttgaaaatttaacccaatttactgatagaatttccgaaacctttaaagataatccgaagcataaatttacaaagttatctcgatttaactatttagtttctggtataaaagaatttataaccgaaaacaaaacagaccttattgtaatggggacccaaggtgccacaggtgctaaggaagtgttatttggttctaatacggtgcaagtttttaaaaatattaaatgtccggttatagctgttccttctcattttgaattcgaaaaaccacttgaattctctttcctacagatctccaggtag

SEQ ID NO: 24944 - protein, 165 aa, Unknown
  Obtained from environmental sample
  DOMAIN (1)...(147): Universal stress protein family
  misc_feature (1)..(165): Xaa is any amino acid
MKHILLPTDFSDNSWNAIKYAISLFKNEICTFHLLNTYTPVVYRADYVFGSPAEFGLADVMRDTSLENLTQFTDRISETFKDNPKHKFTKLSRFNYLVSGIKEFITENKTDLIVMGTQGATGAKEVLFGSNTVQVFKNIKCPVIAVPSHFEFEKPLEFSFLQISR

SEQ ID NO: 24945 - DNA, 498 bp, Unknown; identical to SEQ ID NO: 24943
  Obtained from environmental sample
  misc_feature (1)..(498): n is a, c, g, or t

SEQ ID NO: 24946 - protein, 165 aa, Unknown; identical to SEQ ID NO: 24944
  Obtained from environmental sample
  DOMAIN (1)...(147): Universal stress protein family
  misc_feature (1)..(165): Xaa is any amino acid

SEQ ID NO: 24947 - DNA, 813 bp, Unknown
  Obtained from environmental sample
  misc_feature (1)..(813): n is a, c, g, or t
ttgaatcttaaggattttctattcatgaatnttgtgtttattgatgtttgttctaaaaccgaagccattattaatagttttgagtgggttaaatggaccgtgtctaaaaaaagcatcagtgcttcaccagcaagaagtaccctgtataaaaaggcagaaggacaaatttttatagggttagatgatgatgcacatccaataagtgaagcctttataaaatctgtcgaagatgattttaataccaacaccaaccttggtattatagcgtttcaagaaataagaggattatacaaatttgatcacgaagcattaagtttagcaaaacaaattgaagcttattttacaaacgattttataggttgtggatttgctattaaaaaagagatatatgatgctacaagagggtttcctgtgtggattgatatttatggtgaagaaccagctttagctttagaggttttagatttaggctatcaaatattttatgatccgagaattatagtcaatcatcgtgtggatactgtaaaaaggaagttacaaggtaaaaactattttaggtttgagcatcaattaaaaaatacgattcgtttctatctggtgtattataaatcacctttaaaaaaaatagttaaattgttgttgcataattttacaaagtatgctttaaaagactttaagtattttaaatcttttgtatacgtttgcttttcaactcttttaaagttaccaacgattttaagttatagacgtcctgttaaagcaagtacgttacaaattataaaaaaactaaaaggactaaattattcaggataa

SEQ ID NO: 24948 - protein, 270 aa, Unknown
  Obtained from environmental sample
  misc_feature (1)..(270): Xaa is any amino acid
MNLKDFLFMNXVFIDVCSKTEAIINSFEWVKWTVSKKSISASPARSTLYKKAEGQIFIGLDDDAHPISEAFIKSVEDDFNTNTNLGIIAFQEIRGLYKFDHEALSLAKQIEAYFTNDFIGCGFAIKKEIYDATRGFPVWIDIYGEEPALALEVLDLGYQIFYDPRIIVNHRVDTVKRKLQGKNYFRFEHQLKNTIRFYLVYYKSPLKKIVKLLLHNFTKYALKDFKYFKSFVYVCFSTLLKLPTILSYRRPVKASTLQIIKKLKGLNYSG

SEQ ID NO: 24949 - DNA, 906 bp, Unknown
  Obtained from environmental sample
  misc_feature (1)..(906): n is a, c, g, or t
gtgggtaaacaattggagcagtctggctatgaggtgtattggtttgacgtgactgatggaggacctaaatcttcaaaaatagagtgggttactcaaataaaaggttggaagttaaaatgggattttccttttagaagtacaataaaaaaatacttacctaatctatataaaaacattcagaaaattaatgaaaatagcgttttaaaaacctttcaaagtactatagatcatatacaaccagatatagtccattgttttgaaatgcagttagcaggattgcctattctgcctataatgttagacaatacaataccatttatctattcatcttggggaagtgatgtgttttattttgagcaattaggtgtctcaaaacaagcattgcagcagttttacgcacgtgctaattatttaatcacagattgtaaacgcgattataagttagttttaaaaaatggttttaaaaatcaatttttaggcgtgtttcctggaaatggaggcttaactatccaaacatctaaaataaaaccgtttgataatagaccgcttattttgataaagggttatgacgatggtgtaggcaaagcatctaaagtattagaagctttattattagtttcacaagacttgttttttaacaaacatattgttatttatagtgcggatgatgttattgagcaacaaatacgagcttcagaaaaactctcagattttaatattaccgtatattctagacataaatttattcaaaatacagacttattagctgttatgggacaaagttgtattcatatagccaatagtatttccgatggaatgccaaatgcactattagaagccatgtcaatgggctgctttcctaatcaatctaatccagacaagtacagaaaaattatacgcatatag

SEQ ID NO: 24950 - protein, 301 aa, Unknown
  Obtained from environmental sample
  misc_feature (1)..(301): Xaa is any amino acid
MGKQLEQSGYEVYWFDVTDGGPKSSKIEWVTQIKGWKLKWDFPFRSTIKKYLPNLYKNIQKINENSVLKTFQSTIDHIQPDIVHCFEMQLAGLPILPIMLDNTIPFIYSSWGSDVFYFEQLGVSKQALQQFYARANYLITDCKRDYKLVLKNGFKNQFLGVFPGNGGLTIQTSKIKPFDNRPLILIKGYDDGVGKASKVLEALLLVSQDLFFNKHIVIYSADDVIEQQIRASEKLSDFNITVYSRHKFIQNTDLLAVMGQSCIHIANSISDGMPNALLEAMSMGCFPNQSNPDKYRKIIRI

SEQ ID NO: 24951 - DNA, 522 bp, Unknown
  Obtained from environmental sample
  misc_feature (1)..(522): n is a, c, g, or t
ttggagcaggtcaattacattaagcacctaaacgctgtattcttacaattctcaaaggatagccgtttaaatcccacgcacataagtttgtacgtggcattgtttcaattatggaacaactatcactttccgacagaattctatatcaatcgagaagaagcgatgcggttttccaagattggttcaaaaactacctaccatcgctgcatcaaagaactacatcattggaaatacctattatacgaaccctcacataatccatttaaaggcagcagaatcaagatgttcaattttgggacaagtgatggacaagctctgtacccaaancctaccaatatcgggacaagcaatggacaagcggtggtatctataaacaaacatatacaaacaggaaaaaaccaagcaaatgatactaaaattgacaagccaaaaaatgaaaatgaagtcattgattttttcgaaacggacatttgcgcacaattggaaggccaaaattctaaaccactaccaaggcatcggtga

SEQ ID NO: 24952 - protein, 173 aa, Unknown
  Obtained from environmental sample
  misc_feature (1)..(173): Xaa is any amino acid
MEQVNYIKHLNAVFLQFSKDSRLNPTHISLYVALFQLWNNYHFPTEFYINREEAMRFSKIGSKTTYHRCIKELHHWKYLLYEPSHNPFKGSRIKMFNFGTSDGQALYPXPTNIGTSNGQAVVSINKHIQTGKNQANDTKIDKPKNENEVIDFFETDICAQLEGQNSKPLPRHR

SEQ ID NO: 24953 - DNA, 471 bp, Unknown
  Obtained from environmental sample
  misc_feature (1)..(471): n is a, c, g, or t
atgaatccccacaaaccacatatcattaccgagggtagcgttcaatacaccttgggagaactgaaagacaatcaaatgctttatgattttgataaaatgctaatttatctcaatgccaaaggaaaactactttttggcaagaaattcaaaatttttgaagaagaccgtgatattatattcaagctctgtaattattttatcagggatgaagctaattgcaaaaaattagacatcgaccgcgataaagggattttgctttctggtcctgttggttgtggaaaaaccagtttaatgaaactgttacgccatattgtgccacatcagaaatcgtatgaggttatacccacacgaaacattgcctttgcctttaataatattgggtacaccatcattgaaaattacggcgacaaaaagttttattgtttgatgattntgggtgtagacccaccagaagctcgagccgattcttga

SEQ ID NO: 24954 - protein, 156 aa, Unknown
  Obtained from environmental sample
  misc_feature (1)..(156): Xaa is any amino acid
MNPHKPHIITEGSVQYTLGELKDNQMLYDFDKMLIYLNAKGKLLFGKKFKIFEEDRDIIFKLCNYFIRDEANCKKLDIDRDKGILLSGPVGCGKTSLMKLLRHIVPHQKSYEVIPTRNIAFAFNNIGYTIIENYGDKKFYCLMIXGVDPPEARADS

SEQ ID NO: 24955 - DNA, 483 bp, Unknown
  Obtained from environmental sample
  misc_feature (1)..(483): n is a, c, g, or t
atgttgcatcaaggactacatcatggaaaacctatatcggaccctcacataatccatttaaagccagcagaatcaaagatgttcaattttgggacaagtgatggacaagctctgtacccaaaccgtaccaatatcgggacaagcaatggacaagcggtggtatctataaacagacatatacaaacaggaaaaaacaaagcaaatgatactaaacttgacaagccaaaaaatgaaaatgaagtcattgatttttttgaaaaggaaaattggccagaattggaagccaaaaaattttacaaccactaccaaggcatcggttggaaagtaggtggaaaaacaaaaattgtcgattggcacgccacagctcgaaactggatgataaaggccgaagagctaaaagaagaaaaaacaatggttgcagttagccaaaatacggacaacctaaagacaagttccaacaaaaattataatgaaccattatga

SEQ ID NO: 24956 - protein, 160 aa, Unknown
  Obtained from environmental sample
  misc_feature (1)..(160): Xaa is any amino acid
MLHQGLHHGKPISDPHIIHLKPAESKMFNFGTSDGQALYPNRTNIGTSNGQAVVSINRHIQTGKNKANDTKLDKPKNENEVIDFFEKENWPELEAKKFYNHYQGIGWKVGGKTKIVDWHATARNWMIKAEELKEEKTMVAVSQNTDNLKTSSNKNYNEPL

SEQ ID NO: 24957 - DNA, 639 bp, Unknown
  Obtained from environmental sample
  misc_feature (1)..(639): n is a, c, g, or t
atggccaatctgtttaaggtacgtatcccaaccaataaagacccaaaagaggagcatgaagtctgggtatccgataaggccagtatcacgctgtatgagtttgaggcaaagtcgggcgcatttgccattgggcgtcatcctatgggtatctccaaaggtatcaacccagatgaaatcagtgtctttgcgctagtccgtaaccaacaaatcgtagtagtcgatgacaacacaaagctaaaattcggtgacagtgtctggtatgcgatgagaggtaatcacgcgagcaaaatcgccaagattttcaatgacacaacattagatcgcaaagctatcgatgacttctatggcgattggttgctatcaccgagtgttaagcttggagacttgccattttttacaggaattatggcgtctgagacactggtaaaaacacttaaaacgtccgatgaagacagcgcaaaaaacatgtgggagcagacggtggccgagtacgtgaaatcacacttaggtactgcgccagtgtcgggcgatactgttgtggtgagtgacgagtggtcattggttattaaggaagtcgatgacaaagggaagctaagaaccattggtctaaagtaccaacaaccgtctgcaatagtgtaa

SEQ ID NO: 24958 - protein, 212 aa, Unknown
  Obtained from environmental sample
  misc_feature (1)..(212): Xaa is any amino acid
MANLFKVRIPTNKDPKEEHEVWVSDKASITLYEFEAKSGAFAIGRHPMGISKGINPDEISVFALVRNQQIVVVDDNTKLKFGDSVWYAMRGNHASKIAKIFNDTTLDRKAIDDFYGDWLLSPSVKLGDLPFFTGIMASETLVKTLKTSDEDSAKNMWEQTVAEYVKSHLGTAPVSGDTVVVSDEWSLVIKEVDDKGKLRTIGLKYQQPSAIV

SEQ ID NO: 24959 - DNA, 756 bp, Unknown
  Obtained from environmental sample
  misc_feature (1)..(756): n is a, c, g, or t
atgattcatttcttcggaaaccaaaacagtaacctttttgctgttcaagcaacaaaagaattatcaacgcaaaccatttctaaattgatttggttatttggcaaccagccaaaaatagaacaagcatcattagatgctttttttgttggtcctagagctgcaatgattacaccttggagtactaatgcagtagaaatcacccaaaatatgggtattgatggcatcatcagaattgaagaatttgaagcttgccaaaaagactttacaggttttgatccaatgatttcagaaaaatataatggattaaaccaagagtcttttacaataaatatccaaccaaaaccaatattaaatattgaggatatagcgtcttataatcaacaagaaggtttagctttaaatgatgaagaaattgaatacttagaaggcgtatcaaaaaaaataggtcgtccattaacagattcagaagtctttgggttttctcaagtcaactcagagcattgtcgtcataaaatatttaatgggacatttgtcattgatggaaaagaaaaaccaacatcgctttttaaactaattaaagaaacctccaagcaacatccaaacactatcgtttcggcatataaagataatgttgcttttataaaaggtcctaaagtggagcaatttgcgccaaaacgtgcagatgttcctgatttctatgtaaaaaaagattacaactctgttatttcgcttaaagcggaaacacatactttctga

SEQ ID NO: 24960 - protein, 251 aa, Unknown
  Obtained from environmental sample
  misc_feature (1)..(251): Xaa is any amino acid
MIHFFGNQNSNLFAVQATKELSTQTISKLIWLFGNQPKIEQASLDAFFVGPRAAMITPWSTNAVEITQNMGIDGIIRIEEFEACQKDFTGFDPMISEKYNGLNQESFTINIQPKPILNIEDIASYNQQEGLALNDEEIEYLEGVSKKIGRPLTDSEVFGFSQVNSEHCRHKIFNGTFVIDGKEKPTSLFKLIKETSKQHPNTIVSAYKDNVAFIKGPKVEQFAPKRADVPDFYVKKDYNSVISLKAETHTF

SEQ ID NO: 24961 - DNA, 342 bp, Unknown
  Obtained from environmental sample
  misc_feature (1)..(342): n is a, c, g, or t
gtggcattatttaaaatatttgtagataagaaaggactttaccactttttattaaaatcagattccaaacatatcgtttttataagtgcaggcttttcttctaaagcaaattgcattaagaaaattcaaactgttaaacataattcgaaaaatgatcgtgcattttcccgtttaaaatcaaaatatggcaatccctattttaaatttagaaaaattaaaacggacgaaacaattggcattagtgagttgtttttaaataaatcattaatggagcgtaaaattgaagccattaagcaatcggcagttcatgctcctattgataagttaacctatactatttag

SEQ ID NO: 24962 - protein, 113 aa, Unknown
  Obtained from environmental sample
  DOMAIN (9)...(57): Domain of unknown function (DUF1508)
  misc_feature (1)..(113): Xaa is any amino acid
MALFKIFVDKKGLYHFLLKSDSKHIVFISAGFSSKANCIKKIQTVKHNSKNDRAFSRLKSKYGNPYFKFRKIKTDETIGISELFLNKSLMERKIEAIKQSAVHAPIDKLTYTI

SEQ ID NO: 24963 - DNA, 831 bp, Unknown
  Obtained from environmental sample
  misc_feature (1)..(831): n is a, c, g, or t
ttgaaactgtacatgagtaagcagatcaacgtcgctttaataggaaatccgaacacaggaaaaacatccgtttttaatgcactaactggattaaaccaaaaagttggaaattatccaggtattactgttgaaaaaaaagaaggtatatgcaaacttccacgaggagttaaagcacatatcatcgatttaccaggaacgtacagtttaaatgcatcgtctttagatgaaaatgtagttattgaattgctacttaataaaacagacaaagatcatccagatgttgctgttgttgttagtgatgtcgaaaatttaaagcgaaatttattactatttactcaaattaaagatttaaagattccaacaattttagtgattaatatgtctgatagaatggcctataaaggtatttcgttagatatcgatcatttagaacagcaactcaaaactaaaattgcccttataagtactagaaaaaataaaggtattgatgaacttaaagaattaataacaaactatagagagctctctacagaaccatgcttagatgcatccataatagatgaaacctattttaacaacttaagaaaggcatttcctaatcagttattatacaaactttggttggttattactcaagatgttaatttcggaaaaacagatagaaaaacttttgaagctgtagaagattttaaaactaagtctaaagcagatttaaaacgtcttcaacaaaaggaaacgataaaacgttatcaatttataaacgaaacactacaaaaagggcaaaccatagatcttaaatctgntaaagatttaagnaatacaactagatag

SEQ ID NO: 24964 - protein, 276 aa, Unknown
  Obtained from environmental sample
  DOMAIN (13)...(232): Ferrous iron transport protein B
  misc_feature (1)..(276): Xaa is any amino acid
MKLYMSKQINVALIGNPNTGKTSVFNALTGLNQKVGNYPGITVEKKEGICKLPRGVKAHIIDLPGTYSLNASSLDENVVIELLLNKTDKDHPDVAVVVSDVENLKRNLLLFTQIKDLKIPTILVINMSDRMAYKGISLDIDHLEQQLKTKIALISTRKNKGIDELKELITNYRELSTEPCLDASIIDETYFNNLRKAFPNQLLYKLWLVITQDVNFGKTDRKTFEAVEDFKTKSKADLKRLQQKETIKRYQFINETLQKGQTIDLKSXKDLXNTTR

SEQ ID NO: 24965 - DNA, 357 bp, Unknown
  Obtained from environmental sample
  misc_feature (1)..(357): n is a, c, g, or t
ttgcaattcaaaatttttaacacatttaaaatgtcgtttctctcattctttaaaggctataaaaaattcggtatattcttttctatactttcccttattattattgtcattatctacaatgtcttaaatgtaaaacaaccgcttcctatttatcaaccagctatggtcagtgaagaattggtagacagcactattcagcatcaattaaaatatcataagattgccgattttagtctcacaaatcaaaatggtgaaaccataacgcaagacacttataaaggacaaatatatgtggcgggattcttctttaaaacctggcaaaccatttgcccaataatgaccgacccatttttttga

SEQ ID NO: 24966 - protein, 118 aa, Unknown
  Obtained from environmental sample
  misc_feature (1)..(118): Xaa is any amino acid
MQFKIFNTFKMSFLSFFKGYKKFGIFFSILSLIIIVIIYNVLNVKQPLPIYQPAMVSEELVDSTIQHQLKYHKIADFSLTNQNGETITQDTYKGQIYVAGFFFKTWQTICPIMTDPFF

SEQ ID NO: 24967 - DNA, 462 bp, Unknown
  Obtained from environmental sample
  misc_feature (1)..(462): n is a, c, g, or t
atgaaaagacacaccgttttatatcttttacttattgttttaattataatgaatggcttttttctattcaattatataggtcgtccaggtcagaatggaccaaaagcatcaggagattttattgtaactgagttaaaatttaatgaccaacaattagcacaatttaaaagtttagaagctaaacatcacaataatatgcgtgcagttggtgatgctattaagtctttaaaagaccagttgtttagtaatattactgcagcttcaattgatcaacaagagatagataatttaatagcaaatattgcagacaaaacaattacaagagaacacgaattgtttaaaagattaagggcaatttataatttgtctgatgataaacaaaaagaacaatttaaatctataataaaaaaagcacgaagatttgataatcaaggaccagaacatcctaatagaccagattaa

SEQ ID NO: 24968 - protein, 153 aa, Unknown
  Obtained from environmental sample
  misc_feature (1)..(153): Xaa is any amino acid
MKRHTVLYLLLIVLIIMNGFFLFNYIGRPGQNGPKASGDFIVTELKFNDQQLAQFKSLEAKHHNNMRAVGDAIKSLKDQLFSNITAASIDQQEIDNLIANIADKTITREHELFKRLRAIYNLSDDKQKEQFKSIIKKARRFDNQGPEHPNRPD

SEQ ID NO: 24969 - DNA, 588 bp, Unknown
  Obtained from environmental sample
  misc_feature (1)..(588): n is a, c, g, or t
ttgcatctaaacttattaatagaatatctaacatttttgacagaaacagattttatacaccagcttaaggctaaaagtagcgcctcttatagtaagcttttggaggattttcagcacaaagtgtttgggacttgtctgtcatttgtaccaaatagggaagatgcagaggatatcgctcaagaggtttttgtggaggtttttaattctattcataaatttaagcaagaatctaagttatccacatggatttataggattacaaccaataaatgtttagaatttattagaaaaaaaaacgctaaaaaacgttttgcttttttagagtcattgtcaagtaatgattataatctagataaagctagttactttacagagattaatcatccaggattagttttagaacaaaaagaaactagtgaaatcttgtttttagctattaacaaattgcctgaagcacaacgtatagtttttacgctaaataaaattgatgataaaagctataaagaaattagtgaaattactaataaaagtgttgggtctattgagtctttgctgtttagagctaaaaagaattaccaaaaacactag

SEQ ID NO: 24970 - protein, 195 aa, Unknown
  Obtained from environmental sample
  DOMAIN (145)...(194): Sigma-70, region 4
  misc_feature (1)..(195): Xaa is any amino acid
MHLNLLIEYLTFLTETDFIHQLKAKSSASYSKLLEDFQHKVFGTCLSFVPNREDAEDIAQEVFVEVFNSIHKFKQESKLSTWIYRITTNKCLEFIRKKNAKKRFAFLESLSSNDYNLDKASYFTEINHPGLVLEQKETSEILFLAINKLPEAQRIVFTLNKIDDKSYKEISEITNKSVGSIESLLFRAKKNYQKH

SEQ ID NO: 24971 - DNA, 615 bp, Unknown
  Obtained from environmental sample
  misc_feature (1)..(615): n is a, c, g, or t
ttgcatctaaacttattaatagaatatctaacatttttgacagaaacagattttatacaccagcttaaggctaaaagtagcgcctcttatagtaagcttttggaggattttcagcacaaagtgtttgggacttgtctgtcatttgtaccaaatagggaagatgcagaggatatcgctcaagaggtttttgtggaggtttttaattctattcataaatttaagcaagaatctaagttatccacatggatttataggattacaaccaataaatgtttagaatttattagaaaaaaaaacgctaaaaaacgttttgcttttttagagtcattgtcaagtaatgattataatctagataaagctagttactttacagagattaatcatccaggattagttttagaacaaaaagaaactagtgaaatcttgtttttagctattaacaaattgcctgaagcacaacgtatagtttttacgctaaataaaattgatgataaaagctataaagaaattagtgaaattactaataaaagtgttgggtctattgagtctttgctgtttagagctaaaaagaatttacaaaaaacactagaaaatttttataaaaatcaagagtaa

SEQ ID NO: 24972 - protein, 204 aa, Unknown
  Obtained from environmental sample
  DOMAIN (145)...(194): Sigma-70, region 4
  misc_feature (1)..(204): Xaa is any amino acid
MHLNLLIEYLTFLTETDFIHQLKAKSSASYSKLLEDFQHKVFGTCLSFVPNREDAEDIAQEVFVEVFNSIHKFKQESKLSTWIYRITTNKCLEFIRKKNAKKRFAFLESLSSNDYNLDKASYFTEINHPGLVLEQKETSEILFLAINKLPEAQRIVFTLNKIDDKSYKEISEITNKSVGSIESLLFRAKKNLQKTLENFYKNQE

SEQ ID NO: 24973 - DNA, 549 bp, Unknown
  Obtained from environmental sample
  misc_feature (1)..(549): n is a, c, g, or t
atgagttcaagcaagttctttgggacaactgtcggaggatatggcaaaggcctccgggaggatatcaaaaaatattacggggctgtccttggctttggaggccggggcgaatctattgccatgaaggataattactgcgaaatagaccctaccaaggtcgatgaatttggtattcccgtacttcgcttccattacaaatggtccgattacgaacgcaaacaggtaaggcacatgcaggatacctttgaagaactgatccacaatatgggtggggaagcgttgggcgcaaaacccatcaaggaagaggattatggcatatccccgccaggctggatcattcatgaggtaggcactaccagaatgggcaatgatcccaaaacttcggtaaccaataagtttcaacaacttcacgacacggataatgtatttatcgttgatgcgggccctttcgtatcccaagcggacaagaacccgacctggaccattttggccctctcttggagaacatcggaccatatcatcgaacaattgaaacagcaaaatatctag

SEQ ID NO: 24974 - protein, 182 aa, Unknown
  Obtained from environmental sample
  misc_feature (1)..(182): Xaa is any amino acid
MSSSKFFGTTVGGYGKGLREDIKKYYGAVLGFGGRGESIAMKDNYCEIDPTKVDEFGIPVLRFHYKWSDYERKQVRHMQDTFEELIHNMGGEALGAKPIKEEDYGISPPGWIIHEVGTTRMGNDPKTSVTNKFQQLHDTDNVFIVDAGPFVSQADKNPTWTILALSWRTSDHIIEQLKQQNI

SEQ ID NO: 24975 - DNA, 750 bp, Unknown
  Obtained from environmental sample
  misc_feature (1)..(750): n is a, c, g, or t
atgcccgaaattgatgggtttgaactgattaaatttgtatctgaacattatcctaacttaccaaaacttatagtaacgggttatccttcggttcaagattcgctaagtgccataaaatctggagttgccgaatatttaaccaaaccttttacaaaaaacgaacttaaattagcgatagacaaatcgttgactagaccaaattcacaaaagaagcaacaaacagaaaattttaaagagcctaccgcttatggagaaattattggaacttcaaaaaaaataagtgaggttgtagaaatcatccaacgtgttaaaaacaataaagccaccatttttataaacggggaaagtggtacaggtaaagagttagtagcacgtgctatccattatcaaggcaaattttctagagcaccttttatagctgttaattgcggggctattccagaaaacttattagaatcggagctttttggttatattaaaggcgcttttacaggcgcagataccgatagaaacggcttttttcaagcggcgaatggagggactatttttttagatgaaataggaaacgcttcactagcagtacaatctcgattattacgcgtgttacaagagaaaaaagtagtgaaagtagggtctcaaaaacaagaggagatcgatgttaggattataaccgcaaccaatagtgatttaaaggagatgataaacaaacagctttttagagaagatttgtattctcgagccgattcttga

SEQ ID NO: 24976 - protein, 249 aa, Unknown
  Obtained from environmental sample
  DOMAIN (86)...(249): Sigma-54 interaction domain
  misc_feature (1)..(249): Xaa is any amino acid
MPEIDGFELIKFVSEHYPNLPKLIVTGYPSVQDSLSAIKSGVAEYLTKPFTKNELKLAIDKSLTRPNSQKKQQTENFKEPTAYGEIIGTSKKISEVVEIIQRVKNNKATIFINGESGTGKELVARAIHYQGKFSRAPFIAVNCGAIPENLLESELFGYIKGAFTGADTDRNGFFQAANGGTIFLDEIGNASLAVQSRLLRVLQEKKVVKVGSQKQEEIDVRIITATNSDLKEMINKQLFREDLYSRADS

SEQ ID NO: 24977 - DNA, 888 bp, Unknown
  Obtained from environmental sample
  misc_feature (1)..(888): n is a, c, g, or t
atggtattcaaaaaagaaaacatacttattgttgatgacgatattaatatattagagctcttacagcgccatttaaacacatggaattatcacgtttataaagcgatttctgtacgagaggcagttactattttaaaagacaataccattaatctattaattaccgatcttaaaatgcccgaaattgatgggtttgaactgattaaatttgtatctgaacattatcctaacttaccaaaacttatagtaacgggttatccttcggttcaagattcgctaagtgccataaaatctggagttgccgaatatttaaccaaaccttttacaaaaaacgaacttaaattagcgatagacaaatcgttgactagaccaaattcacaaaagaagcaacaaacagaaaattttaaagagcctaccgcttatggagaaattattggaacttcaaaaaaaataagtgaggttgtagaaatcatccaacgtgttaaaaacaataaagccaccatttttataaacggggaaagtggtacaggtaaagagttagtagcacgtgctatccattatcaaggcaaattttctagagcaccttttatagctgttaattgcggggctattccagaaaacttattagaatcggagctttttggttatattaaaggcgcttttacaggcgcagataccgatagaaacggcttttttcaagcggcgaatggagggactatttttttagatgaaataggaaacgcttcactagcagtacaatctcgattattacgcgtgttacaagagaaaaaagtagtgaaagtagggtctcaaanacaagaggagatcgatgttaggattataccgcaaccaatagtgattaaaggagatactaacaacagcttttag

SEQ ID NO: 24978 - protein, 295 aa, Unknown
  Obtained from environmental sample
  DOMAIN (6)...(125): Response regulator receiver domain
  misc_feature (1)..(295): Xaa is any amino acid
MVFKKENILIVDDDINILELLQRHLNTWNYHVYKAISVREAVTILKDNTINLLITDLKMPEIDGFELIKFVSEHYPNLPKLIVTGYPSVQDSLSAIKSGVAEYLTKPFTKNELKLAIDKSLTRPNSQKKQQTENFKEPTAYGEIIGTSKKISEVVEIIQRVKNNKATIFINGESGTGKELVARAIHYQGKFSRAPFIAVNCGAIPENLLESELFGYIKGAFTGADTDRNGFFQAANGGTIFLDEIGNASLAVQSRLLRVLQEKKVVKVGSQXQEEIDVRIIPQPIVIKGDTNNSF

SEQ ID NO: 24979 - DNA, 684 bp, Unknown
  Obtained from environmental sample
  misc_feature (1)..(684): n is a, c, g, or t
ttgctagaatacaaggccagatataaagaagatccacgtttagctgtaaaaccttttgctttatacgcagatgattggataaattggatagagtttcttggattgaaaaagaaaagttttaagtcttatgaagatgctaagaaaattatccaaactttaaatattattagttttgccgattataaaaactgtcctttagctgatttgtacttacctaagaatcctgacagctattactctgctagttggacaaattggaaagattttgtcttacctgaaatcgttgataacttagaaatactcaaaaaagcatgcaaaatacttaatattagtaactcgaagcagtatcgggaggtacaaaaaaaatataaacaattaccttccaagccagataaaaagtttgaagattgggttgattggtatgatttattaaatatcccccggccatattcatatgaagaactacgtttaatagtattaaaatataaatgtaagactttaaaagattataaagatatgcgcaccaaactacatgatccgcgaattccttcgtcgccagaagagacttataaaacatgtggctggacaaacgcatataaatttcttggaacaattagaccatatcaaattaaatattttgatccaaaatggacattttgggcagatttcatagttgaattttga

SEQ ID NO: 24980 - protein, 227 aa, Unknown
  Obtained from environmental sample
  misc_feature (1)..(227): Xaa is any amino acid
MLEYKARYKEDPRLAVKPFALYADDWINWIEFLGLKKKSFKSYEDAKKIIQTLNIISFADYKNCPLADLYLPKNPDSYYSASWTNWKDFVLPEIVDNLEILKKACKILNISNSKQYREVQKKYKQLPSKPDKKFEDWVDWYDLLNIPRPYSYEELRLIVLKYKCKTLKDYKDMRTKLHDPRIPSSPEETYKTCGWTNAYKFLGTIRPYQIKYFDPKWTFWADFIVEF

SEQ ID NO: 24981 - DNA, 495 bp, Unknown
  Obtained from environmental sample
  misc_feature (1)..(495): n is a, c, g, or t
atggaatttgtacaacagtatttgcaaagtgagcgtttacttggcttaagcgcaggaattataggcttattatctattactactggtataattttttacgttaacaaaccacaatttaaagtctttgcgattaccatgttaatcattggattaatagaagctggattatttataactggttactttttagtaaacaatcaaaataacgtaaataaaaaaatagaacaatttgaaagtaataaagacaactatttaaagactgacaaaatagttgtggataaaaacctgaaagccttttttatccttaaattaatttatgccataacgtttataaccttagctattgtgttatctaagattaaccttaaacccatctattttggcatatttacagctttaatgatccatctagctgctgctattgtaattgatacatttggagaacgttatactaaaatatataagaccaatattgaaactacattaaaaatataa

SEQ ID NO: 24982 - protein, 164 aa, Unknown
  Obtained from environmental sample
  misc_feature (1)..(164): Xaa is any amino acid
MEFVQQYLQSERLLGLSAGIIGLLSITTGIIFYVNKPQFKVFAITMLIIGLIEAGLFITGYFLVNNQNNVNKKIEQFESNKDNYLKTDKIVVDKNLKAFFILKLIYAITFITLAIVLSKINLKPIYFGIFTALMIHLAAAIVIDTFGERYTKIYKTNIETTLKI

SEQ ID NO: 24983 - DNA, 699 bp, Unknown
  Obtained from environmental sample
  misc_feature (1)..(699): n is a, c, g, or t
gtgagccgactagcattaactcaatatttcttcacgtgctttgtattggtttttggttttaaaattattacacattatctacttttaaaatatagggccatttttaagggaaatatgagagtcattgtcgttattggaaaaaataagaaaatgaatcagctcataaaaatctttaacaatcgattggattttggatatgaagtgagaaagcagtttaattcacgtgccgaaggattttcattagaggagtgctttaaatatattgcagagcataaaatcgataaaatatacttttcagtttctgaactttcaaataatcaaattaatagactggttaattttgcagataataaccttatagagctcaagtttattccagataatatggaggtctttagtaagaaattgaaatacgaatattatgagtttatccccgttttatctatgcgagagattcctttagacgaacctttaaatatgataattaagcgcgtcttcgatattgtgttttcgctaatagtaattgtctttttgttatcgtggttaacaccaattatcgctattttaattaaactagactccaaagggcctgtgttttttaagcaatctagaaacggttttagtcgctcagaatttaactgttataagtttcgttctatgacggtatatgataatgcacacattgnacaagccacgtaa

SEQ ID NO: 24984 - protein, 232 aa, Unknown
  Obtained from environmental sample
  misc_feature (1)..(232): Xaa is any amino acid
MSRLALTQYFFTCFVLVFGFKIITHYLLLKYRAIFKGNMRVIVVIGKNKKMNQLIKIFNNRLDFGYEVRKQFNSRAEGFSLEECFKYIAEHKIDKIYFSVSELSNNQINRLVNFADNNLIELKFIPDNMEVFSKKLKYEYYEFIPVLSMREIPLDEPLNMIIKRVFDIVFSLIVIVFLLSWLTPIIAILIKLDSKGPVFFKQSRNGFSRSEFNCYKFRSMTVYDNAHIXQAT

SEQ ID NO: 24985 - DNA, 474 bp, Unknown
  Obtained from environmental sample
  misc_feature (1)..(474): n is a, c, g, or t
ttgggctttgatgcagagaaaacagcattagataaaaatttaagtatagacttaagactaaatttagcagatgatttgttattgtatacagataaaataacaatgcaccattctatagaagctagagtaccaatcttagacttagaattaattgcatttatcgagtctttgcctcacgactttaaagttaggtttcgaaaaacaaaaattatacataaagccttagctaaaaaaatacttccgccagaaattattaataggaagaagaaagcgtttaagtcaccaacaaaacagtggttcgaaacacataataatgaaatattagcgctattaaccaataagaattctaagttttcagcttattttaatgtagaagaagtcgcaaaggttgtaaaattgcataagcgtggcgagaataaagaaaaagaaatatttcttttattaaatttttactattggttcaagaatttttaa

SEQ ID NO: 24986 - protein, 157 aa, Unknown
  Obtained from environmental sample
  misc_feature (1)..(157): Xaa is any amino acid
MGFDAEKTALDKNLSIDLRLNLADDLLLYTDKITMHHSIEARVPILDLELIAFIESLPHDFKVRFRKTKIIHKALAKKILPPEIINRKKKAFKSPTKQWFETHNNEILALLTNKNSKFSAYFNVEEVAKVVKLHKRGENKEKEIFLLLNFYYWFKNF

SEQ ID NO: 24987 - DNA, 921 bp, Unknown
  Obtained from environmental sample
  misc_feature (1)..(921): n is a, c, g, or t
gtgagttggattgatgacgagattgctttaattcaacttcactctaatgtctctgactcaaaaaaagatgtcgctttaatattaaaaacaaaagcaattgacgatgctaaagacaacttagattttatattagaacaaattagaaaacgtacaccagtaaagtttaaagaagttaattacaaaggatacgccataaattttatgtctatcaaaggttttttcaaaatcattttaggcgatttattttcaaatattgaaaaaccttattttacaattatagacgattatgtaataattagtaatgagcccaataccttaaaaagtataattaatgcttacacaaacaaagagaccttaaactattttaaagcctttaatgactttgataacaggtttaataataagtctagtgtgtttgcttacattaatactcctaatttatataatacagcttatgactttgtagatattgcaactaaaaaacagctaaaaactaataaagattactttatatgttttccgcaaataggcatacaattaacaccaagcaaaaacgactttaaaagccaattaatactagagtatcaaacgcctgaaaaagttaagtctagctatacttttgaggatgataaaacaaaaacaattattactaattctattaatcttacagaagagaacattaataaagctaccgtttttagcatcccagaattatatccttctgatttaactgctcaaatttttacaaaaaaatactctaacggaaacccacgtttttctgttgaattaaaagatggattcaaacatggtagctacaaagcgtattatcaaaatgcgaatttaaaaatttcgggtaaatatcgaacagaccaacaagttggcacttggaaagcgtatgatattatgaaaatttatttttnn

SEQ ID NO: 24988 - protein, 307 aa, Unknown
  Obtained from environmental sample
  misc_feature (1)..(307): Xaa is any amino acid
MSWIDDEIALIQLHSNVSDSKKDVALILKTKAIDDAKDNLDFILEQIRKRTPVKFKEVNYKGYAINFMSIKGFFKIILGDLFSNIEKPYFTIIDDYVIISNEPNTLKSIINAYTNKETLNYFKAFNDFDNRFNNKSSVFAYINTPNLYNTAYDFVDIATKKQLKTNKDYFICFPQIGIQLTPSKNDFKSQLILEYQTPEKVKSSYTFEDDKTKTIITNSINLTEENINKATVFSIPELYPSDLTAQIFTKKYSNGNPRFSVELKDGFKHGSYKAYYQNANLKISGKYRTDQQVGTWKAYDIMKIYFX

SEQ ID NO: 24989 - DNA, 735 bp, Unknown
  Obtained from environmental sample
  misc_feature (1)..(735): n is a, c, g, or t
atgtctatcaaaggttttttcaaaatcattttaggcgatttattttcaaatattgaaaaaccttattttacaattatagacgattatgtaataattagtaatgagcccaataccttaaaaagtataattaatgcttacacaaacaaagagaccttaaactattttaaagcctttaatgactttgataacaggtttaataataagtctagtgtgtttgcttacattaatactcctaatttatataatacagcttatgactttgtagatattgcaactaaaaaacagctaaaaactaataaagattactttatatgttttccgcaaataggcatacaattaacaccaagcaaaaacgactttaaaagccaattaatactagagtatcaaacgcctgaaaaagttaagtctagctatacttttgaggatgataaaacaaaaacaattattactaattctattaatcttacagaagagaacattaataaagctaccgtttttagcatcccagaattatatccttctgatttaactgctcaaatttttacaaaaaaatactctaacggaaacccacgtttttctgttgaattaaaagatggattaaaacatggtagctacaaagcgtattatcaaaatggaaatttaaaaatttcgggtaaatatagaaaagacaaacaagttggcacttggaaagcgtatgatattactgaaaatttaatttctaaaaccacgttctaa

SEQ ID NO: 24990 - protein, 244 aa, Unknown
  Obtained from environmental sample
  misc_feature (1)..(244): Xaa is any amino acid
MSIKGFFKIILGDLFSNIEKPYFTIIDDYVIISNEPNTLKSIINAYTNKETLNYFKAFNDFDNRFNNKSSVFAYINTPNLYNTAYDFVDIATKKQLKTNKDYFICFPQIGIQLTPSKNDFKSQLILEYQTPEKVKSSYTFEDDKTKTIITNSINLTEENINKATVFSIPELYPSDLTAQIFTKKYSNGNPRFSVELKDGLKHGSYKAYYQNGNLKISGKYRKDKQVGTWKAYDITENLISKTTF

SEQ ID NO: 24991 - DNA, 822 bp, Unknown
  Obtained from environmental sample
  misc_feature (1)..(822): n is a, c, g, or t
gtggatcaagaatcggctcgagaatcaaaggacactgaaaaagtgttggacagcagttgtggtactggtggcttcgttgttactgctatgaatgttgtaattgacagaattaaaaatcaacttgaaagtcaatatggcgagaaagctggatggaattcagacgtgctttccgtttacaatgacaaaatatctgaaatagcagcagaaaattattttggttttgatataaatccagaccttgttaaatctaccaaaatgaatatggtaatgaataatgatggtagtgggaatattttacaactaaattcacttttaccaccacaagaatgggaagaagaaactaaaaaaacacttgccaaagcattaggacttaaagcaagtgcaattacgaaccacaacagtttaggacattttgatgtcattgtaacaaatccgccatttggttcaaaaattccaattaaagaccaacagatattagaacagtttgatattggttacatatggaataaagacgataatggtaattggtttaaaactgaccgtttacagtcaagtgttgcaccagaacaactttttatagaacgtattattcaacttttaaaagaaggtggtagaaccgctattgttcttcctgactcgatacttggtgcaccaggattagagtatttgagatattggttaattaaaaatacgaaaataattgcaagtgtagatttgcataaagatgcttttcaacctcgaaatggcacacaatgttctattcttatacttcaaaagaaaacaaaagcagaaattagcgaagaagaaaatcaagagaaataa

SEQ ID NO: 24992 - protein, 273 aa, Unknown
  Obtained from environmental sample
  misc_feature (1)..(273): Xaa is any amino acid
MDQESARESKDTEKVLDSSCGTGGFVVTAMNVVIDRIKNQLESQYGEKAGWNSDVLSVYNDKISEIAAENYFGFDINPDLVKSTKMNMVMNNDGSGNILQLNSLLPPQEWEEETKKTLAKALGLKASAITNHNSLGHFDVIVTNPPFGSKIPIKDQQILEQFDIGYIWNKDDNGNWFKTDRLQSSVAPEQLFIERIIQLLKEGGRTAIVLPDSILGAPGLEYLRYWLIKNTKIIASVDLHKDAFQPRNGTQCSILILQKKTKAEISEEENQEK

SEQ ID NO: 24993 - DNA, 1035 bp, Unknown
  Obtained from environmental sample
  misc_feature (1)..(1035): n is a, c, g, or t
gtggacagcagttgtggtactggtggcttcgttgttactgctatgaatgttgtaattgacagaattaaaaatcaacttgaaagtcaatatggcgagaaagctggatggaattcagacgtgctttccgtttacaatgacaaaatatctgaaatagcagcagaaaattattttggttttgatataaatccagaccttgttaaatctaccaaaatgaatatggtaatgaataatgatggtagtgggaatattttacaactaaattcacttttaccaccacaagaatgggaagaagaaactaaaaaaacacttgccaaagcattaggacttaaagcaagtgcaattacgaaccacaacagtttaggacattttgatgtcattgtaacaaatccgccatttggttcaaaaattccaattaaagaccaacagatattagaacagtttgatattggttacatatggaataaagacgataatggtaattggtttaaaactgaccgtttacagtcaagtgttgcaccagaacaactttttatagaacgtattattcaacttttaaaagaaggtggtagaaccgctattgttcttcctgactcgatacttggtgcaccaggattagagtatttgagatattggttaattaaaaatacgaaaataattgcaagtgtagatttgcataaagatgcttttcaacctcgaaatggcacacaatgttctattcttatacttcaaaagaaaacaaaagcagaaatagccgaagaagaaaaatcaagagaaataatagactacgaaatttttatgactatgatagaccacataggtcacgataaacgtggaggaaagatttttaaacgtgataaaaatggagatgttgttatggttgaagtcgaggaaattgttagagaaaaagatgccgacggaaatttaattgcccgaaaagaagttactcaagagaaaattgtaaatgaccaaactattcacgtagcaaaagttttggctgtttggaaaacaaaccagggattgggtggtcgannnana

SEQ ID NO: 24994 - protein, 345 aa, Unknown
  Obtained from environmental sample
  DOMAIN (150)...(305): N-6 DNA Methylase
  misc_feature (1)..(345): Xaa is any amino acid
MDSSCGTGGFVVTAMNVVIDRIKNQLESQYGEKAGWNSDVLSVYNDKISEIAAENYFGFDINPDLVKSTKMNMVMNNDGSGNILQLNSLLPPQEWEEETKKTLAKALGLKASAITNHNSLGHFDVIVTNPPFGSKIPIKDQQILEQFDIGYIWNKDDNGNWFKTDRLQSSVAPEQLFIERIIQLLKEGGRTAIVLPDSILGAPGLEYLRYWLIKNTKIIASVDLHKDAFQPRNGTQCSILILQKKTKAEIAEEEKSREIIDYEIFMTMIDHIGHDKRGGKIFKRDKNGDVVMVEVEEIVREKDADGNLIARKEVTQEKIVNDQTIHVAKVLAVWKTNQGLGGRXX

SEQ ID NO: 24995 - DNA, 753 bp, Unknown
  Obtained from environmental sample
  misc_feature (1)..(753): n is a, c, g, or t
ttggtacaaaacttttttgagcttactgttgagcaaaccagaatacctttaatttctaaggtaataccaactgcacaatcgcatatattattttttaaatcaaaatcaccactagaaacaggcgtaagaaataaaatttataagaataaaggaatcgttgtatttgggcaatcctataaatcttacacgatgaaggcacaaaacccctattttaatttcgggattaatttgcatccaactgcgctatacaaaattttaaaaacagatatttctaaattaacagataaacatattaacctatctaaaatagatactaaattatatgagttattatatcctgtttttaaagaaaaccttcacggaacagcattagcacaacgtattgaaagccaactatcaaaccttcaaatttacgaaagtaaaaacacaaaattagtggacgaagctattaaggtgatatacaaaaaagaaggtaaaattaatgtagaagaacttcttaaaatatttccaatttcgcaaaaacatctagaagtacagtttaaaaaaaccataggattaacacctttaaaatttataaaactttataaatttttaagtttaatgaggcaatacgaatctaaaaaagcatcaataacacaattaatagagtattatgcttattatgacctgtctcattttantaaagactttaaattatttatgaaccaaaagccctcagattacttcaaatctgagatctcgaccgattcttga

SEQ ID NO: 24996 - protein, 250 aa, Unknown
  Obtained from environmental sample
  misc_feature (1)..(250): Xaa is any amino acid
MVQNFFELTVEQTRIPLISKVIPTAQSHILFFKSKSPLETGVRNKIYKNKGIVVFGQSYKSYTMKAQNPYFNFGINLHPTALYKILKTDISKLTDKHINLSKIDTKLYELLYPVFKENLHGTALAQRIESQLSNLQIYESKNTKLVDEAIKVIYKKEGKINVEELLKIFPISQKHLEVQFKKTIGLTPLKFIKLYKFLSLMRQYESKKASITQLIEYYAYYDLSHFXKDFKLFMNQKPSDYFKSEISTDS

SEQ ID NO: 24997 - DNA, 741 bp, Unknown
  Obtained from environmental sample
  misc_feature (1)..(741): n is a, c, g, or t
atgaattttagatatatagaatgtaccaacactaaccagttggtacaaaacttttttgagcttactgttgagcaaaccagaatacctttaatttctaaggtaataccaactgcacaatcgcatatattattttttaaatcaaaatcaccactagaaacaggcgtaagaaataaaatttataagaataaaggaatcgttgtatttgggcaatcctataaatcttacacgatgaaggcacaaaacccctattttaatttcgggattaatttgcatccaactgcgctatacaaaattttaaaaacagatatttctaaattaacagataaacatattaacctatctaaaatagatactaaattatatgagttattatatcctgtttttaaagaaaaccttcacggaacagcattagcacaacgtattgaaagccaactatcaaaccttcaaatttacgaaagtaaaaacacaaaattagtggacgaagctattaaggtgatatacaaaaaagaaggtaaaattaatgtagaagaacttcttaaaatatttccaatttcgcaaaaacatctagaagtacagtttaaaaaaaccataggattaacacctttaaaatttataaaactttataaatttttaagtttaatgaggcaatacgaatctaaaaaagcatcaataacacaattaatagagtattatgcttattatgacctgtctcattttactaaagactttaattatttatga

SEQ ID NO: 24998 - protein, 246 aa, Unknown
  Obtained from environmental sample
  misc_feature (1)..(246): Xaa is any amino acid
MNFRYIECTNTNQLVQNFFELTVEQTRIPLISKVIPTAQSHILFFKSKSPLETGVRNKIYKNKGIVVFGQSYKSYTMKAQNPYFNFGINLHPTALYKILKTDISKLTDKHINLSKIDTKLYELLYPVFKENLHGTALAQRIESQLSNLQIYESKNTKLVDEAIKVIYKKEGKINVEELLKIFPISQKHLEVQFKKTIGLTPLKFIKLYKFLSLMRQYESKKASITQLIEYYAYYDLSHFTKDFNYL

SEQ ID NO: 24999 - DNA, 789 bp, Unknown
  Obtained from environmental sample
  misc_feature (1)..(789): n is a, c, g, or t
atggttgaaagttacgagcgtaatttagctgataacaaaattacactggccaatgagcaacttattggagccaataaagagttaaacatcttacgaaatcagttagagcaagaaaatatatatcttagaaatgagcttgacttagtttttaactatgaagaaatggtgtatggtagtgaagagtttagtaatgtattatcagaaattgaaaaagttgcccctacaaatgcaaccgtattattattaggagagtcgggtactggtaaagagttgttagcaagggcaattcataatacgagtatgcgtaataacaaacctttgattaaggttaattgttctgccattcctagagaacttatagaaagtgaattttttggacataaaaaaggatcgtttacaggagcatatactgacaaaatcggaaagtttgaattagcagatggaggcaccttgtttttagatgaaataggtgagttgccaattgatatgcagccgaaaattttaagatttttgcaagaaggagaaattgaagttgttggtggagcaagtttaaaaaaattagacgttagagtaattgcagcgactaacttaaaccttaaagaagcgattgaaaaaaagcaatttagagaagatttatatttccgattaaatgtgtttccaatagaagtgccaccgntaagaaagcgaaaggacgatattcctttattggtggaacattttgtagataagtttaataaagcatacggaaaaagcattcaatacattaccgatgaagcgatggataattaa

SEQ ID NO: 25000 - protein, 262 aa, Unknown
  Obtained from environmental sample
  DOMAIN (55)...(262): Sigma-54 interaction domain
  misc_feature (1)..(262): Xaa is any amino acid
MVESYERNLADNKITLANEQLIGANKELNILRNQLEQENIYLRNELDLVFNYEEMVYGSEEFSNVLSEIEKVAPTNATVLLLGESGTGKELLARAIHNTSMRNNKPLIKVNCSAIPRELIESEFFGHKKGSFTGAYTDKIGKFELADGGTLFLDEIGELPIDMQPKILRFLQEGEIEVVGGASLKKLDVRVIAATNLNLKEAIEKKQFREDLYFRLNVFPIEVPPXRKRKDDIPLLVEHFVDKFNKAYGKSIQYITDEAMDN

SEQ ID NO: 25001 - DNA, 540 bp, Unknown
  Obtained from environmental sample
  misc_feature (1)..(540): n is a, c, g, or t
atgcaatgcctaagaaaaaatggtgatgaatttccggtagagtttacactaagcagtatgaatgtggatggtaaaactttttattgtgctatgatgcttaatatcaccaagcgtacagtattgcaaaataaattaaagcaaaaaactaaagatttagaactgtttttatatcgttcagcacatgatctcaaagctcctttttcttcagctcaaggactaattaatttactaaaagaagaaaataacaataaaaaaactcaagttttaatagaaatgttaaatacaaccataaacagtggtagagttttatcaaataatctatcagacgcatcgataatttttgaaaaaaattatgagctcaaaaaaattgattttcatgaaattattcaagaggtattgaaaacccttagttgctcaaggaattttgaacttattaattttaatatagatattgatgttaacaaaacctttaaatctaaaccagaattaatatactctatatttcaaaacttaatacaaaatgcaattaatattctgtga

SEQ ID NO: 25002 - protein, 179 aa, Unknown
  Obtained from environmental sample
  misc_feature (1)..(179): Xaa is any amino acid
MQCLRKNGDEFPVEFTLSSMNVDGKTFYCAMMLNITKRTVLQNKLKQKTKDLELFLYRSAHDLKAPFSSAQGLINLLKEENNNKKTQVLIEMLNTTINSGRVLSNNLSDASIIFEKNYELKKIDFHEIIQEVLKTLSCSRNFELINFNIDIDVNKTFKSKPELIYSIFQNLIQNAINIL

SEQ ID NO: 25003 - DNA, 810 bp, Unknown
  Obtained from environmental sample
  misc_feature (1)..(810): n is a, c, g, or t
atgttttactcttctttagtttctccagtttttaataataacggagcaatagtttctgcaaccatttgtattcatgagattactgaatttaaagggattagtaaggaagtccaagatagtgaagctaaatataggtcaatataccaatctataaacgtaggtattattgttgtagccgacaaaaaaggtaacattgttgaatggaataagggagctgaattagcatttgggtactcagaaattgaagtacttggaaaacctcttactattttaacttcagaaaagcttaaactaccaaacattaaagagttattagaagcaataaaaaaaataaaaaacaatcaaaatgttgatattattgaaatgcaatgcctaagaaaaaatggtgatgaatttccggtagagtttacactaagcagtatgaatgtggatggtaaaactttttattgtgctatgatgcttaatatcaccaagcgtacagtattgcaaaataaattaaagcaaaaaactaaagatttagaactgtttttatatcgttcagcacatgatctcaaagctcctttttcttcagctcaaggactaattaatttactaaaagaagaaaataacaataaaaaaactcaagttttaatagaaatgttaaatacaaccataaacagtggtagagttttatcaaataatctatcagacgcatcgataatttttgaaaaaaattatgagctcaaaaaaattgattttcatgaaattattcaagaggtattgaaacccttagttgctcaaggaattttgaacttattaattttaatatag

SEQ ID NO: 25004 - protein, 269 aa, Unknown
  Obtained from environmental sample
  DOMAIN (42)...(106): PAS domain
  misc_feature (1)..(269): Xaa is any amino acid
MFYSSLVSPVFNNNGAIVSATICIHEITEFKGISKEVQDSEAKYRSIYQSINVGIIVVADKKGNIVEWNKGAELAFGYSEIEVLGKPLTILTSEKLKLPNIKELLEAIKKIKNNQNVDIIEMQCLRKNGDEFPVEFTLSSMNVDGKTFYCAMMLNITKRTVLQNKLKQKTKDLELFLYRSAHDLKAPFSSAQGLINLLKEENNNKKTQVLIEMLNTTINSGRVLSNNLSDASIIFEKNYELKKIDFHEIIQEVLKPLVAQGILNLLILI

SEQ ID NO: 25005 - DNA, 846 bp, Unknown
  Obtained from environmental sample
  misc_feature (1)..(846): n is a, c, g, or t
atgcgagttgtaaaaagacagttagagttagtaactattccgttattaaaaattggaggcgtttcttataaaaatatgccatcattaataagtaaaacggatacaaatcttattttcgaatgttttgaaattgatggatttattggtagtaacttactgcgtcattcaattgtacaaattttaccacaagaacaactaatcaaactcactaataataagaaaaaactgtcgctgaaaaggaaaaatgcatcaaaaatagaatttcttgataaacagagtacaccttttatttggatagaattaaacgccaatgacaaagtaaaagaacaagtttatgtagatacaggaatgagcgggttttatgatttatcgaacaatcatctcaaaatttttcaaaaggatgctgttttcacaattaattctgaagctagtggaagtctaggaacaggtctttttggatcagaaaatgaaagcacctattatcaacttgttattcccaaaatagaaattaataatactctatttaacgacataactgtacaaaccactaatgatattaattcaagaattggctcaggaattttgctttatggaaatctgactattgattatataaacaagcgtttttattacgaatcatttcaaaataatataaatttaaaagaaccttcttttggctttagtccaactttaatagacaataaattagtaattggtttagtttgggacgatcatttaaaagataaaattacatatggagatcaaattgtagaaattaatgggaaaaacgtcttaaacgcgaatgtgtgtgatctatcagtcgaaaatccatctttacataaatga

SEQ ID NO: 25006 - protein, 281 aa, Unknown
  Obtained from environmental sample
  misc_feature (1)..(281): Xaa is any amino acid
MRVVKRQLELVTIPLLKIGGVSYKNMPSLISKTDTNLIFECFEIDGFIGSNLLRHSIVQILPQEQLIKLTNNKKKLSLKRKNASKIEFLDKQSTPFIWIELNANDKVKEQVYVDTGMSGFYDLSNNHLKIFQKDAVFTINSEASGSLGTGLFGSENESTYYQLVIPKIEINNTLFNDITVQTTNDINSRIGSGILLYGNLTIDYINKRFYYESFQNNINLKEPSFGFSPTLIDNKLVIGLVWDDHLKDKITYGDQIVEINGKNVLNANVCDLSVENPSLHK

SEQ ID NO: 25007 - DNA, 837 bp, Unknown
  Obtained from environmental sample
  misc_feature (1)..(837): n is a, c, g, or t
atgttagaagttttagatcctgaacaaaatgaagctttttacgataattatttagaagttggttacgatttatcgaaagtactttttattgctacagccaataatttagggcaaattccttgggctttaagagatagaatggaaattattaacgttactggttatacaattgaagaaaaaacagaaatagctaagagacatttattaccaaaacaattaaaagaacatggtttaactaccaaagatttaaagttaggtaaaaaacaaatagagcaaattgtagaaggttatactcgtgaatctggtgttcgtggtttagaaaaacaagtggcaaaagtggttcgttttgcagcaaaaagtattgctttagaagaagaatatgatatttctttgtcatcagaaaaagtagaagaaattctaggcacaccaagaaacagagataaatttgaaaataatgatgttgcaggagttgtaacaggtttggcttggacaagagttggaggtgatattttatttatagaatctattttatcaaaaggaaaaggaaacctttctattactggtaatttaggaaatgtaatgaaagaatctgcaaccattgctttgcaatacataaaatcaaatgctgaagaatttgatataaagccagaaattatagaacagtataatgtgcatgtacacgttcctgaaggtgcaaccccaaaagatggtcctagtgcaggtattaccatgttaacttctttagtttcttcttacacacaacgtaaagtgaacaataagttagcaatgactggtgaaattacttacgtggaaaagtattactggtggtggaattaa

SEQ ID NO: 25008 - protein, 278 aa, Unknown
  Obtained from environmental sample
  DOMAIN (130)...(274): Lon protease (S16) C-terminal proteolytic domain
  misc_feature (1)..(278): Xaa is any amino acid
MLEVLDPEQNEAFYDNYLEVGYDLSKVLFIATANNLGQIPWALRDRMEIINVTGYTIEEKTEIAKRHLLPKQLKEHGLTTKDLKLGKKQIEQIVEGYTRESGVRGLEKQVAKVVRFAAKSIALEEEYDISLSSEKVEEILGTPRNRDKFENNDVAGVVTGLAWTRVGGDILFIESILSKGKGNLSITGNLGNVMKESATIALQYIKSNAEEFDIKPEIIEQYNVHVHVPEGATPKDGPSAGITMLTSLVSSYTQRKVNNKLAMTGEITYVEKYYWWWN

SEQ ID NO: 25009 - DNA, 342 bp, Unknown
  Obtained from environmental sample
  misc_feature (1)..(342): n is a, c, g, or t
gtggcaaaagtggttcgttttgcagcaaaaagtattgctttagaagaagaatatgatatttctttgtcatcagaaaaagtagaagaaattctaggcacaccaagaaacagagataaatttgaaaataatgatgttgcaggagttgtaacaggtttggcttggacaagagttggaggtgatattttatttatagaatctattttatcaaaagcgacaaaggaaaccttttcttattnactaggtaactntctaggaacatcgttaatcgaacagcaattctgnncaacccattgncttnnntgcaatacatttaaaattcaaattgcnttgaagaaatcttga

SEQ ID NO: 25010 - protein, 113 aa, Unknown
  Obtained from environmental sample
  DOMAIN (21)...(112): Lon protease (S16) C-terminal proteolytic domain
  misc_feature (1)..(113): Xaa is any amino acid
MAKVVRFAAKSIALEEEYDISLSSEKVEEILGTPRNRDKFENNDVAGVVTGLAWTRVGGDILFIESILSKATKETFSYXLGNXLGTSLIEQQFXXTHXLXCNTFKIQIALKKS

SEQ ID NO: 25011 - DNA, 912 bp, Unknown
  Obtained from environmental sample
  misc_feature (1)..(912): n is a, c, g, or t
gtgataacgaaaaaccattccaacaatttaaccacatcacgcaagctttctacagccgtagatgcgcgtaacgtccgtaacattgtgctcatgcgtccttgtaataatatgattgagtttaaacagatcatagnccgaggcacccgcacttacgatggcaaagactattttaccatttacgactttgtaaaagcgcaccataactttgctgatcctgcttgggatggtgaaccaatacccagcgaagtatgcccagagtgcggcacaaccccgtgccaatgtgaagacactggcggcgatggtgccggtgaaaagaaaccgtgtaaagtgtgtgaacaaaaaccatgtgtttgtgaaaagccagagcctgaaggctgtgaaaaatgtggcgaaagaccatgtgtatgcgaaaagctcgaaataaagctctcagacggccgtacacgacaaataaagcatatatcctcagcaatgtactggagtgctgaaggcaagcccattacagctaaagagtttgttgaacgtatgttcgatgacctaccgcgcttttttgaaaacgaagaccaactacgagaaatctggagcgacccaaccactcgcgaaaagctattagaagatttaaccgaagcgggttacgatagcgaaaaactcgatagcatgaaggcagtaattgatgctcaagacagcgatgtatacgatgttttatcgtacgtagcctatgccgcagaagcgcaaacacgcaccgagcgagctcaacaagctaaacctaaaataaactcagcgtttagcgattataaacaacaagagtttatcaactttatattaagtaaatacattgaagacggcgttcaagaactggcacccaaaaaaaatgcgcagcttatagagctcgaccgattcttgatccactag

SEQ ID NO: 25012 - protein, 303 aa, Unknown
  Obtained from environmental sample
  misc_feature (1)..(303): Xaa is any amino acid
MITKNHSNNLTTSRKLSTAVDARNVRNIVLMRPCNNMIEFKQIIXRGTRTYDGKDYFTIYDFVKAHHNFADPAWDGEPIPSEVCPECGTTPCQCEDTGGDGAGEKKPCKVCEQKPCVCEKPEPEGCEKCGERPCVCEKLEIKLSDGRTRQIKHISSAMYWSAEGKPITAKEFVERMFDDLPRFFENEDQLREIWSDPTTREKLLEDLTEAGYDSEKLDSMKAVIDAQDSDVYDVLSYVAYAAEAQTRTERAQQAKPKINSAFSDYKQQEFINFILSKYIEDGVQELAPKKNAQLIELDRFLIH

SEQ ID NO: 25013 - DNA, 330 bp, Unknown
  Obtained from environmental sample
  misc_feature (1)..(330): n is a, c, g, or t
gtggacggggaaattttggcccaattcacaaccaacaaaacaaacgggagggttatccaaaagttcccattcaaaaaaagtaatgaaaaattaaacctatacatagaggccaataacgacaaggtctcctccaaaagtcctaccagttacatttcgtggtttgcttttcttcctgaaattaaagctgataataacactggctattccgaaatggatgcggagtttatggagttggtgaacacagccaccactacattacctattattgtggaaatcccgattatcgaaaaagaaccactcaggtttttgaaagaggcaattggcttatga

SEQ ID NO: 25014 - protein, 109 aa, Unknown
  Obtained from environmental sample
  misc_feature (1)..(109): Xaa is any amino acid
MDGEILAQFTTNKTNGRVIQKFPFKKSNEKLNLYIEANNDKVSSKSPTSYISWFAFLPEIKADNNTGYSEMDAEFMELVNTATTTLPIIVEIPIIEKEPLRFLKEAIGL

SEQ ID NO: 25015 - DNA, 690 bp, Unknown
  Obtained from environmental sample
  misc_feature (1)..(690): n is a, c, g, or t
nnaaaatataatggattaaaccaagagtcttttacaataaatatccaaccaaaaccaatattaaatattgaggatatagcgtcttataatcaacaagaaggtttagctttaaatgatgaagaaattgaatacttagaaggcgtatcaaaaaaaataggtcgtccattaacagattcagaagtctttgggttttctcaagtcaactcagagcattgtcgtcataaaatatttaatgggacatttgtcattgatggaaaagaaaaaccaacatcgctttttaaactaattaaagaaacctccaagcaacatccaaacactatcgtttcggcatataaagataatgttgcttttataaaaggtcctaaagtggagcaatttgcgccaaaacgtgcagatgttcctgatttctatgtaaaaaaagattacaactctgttatttcgcttaaagcggaaacacataactttccaacaaccgtagagccatttaatggagctgcaacaggatctggaggagaaattagagacagattagctggtggaaaaggatcgttaccattagcaggaactgctgtttacatgacttcttattctagattagaagaaaatagaccatgggaacaagctatggaagcacgtncttggctataccaaacaccaatggatattctcggccgattcttgatccgctag

SEQ ID NO: 25016 - protein, 229 aa, Unknown
  Obtained from environmental sample
  misc_feature (1)..(229): Xaa is any amino acid
MKYNGLNQESFTINIQPKPILNIEDIASYNQQEGLALNDEEIEYLEGVSKKIGRPLTDSEVFGFSQVNSEHCRHKIFNGTFVIDGKEKPTSLFKLIKETSKQHPNTIVSAYKDNVAFIKGPKVEQFAPKRADVPDFYVKKDYNSVISLKAETHNFPTTVEPFNGAATGSGGEIRDRLAGGKGSLPLAGTAVYMTSYSRLEENRPWEQAMEARXWLYQTPMDILGRFLIR

SEQ ID NO: 25017 - DNA, 948 bp, Unknown
  Obtained from environmental sample
  misc_feature (1)..(948): n is a, c, g, or t
atgatcaatttcttcggaaacctaaacagtaacctttttgctgttcaagcaacaagagaattatcaacgcaaaccatgtctaaattgatttggttatttggcaaccagccaaaaatagnacaagcatcattagatgctttttttgttggtcctagagctgcaatgattacaccttggagtactaatgcagtagaaatcacccaaaatatgggtattgatggcatcatcagaattgaagaatttgaagcttgccaaaaagactttacaggttttgatccaatgatttcagaaaaatataatggattaaaccaagagtcttttacaataaatatccaaccaaaaccaatattaaatattgaggatatagcgtcttataatcaacaagaaggtttagctttaaatgatgaagaaattgaatacttagaaggcgtatcaaaaaaaataggtcgtccattaacagattcagaagtctttgggttttctcaagtcaactcagagcattgtcgtcataaaatatttaatgggacatttgtcattgatggaaaagaaaaaccaacatcgctttttaaactaattaaagaaacctccaagcaacatccaaacactatcgtttcggcatataaagataatgttgcttttataaaaggtcctaaagtggagcaatttgcgccaaaacgtgcagatgttcctgatttctatgtaaaaaaagattacaactctgttatttcgcttaaagcggaaacacataactttccaacaaccgtagagccatttaatggagctgcaacaggatctggaggagaaattagagacagattagctggtggaaaaggatcgttaccattagcaggaactgctgtttacatgacttcttattctagattagaagaaaatagaccatgggacaagctatggaagaacgtccttggctataccaaacaccaatga

SEQ ID NO: 25018 - protein, 315 aa, Unknown
  Obtained from environmental sample
  misc_feature (1)..(315): Xaa is any amino acid
MINFFGNLNSNLFAVQATRELSTQTMSKLIWLFGNQPKIXQASLDAFFVGPRAAMITPWSTNAVEITQNMGIDGIIRIEEFEACQKDFTGFDPMISEKYNGLNQESFTINIQPKPILNIEDIASYNQQEGLALNDEEIEYLEGVSKKIGRPLTDSEVFGFSQVNSEHCRHKIFNGTFVIDGKEKPTSLFKLIKETSKQHPNTIVSAYKDNVAFIKGPKVEQFAPKRADVPDFYVKKDYNSVISLKAETHNFPTTVEPFNGAATGSGGEIRDRLAGGKGSLPLAGTAVYMTSYSRLEENRPWDKLWKNVLGYTKHQ

SEQ ID NO: 25019 - DNA, 381 bp, Unknown
  Obtained from environmental sample
  misc_feature (1)..(381): n is a, c, g, or t
atggacaacccctctaaaattaccgaaggtggcgtggaatattcgctgggaaaatttgacggtaaaagcgtcctctacgactttcccaaaatattgatatacctgaatgccaagggaaaacttttatttggcgaaaagttcaggatttatgatgaggataaggatattttgctgaagctctgttcctacttcatcaaggataaagacaactgtaaaacctatggaattgatattgacaaaggaattttgctttctggacctgttggatgcggaaaaacgaccttgatgaaattactacgccatatcgtaccaatgcaaagaccttatgagatgattccgtgtagaaacattactttcagctttaaccacctaggtttttaa

SEQ ID NO: 25020 - protein, 126 aa, Unknown
  Obtained from environmental sample
  misc_feature (1)..(126): Xaa is any amino acid
MDNPSKITEGGVEYSLGKFDGKSVLYDFPKILIYLNAKGKLLFGEKFRIYDEDKDILLKLCSYFIKDKDNCKTYGIDIDKGILLSGPVGCGKTTLMKLLRHIVPMQRPYEMIPCRNITFSFNHLGF

SEQ ID NO: 25021 - DNA, 360 bp, Unknown
  Obtained from environmental sample
  misc_feature (1)..(360): n is a, c, g, or t
ttgtttagcacaaaaaaggtgtcatttgccccattttcggacacatgccaatgttgtgtgggtttatgggtacgtaaaaatttctttatttttttagatactattaaacctccaaaggttaatagtatttctggttgcaagccttgtaactcctgttccgttaacgcaccaattaatttatcaatacttggacaaatattatcatggtgcaagttagacgtactttcggttaatatcaatacactttcatcttctgctaaaacgtcaataaagtgctgctctacgctgtttggagctaaaacacctactaatactaacttcttattggagttattccaaatttcagcgaaagcgttataa

SEQ ID NO: 25022 - protein, 119 aa, Unknown
  Obtained from environmental sample
  misc_feature (1)..(119): Xaa is any amino acid
MFSTKKVSFAPFSDTCQCCVGLWVRKNFFIFLDTIKPPKVNSISGCKPCNSCSVNAPINLSILGQILSWCKLDVLSVNINTLSSSAKTSIKCCSTLFGAKTPTNTNFLLELFQISAKAL

SEQ ID NO: 25023 - DNA, 864 bp, Unknown
  Obtained from environmental sample
  misc_feature (1)..(864): n is a, c, g, or t
ttgcctaatggagcaagtacaaaaaatgccggattcacctgttttggaagcgtttctgagatcctggatgatctaaattctcattctgaagaagaagtgacgcaactcataaaaaagcgattaaaaggtttgaagttgcttcggaagaaccttggaaatcaaaatattggttataaagaatacgggggctacgaacttttcaccaatcaggatggtgctctttttgaagaatgtaaattggctataccaaaccttaataacatgctgaaaccaatatttggagaagaggtttttagtatccaaaaagatagtttcaactttaaaaatattcagaagagactcatttttaatcaatttgaagggcaattaaataccggaaaaatgatggaagctctgctatataaagtgcataaagccggtataaaaatcctgaataatattacagttgaagaatatgcagaaacaggggattcagtaaaaattaaaaccgataaattagaattttcggtaaataaattattaatcgctaccaacggatttgcttcacaactgggaattccagaagtcaaaccagcccgcgcccaggttttgattaccaaaccaattaaaaatctggaaattaaaggcacctttcatcttgataaaggctattattatttcagaaatataaatgatcgaattttatttggcggcggaagaaaccttgatcttgaaacagaagaaaccaccgaaatcgctcaaacgaaacttattcagcagaaactggagaaattactaaaaaacacaattttgcctgaaactggttttgagattgagcaacgttggagtgggataatgggcgttggagagcagaaaatccggtga

SEQ ID NO: 25024 - protein, 287 aa, Unknown
  Obtained from environmental sample
  misc_feature (1)..(287): Xaa is any amino acid
MPNGASTKNAGFTCFGSVSEILDDLNSHSEEEVTQLIKKRLKGLKLLRKNLGNQNIGYKEYGGYELFTNQDGALFEECKLAIPNLNNMLKPIFGEEVFSIQKDSFNFKNIQKRLIFNQFEGQLNTGKMMEALLYKVHKAGIKILNNITVEEYAETGDSVKIKTDKLEFSVNKLLIATNGFASQLGIPEVKPARAQVLITKPIKNLEIKGTFHLDKGYYYFRNINDRILFGGGRNLDLETEETTEIAQTKLIQQKLEKLLKNTILPETGFEIEQRWSGIMGVGEQKIR

SEQ ID NO: 25025 - DNA, 966 bp, Unknown
  Obtained from environmental sample
  misc_feature (1)..(966): n is a, c, g, or t
ttgcctaatggagcaagtacaaaaaatgcctggatcacctgttttggaagcgtttctgagatcctggatgatctaaattctcattctgaagaagaagtgacgcaactcataaaaaagcgattaaaaggtttgaagttgcttcggaagaaccttggaaatcaaaatattggttataaagaatacgggggctacgaacttttcaccaatcaggatggtgctctttttgaagaatgtaaattggctataccaaaccttaataacatgctgaaaccaatatttggagaagaggtttttagtatccaaaaagatagtttcaactttaaaaatattcagaagagactcatttttaatcaatttgaagggcaattaaataccggaaaaatgatggaagctctgctatataaagtgcataaagccggtataaaaatcctgaataatattacagttgaagaatatgcagaaacaggggattcagtaaaaattaaaaccgataaattagaattttcggtaaataaattattaatcgctaccaacggatttgcttcacaactgggaattccagaagtcaaaccagcccgcgcccaggttttgattaccaaaccaattaaaaatctggaaattaaaggcacctttcatcttgataaaggctattattatttcagaaatataaatgatcgaattttatttggcggcggaagaaaccttgatcttgaaacagaagaaaccaccgaaatcgctcaaacgaaacttattcagcagaaactggagaaattactaaaaaccacaattttgcctgaaactgcttttgagattgagcaatgctggagtgggattatgggcgttggagagcagaaaaatccggtgattaaacaaatttcagataatgtttattgcggaattcgccttgggggaatgggtgttgtattggcagttaatagggaaagaatttcagaattgatcaactga

SEQ ID NO: 25026 - protein, 321 aa, Unknown
  Obtained from environmental sample
  misc_feature (1)..(321): Xaa is any amino acid
MPNGASTKNAWITCFGSVSEILDDLNSHSEEEVTQLIKKRLKGLKLLRKNLGNQNIGYKEYGGYELFTNQDGALFEECKLAIPNLNNMLKPIFGEEVFSIQKDSFNFKNIQKRLIFNQFEGQLNTGKMMEALLYKVHKAGIKILNNITVEEYAETGDSVKIKTDKLEFSVNKLLIATNGFASQLGIPEVKPARAQVLITKPIKNLEIKGTFHLDKGYYYFRNINDRILFGGGRNLDLETEETTEIAQTKLIQQKLEKLLKTTILPETAFEIEQCWSGIMGVGEQKNPVIKQISDNVYCGIRLGGMGVVLAVNRERISELIN

SEQ ID NO: 25027 - DNA, 561 bp, Unknown; identical to SEQ ID NO: 24767
  Obtained from environmental sample
  misc_feature (1)..(561): n is a, c, g, or t

SEQ ID NO: 25028 - protein, 186 aa, Unknown; identical to SEQ ID NO: 24768
  Obtained from environmental sample
  misc_feature (1)..(186): Xaa is any amino acid

SEQ ID NO: 25029 - DNA, 561 bp, Unknown; identical to SEQ ID NO: 24767
  Obtained from environmental sample
  misc_feature (1)..(561): n is a, c, g, or t

SEQ ID NO: 25030 - protein, 186 aa, Unknown; identical to SEQ ID NO: 24768
  Obtained from environmental sample
  misc_feature (1)..(186): Xaa is any amino acid

SEQ ID NO: 25031 - DNA, 396 bp, Unknown
  Obtained from environmental sample
  misc_feature (1)..(396): n is a, c, g, or t
ttgaaagcgcaggttatcgtccattggcaaaccggcttgatacttgatgtgcaaacctgcaaagggtcaatccacgattttaagctctataaagatacttgtcctgattggcttcctaacaatgctaaattactagcagatagtggctatcaagggttagcaaagctacataagcaaactttcacaccatttaagaaacctcgtggtggtcagttattggagatatgcaaacaggccaatcactatctggcaaagttccgtattgtggttgagcaccaaataggcttaatcaagttgttcaaaatcgtggctcataaatatcgtaaccgtcgtcagcgctatgatcttagaatgaagctatttgctggtatcgttaatttcgagcttagaatatga

SEQ ID NO: 25032 - protein, 131 aa, Unknown
  Obtained from environmental sample
  misc_feature (1)..(131): Xaa is any amino acid
MKAQVIVHWQTGLILDVQTCKGSIHDFKLYKDTCPDWLPNNAKLLADSGYQGLAKLHKQTFTPFKKPRGGQLLEICKQANHYLAKFRIVVEHQIGLIKLFKIVAHKYRNRRQRYDLRMKLFAGIVNFELRI

SEQ ID NO: 25033 - DNA, 396 bp, Unknown
  Obtained from environmental sample
  misc_feature (1)..(396): n is a, c, g, or t
ttgaaagcgcaggttatcgtccattggcaaaccggcttgatacttgatgtgcaaacctgcaaagggtcaatccacgattttaagctctataaagatacttgtcctgattggcttcctaacaatgctaaattactagcagatagtggctatcaagggttagcaaagctacataagcaaactttcacaccatttaagaaacctcgtggtggtcagttattggagatatgcaaacaggccaatcactatctggcaaagttccgtattgtggttgagcacaaaataggcttaatcaagttgttcaaaatcgtggctcataaatatcgtaaccgtcgtcagcgctatgatcttagaatgaagctatttgctggtatcgttaatttcgagcttagaatatga

SEQ ID NO: 25034 - protein, 131 aa, Unknown
  Obtained from environmental sample
  DOMAIN (1)...(129): Transposase DDE domain
  misc_feature (1)..(131): Xaa is any amino acid
MKAQVIVHWQTGLILDVQTCKGSIHDFKLYKDTCPDWLPNNAKLLADSGYQGLAKLHKQTFTPFKKPRGGQLLEICKQANHYLAKFRIVVEHKIGLIKLFKIVAHKYRNRRQRYDLRMKLFAGIVNFELRI

SEQ ID NO: 25035 - DNA, 765 bp, Unknown
  Obtained from environmental sample
  misc_feature (1)..(765): n is a, c, g, or t
gtgagctttgaaggcgataatttaatcgatccaaataatccaacggatatagttaacgaaaaatctctgcaaataattgcggacactgctaagaaacatgattctttgataattacggatgaggtttatacggcttttttccctaagaagaagctaattatagattattgtccggagcggactatacgaattgatgcgcgatctaaggtggaaaggagtacgggtctgaggtttggggatatgtttgtttgcaaggaagcgaatgaatatcttactaataatatttttaaggggatgctgccggaggggatggatattcggacttttttgctacatgcaaaggggccgggtggagctgagggtgaattgcagcatactacgtttgttccggggccgtcgcagtttatgggaatttctcatatggttttggcgggggatgagcggaagaaatattttgaatcggtttatgataacgtgaaagtttttgttgaagggcttggattaccgcatgaagggaatctgtattatgtgatttttgatatgaattcgattgagggtctgacaaagaaggatgtgactgcagaagagaaattgttggagctggctaagcagggagttgtctttttgccggcttgtcttttcttctctgaatatgagagaatgaaaaaagattttactaatatggtgagggcgtctgtggttaatacaggagttgaaaatgtagagaaggcggcgcaaatcactaaaaattatttaacaacttaa

SEQ ID NO: 25036 - protein, 254 aa, Unknown
  Obtained from environmental sample
  misc_feature (1)..(254): Xaa is any amino acid
MSFEGDNLIDPNNPTDIVNEKSLQIIADTAKKHDSLIITDEVYTAFFPKKKLIIDYCPERTIRIDARSKVERSTGLRFGDMFVCKEANEYLTNNIFKGMLPEGMDIRTFLLHAKGPGGAEGELQHTTFVPGPSQFMGISHMVLAGDERKKYFESVYDNVKVFVEGLGLPHEGNLYYVIFDMNSIEGLTKKDVTAEEKLLELAKQGVVFLPACLFFSEYERMKKDFTNMVRASVVNTGVENVEKAAQITKNYLTT

SEQ ID NO: 25037 - DNA, 810 bp, Unknown
  Obtained from environmental sample
  misc_feature (1)..(810): n is a, c, g, or t
ttgttgtactttattattacgttgttcatagaatattttctttggttaccaccaaaagccagaagtgttttattctttacatttattttagttgaattagggttacttattaaatttatagtaataccaatatcgaaactactaggtcttcaaaaggggatttcttttactgagtcttcgaaaataataggcaatcattttcctgaagttgatgataaattattgaatgttcttcaactcaatcaaaataagaagcaatcagaattgttagttgccagtattgaacaaaaatctgaatctttaaaacctttcatttttaaaaaagctattaatttcagaagtaatattaagtatataaaatatttatctattcctttggtcatttggctattagtctttctttcaggtaatatttccatttttaatgatagtttaaatagggttgtacactatcaaacggcgtatgaaacaccggcaccgtttaattttagaatattaaatactgatttaagtaccattgaaggaaaaccatttgaattagaggtagaaacagtagggaatataattcctgaaaatgttagaatacattttaattcagagggctatttattaaaagataaaaggcaaggttttttttcttatgattttataaactttaatgagtctgtagtattttatttggaagcaaatggtgtaaggtcaaaaaattatcagctaaatgtaattagggaccccaacggttatagggttttgaaatggtttttaaactaccccaaattatccagggaaaaaaggaccaaaagcctttaa

SEQ ID NO: 25038 - protein, 269 aa, Unknown
  Obtained from environmental sample
  misc_feature (1)..(269): Xaa is any amino acid
MLYFIITLFIEYFLWLPPKARSVLFFTFILVELGLLIKFIVIPISKLLGLQKGISFTESSKIIGNHFPEVDDKLLNVLQLNQNKKQSELLVASIEQKSESLKPFIFKKAINFRSNIKYIKYLSIPLVIWLLVFLSGNISIFNDSLNRVVHYQTAYETPAPFNFRILNTDLSTIEGKPFELEVETVGNIIPENVRIHFNSEGYLLKDKRQGFFSYDFINFNESVVFYLEANGVRSKNYQLNVIRDPNGYRVLKWFLNYPKLSREKRTKSL

SEQ ID NO: 25039 - DNA, 540 bp, Unknown
  Obtained from environmental sample
  misc_feature (1)..(540): n is a, c, g, or t
atgacaagtatcctttggcattacagtacatttttaaaagagattcctgggacacttttacctgtatttacagaaatcaacattaagcctactggcgagattaaagacccaacgtttaaggatgcatatccagaaaaccgaatgttatcccttatgcactactggctcttaaatatggaacagttagatggtaatgttgcgccttttaaagagttattagcagatgatttcaaacttaacttttcaacaaataacgaacctattatcaccataaagcaattagaacaatggttgaatggaacgccaaaacaattgaaggaaagcagtcattttccggagaattttactgtaaaagtaatttcagaaaatgaatatgaagtcaatgtagattttgtttggaaagggaaaacaaaagagggtcaaaaattaaccgcaactaccgcacaccattggataataaaggataatccaaatgacaggtttgcaaaaataaaagagattaccattattcaaaaagtgccacttactccattaaaataa

SEQ ID NO: 25040 - protein, 179 aa, Unknown
  Obtained from environmental sample
  misc_feature (1)..(179): Xaa is any amino acid
MTSILWHYSTFLKEIPGTLLPVFTEINIKPTGEIKDPTFKDAYPENRMLSLMHYWLLNMEQLDGNVAPFKELLADDFKLNFSTNNEPIITIKQLEQWLNGTPKQLKESSHFPENFTVKVISENEYEVNVDFVWKGKTKEGQKLTATTAHHWIIKDNPNDRFAKIKEITIIQKVPLTPLK

SEQ ID NO: 25041 - DNA, 426 bp, Unknown
  Obtained from environmental sample
  misc_feature (1)..(426): n is a, c, g, or t
ttggtttttgctactaacagtattgcaaatccaaaacaaaaaattgaaaaagctattgaggtccttacacaatcagcaactttagactctaatttctctcatatcgatgaggtacttttaaaacgtattgtaattaacgaatactctaaatcatacctaactaaagaggtcgataacgaaaataaggaaggttactttctagtatacaaaagactggttacacgactacatgatatggtattaaccattgataaggattattcgtatgcctttagtttatcaagtactgttattgatggtgcattgcatcaacattttttaaaagaccattttactactatatctgatcttaaaaaatcagacgatcctactaactattttaaagatttagttttcaaaacccttaacatctcaacaaatgagtaa

SEQ ID NO: 25042 - protein, 141 aa, Unknown
  Obtained from environmental sample
  misc_feature (1)..(141): Xaa is any amino acid
MVFATNSIANPKQKIEKAIEVLTQSATLDSNFSHIDEVLLKRIVINEYSKSYLTKEVDNENKEGYFLVYKRLVTRLHDMVLTIDKDYSYAFSLSSTVIDGALHQHFLKDHFTTISDLKKSDDPTNYFKDLVFKTLNISTNE

SEQ ID NO: 25043 - DNA, 687 bp, Unknown; identical to SEQ ID NO: 21105
  Obtained from environmental sample
  misc_feature (1)..(687): n is a, c, g, or t

SEQ ID NO: 25044 - protein, 228 aa, Unknown; identical to SEQ ID NO: 21106
  Obtained from environmental sample
  DOMAIN (30)...(76): Bacterial regulatory proteins, tetR family
  misc_feature (1)..(228): Xaa is any amino acid

SEQ ID NO: 25045 - DNA, 615 bp, Unknown
  Obtained from environmental sample
  misc_feature (1)..(615): n is a, c, g, or t
ttggacgaggttcaattcccccggggaccacatggatcaccaggaaccgtttcagaatacgaccagggcaccttgtggacgacgataccggtcaaaaagaaaggcctgggactccaagacattaatgcggtcagaatttatcatgaaggccattgggcgcgcaaacatctggccagcttgaaaaatgcttacgcgaatgctccttattttgcgggccacacaaattttcttaaaaaattgtttacaaaaaaatttgaaaaacttatcgacttgaacctggaaattatccgttatctgataaaatgtttaaatatcgacaccaaggttgtcttactgtcggaactgggggttcaaacacgtggccatcaactgctcatcgacatatgccgcgctcagggagcatcctgttatctggcccagagtccggcccaaaaatatattaatccggatctattccgggacgcagaaatcgagctaaaatattttaagctgccggcgctgatctatcctcaactctgggggagcttcatccccaatttgtctacattagaccttgttttcaactgtggccccaagtcttttgaacttcttattgctgaaaggaatattgtatga

SEQ ID NO: 25046 - protein, 204 aa, Unknown
  Obtained from environmental sample
  misc_feature (1)..(204): Xaa is any amino acid
MDEVQFPRGPHGSPGTVSEYDQGTLWTTIPVKKKGLGLQDINAVRIYHEGHWARKHLASLKNAYANAPYFAGHTNFLKKLFTKKFEKLIDLNLEIIRYLIKCLNIDTKVVLLSELGVQTRGHQLLIDICRAQGASCYLAQSPAQKYINPDLFRDAEIELKYFKLPALIYPQLWGSFIPNLSTLDLVFNCGPKSFELLIAERNIV

SEQ ID NO: 25047 - DNA, 813 bp, Unknown
  Obtained from environmental sample
  misc_feature (1)..(813): n is a, c, g, or t
atggctggcattatgtctgtaattgtattaagctcatgtgtttcaaaaaagaaatatgttgccttacaacaagaaaatggagagattaaaagtgagttaacaaaagtaaaagtagaaaacgaagatttagaagctaaatttggaaaaatccaaatgcgcgtggatgaatacaataataagattacagagttaaaagaagataacgatgtaaagtttgatgctgttggtgatgttgctgtaatatctaatgcgacaaaaagaaagatgagagaaaccttaaaaaaggtagatcctagtcttttaaatgaagcgcgaacattaagagattctatgaatttggcggtgtcttataacttgaaaaagaatatggatacgagtgagttaaatgaagatgaagatatctctattagtattgacgaaactgtggtaatgatttctatttcagataaactattatttaacactggtagctaccgtgtaagtaataaagcaaataacattttacaaaaacttgccgatgttattaattcggaaccaagtttagaagttatggtagaaggtcacaccgatgcaagatctattagtactcctcaaattgcagataattgggatttaagtgtgctacgtgcaacgtctgtagtaagaaaattacaaaaccaatataatgttgctccagaaaaattaattgcagcaggaagaagtagttataagcctttatttaataatgattctaacgaaaatagatctaagaatagaagaacacgggttgtaattcttccaaatattaataagttttttgctttaatggagtaa

SEQ ID NO: 25048 - protein, 270 aa, Unknown
  Obtained from environmental sample
  DOMAIN (152)...(252): OmpA family
  misc_feature (1)..(270): Xaa is any amino acid
MAGIMSVIVLSSCVSKKKYVALQQENGEIKSELTKVKVENEDLEAKFGKIQMRVDEYNNKITELKEDNDVKFDAVGDVAVISNATKRKMRETLKKVDPSLLNEARTLRDSMNLAVSYNLKKNMDTSELNEDEDISISIDETVVMISISDKLLFNTGSYRVSNKANNILQKLADVINSEPSLEVMVEGHTDARSISTPQIADNWDLSVLRATSVVRKLQNQYNVAPEKLIAAGRSSYKPLFNNDSNENRSKNRRTRVVILPNINKFFALME

SEQ ID NO: 25049 - DNA, 768 bp, Unknown
  Obtained from environmental sample
  misc_feature (1)..(768): n is a, c, g, or t
atgccaacaaagatctattcaacagccaaaatacttatagtggaggagcaaccgctcgcccaaagctatatgaaacaatcgctagaaaagcttggctttggacagttacgatttgcagatcatgctaactcggcaaaagagcagtgtataaacgagcaatttgatttaattgtatgctcattcaatctaaataagcatcaagatggttatcagctttatgaggaattgcgaataaagcagttaattaaaagctccactgggtttatttttatttctgcagaaacaagtggctcgcttgtacatagtgttcttgaattacaacccgatgattttttggttaaaccatttacagcacaagagcttaaaatacgtatagagcgtattttaaaacgtaaacgtgatttacaaacagtttacaactttattgatgacggtaatgattccaaagcacttaagtacataagtgcagcattaaataaaaacaacaactacagccctattttactgcgattaaaaggtgatgccctactacgccttaatcgtaaccaagaggccaaagacttttttaagtcggtactcgatatccaaaaatttgcatgggctaaagtaggtttagtagaagcactgatagaaaataatgaacatattttagcccaacgcatgcttaaaaccatgttagagcgcaacgaaactcgtttaatcgcgcttgatttattaggtcgtttagaaattaaacttaatcaatttgagctcgcacaagagttttaa

SEQ ID NO: 25050 - protein, 255 aa, Unknown
  Obtained from environmental sample
  DOMAIN (9)...(133): Response regulator receiver domain
  misc_feature (1)..(255): Xaa is any amino acid
MPTKIYSTAKILIVEEQPLAQSYMKQSLEKLGFGQLRFADHANSAKEQCINEQFDLIVCSFNLNKHQDGYQLYEELRIKQLIKSSTGFIFISAETSGSLVHSVLELQPDDFLVKPFTAQELKIRIERILKRKRDLQTVYNFIDDGNDSKALKYISAALNKNNNYSPILLRLKGDALLRLNRNQEAKDFFKSVLDIQKFAWAKVGLVEALIENNEHILAQRMLKTMLERNETRLIALDLLGRLEIKLNQFELAQEF

SEQ ID NO: 25051 - DNA, 441 bp, Unknown
  Obtained from environmental sample
  misc_feature (1)..(441): n is a, c, g, or t
gtggacgctataaataaaaaaatagcggtggtggtgctgtttataggtgtggcgcttagtgtgctaatgctaactacaaagcttacagagcagccttggtttatatttttatttgtcttatgggtatttgtttattgctcttgttgttaccgattaaccccactgtttaaaacacgaaaccaagttaatgattttattaagcgcgatgcaaaacatttagtattgtttagcttagcgggattttttgataaaaaatctggcccgcagtggttagcaattaaaaatattaagcacctttcaacccgcaataatgaactgctagtacacagctaccagcaaacgcaatttagtattagtttacctgcgtcaaaagtagagctagatgcttttttacagcagatactgactaattcagaaagacgaagtattacatttgattaa

SEQ ID NO: 25052 - protein, 146 aa, Unknown; identical to SEQ ID NO: 21800
  Obtained from environmental sample
  misc_feature (1)..(146): Xaa is any amino acid

SEQ ID NO: 25053 - DNA, 666 bp, Unknown
  Obtained from environmental sample
  misc_feature (1)..(666): n is a, c, g, or t
atgaaagcagtaatattagctgncggatcaggtacaaggctttggccactcagcagaaaatacaagcccaaacaatttcaaaaacttgttagcaacaaaacaatgctacaagaaactgttgaacgtttaagctttctaaaaccggaagatatctatatttcaaccaataaagaatatgtaaacgttattaaaaaacaaacaaaatccctcgtccccccaaaaaacataattgttgaaccagatttaagagacaccgccccatgtattggactagcagccatgtacattgcaaaaaagcatccaaaagaggtaatgagcataatttatgcagatcatttaattgctgacaagaaagaactcacaaaaaaattgaaaattgctgaaaaattggcaaaaagttccggaactctaaacattattgaagttaaagccaaatttccgaatgtaaatttaggatatgtgaagattggaaaaccattaaaagagattagtggtaccgaaatctatgcatttgagggatttacagaaaaaccatcactccaaaaagccaaaaagttcctagaatcatttaaatatctgtggaataccggactttatgtatggaaagtagatactatattggattgttataaaaaattcctaccaaatacatataaaatcttctaa

SEQ ID NO: 25054 - protein, 221 aa, Unknown
  Obtained from environmental sample
  DOMAIN (2)...(217): Nucleotidyl transferase
  misc_feature (1)..(221): Xaa is any amino acid
MKAVILAXGSGTRLWPLSRKYKPKQFQKLVSNKTMLQETVERLSFLKPEDIYISTNKEYVNVIKKQTKSLVPPKNIIVEPDLRDTAPCIGLAAMYIAKKHPKEVMSIIYADHLIADKKELTKKLKIAEKLAKSSGTLNIIEVKAKFPNVNLGYVKIGKPLKEISGTEIYAFEGFTEKPSLQKAKKFLESFKYLWNTGLYVWKVDTILDCYKKFLPNTYKIF

SEQ ID NO: 25055 - DNA, 672 bp, Unknown
  Obtained from environmental sample
  misc_feature (1)..(672): n is a, c, g, or t
gtgtgctttggtgaatattcagaaaaagcacccgttgtctttcctccaccaaaaataaaaaacaatttaggaaaaactttagaaaagacggggaaaaagcaactccgaatagcagaaacagaaaaatatgcacatgtaacttttttctttaacagtcaggaagacgatccatataaaggggaaaaaagaatcatggtagattcaccaaaagtcgtctcttacgacctaaaaccagaaatgagcgcattcgtactaacaaataaaattgtaaaagagttggataagcacgaatatgacgtcgtaatacaaaatttcgctaacttagatttagttggccattcaggagaattagaagcaactattgatgcatgtgaagctattgataaatgcattggaaaaatataccaagtcgccctagaaaaaggctaccatttaatgataactgcagatcatggaaacgcagaatacatgatatatgatgatacaaaagaacaatgtccatctcacacaacaaatccagtaccattcattcttgtttcaaacactataaaaaatgttagattatgtaagaaaagcggattacaagatatagcaccaacaattttaaaaatcatgggaataaaaaaaccaaaagagatgacaggaaaatcattaattagaaacggcaaatga

SEQ ID NO: 25056 - protein, 223 aa, Unknown
  Obtained from environmental sample
  DOMAIN (79)...(198): Metalloenzyme superfamily
  misc_feature (1)..(223): Xaa is any amino acid
MCFGEYSEKAPVVFPPPKIKNNLGKTLEKTGKKQLRIAETEKYAHVTFFFNSQEDDPYKGEKRIMVDSPKVVSYDLKPEMSAFVLTNKIVKELDKHEYDVVIQNFANLDLVGHSGELEATIDACEAIDKCIGKIYQVALEKGYHLMITADHGNAEYMIYDDTKEQCPSHTTNPVPFILVSNTIKNVRLCKKSGLQDIAPTILKIMGIKKPKEMTGKSLIRNGK

SEQ ID NO: 25057 - DNA, 606 bp, Unknown
  Obtained from environmental sample
  misc_feature (1)..(606): n is a, c, g, or t
atgacttttcatttaaaaccaatactagtttttgcattactttttatgtcttgcaacacaggaaaactaactgtagtaggatccatagatggtgatttggacgaagcttctgcagcacaattaattagtggatctgatttaatttggactattgaggatgcaggtaataaaaacaatgtgtatggtttagacaaaaaaggtaatattattaaagatatagatattagcaatattaaaaaccatgactgggaagacttagctgctgacaacattgggaatttatacattggagattttggaaataactcaagaaaacgagaccacttttttatatataaagtcaataacatagcaaacattaaggacaaaacagaagctgaaactatacgctttacattacctgatgatattaagtctgaagattttgaagctttctttttatggaataatgacttttatatttttagtaaagagaataaaaaaacaatggttattaaagtaccaaacaccattgggtctcacgttgcaacgtatgttacagactacaaactaaaaggaaacgatacacgtgtaacatctgcagacattagtcctgatggctctann

SEQ ID NO: 25058 - protein, 202 aa, Unknown
  Obtained from environmental sample
  SIGNAL (1)...(20)
  misc_feature (1)..(202): Xaa is any amino acid
MTFHLKPILVFALLFMSCNTGKLTVVGSIDGDLDEASAAQLISGSDLIWTIEDAGNKNNVYGLDKKGNIIKDIDISNIKNHDWEDLAADNIGNLYIGDFGNNSRKRDHFFIYKVNNIANIKDKTEAETIRFTLPDDIKSEDFEAFFLWNNDFYIFSKENKKTMVIKVPNTIGSHVATYVTDYKLKGNDTRVTSADISPDGSX

SEQ ID NO: 25059 - DNA, 540 bp, Unknown
  Obtained from environmental sample
  misc_feature (1)..(540): n is a, c, g, or t
atgaaatacctacaatatttattgatactttttgtagttttaagttgcaaaccaaatagcgaaaaacatgttgcacttggaacttggaatagatgtaataaagatggtagctatattgaatacaaaataactgagcagtacatgctcattttgacatcgcatagaccaaatgaaataatcatttttggaaataaagtactagacgacaaattaatttcctatcaacttaaaaacgggacgaaaatacttcaagacaatgatactctggtaactttaaaaaagtcatcagagaaagtcattttaatgagtacttggggatatgacaaatatgaattgaacaaggcagaatttgattacgataaaattgattctttaaatttggaatcgtggaaaaagaaaacattatctgaatttaaaaaaagagctgaaataaaaagttgtcctgacttaagaacccaagatgagaaaataattccgactctggatttggataaccttgaggaagaggaaattgacataatcgaaattgaaaaggaataa

SEQ ID NO: 25060 - protein, 179 aa, Unknown
  Obtained from environmental sample
  misc_feature (1)..(179): Xaa is any amino acid
MKYLQYLLILFVVLSCKPNSEKHVALGTWNRCNKDGSYIEYKITEQYMLILTSHRPNEIIIFGNKVLDDKLISYQLKNGTKILQDNDTLVTLKKSSEKVILMSTWGYDKYELNKAEFDYDKIDSLNLESWKKKTLSEFKKRAEIKSCPDLRTQDEKIIPTLDLDNLEEEEIDIIEIEKE

SEQ ID NO: 25061 - DNA, 540 bp, Unknown
  Obtained from environmental sample
  misc_feature (1)..(540): n is a, c, g, or t
atgaaatacctacaatatttattgatactttttgtagttttaagttgcaaaccaaatagcgaaaaacatgttgcacttggaacttggaatagatgtaataaagatggtagctatattgaatacaaaataactgagcagtacatgctcattttgacatcgcatagaccaaatgaaataatcatttttggaaataaagtactagacgacaaattaatttcctatcaacttaaaaacgggacgaaaatacttcaagacaatgatactctggtaactttaaaaaagtcatcagagaaagtcattttaatgagtacttggggatatgacaaatatgaattgaacaaggcagaatttgattacgataaaattgattctttaaatttggaatcgtggaaaaagaaaacattatctgaatttaaaaaaagagctgaaataaaaagttgtcctgacttaagaacccaagatgagaaaataattccgactctggatttggataaccttgaggaagaggaaattgaaataatcgaaattgaaaaggaataa

SEQ ID NO: 25062 - protein, 179 aa, Unknown
  Obtained from environmental sample
  misc_feature (1)..(179): Xaa is any amino acid
MKYLQYLLILFVVLSCKPNSEKHVALGTWNRCNKDGSYIEYKITEQYMLILTSHRPNEIIIFGNKVLDDKLISYQLKNGTKILQDNDTLVTLKKSSEKVILMSTWGYDKYELNKAEFDYDKIDSLNLESWKKKTLSEFKKRAEIKSCPDLRTQDEKIIPTLDLDNLEEEEIEIIEIEKE

SEQ ID NO: 25063 - DNA, 639 bp, Unknown
  Obtained from environmental sample
  misc_feature (1)..(639): n is a, c, g, or t
ttgccaattaatctacatgtaaagcctgattgttggttggtttctgttttaatatctataaaaaagtttcatggtttgttttctcaagaagccgattatatcacgtttttaagtagtgataataaggataaaaaatattacaaggatggaaagatttcgccatctatggctattgcattaaatcaaattattaattataacttaaactcatctattaaaaccttgtattttaaaggaaaagcatatgagttacttagcttgtattttaatagaggagaggatgctaatattgatcagtgtccctttttagtagatgaatctaatgttgctaaaattaagcaagccaaagatattgtaattgctagaatggcagagccaccaactttacaagaattgtctgaagaaataaatttatcgcttaaaaaattaaaagaaggttttaagcagatttatggagactctgtttttagttttttgtttgattataaaatggaggttgcaagaaagcttttagagacaggttcgcacaatgttaacgaggttggtttgcgtgttggatatagtacggctagccattttatcgctgcttttaaaaaaaagtatgggattactcctaaaaagtatatacaatccatataa

SEQ ID NO: 25064 - protein, 212 aa, Unknown
  Obtained from environmental sample
  DOMAIN (166)...(210): Bacterial regulatory helix-turn-helix proteins, AraC family
  misc_feature (1)..(212): Xaa is any amino acid
MPINLHVKPDCWLVSVLISIKKFHGLFSQEADYITFLSSDNKDKKYYKDGKISPSMAIALNQIINYNLNSSIKTLYFKGKAYELLSLYFNRGEDANIDQCPFLVDESNVAKIKQAKDIVIARMAEPPTLQELSEEINLSLKKLKEGFKQIYGDSVFSFLFDYKMEVARKLLETGSHNVNEVGLRVGYSTASHFIAAFKKKYGITPKKYIQSI

SEQ ID NO: 25065 - DNA, 804 bp, Unknown
  Obtained from environmental sample
  misc_feature (1)..(804): n is a, c, g, or t
atggtacatgttttagactcattaatgcaatcacaatccgtatttgcaggtgttggcgctgcacatttaccaggaaataaagggatgctaaaaatgcttgaagacaaaggttacacagtaaaacctttactatctaaacaaacgactgtcgcacaaaccaaaaaagaacaaattgaagcatttattgcaccaactagcattacaaaacaaagtacacctgatggttttttaaccctaaaggcttttacggaactttatgagttttattatggtggtcaaaaatattacatatctccagacatgaccaatggtgcgtatttaactattagtaggtttaatacttttgattatttaccaaacgacaaagaaatttctttagatagattagataattttttatttgaggatattcctggagatattatcaaaaaagaaatactatccaatccgtatccaggtattagtattttaaataaaactaaaaaaggtgactatcaaaaatatcatatatacaaaacacctttagaagtagtcgtgataaaatttgctggtcaaaaagagtatgttttaaaaaatgaagcaccaatatttaaatctataaaatttaaaacaccaacaaatacattaacaacctttacctctgcttacaataaatacaaggttaattttccagaataccataccacagataacgtccaaaatgcaggacaaaaattaatccaaggtaaaataaaagacgattattattttgtaaaagaagtcgcttttaacgatgtatactatattgaagaagataaattttga

SEQ ID NO: 25066 - protein, 267 aa, Unknown
  Obtained from environmental sample
  misc_feature (1)..(267): Xaa is any amino acid
MVHVLDSLMQSQSVFAGVGAAHLPGNKGMLKMLEDKGYTVKPLLSKQTTVAQTKKEQIEAFIAPTSITKQSTPDGFLTLKAFTELYEFYYGGQKYYISPDMTNGAYLTISRFNTFDYLPNDKEISLDRLDNFLFEDIPGDIIKKEILSNPYPGISILNKTKKGDYQKYHIYKTPLEVVVIKFAGQKEYVLKNEAPIFKSIKFKTPTNTLTTFTSAYNKYKVNFPEYHTTDNVQNAGQKLIQGKIKDDYYFVKEVAFNDVYYIEEDKF

SEQ ID NO: 25067 - DNA, 762 bp, Unknown
  Obtained from environmental sample
  misc_feature (1)..(762): n is a, c, g, or t
atgatcagatcggctcgagtgtctacgcatgccatatggtacatgttagactcattaatgcaatcacaatccgtatttgcaggtgttggcgctgcacatttaccaggaaataaagggatgctaaaaatgcttgaagacaaaggttacacagtaaaacctttactatctaaacaaacgactgtcgcacaaaccaaaaaagaacaaattgaagcatttattgcaccaactagcattacaaaacaaagtacacctgatggttttttaaccctaaaggcttttacggaactttatgagttttattatggtggtcaaaaatattacatatctccagacatgaccaatggtgcgtatttaactattagtaggtttaatacttttgattatttaccaaacgacaaagaaatttctttagatagattagataattttttatttgaggatattcctggagatattatcaaaaaagaaatactatccaatccgtatccaggtattagtattttaaataaaactaaaaaaggtgactatcaaaaatatcatatatacaaaacacctttagaagtagtcgtgataaaatttgctggtcaaaaagagtatgttttaaaaaatgaagcaccaatatttaaatctataaaatttaaaacaccaacaaatacattaacaacctttacctctgcttacaataaatacaaggttaattttccagaataccataccacagataacgtccaaaatgcaggaccaaaaattaatccacggtaa

SEQ ID NO: 25068 - protein, 253 aa, Unknown
  Obtained from environmental sample
  misc_feature (1)..(253): Xaa is any amino acid
MIRSARVSTHAIWYMLDSLMQSQSVFAGVGAAHLPGNKGMLKMLEDKGYTVKPLLSKQTTVAQTKKEQIEAFIAPTSITKQSTPDGFLTLKAFTELYEFYYGGQKYYISPDMTNGAYLTISRFNTFDYLPNDKEISLDRLDNFLFEDIPGDIIKKEILSNPYPGISILNKTKKGDYQKYHIYKTPLEVVVIKFAGQKEYVLKNEAPIFKSIKFKTPTNTLTTFTSAYNKYKVNFPEYHTTDNVQNAGPKINPR

SEQ ID NO: 25069 - DNA, 735 bp, Unknown
  Obtained from environmental sample
  misc_feature (1)..(735): n is a, c, g, or t
gtgtatggttttattgatgatagcgtaactcacgaaattgttaaagacaaggaaattgcttacgaaggtggtaaaattttgggtaaatttttaaatgggacatcagattttgatagcaaacaattaatagatgtaattccgaacttccatgatatgtcttttcgttttaatcaatatgcatcatctttgcaaagtgcttcaaaagagcgtttaaaaaaagcagagaaatacactaaaatcgtaagagatttaaaggatgagatgcatattcttcaaacattaaaagaatcaggtaaaattccagtaagggtaactcataatgatacaaaaatatctaattcgctttttactatggatgaaaagggcatttgtatgatagatactgatactgttatgcctggaattattcattatgattttggtgatgccatcagaacaatttgtaattcagttgcagaagatgaaaaagatatatctaaagttgaatttaatttagagtattacaaagcgtataaaaaagggtttttagaagaaacagcaaattctttatcagaaactgaactagaatatttgcctttagcagcaaaaacaatgatttttattatggcacttcgttttttaacagattacttaaataacgatatgtactataaaacaacatatccagatcataatttagacagagcaaaaaatcaatttaaattgataaaaagtttttctgaaaagatgagctaa

SEQ ID NO: 25070 - protein, 244 aa, Unknown
  Obtained from environmental sample
  misc_feature (1)..(244): Xaa is any amino acid
MYGFIDDSVTHEIVKDKEIAYEGGKILGKFLNGTSDFDSKQLIDVIPNFHDMSFRFNQYASSLQSASKERLKKAEKYTKIVRDLKDEMHILQTLKESGKIPVRVTHNDTKISNSLFTMDEKGICMIDTDTVMPGIIHYDFGDAIRTICNSVAEDEKDISKVEFNLEYYKAYKKGFLEETANSLSETELEYLPLAAKTMIFIMALRFLTDYLNNDMYYKTTYPDHNLDRAKNQFKLIKSFSEKMS

SEQ ID NO: 25071 - DNA, 531 bp, Unknown
  Obtained from environmental sample
  misc_feature (1)..(531): n is a, c, g, or t
atggctaaagtaaaaactacctttttttgtcaaaattgcggtacgcaatatgctaaatggcaaggacaatgtaatgcctgcaaggagtggaatacaattgttgaagaggttgtgcaaaaaccagaaaaaagcgattggaaaacacctactaataatacaaaacgagcatcaaaaccattaagaataaacgaaattgattcctctaaagaagcaagattagatacgcttgatgcggaatttaatcgtgtgttgggtggtgggattgtaccaggatctttaacgcttttgggtggagaaccaggtattggtaaaagtacattgttacttcaaatttcattaaaattaccctataaaaccttatacgtttctggagaagaaagtcaaaagcaaataaaaatgcgtgccgagcgtataaacccgcgaaacgaaagttgctacattcttaatgaaaacaaaaacacaaatatttttaagcaaatagaagctttaagccagatattgtattatggttctattcaacattgcttctga

SEQ ID NO: 25072 - protein, 176 aa, Unknown
  Obtained from environmental sample
  misc_feature (1)..(176): Xaa is any amino acid
MAKVKTTFFCQNCGTQYAKWQGQCNACKEWNTIVEEVVQKPEKSDWKTPTNNTKRASKPLRINEIDSSKEARLDTLDAEFNRVLGGGIVPGSLTLLGGEPGIGKSTLLLQISLKLPYKTLYVSGEESQKQIKMRAERINPRNESCYILNENKNTNIFKQIEALSQILYYGSIQHCF

SEQ ID NO: 25073 - DNA, 528 bp, Unknown
  Obtained from environmental sample
  misc_feature (1)..(528): n is a, c, g, or t
atgagtcctaaaggaaaaaaaacttttgatgtattaatcgaaataccaaaaggaagccgtaacaaatatgaatacgattttgatttaaaaaagatccgttttgatcgtttgttgttttcttccatgatgtatcctgctgattatggtttcattccggaaactctagctttggatggagatccattagacgttttggtgttaggtactgaacctacctttcctatgtgcgttgttgaagtaaaacctattggtgtgttccatatggctgatgaaaaaggaaacgacgagaaagtaatctgtgtaccagtttctgatcctatttggaatagtcttaacgatttatctgacgtgaatgctcatcaaattaaagaaattgaacatttctttcaagtgtataaagatttggaaaagaaaaaagttgatgtaggtggatggggagatgcacaagaggcttatgacatccttaataaatgtgttctccgttacgaaaacagtgagcataaaaccaacgggaattttactatttaa

SEQ ID NO: 25074 - protein, 175 aa, Unknown
  Obtained from environmental sample
  DOMAIN (10)...(164): Inorganic pyrophosphatase
  misc_feature (1)..(175): Xaa is any amino acid
MSPKGKKTFDVLIEIPKGSRNKYEYDFDLKKIRFDRLLFSSMMYPADYGFIPETLALDGDPLDVLVLGTEPTFPMCVVEVKPIGVFHMADEKGNDEKVICVPVSDPIWNSLNDLSDVNAHQIKEIEHFFQVYKDLEKKKVDVGGWGDAQEAYDILNKCVLRYENSEHKTNGNFTI

SEQ ID NO: 25075 - DNA, 678 bp, Unknown
  Obtained from environmental sample
  misc_feature (1)..(678): n is a, c, g, or t
atgcacaatcctttattacaaaaattcaataccagatatacaactgcacctttttcgcaaatcaaaaacgaacattttaaaccggcatttaaagaaggaatcaagagagcgaaggcggaaatcgatgctattattgaaaaccacgaaaaacccacttttaaaaatacaattgaagctttagatttttcaggttatacattagacagactttcctctgtcttttttaacttgaattcagccgaaacgagtgatgaaattcaaaaaatagctcaagaagtttctccttggttatcagagttttctaatgatataagattaaatgaaaagttatttcaacgcgtaaagagtctttatgaaaatcgcaaaaatttaaagttaacaattgaacaacaaacgctattagataaaaaatataaaagtttttcgagaaatggagctaatttaaatgatatagacaagactaaacttcgaaaaatagataaaaaactctcgaaactctctttgcagtttggtgaaaatgtattggcagaaaccaatgcttatgagttacatattactaatgaaggtgagctaaaaggtctacccgaaggagctaaagaagcggcacaacaactcgcaattgaaaagagaaaagggttgatctttaccttagttatcccagctatattccttttatga

SEQ ID NO: 25076 - protein, 225 aa, Unknown
  Obtained from environmental sample
  misc_feature (1)..(225): Xaa is any amino acid
MHNPLLQKFNTRYTTAPFSQIKNEHFKPAFKEGIKRAKAEIDAIIENHEKPTFKNTIEALDFSGYTLDRLSSVFFNLNSAETSDEIQKIAQEVSPWLSEFSNDIRLNEKLFQRVKSLYENRKNLKLTIEQQTLLDKKYKSFSRNGANLNDIDKTKLRKIDKKLSKLSLQFGENVLAETNAYELHITNEGELKGLPEGAKEAAQQLAIEKRKGLIFTLVIPAIFLL

SEQ ID NO: 25077 - DNA, 432 bp, Unknown
  Obtained from environmental sample
  misc_feature (1)..(432): n is a, c, g, or t
atgagtaaggtaaaatattattacgattctgacaccctctcttataagaaaatagagcgcaaaaaaaggaatacctttaagtatggcgctatttttattttgggttcagcgctttttgcatttcttttggtgtttttagctagccaatttgtaaaatcgcctaaagagcgtgctttagctagagaacttcagcatatggaattacagtatcggcttttgaataagaagatggacgaagcgcaatcagttctgtccaatgttgaagaacgtgacaacgccatataccgactctattttgaggctaatcctattcctgaagaacagcgtaaagcaggttttggtgggattaatcggtataagaatttagaaggttttgacacttcanaaatcatcatcgaaaccaataacgtttggacctctttgcaaagcgnn

SEQ ID NO: 25078 - protein, 144 aa, Unknown
  Obtained from environmental sample
  misc_feature (1)..(144): Xaa is any amino acid
MSKVKYYYDSDTLSYKKIERKKRNTFKYGAIFILGSALFAFLLVFLASQFVKSPKERALARELQHMELQYRLLNKKMDEAQSVLSNVEERDNAIYRLYFEANPIPEEQRKAGFGGINRYKNLEGFDTSXIIIETNNVWTSLQSX

SEQ ID NO: 25079 - DNA, 315 bp, Unknown
  Obtained from environmental sample
  misc_feature (1)..(315): n is a, c, g, or t
atgcacatcgacctccccgaaaaaagatattatggcattggcgaagtggctaaggcatttaaagtcaacacctctttaatccggttttgggagaaggaatttgacatcctcaaacctaaaaagaacgctaagggcaaccgtaaatttacaccagaagacattcagaacctcaagttcatttttcatctggtcaaagaacgcggttttacgttagaaggtgcaaaaacccacttaaaggaagaaaaacaacaagcacttaatacttttgaaattatcagtaaattagatcatatcaatctcaactttaaaaattaa

SEQ ID NO: 25080 - protein, 104 aa, Unknown
  Obtained from environmental sample
  DOMAIN (12)...(49): MerR family regulatory protein
  misc_feature (1)..(104): Xaa is any amino acid
MHIDLPEKRYYGIGEVAKAFKVNTSLIRFWEKEFDILKPKKNAKGNRKFTPEDIQNLKFIFHLVKERGFTLEGAKTHLKEEKQQALNTFEIISKLDHINLNFKN

SEQ ID NO: 25081 - DNA, 372 bp, Unknown
  Obtained from environmental sample
  misc_feature (1)..(372): n is a, c, g, or t
gtggctgttattaacagcaaactcggtaagctctttggttatttcaatattgttaaggcctgcttgttttggtacttcgtatctaaaacccacgccactatcaaacgctttaaagcgcacgctataagtaccatcttgaggttgtggcttagcaaaggttacagttacctcgttatgctgatctacaaccgtttgtcgctcgccccaaggttgttgccactgagtgttggtactttgttgttgaactttggttattttaaagctgttactaaacggtgcatgttgtttaaattcaaacccgagagcggaattattaatgactgttttatttttaaaactaatagaataactaggtgtactctgctcgtctga

SEQ ID NO: 25082 - protein, 123 aa, Unknown
  Obtained from environmental sample
  misc_feature (1)..(123): Xaa is any amino acid
MAVINSKLGKLFGYFNIVKACLFWYFVSKTHATIKRFKAHAISTILRLWLSKGYSYLVMLIYNRLSLAPRLLPLSVGTLLLNFGYFKAVTKRCMLFKFKPESGIINDCFIFKTNRITRCTLLV

SEQ ID NO: 25083 - DNA, 372 bp, Unknown; identical to SEQ ID NO: 25081
  Obtained from environmental sample
  misc_feature (1)..(372): n is a, c, g, or t

SEQ ID NO: 25084 - protein, 123 aa, Unknown; identical to SEQ ID NO: 25082
  Obtained from environmental sample
  misc_feature (1)..(123): Xaa is any amino acid

SEQ ID NO: 25085 - DNA, 357 bp, Unknown
  Obtained from environmental sample
  misc_feature (1)..(357): n is a, c, g, or t
atgcaaaaaaaattatatttctcttcactgttatttttcttaatagtgtcatttacaaacgctcaagaattatcaactgctaaaattaaagatcttgtggaatcttacaaagaagatgtaagaggtccttattacagaataaaatggttttgtgaagatggtagtgttagagatgctaaagatccttgtccagataaaattgaaggaattcaacatgctagttttaaaacatctgctttagaattaagaaaaccaatcatttgttttgtggtgaaatttgggatccacaaaaattacgaatttttagacgaacaaaacattacagcagacttaaacatatcaattggtaatatataa

SEQ ID NO: 25086 - protein, 118 aa, Unknown
  Obtained from environmental sample
  SIGNAL (1)...(19)
  misc_feature (1)..(118): Xaa is any amino acid
MQKKLYFSSLLFFLIVSFTNAQELSTAKIKDLVESYKEDVRGPYYRIKWFCEDGSVRDAKDPCPDKIEGIQHASFKTSALELRKPIICFVVKFGIHKNYEFLDEQNITADLNISIGNI

SEQ ID NO: 25087 - DNA, 486 bp, Unknown
  Obtained from environmental sample
  misc_feature (1)..(486): n is a, c, g, or t
ttggaaaagggcaaagtaaaattaaaaccagatattttacacaaatccagtttctcaattgcagggttaacttattccggacatgatgctactgaaattttcaaattatggcaggctttttggttaatggtacaggaaggtaagattattcttggtaatagcggatgcctcggcgcttgcctgcatgacattgatatgcggaataacgaaatctttgtatattatgcaggtatagcggtcaatcaatcactcgatatttcaaaagaaataaaattcgtcaatattcctgaaagtacttacgctgtctttaagcataaaggaccaatttcagaaattgaacaaacctacgaccggatatatggcagctggtttccccgtaccggcaatactcccaccatggatttagatataattgtagttgatcaccggtttaaaatacagagtaaaaatagtgtaatagacatcttaataccgattcaagagtaa

SEQ ID NO: 25088 - protein, 161 aa, Unknown
  Obtained from environmental sample
  DOMAIN (8)...(160): Bacterial transcription activator, effector binding domain
  misc_feature (1)..(161): Xaa is any amino acid
MEKGKVKLKPDILHKSSFSIAGLTYSGHDATEIFKLWQAFWLMVQEGKIILGNSGCLGACLHDIDMRNNEIFVYYAGIAVNQSLDISKEIKFVNIPESTYAVFKHKGPISEIEQTYDRIYGSWFPRTGNTPTMDLDIIVVDHRFKIQSKNSVIDILIPIQE

SEQ ID NO: 25089 - DNA, 912 bp, Unknown
  Obtained from environmental sample
  misc_feature (1)..(912): n is a, c, g, or t
ttgttgttaacccaaatgttacaggaatcccaggtggttttcaataatagtttctatctcatgcaagatcggagaaataatacgattgaatatattgagnctaatctcgataaaaatattcatcttgaatttctggccagcaaatttgctttatctaaatatcacttccatcggattttcaaagctttgattggagaccctcccttcagatatattgaaaaaaggagactttccggagccgcagcagatttaattgaaacgaataaacggattatcgatattgccttcgactatggttttaattctcatgagtcattcataaggtcatttaaaaaaaaatattcacttacgccaagtcaatttcgaaaaacaaagcctgactttcgcttctatgagaaatgcccgatcggttctattgagctaaaattggaaaagggcaaagtaaaattaaaaccagatattttacacaaatccagtttctcaattgcagggttaacttattccggacatgatgctactgaaattttcaaattatggcaggctttttggttaatggtacaggaaggtaagattattcttggtaatagcggatgcctcggcgcttgcctgcatgacattgatatgcggaataacgaaatctttgtatattatgcaggtatagcggtcaatcaatcactcgatatttcaaaagaaataaaattcgtcaatattcctgaaagtacttacgctgtctttaagcataaaggaccaatttcagaaattgaacaaacctacgaccggatatatggcagctggtttccccgtaccggcaatactcccaccatggatttagatataattgtagttgatcaccggtttaaaatacagagtaaaaatagtgtaatagacatcttaataccgattcaagagtaa

SEQ ID NO: 25090 - protein, 303 aa, Unknown
  Obtained from environmental sample
  DOMAIN (79)...(123): Bacterial regulatory helix-turn-helix proteins, AraC family
  misc_feature (1)..(303): Xaa is any amino acid
MLLTQMLQESQVVFNNSFYLMQDRRNNTIEYIEXNLDKNIHLEFLASKFALSKYHFHRIFKALIGDPPFRYIEKRRLSGAAADLIETNKRIIDIAFDYGFNSHESFIRSFKKKYSLTPSQFRKTKPDFRFYEKCPIGSIELKLEKGKVKLKPDILHKSSFSIAGLTYSGHDATEIFKLWQAFWLMVQEGKIILGNSGCLGACLHDIDMRNNEIFVYYAGIAVNQSLDISKEIKFVNIPESTYAVFKHKGPISEIEQTYDRIYGSWFPRTGNTPTMDLDIIVVDHRFKIQSKNSVIDILIPIQE

SEQ ID NO: 25091 - DNA, 411 bp, Unknown
  Obtained from environmental sample
  misc_feature (1)..(411): n is a, c, g, or t
atgaaataccatcttatagacaatcaactctttattaaaaacagaaaaaactttatggcgcaaatgaagtccaatagtttagctgtttttaattcgaatgacgtataccctattggtgcagatagcaccattccatttcaacaagaccgaaatatattttatttaagtggtgtagaccaagaagatagcatcttggtcctatttccagactgcccaaagccaaagcatcgagaaatactatttgttacagaaaccaacgatcatattgcggtttgggacggtgagaaactaaccaaagaaaaagcgtttgaaacgtctggtataaaaaccgtttattggctacaggatttcgatcacactttttacagaagtcatggcacaatgcgaaacggtttatataaacaccaatga

SEQ ID NO: 25092 - protein, 136 aa, Unknown
  Obtained from environmental sample
  DOMAIN (6)...(132): Aminopeptidase P, N-terminal domain
  misc_feature (1)..(136): Xaa is any amino acid
MKYHLIDNQLFIKNRKNFMAQMKSNSLAVFNSNDVYPIGADSTIPFQQDRNIFYLSGVDQEDSILVLFPDCPKPKHREILFVTETNDHIAVWDGEKLTKEKAFETSGIKTVYWLQDFDHTFYRSHGTMRNGLYKHQ

SEQ ID NO: 25093 - DNA, 597 bp, Unknown
  Obtained from environmental sample
  misc_feature (1)..(597): n is a, c, g, or t
atgaagccatcggttaacatattgataagcggcggcggaacaggaggacatatctatcctgcgattgcaattgctaatgaacttaaaagacggaatgctgaagctaattttttgtttgtgggggctcaagacagaatggaaatggaaaaagttccactggccggttatccaattgaaggattatggataacaggtatccagcgaaagcttaccctaaaaaatttattgtttcccattaagttaatgagtagtttgtataaagcgaataagatcattaaaaagtttaaaccaaatgtagtcatcggtacaggaggttttgcatcaggtccaaccttacatatggcagcaaaaaaaggaataccgacattagtgcaagaacaaaactcatatccgggtatcactaataaaattttaggtaaaaaagcgaatgttatttgtgtggcttatgacggcttagaacgtttttttccagtcgataaaattgttaaaacagggaatccggtacgtcaggatctattagaatttctcaaaaaagaaaagaagcacaacaatcttttaaacttattacaactcctgagccgattcttgatccactag

SEQ ID NO: 25094 - protein, 198 aa, Unknown
  Obtained from environmental sample
  DOMAIN (7)...(147): Glycosyltransferase family 28 N-terminal domain
  misc_feature (1)..(198): Xaa is any amino acid
MKPSVNILISGGGTGGHIYPAIAIANELKRRNAEANFLFVGAQDRMEMEKVPLAGYPIEGLWITGIQRKLTLKNLLFPIKLMSSLYKANKIIKKFKPNVVIGTGGFASGPTLHMAAKKGIPTLVQEQNSYPGITNKILGKKANVICVAYDGLERFFPVDKIVKTGNPVRQDLLEFLKKEKKHNNLLNLLQLLSRFLIH

SEQ ID NO: 25095 - DNA, 543 bp, Unknown
  Obtained from environmental sample
  misc_feature (1)..(543): n is a, c, g, or t
atggactataaaaatacatccattcaaagtaatttagtggggagttataactacacaaacattgcaattgccattaccattggtgaatattttaaagtatcaaaagctgatataaaagaagctattgaaagttatactccaaaaaacaatcgttctcaaatcatcgaaaacaaaacgaataaaattattttagatgcttataatgcaaatccttctagcatgaaagtggctttagaaaattttgcatcattggttcatgacaaaaaagcaatcattttaggagatatgtttgaacttggtaaagacagccaaaaggaacatcaagaaattgtaaatcttgccaactctttgggttttcaaaatcaatattttgttggcgaaaattttcatcaaacaagaacagactcacaacaatttaaaacattcgacgattttgaaagttatatcaaaaaagatcctctagaaaaccaatatatattgattaaaggctctagaggaatgcgtttagaaagaattttagaatcgctagacgttgttcgttag

SEQ ID NO: 25096 - protein, 180 aa, Unknown
  Obtained from environmental sample
  DOMAIN (47)...(141): Mur ligase family, glutamate ligase domain
  misc_feature (1)..(180): Xaa is any amino acid
MDYKNTSIQSNLVGSYNYTNIAIAITIGEYFKVSKADIKEAIESYTPKNNRSQIIENKTNKIILDAYNANPSSMKVALENFASLVHDKKAIILGDMFELGKDSQKEHQEIVNLANSLGFQNQYFVGENFHQTRTDSQQFKTFDDFESYIKKDPLENQYILIKGSRGMRLERILESLDVVR

SEQ ID NO: 25097 - DNA, 360 bp, Unknown
  Obtained from environmental sample
  misc_feature (1)..(360): n is a, c, g, or t
atgataaacaattcagaattttcaaacaggttaagaacaatcatggatttctaccaattatcggcttctgcatttgctgataaaatacaggtacctagatctagtatatcacacttgctttcaggaagaaacaaacccagtttagattttgttttaaaggttgttaaagaatttaaggatgtcgaattatattggttattgaatgggaaaggttcttttccgaatagcctcactcctatccaaacagacaatacaacagcccctattcaagaaagcacacctaagactaagtcatcggccaacaatgactttaaactacctgaaactgcaaaaaagatagaaagaatagtacttttttga

SEQ ID NO: 25098 - protein, 119 aa, Unknown
  Obtained from environmental sample
  DOMAIN (11)...(66): Helix-turn-helix
  misc_feature (1)..(119): Xaa is any amino acid
MINNSEFSNRLRTIMDFYQLSASAFADKIQVPRSSISHLLSGRNKPSLDFVLKVVKEFKDVELYWLLNGKGSFPNSLTPIQTDNTTAPIQESTPKTKSSANNDFKLPETAKKIERIVLF

SEQ ID NO: 25099 - DNA, 378 bp, Unknown
  Obtained from environmental sample
  misc_feature (1)..(378): n is a, c, g, or t
gtggatcaagaatcggtcgagagcatcaaagcaattgcgtatgctttaaaaaggaataatattaaatacaagtttgtttctagaaatcctgaagggaaaaaagaaatttcttacaatagtttaacgcaaaaagttatagagaaacatacaattgttatcaactctacacctttaggaacttttccagatgttgaaaaatgtcctaatattccttatcaatttatcacccaaaaccatattttatacgatttaatctataatccagcaatttcaacttttttatcaaaaggaaacgaaaaagaagccattacaaaaaatgggttgcaaatgttagagttgcaagcagaagaatcgtggagaatttggaatcaaaaataa

SEQ ID NO: 25100 - protein, 125 aa, Unknown
  Obtained from environmental sample
  misc_feature (1)..(125): Xaa is any amino acid
MDQESVESIKAIAYALKRNNIKYKFVSRNPEGKKEISYNSLTQKVIEKHTIVINSTPLGTFPDVEKCPNIPYQFITQNHILYDLIYNPAISTFLSKGNEKEAITKNGLQMLELQAEESWRIWNQK

SEQ ID NO: 25101 - DNA, 360 bp, Unknown
  Obtained from environmental sample
  misc_feature (1)..(360): n is a, c, g, or t
atggcacagcataatgaattaggtaaaaaaggagagcaattggccattaattatttgttaaaaaagggttataaaatcctggaaaaaaattggcgttttcaaaaagcagaaattgatatcatcgctcaaaaaggtgaaacccttgctgttgttgaagtaaaaacgagatcaagtattgattttgggaaccctcaggattttgtaaatcctaaaaaaataaagttactggtaatggcaattgatgaatatgtaatttctaacgatctggatgttaatgtcagatttgatatcattgctattgttcatgaaaacaagaatttcaccttagaacatctggaagatgccttttatcatttttaa

SEQ ID NO: 25102 - protein, 119 aa, Unknown
  Obtained from environmental sample
  DOMAIN (10)...(101): Uncharacterised protein family UPF0102
  misc_feature (1)..(119): Xaa is any amino acid
MAQHNELGKKGEQLAINYLLKKGYKILEKNWRFQKAEIDIIAQKGETLAVVEVKTRSSIDFGNPQDFVNPKKIKLLVMAIDEYVISNDLDVNVRFDIIAIVHENKNFTLEHLEDAFYHF

SEQ ID NO: 25103 - DNA, 381 bp, Unknown
  Obtained from environmental sample
  misc_feature (1)..(381): n is a, c, g, or t
ttggtgggcggaaattgtcatttatacagtttgctgggttcaaaatcaacaatttcgttagaaaataaaattttatttattgaagatgtaggcgaatacgaatatcacatagacaggatgttgttaaaccttaaacggaatggctattttgaaaaatgtaaaggattaattattggtggaatatctgacataagagaaaatgatgtagcatttggtaaaacagtagaagaaattgtactcgatgccgtaaaagagtatgatttcccggttagttttgaattcccggcagggcacattagagataataggaccttaattttagggagggagatctcattaatggtaaaagcaaagaaggcagttgttaagtttttaaaataa

SEQ ID NO: 25104 - protein, 126 aa, Unknown
  Obtained from environmental sample
  misc_feature (1)..(126): Xaa is any amino acid
MVGGNCHLYSLLGSKSTISLENKILFIEDVGEYEYHIDRMLLNLKRNGYFEKCKGLIIGGISDIRENDVAFGKTVEEIVLDAVKEYDFPVSFEFPAGHIRDNRTLILGREISLMVKAKKAVVKFLK

SEQ ID NO: 25105 - DNA, 360 bp, Unknown; identical to SEQ ID NO: 25101
  Obtained from environmental sample
  misc_feature (1)..(360): n is a, c, g, or t

SEQ ID NO: 25106 - protein, 119 aa, Unknown; identical to SEQ ID NO: 25102
  Obtained from environmental sample
  DOMAIN (10)...(101): Uncharacterised protein family UPF0102
  misc_feature (1)..(119): Xaa is any amino acid

SEQ ID NO: 25107 - DNA, 600 bp, Unknown
  Obtained from environmental sample
  misc_feature (1)..(600): n is a, c, g, or t
atgaatttcgattttgaaatgccagaaattgatttttcaagtctagaaaatttagaattaccaaagatggattttgattttgatttcaattttgactttaaagatgtttttgatgatattgacgaaaacatgggaaaagatggtaagtataattttagatggaaagatgatgaaaataacattgtaatcaacacgaaagaggaatgggaagcatttaagaaatctaaaaaatatgcagaactaaaaagtaaaatgaaaattgataaagaaaaattaagaaaagattttgctgaatctcaagaagaaatgaaaaagcaattaaaggaatctaaagaaaaatattataagatagataaagaaaaaataaagcaagaattattaaaagttaaagaagaacttaaaaaattaaactttaaatctaattcagatgatatcatcatcaatggaaaaaaaataaaaattaaaaagaggttagaaattaaagttccaaaaggtgcaactttcgatttgaatacgcgtcattgtaaagttacattgccaaacacagttgcctttggtaacgtaaaatatggcacttttaatgctcataaattaaatggn

SEQ ID NO: 25108 - protein, 200 aa, Unknown
  Obtained from environmental sample
  misc_feature (1)..(200): Xaa is any amino acid
MNFDFEMPEIDFSSLENLELPKMDFDFDFNFDFKDVFDDIDENMGKDGKYNFRWKDDENNIVINTKEEWEAFKKSKKYAELKSKMKIDKEKLRKDFAESQEEMKKQLKESKEKYYKIDKEKIKQELLKVKEELKKLNFKSNSDDIIINGKKIKIKKRLEIKVPKGATFDLNTRHCKVTLPNTVAFGNVKYGTFNAHKLNG

SEQ ID NO: 25109 - DNA, 654 bp, Unknown
  Obtained from environmental sample
  misc_feature (1)..(654): n is a, c, g, or t
atgaatttcgattttgaaatgccagaaattgatttttcaagtctagaaaatttagaattaccaaagatggattttgattttgatttcaattttgactttaaagatgtttttgatgatattgacgaaaacatgggaaaagatggtaagtataattttagatggaaagatgatgaaaataacattgtaatcaacacgaaagaggaatgggaagcatttaagaaatctaaaaaatatgcagaactaaaaagtaaaatgaaaattgataaagaaaaattaagaaaagattttgctgaatctcaagaagaaatgaaaaagcaattaaaggaatctaaagaaaaatattataagatagataaagaaaaaataaagcaagaattattaaaagttaaagaagaacttaaaaaattaaactttaaatctaattcagatgatatcatcatcaatggaaaaaaaataaaaattaaaaagaggttagaaattaaagttccaaaaggtgcaactttcgatttgaatacgcgtcattgtaaagttacattgccaaacacagttgcctttggtaacgtaaaatatggcacttttaatgctcataacttaaatggtggtgaattaacaattgatttttctcctgtaactatcaacgatttaaacgcnnnt

SEQ ID NO: 25110 - protein, 218 aa, Unknown
  Obtained from environmental sample
  misc_feature (1)..(218): Xaa is any amino acid
MNFDFEMPEIDFSSLENLELPKMDFDFDFNFDFKDVFDDIDENMGKDGKYNFRWKDDENNIVINTKEEWEAFKKSKKYAELKSKMKIDKEKLRKDFAESQEEMKKQLKESKEKYYKIDKEKIKQELLKVKEELKKLNFKSNSDDIIINGKKIKIKKRLEIKVPKGATFDLNTRHCKVTLPNTVAFGNVKYGTFNAHNLNGGELTIDFSPVTINDLNAX

SEQ ID NO: 25111 - DNA, 648 bp, Unknown
  Obtained from environmental sample
  misc_feature (1)..(648): n is a, c, g, or t
ttgatgcacggggaagcttgctgccgatttggcaatcgtcgacgtgatactgaaatggttaataatagtgatgccgattggtttcatatcgatgtaatggatggtcagtttgtaccggacatatcgtacggtatgccaataatcgctgcgataaaaagacatgctaaaaagccattagatgtgcatttaatgattgaaaagccagaacgctatattgaagaattcgctaaagttggtgcagatattattactgtgcactatgaatctactgttcatttacaccgaacgctaagacaaatcaaagatgctggctgtaaagcaggtattgttcttaatataactactcctcttgtggttttagaagatattttaccagagtgttatatggttttattaatgtctataaacccaggctttggtggtcaaaaatttgaagacatcacctataagcgcatcaaaaaccttcgtaaaatgatagacgaacaaggtttagatacacgtatagaggttgatggtggtgttacggataaaaatattcagaaattggttgaagcaggagccgatacttttgtcgctggaagtcatgtttttaaaagcaataatccaactaaagctattaaaaacttaaaggatttagctaattcttaa

SEQ ID NO: 25112 - protein, 215 aa, Unknown
  Obtained from environmental sample
  DOMAIN (6)...(200): Ribulose-phosphate 3 epimerase family
  misc_feature (1)..(215): Xaa is any amino acid
MMHGEACCRFGNRRRDTEMVNNSDADWFHIDVMDGQFVPDISYGMPIIAAIKRHAKKPLDVHLMIEKPERYIEEFAKVGADIITVHYESTVHLHRTLRQIKDAGCKAGIVLNITTPLVVLEDILPECYMVLLMSINPGFGGQKFEDITYKRIKNLRKMIDEQGLDTRIEVDGGVTDKNIQKLVEAGADTFVAGSHVFKSNNPTKAIKNLKDLANS

SEQ ID NO: 25113 - DNA, 624 bp, Unknown
  Obtained from environmental sample
  misc_feature (1)..(624): n is a, c, g, or t
atgagacaactaaaaattaccaagcaggttaccaacagggaaactgcatcgttagataaatatttacaagaaattggtaaggtagatcttataaccgcagacgaagaggtagaattagctcaacgtattaaggctggtgatcaacttgctttagaaaaattaacaaaagcaaatttacgttttgttgtatctgtggctaaacaataccaaaaccaaggtttaacattacccgatttaattaatgaaggtaatttaggtttaattaaggctgcacagcgttttgatgaaacacgtggttttaaatttatttcttatgctgtttggtggattagacaatctatcttacaagcattagcagaacaatctcgtattgtgcgtttaccactaaacaaaattggttctattaataaaatcaacaagacttttgcttttttagagcaaagtcatgaacgaccaccttctgctgaagaaatccgccaagaattagacatgacgattaacgacgttaaggagtctatgaaaaattctgggcgtcacgttagtatggatgctccttttattgaaggtgaagattctaacttatatgatgtattacgaagtgtgagaatcaccaaacccgaatcg

SEQ ID NO: 25114 - protein, 208 aa, Unknown
  Obtained from environmental sample
  DOMAIN (128)...(208): Sigma-70 region 3
  misc_feature (1)..(208): Xaa is any amino acid
MRQLKITKQVTNRETASLDKYLQEIGKVDLITADEEVELAQRIKAGDQLALEKLTKANLRFVVSVAKQYQNQGLTLPDLINEGNLGLIKAAQRFDETRGFKFISYAVWWIRQSILQALAEQSRIVRLPLNKIGSINKINKTFAFLEQSHERPPSAEEIRQELDMTINDVKESMKNSGRHVSMDAPFIEGEDSNLYDVLRSVRITKPES

SEQ ID NO: 25115 - DNA, 423 bp, Unknown
  Obtained from environmental sample
  misc_feature (1)..(423): n is a, c, g, or t
atgaaaaattcaatcttaattttcacaactctatttagcttcatatgtggaactcaacaattacaagcacaagattttaatattacaaaaaataattacttaatcctttccaaaaatatccaacaacttaaacctgtattactaactgcccaatctttagcaacggaagacggtattaactatggtgacttttacgtaattatttgcggtaaaacagtaaaagatattcctaataacactgaatttaaaacccttttagaagaagcaaaattcttaaatataaaagtctttgtgtgtggtatttcacttaaaaaatttaatataacacctaaacaattacctgatagtattgtagttacagaaaatggaatcctttatggttttcaacttacaaaaaatggattcttaacattaactatctaa

SEQ ID NO: 25116 - protein, 140 aa, Unknown
  Obtained from environmental sample
  SIGNAL (1)...(18)
  misc_feature (1)..(140): Xaa is any amino acid
MKNSILIFTTLFSFICGTQQLQAQDFNITKNNYLILSKNIQQLKPVLLTAQSLATEDGINYGDFYVIICGKTVKDIPNNTEFKTLLEEAKFLNIKVFVCGISLKKFNITPKQLPDSIVVTENGILYGFQLTKNGFLTLTI

SEQ ID NO: 25117 - DNA, 615 bp, Unknown
  Obtained from environmental sample
  misc_feature (1)..(615): n is a, c, g, or t
ttgattcatatttggcaaaaagacgaaggatttaaaaaagcccatattttaaacaaagcaatagcaaaagcatcaggagattatataatccaggtagatggagattgtattatgcatccgcattttattaaggatcatttacaatttgttcaagaaaacacttatttatttggatctagagtaaatatccaaaaagattatttagatactttgtttaagactaaacaaacctctttttcagctttttctaaaggaataaaaaaacgtactcgtgctttacatattccaatgctaagtaaattatataaaccaaatgctgagttttcaagtaaatttagaggttgtaatacctcttattttaaaaaagattttatcgctgttaatggttataatgaagatataactggttggggaagagaagattctgaattagtcttaagaatgcacaataatggtttgcaagctagacgcttacgttatagaggtattgtgtttcatatatatcacaacgaaaaatctagagatagatttgagattaatgatactattgagcaaaaaactattaacgaaactattaaatgggctaaaaacggagtagataagtatttaccttaa

SEQ ID NO: 25118 - protein, 204 aa, Unknown
  Obtained from environmental sample
  misc_feature (1)..(204): Xaa is any amino acid
MIHIWQKDEGFKKAHILNKAIAKASGDYIIQVDGDCIMHPHFIKDHLQFVQENTYLFGSRVNIQKDYLDTLFKTKQTSFSAFSKGIKKRTRALHIPMLSKLYKPNAEFSSKFRGCNTSYFKKDFIAVNGYNEDITGWGREDSELVLRMHNNGLQARRLRYRGIVFHIYHNEKSRDRFEINDTIEQKTINETIKWAKNGVDKYLP

SEQ ID NO: 25119 - DNA, 303 bp, Unknown
  Obtained from environmental sample
  misc_feature (1)..(303): n is a, c, g, or t
gtgagtcaatctcttggttttatttatttttacccaaaaatcaactacatggatgtctctataattattgtaaactttaattcttctggttataccattaattgtattgactctatttacaaatttactaaagaccttagttttgagattattgttgttgataaccaatctaaactagaggatgttaaaacgttagaatcacacttaaaaattgctgactttactttaattaaaagcaaagaaaatttaggctttggaggcggaaatgatttgggttaccaacatgctagtgtaaccatttag

SEQ ID NO: 25120 - protein, 100 aa, Unknown
  Obtained from environmental sample
  misc_feature (1)..(100): Xaa is any amino acid
MSQSLGFIYFYPKINYMDVSIIIVNFNSSGYTINCIDSIYKFTKDLSFEIIVVDNQSKLEDVKTLESHLKIADFTLIKSKENLGFGGGNDLGYQHASVTI

SEQ ID NO: 25121 - DNA, 573 bp, Unknown
  Obtained from environmental sample
  misc_feature (1)..(573): n is a, c, g, or t
atgaaaaatattgttgttggttttttaatgtcttatgactacgagaaattaaaattatctattcctccagtttatgaacaagcggataaaatatatctagctttagaccataaacaacgtacctggaaaggtgaaacttttgatgttgaccctactttttttgaatggctttcaaattttgataagcacaataaaattgaaatttataaagacaatttttttgtgccagagctaaatgctatccaaaacgataccagagaacgtcacatgttgtccattaaaatgggtattggtaattggttagtgcaagtagacagtgacgagatttttattgacttcactcagtttgttaaaacattacgtcaacacgatcattttttggataatcctaagaaaaacccagttcaaatagctggttttttaattcatatttatacgtatttagaagacggaatgctttacgttgatgaagctacaaaagtaatgttggcgactaatttaccaattttaatattgccgaatagtaagagcgtttatatataccattatgtttgctacccgatgtttgcctaa

SEQ ID NO: 25122 - protein, 190 aa, Unknown
  Obtained from environmental sample
  misc_feature (1)..(190): Xaa is any amino acid
MKNIVVGFLMSYDYEKLKLSIPPVYEQADKIYLALDHKQRTWKGETFDVDPTFFEWLSNFDKHNKIEIYKDNFFVPELNAIQNDTRERHMLSIKMGIGNWLVQVDSDEIFIDFTQFVKTLRQHDHFLDNPKKNPVQIAGFLIHIYTYLEDGMLYVDEATKVMLATNLPILILPNSKSVYIYHYVCYPMFA

SEQ ID NO: 25123 - DNA, 333 bp, Unknown
  Obtained from environmental sample
  misc_feature (1)..(333): n is a, c, g, or t
gtgagtcaatctcttggttttatttatttttacccaaaaatcaactacatggatgtctctataattattgtaaactttaattcttctggttataccattaattgtattgactctatttacaaatttactaaagaccttagttttgagattattgttgttgataaccaatctaaactagaggatgttaaaacgttagaatcacacttaaaaattgctgactttactttaattaaaagcaaagaaaatttagctttggaggcggaaatgatttgggttacctataagctagtggtgccatttagcatttgtaacaatgatgctgtcatagnctga

SEQ ID NO: 25124 - protein, 110 aa, Unknown
  Obtained from environmental sample
  misc_feature (1)..(110): Xaa is any amino acid
MSQSLGFIYFYPKINYMDVSIIIVNFNSSGYTINCIDSIYKFTKDLSFEIIVVDNQSKLEDVKTLESHLKIADFTLIKSKENLALEAEMIWVTYKLVVPFSICNNDAVIX

SEQ ID NO: 25125 - DNA, 615 bp, Unknown
  Obtained from environmental sample
  misc_feature (1)..(615): n is a, c, g, or t
atgaaaaatattgttgttggttttttaatgtcttatgactacgagaaattaaaattatctattcctccagtttatgaacaagcggataaaatatatctagctttagaccataaacaacgtacctggaaaggtgaaacttttgatgttgaccctactttttttgaatggctttcaaattttgataagcacaataaaattgaaatttataaagacaatttttttgtgccagagctaaatgctatccaaaacgataccagagaacgtcacatgttgtccattaaaatgggtattggtaattggttagtgcaagtagacagtgacgagatttttattgacttcactcagtttgttaaaacattacgtcaacacgatcattttttggataatcctaagaaaaacccagttcaaatagctggttttttaattaatatttataagtatttagaagacggaatgctttacgttgatgagcctacaaaagtaatgttggcgactaattacccaaattataaatatgccagaaatagtaaagagcgtgtaatatataccaataatgtattgctacncgagtgtttgtctaaagatgaagcgtctctaaaatttaaactagaataa

SEQ ID NO: 25126 - protein, 204 aa, Unknown
  Obtained from environmental sample
  misc_feature (1)..(204): Xaa is any amino acid
MKNIVVGFLMSYDYEKLKLSIPPVYEQADKIYLALDHKQRTWKGETFDVDPTFFEWLSNFDKHNKIEIYKDNFFVPELNAIQNDTRERHMLSIKMGIGNWLVQVDSDEIFIDFTQFVKTLRQHDHFLDNPKKNPVQIAGFLINIYKYLEDGMLYVDEPTKVMLATNYPNYKYARNSKERVIYTNNVLLXECLSKDEASLKFKLE

SEQ ID NO: 25127 - DNA, 750 bp, Unknown
  Obtained from environmental sample
  misc_feature (1)..(750): n is a, c, g, or t
atgctaatttctatttatgataacaattttgaacaattaaaaaacggctgttcgttagcttttgctgaaatccatgccaattactgtagacgtatcttctggttgggcaagcaaatgatcaatgatgattttgtaatagaatctttggttcaggatacgttcttaaaattatggatccatagagacacaattgaatctccaaagcatatattcttttttttaaggtttgtaatgaaaagggaatgcatatcttactatactcgacccaaaaacaaattttatagatccgttcactcattggataattttgacaactaccaagattatatggcaggatatgaccccctacaggacattgacaacctaaatgagcaagataaaacacaagaggactttgagagcatcaaaaaaatactaccacttttaaatgcagaaagtagtcatttgattggtctatgtttaaaatatggctttcagtataaagccctttccgatgctatgggaactagcgttactgagaccactaacaaagttaaaaaagcaattagagatatcaagtctattataactcaaggaagtgcacttgaaaccaaatcaaggactgccataaaaattcacggaattatgaccaccgaacaagcagaggtgtttaaactccccttgtgtacaaaagcattcttttgctgtcattgccaccgtactcaaactttcccaaaaggaagtacagagagagttattggccgcctataa

SEQ ID NO: 25128 - protein, 249 aa, Unknown
  Obtained from environmental sample
  misc_feature (1)..(249): Xaa is any amino acid
MLISIYDNNFEQLKNGCSLAFAEIHANYCRRIFWLGKQMINDDFVIESLVQDTFLKLWIHRDTIESPKHIFFFLRFVMKRECISYYTRPKNKFYRSVHSLDNFDNYQDYMAGYDPLQDIDNLNEQDKTQEDFESIKKILPLLNAESSHLIGLCLKYGFQYKALSDAMGTSVTETTNKVKKAIRDIKSIITQGSALETKSRTAIKIHGIMTTEQAEVFKLPLCTKAFFCCHCHRTQTFPKGSTERVIGRL

SEQ ID NO: 25129 - DNA, 375 bp, Unknown
  Obtained from environmental sample
  misc_feature (1)..(375): n is a, c, g, or t
gtgggagaaagttacacaaaaccattagtagataatggtacatttagacgtgttgacaactgtccttcaccttggccttgtggtgttatagctgttagagaagaatttttgaaaaccaataaagacgatgtgaaggctattttagacattgttaatgctacaacccaagagtttaaagatataccaagtattgatcgtatgattgcaaaccgctacgagcaggaattggaagatgtgcaagaatggttaggcttaacagaatggtcgcaagaaaatatttctaaaaaaacagtacaaaaagtacaagacgaattgtttgcattaaatattattcctgaaaaatggaagtatgaagatttagtcgcagatgtataa

SEQ ID NO: 25130 - protein, 124 aa, Unknown
  Obtained from environmental sample
  misc_feature (1)..(124): Xaa is any amino acid
MGESYTKPLVDNGTFRRVDNCPSPWPCGVIAVREEFLKTNKDDVKAILDIVNATTQEFKDIPSIDRMIANRYEQELEDVQEWLGLTEWSQENISKKTVQKVQDELFALNIIPEKWKYEDLVADV

SEQ ID NO: 25131 - DNA, 849 bp, Unknown
  Obtained from environmental sample
  misc_feature (1)..(849): n is a, c, g, or t
atgtggactctttccaaaaaagcaaaagatggtataggctctttttggaaaatggactggaatcaatttgataatgcggacaaagctatttcacaaattgaagcagaattagagactgaaaaaattgacttaaagagtaaaattaaaagccttactaatgataatgtgcttatagaacaagttataagggatttaaactttgatagaggtacaatcattaaaatagcaaacttaaaagatgattggtttaatgaagaaacatcttctgtctttaaaagtttagaagctctaattccaccaaaagaacttaatattccttttgaagttttctttaaacattttcaacaaccaaaagagtttggtaaagttgataccgcattttttaacgatttcgactataaactaaaagctatttatgatgctgaaaatctgaatgtagatttcgaaatcacaaggaatgaaattgacattaagtcattaaaaaagaaatatcccaacgtatataaaagcaaaagccatccctatgacatacaaacaatagaaaacaaaacatttcagtattcgaagtctattgacaaagtattagaatggaaacttaatagttccaatagaaaattattgaaggaagtcgggagttttgattttacatttttttacttaaaacttaccaattcattaaaggaaggctatccttataaaactatatctgcaagtgaaagaaaatcaattttaaaaagatctggaggtgttcaaatatatagagactcttttagagttagaccttatggagacccaaataatgattggtttcgattgtgttatcgtgcaggaaaaagtcctgctggtcnt

SEQ ID NO: 25132 - protein, 283 aa, Unknown
  Obtained from environmental sample
  misc_feature (1)..(283): Xaa is any amino acid
MWTLSKKAKDGIGSFWKMDWNQFDNADKAISQIEAELETEKIDLKSKIKSLTNDNVLIEQVIRDLNFDRGTIIKIANLKDDWFNEETSSVFKSLEALIPPKELNIPFEVFFKHFQQPKEFGKVDTAFFNDFDYKLKAIYDAENLNVDFEITRNEIDIKSLKKKYPNVYKSKSHPYDIQTIENKTFQYSKSIDKVLEWKLNSSNRKLLKEVGSFDFTFFYLKLTNSLKEGYPYKTISASERKSILKRSGGVQIYRDSFRVRPYGDPNNDWFRLCYRAGKSPAGX

SEQ ID NO: 25133 - DNA, 372 bp, Unknown
  Obtained from environmental sample
  misc_feature (1)..(372): n is a, c, g, or t
atgaacaccaagtgccagtcaagtctgccagatctgctgagccagctgaagcaacagagacagcttaacgaacttgcctataatcataagacgaattttggtaggatggtggctattaaagcgataacattttttcttaaaattaaaaaagaaggtaccattatgattccacaaaaattaaaatggacagacagcttagatatcgctatcgagctttatgaaaaattcccagagaccgatccacagtacatacgttttacagatttgcatcgttgggtgaccgagcttgaaggctttgatgatgatccacaaaaatctaatgaaggcatcttagaagccattcagatgaactggattgatgaagcggattag

SEQ ID NO: 25134 - protein, 123 aa, Unknown
  Obtained from environmental sample
  DOMAIN (60)...(123): Protein of unknown function (DUF528)
  misc_feature (1)..(123): Xaa is any amino acid
MNTKCQSSLPDLLSQLKQQRQLNELAYNHKTNFGRMVAIKAITFFLKIKKEGTIMIPQKLKWTDSLDIAIELYEKFPETDPQYIRFTDLHRWVTELEGFDDDPQKSNEGILEAIQMNWIDEAD

SEQ ID NO: 25135 - DNA, 372 bp, Unknown
  Obtained from environmental sample
  misc_feature (1)..(372): n is a, c, g, or t
atgaacaccaagtggcagtcaagtctgccaaatctgctgagccagctgaagcaacagagacagcttaacgaacttgcctataatcataagacgaattttggtaggatggtggctattaaagcgataacattttttcttaaaattaaaaaagaaggtaccattatgattccacaaaaattaaaatggacagacagcttagatatcgctatcgagctttatgaaaaattcccagagaccgatccacagtacatacgttttacagatttgcatcgttgggtgaccgagcttgaaggctttgatgatgatccacaaaaatctaatgaaggcatcttagaagccattcagatgaactggattgatgaagcggattag

SEQ ID NO: 25136 - protein, 123 aa, Unknown
  Obtained from environmental sample
  DOMAIN (60)...(123): Protein of unknown function (DUF528)
  misc_feature (1)..(123): Xaa is any amino acid
MNTKWQSSLPNLLSQLKQQRQLNELAYNHKTNFGRMVAIKAITFFLKIKKEGTIMIPQKLKWTDSLDIAIELYEKFPETDPQYIRFTDLHRWVTELEGFDDDPQKSNEGILEAIQMNWIDEAD

SEQ ID NO: 25137 - DNA, 585 bp, Unknown
  Obtained from environmental sample
  misc_feature (1)..(585): n is a, c, g, or t
ttggtgattttcacagaagaatttgtattaaaatatttttcaacatctacaatcaactttatctctcaactttataattatcatatttccaatccgttggtcgaaaatagtacgtttaatgatttttttttcaaacaggtttcagaagaacttcaaaatatagattcttatgcaaaaaaagagataattgctaaaatgctggagttgtatttactgaagttagaacgacttgcgcatagttctaattcagataaactgaataaagattatttcgcacattttataaatttcaagaatttagtagaaaacgatttttctaaaactcgaaatgctaaagattatgcagaccgcctttctattacccctaaacatcttaacactatcgtaaaaactgttacattaaacactacaaaagccttcattgatcaatatgttattctggaatcaaaacgagccattcttagtggtagtaattccttaaaagagatttcatatcaaatgggctttgacgaaataactaatttttcaaaatttttcaaaaagcatacaggtttatctcccaaagaatataaatcagcattgtaa

SEQ ID NO: 25138 - protein, 194 aa, Unknown
  Obtained from environmental sample
  DOMAIN (148)...(192): Bacterial regulatory helix-turn-helix proteins, AraC family
  misc_feature (1)..(194): Xaa is any amino acid
MVIFTEEFVLKYFSTSTINFISQLYNYHISNPLVENSTFNDFFFKQVSEELQNIDSYAKKEIIAKMLELYLLKLERLAHSSNSDKLNKDYFAHFINFKNLVENDFSKTRNAKDYADRLSITPKHLNTIVKTVTLNTTKAFIDQYVILESKRAILSGSNSLKEISYQMGFDEITNFSKFFKKHTGLSPKEYKSAL

SEQ ID NO: 25139 - DNA, 465 bp, Unknown
  Obtained from environmental sample
  misc_feature (1)..(465): n is a, c, g, or t
ttgaatcggctcgagtnacancggtttaatnatgaggtaaaaacgtatatcggagtaagtaatattatactaaaaacgcatttaaaagacaaagcaattataacagctaagatagaggagtctattttaaatcattttggttttaacataccaactctagtaaaaacaaaagcagaccttgatttaatatttaaaaaatgtccttttactgatgcagaaaaagaaaacagctattttgctctactttataacgctccaagtcaaagtcaaatcacagcattatcaaattatgattttccaaatgaaaaatttactataactaaccagtgtatctatctttattcaagtgtaggttatggaaggactaaggcaaatagtaatttttttgaaactaaattaaaaatcaaagctaccgctagaaattttaaaacacttactaaggtagtgtcgctaataaaaaattag

SEQ ID NO: 25140 - protein, 154 aa, Unknown
  Obtained from environmental sample
  misc_feature (1)..(154): Xaa is any amino acid
MNRLEXXRFNXEVKTYIGVSNIILKTHLKDKAIITAKIEESILNHFGFNIPTLVKTKADLDLIFKKCPFTDAEKENSYFALLYNAPSQSQITALSNYDFPNEKFTITNQCIYLYSSVGYGRTKANSNFFETKLKIKATARNFKTLTKVVSLIKN

SEQ ID NO: 25141 - DNA, 357 bp, Unknown
  Obtained from environmental sample
  misc_feature (1)..(357): n is a, c, g, or t
ttgcttatgaaaggccctttattttattcaaaaattttattattcggagagtacggtattattaaagactctaaaggtctgtcaataccttataatttttataatggtgcactaaaaatggaggacaatccatcggaagtagcgcaacaatcaaatcaaagtttacaacgctttgctgactatttatctaaaatagaccattcattagtcgtttttgatatacagtcattaaataaagacgttaaagcaggtatgtactttgactcttcaattccacaaggatatggagttggtagtagtggtgcgttagttgcagcaatatatgacaagtatgcacaaaataaattactgtcttag

SEQ ID NO: 25142 - protein, 118 aa, Unknown
  Obtained from environmental sample
  misc_feature (1)..(118): Xaa is any amino acid
MLMKGPLFYSKILLFGEYGIIKDSKGLSIPYNFYNGALKMEDNPSEVAQQSNQSLQRFADYLSKIDHSLVVFDIQSLNKDVKAGMYFDSSIPQGYGVGSSGALVAAIYDKYAQNKLLS

SEQ ID NO: 25143 - DNA, 357 bp, Unknown
  Obtained from environmental sample
  misc_feature (1)..(357): n is a, c, g, or t
ttgcttatgaaaggccctttattttattcaaaaattttattattcggagagtacggtattattaaagactctaaaggtctgtcaataccttataatttttataatggtgcactaaaaatggaggacaatccatcggaagtagcgcaacaatcaaatcaaagtttacaacgctttgctgactatttatctaaaatagaccattcattagtcgtttttgatatacagtcattaaataaagacgttaaagcaggtatgtactttgactcttcaattccacaaggatatggagttggtagtagtgatgcgttagttgcagcaatatatgacaagtatgcaccaaatttcaaactgtcttag

SEQ ID NO: 25144 - protein, 118 aa, Unknown
  Obtained from environmental sample
  misc_feature (1)..(118): Xaa is any amino acid
MLMKGPLFYSKILLFGEYGIIKDSKGLSIPYNFYNGALKMEDNPSEVAQQSNQSLQRFADYLSKIDHSLVVFDIQSLNKDVKAGMYFDSSIPQGYGVGSSDALVAAIYDKYAPNFKLS

SEQ ID NO: 25145 - DNA, 681 bp, Unknown
  Obtained from environmental sample
  misc_feature (1)..(681): n is a, c, g, or t
ttggttataatgagcatagcaaaacaattaaatccagaattatctcaagcgcatttaatccaaaaagcatcctttttagcaagattaggatcaggtagtgcttgtaggagtttggaaggtgatttagtagtttggggtaaacacccaaaaattgaagatagtagcgatttgtttggtgtaaaatatccgtataaagttcacgatatttttaaaaactataacgatactatattattggttgataaaggagaaaaacaggtaagtagcacagttggtcataatttaatgcatggacacccatttgctagccaacgttttgatcaagcagtagacaacataaccgcaatcaaatcaattttagaaacaggagacttaaatcagtttattgctttagtcgaaagtgaagccttgacgctacacgctatgatgatgacaagtatgccttattttattttaatgaaacctaatacgctagaaattattaataaaatctggcaatttaggaaggatacaggattacctgtttgctttactttagatgcaggtgctaatgtacatgtcttatatccagataaatataaagataaaatttatgaattcattaaggaacagttagttgcatattgtcaaaacggtcactatatttgtgataaaattggttttggcgcaaaacagttgtaa

SEQ ID NO: 25146 - protein, 226 aa, Unknown
  Obtained from environmental sample
  misc_feature (1)..(226): Xaa is any amino acid
MVIMSIAKQLNPELSQAHLIQKASFLARLGSGSACRSLEGDLVVWGKHPKIEDSSDLFGVKYPYKVHDIFKNYNDTILLVDKGEKQVSSTVGHNLMHGHPFASQRFDQAVDNITAIKSILETGDLNQFIALVESEALTLHAMMMTSMPYFILMKPNTLEIINKIWQFRKDTGLPVCFTLDAGANVHVLYPDKYKDKIYEFIKEQLVAYCQNGHYICDKIGFGAKQL

SEQ ID NO: 25147 - DNA, 549 bp, Unknown
  Obtained from environmental sample
  misc_feature (1)..(549): n is a, c, g, or t
atgcttgtagatacgagtcctaagagcgattttgattggatgtctttaatgcagcattacggagtgcagactagattgctagattggtctgaaagtgctttagcttctctatatttcgcaatatctgaagaagaccacttactcagtgatggtactctttggatgcttaagcccatcgagttaaataaacttgcaaatattgaggatgaaaataagtattatattccatcttttgatgatgttcatcttacaaactatggaatccaaagcttaagaaactctcgtatacagatgaatcctattgcgacaatagctactagaaataatgctagaattcaagctcaacaaggcgttttcactattcatcatttaaaagataagccacttgaagattactgcgacattaaccaacaaattttcaaatataagatacctaaagagagtaagttgagattaaaaaaagagttagagctattaagctttaatagattttctcttttcccagagctttctagtattggactattacttaaggataagatgaaatga

SEQ ID NO: 25148 - protein, 182 aa, Unknown
  Obtained from environmental sample
  misc_feature (1)..(182): Xaa is any amino acid
MLVDTSPKSDFDWMSLMQHYGVQTRLLDWSESALASLYFAISEEDHLLSDGTLWMLKPIELNKLANIEDENKYYIPSFDDVHLTNYGIQSLRNSRIQMNPIATIATRNNARIQAQQGVFTIHHLKDKPLEDYCDINQQIFKYKIPKESKLRLKKELELLSFNRFSLFPELSSIGLLLKDKMK

SEQ ID NO: 25149 - DNA, 333 bp, Unknown
  Obtained from environmental sample
  misc_feature (1)..(333): n is a, c, g, or t
atgagttatattgaaacaagccctctgcaaaacactacaattttaagagttttttctgaaaaagatgagattgaaatatcaccagagtatcaaagaaacggaagcgtttggactctcgagaagaaaaagcttttgattgactcgattcttaatgattacgatatacctaaaatatattttcataaattcactagagaagaaaaaaaagaaaacgggaaacaatactctattattgatggtagacagcggttagaaactatttggtggtatatggataatggtttcccattatctgatgactctgagtatcaagatgatgacagtctaaaatag

SEQ ID NO: 25150 - protein, 110 aa, Unknown
  Obtained from environmental sample
  misc_feature (1)..(110): Xaa is any amino acid
MSYIETSPLQNTTILRVFSEKDEIEISPEYQRNGSVWTLEKKKLLIDSILNDYDIPKIYFHKFTREEKKENGKQYSIIDGRQRLETIWWYMDNGFPLSDDSEYQDDDSLK

SEQ ID NO: 25151 - DNA, 708 bp, Unknown
  Obtained from environmental sample
  misc_feature (1)..(708): n is a, c, g, or t
ttgctctccaacgcatttaaattcacccctagagaaggcaatattcaattgatagtgactcctgtcaatttaaataagatggtgaaaatcgcagtgagcgattctggcgcaggcgttgccaaggaagagttagactccattttcgagcttttttatcagtctcatatcggtaaaaaaaataaaggcacaggtatcggactagcgctaaccaaagagctcattgatttgcataagggaaccattgaagtagaatcttccaaaacaagtggtacaacattctccattactttcccagtaactgatgacgtctataccgatacggaacggattactgtagattatgaagatgaagctacctacgacacaatggaagaggagttactatcaatagaccataacgatcccaatatattaaaaaaaacagttctgattgtggaagacacgctagacctacagttgtttttaaaggaattgttggaacatcattacaatataattttagctgagaatggtaacgaaggctattattacgccaaaagcaacctacctgacctcatcttaagtgatatcatgatgccagaattagacggtattgaaatgagcaaattacttcaagaagatcagctcacaaagcacattcctgttattttaatgaccgctaaaaagtccacaaatttcaaactgaaaggattgaaattgggcgcatag

SEQ ID NO: 25152 - protein, 235 aa, Unknown
  Obtained from environmental sample
  DOMAIN (140)...(235): Response regulator receiver domain
  misc_feature (1)..(235): Xaa is any amino acid
MLSNAFKFTPREGNIQLIVTPVNLNKMVKIAVSDSGAGVAKEELDSIFELFYQSHIGKKNKGTGIGLALTKELIDLHKGTIEVESSKTSGTTFSITFPVTDDVYTDTERITVDYEDEATYDTMEEELLSIDHNDPNILKKTVLIVEDTLDLQLFLKELLEHHYNIILAENGNEGYYYAKSNLPDLILSDIMMPELDGIEMSKLLQEDQLTKHIPVILMTAKKSTNFKLKGLKLGA

SEQ ID NO: 25153 - DNA, 606 bp, Unknown
  Obtained from environmental sample
  misc_feature (1)..(606): n is a, c, g, or t
ttgaacactatgccagaattaccagaagttgagggttataaaatttatattgacaacaccgcgttacacaacaccatcacatcttttgagtgtcgtgataaccgactgcttaaaacttcaaaatcagaatttgaaaaccatctgatccataataaattaaccaagacccaacgcatcggaaaatatttattcattaaaacctctggcgaaaaaaccctggtaatacatttcggaatgaccggaagacccaattattataaagataaggaagatcggccgaaatatggacacattgtgctcggtttcgaaaatggcttttatttcgcatttgaaaacaagcggaagtttggctggtgggatttaattgattctattacggcttataaagcggaacgcaatttaagcgatgacgcccgagatttaagtttggaggattttaaaacctccttaagcctgaaaaaaacctatataaaagctgtcctcatggatcaaagtgtggcagccggcattggcaattggatggcggatgaaattttgtaccaagcacaaatccatccaatgcaaaaagtccccgacatgagtactcaagacattgacatgttttaa

SEQ ID NO: 25154 - protein, 201 aa, Unknown
  Obtained from environmental sample
  DOMAIN (138)...(200): Formamidopyrimidine-DNA glycosylase H2TH domain
  misc_feature (1)..(201): Xaa is any amino acid
MNTMPELPEVEGYKIYIDNTALHNTITSFECRDNRLLKTSKSEFENHLIHNKLTKTQRIGKYLFIKTSGEKTLVIHFGMTGRPNYYKDKEDRPKYGHIVLGFENGFYFAFENKRKFGWWDLIDSITAYKAERNLSDDARDLSLEDFKTSLSLKKTYIKAVLMDQSVAAGIGNWMADEILYQAQIHPMQKVPDMSTQDIDMF

SEQ ID NO: 25155 - DNA, 624 bp, Unknown
  Obtained from environmental sample
  misc_feature (1)..(624): n is a, c, g, or t
ttgaacactatgccagaattaccagaagttgagggttataaaatttatattgacaacaccgcgttacacaacaccatcacatcttttgagtgtcgtgataaccgactgcttaaaacttcaaaatcagaatttgaaaaccatctgatccataataaattaaccaagacccaacgcatcggaaaatatttattcattaaaacctctggcgaaaaaaccctggtaatacatttcggaatgaccggaagacccaattattataaagataaggaagatcggccgaaatatggacacattgtgctcggtttcgaaaatggcttttatttcgcatttgaaaacaagcggaagtttggctggtgggatttaattgattctattacggcttataaagcggaacgcaatttaagcgatgacgcccgagatttaagtttggaggattttaaaacctccttaagcctgaaaaaaacctatataaaagctgtcctcatggatcaaagtgtggcagccggcattggcaattggatggcggatgaattaagtaccaagcacaatccatccaatgcaanagtcccctctatggtactcagacatgacatgtttcacgcctcaccgatcttgcaaagctga

SEQ ID NO: 25156 - protein, 207 aa, Unknown
  Obtained from environmental sample
  DOMAIN (138)...(198): Formamidopyrimidine-DNA glycosylase H2TH domain
  misc_feature (1)..(207): Xaa is any amino acid
MNTMPELPEVEGYKIYIDNTALHNTITSFECRDNRLLKTSKSEFENHLIHNKLTKTQRIGKYLFIKTSGEKTLVIHFGMTGRPNYYKDKEDRPKYGHIVLGFENGFYFAFENKRKFGWWDLIDSITAYKAERNLSDDARDLSLEDFKTSLSLKKTYIKAVLMDQSVAAGIGNWMADELSTKHNPSNAXVPSMVLRHDMFHASPILQS

SEQ ID NO: 25157 - DNA, 459 bp, Unknown
  Obtained from environmental sample
  misc_feature (1)..(459): n is a, c, g, or t
atggacaatgcttcggctagaatatgtggggtgatttttggacgcccacttggaattgcttttgaaaaagcacctaaagtgattcatttcagtgacaatgaacaagatgcggaccacggagtggatctagttcttaaaaaccttaagaaagctgcgaccttttcccttttgggacttcaaaaccgcaaggaaccactgcccaaaataggagcttttacagtccttaccgattggaatggcaattcaaaatgtatcgttaggacaactgctgtaaaactgaagccattttttagtattaccaaagagtatgtactattggacggcttaggggataaaagtctggaacattggaaaaaattccactgggattattttttacgtgaaatagcaccttttaaacgtgtgccccgtgatagtatgatcgtggtctgtgttgaatttgacaaggtatacggatag

SEQ ID NO: 25158 - protein, 152 aa, Unknown
  Obtained from environmental sample
  DOMAIN (27)...(151): Protein of unknown function (DUF984)
  misc_feature (1)..(152): Xaa is any amino acid
MDNASARICGVIFGRPLGIAFEKAPKVIHFSDNEQDADHGVDLVLKNLKKAATFSLLGLQNRKEPLPKIGAFTVLTDWNGNSKCIVRTTAVKLKPFFSITKEYVLLDGLGDKSLEHWKKFHWDYFLREIAPFKRVPRDSMIVVCVEFDKVYG

SEQ ID NO: 25159 - DNA, 300 bp, Unknown
  Obtained from environmental sample
  misc_feature (1)..(300): n is a, c, g, or t
ttggcttcatccaaagcttcgtggtatttagatcaaattgggaactcaataccaaattcaatattattatcaaacatagactttcaacctatctcaaaaagcataaaaaaagatgaagaaattttaattcaaaaaaatgtaattgttataaaaggaaagtccgttaaaagtgcctatttttctaattggatcaataccttagaacaactaaattgggttgaaaatgtgctgatcaatgaattcggtaccggtaaaaagacaacaaccgagtttgaactgcaaattgaatttaataaatga

SEQ ID NO: 25160 - protein, 99 aa, Unknown
  Obtained from environmental sample
  misc_feature (1)..(99): Xaa is any amino acid
MASSKASWYLDQIGNSIPNSILLSNIDFQPISKSIKKDEEILIQKNVIVIKGKSVKSAYFSNWINTLEQLNWVENVLINEFGTGKKTTTEFELQIEFNK

SEQ ID NO: 25161 - DNA, 882 bp, Unknown
  Obtained from environmental sample
  misc_feature (1)..(882): n is a, c, g, or t
ttgatgctcacgggattgagtcaaaaagctgaaattaatgtaaataatgtagcactatcagattttttacaagcactggccaatacgcataacatcaacatgaatattcatcctgaattaaatgaaatcatcataaataataacttttcaaatgccacggtaaccgatgttttggtttttgtttgtaaagagtacttattggatatcgattttaccggaaacattttatcgatccataaagtaactcagttaaaaccaagtgtcaaacaccgtggcatccctatacaatatgatcaagagaaagatctcttgagtattgatttgcagcaagatacattgtatgttgcttttaaacaaattatgaataaaacaggaaaaaatttggtgtttgctccaggtatggcaagattacaattatctggttatattcaacatatgccttttgacagcgcattggataaaatagcttttgcaaataatatttcgtttaccaaaaccagggataattattatctttttgaagagcatgacaacctaattatagaaagcacgccaaatacaacgactccaaaaaataaacaacaacggcctcaacggaaaagacgctcaaatttttattttgaagttgactcagttagtaaggctttgaatgtcgattttgaaaatacacccatttcaaatatcatttatgatattgggcatgagcttaataaaaatatgtttactgcatcccccttaaatgaagctggaaatgctacggttaaagctgaccgaatcagttatgatttattgctgaacaaaatattggaaaatacagagtttacctataaaaagacggactccatttattatttcggtaaaaaaagaacaaacctcctttag

SEQ ID NO: 25162 - protein, 293 aa, Unknown
  Obtained from environmental sample
  misc_feature (1)..(293): Xaa is any amino acid
MMLTGLSQKAEINVNNVALSDFLQALANTHNINMNIHPELNEIIINNNFSNATVTDVLVFVCKEYLLDIDFTGNILSIHKVTQLKPSVKHRGIPIQYDQEKDLLSIDLQQDTLYVAFKQIMNKTGKNLVFAPGMARLQLSGYIQHMPFDSALDKIAFANNISFTKTRDNYYLFEEHDNLIIESTPNTTTPKNKQQRPQRKRRSNFYFEVDSVSKALNVDFENTPISNIIYDIGHELNKNMFTASPLNEAGNATVKADRISYDLLLNKILENTEFTYKKTDSIYYFGKKRTNLL

SEQ ID NO: 25163 - DNA, 567 bp, Unknown
  Obtained from environmental sample
  misc_feature (1)..(567): n is a, c, g, or t
gtgaatacactactatcattatacccaatttccaaaagtaaagtgttagataatagtcttttgaaacttaaaacattcgttgaaaatggaggtgtgatcattggctatagaaacagtttncggtggttaaatgaaaataaattaatcaaattgaatctgcaaaaatctaaacccgaaaccacaaatgtaacttttgatcggcgtcaaaaatttaggggagctcaagttattggtggagccatatttgaagctaacattgatagaagtcatcccattaattttggatataataaaaatgaaatagcattattcagaaatactaccatttttgtaaaaccggatagcagcagttatataaatccgattcagtatacaaaaaagccattgttaagtggatatatttctaaagaaaacctaaaagtattaggtgaaactattccctttaaaactgctaatatgggtaaaggtaaagtcattgtatttacagataataccaacttcagagcattttggtacggtactaacaagttaatgatgaatgccattttctttgggaagatgatgtga

SEQ ID NO: 25164 - protein, 188 aa, Unknown
  Obtained from environmental sample
  misc_feature (1)..(188): Xaa is any amino acid
MNTLLSLYPISKSKVLDNSLLKLKTFVENGGVIIGYRNSXRWLNENKLIKLNLQKSKPETTNVTFDRRQKFRGAQVIGGAIFEANIDRSHPINFGYNKNEIALFRNTTIFVKPDSSSYINPIQYTKKPLLSGYISKENLKVLGETIPFKTANMGKGKVIVFTDNTNFRAFWYGTNKLMMNAIFFGKMM

SEQ ID NO: 25165 - DNA, 474 bp, Unknown
  Obtained from environmental sample
  misc_feature (1)..(474): n is a, c, g, or t
gtgatcattggctatagaaacagtttgcggtggttaaatgaaaataaattaatcaaattgaatctgcaaaaatctaaacccgaaaccacaaatgtaacttttgatcggcgtcaaaaatttaggggagctcaagttattggtggagccatatttgaagctaacattgatagaagtcatcccattaattttggatataataaaaatgaaatagcattattcagaaatactaccatttttgtaaaaccggatagcagcagttatataaatccgattcagtatacaaaaaagccattgttaagtggatatatttctaaagaaaacctaaaagtattaggtgaaactattccctttaaaactgctaatatgggtaaaggtaaagtcattgtatttacagataataccaacttcagagcattttggtacggtactaacaagttaatgatgaatgccattttctttgggaagatgatgtga

SEQ ID NO: 25166 - protein, 157 aa, Unknown
  Obtained from environmental sample
  misc_feature (1)..(157): Xaa is any amino acid
MIIGYRNSLRWLNENKLIKLNLQKSKPETTNVTFDRRQKFRGAQVIGGAIFEANIDRSHPINFGYNKNEIALFRNTTIFVKPDSSSYINPIQYTKKPLLSGYISKENLKVLGETIPFKTANMGKGKVIVFTDNTNFRAFWYGTNKLMMNAIFFGKMM

SEQ ID NO: 25167 - DNA, 501 bp, Unknown
  Obtained from environmental sample
  misc_feature (1)..(501): n is a, c, g, or t
atgtattttgcttatcataagcctgtaggtattgactgcaagcttgatcagaatgaccctgctagcctgtatcaccacctgcctactattacgcgggtttaccctattggccgtcttgataaagactcccgtggcttgcttatattaaccaacgatggtgagttgtgtaaccaactaattcatcccgacttccaccagccaaaacgttacttagttagcgttaataaaagcattgatgccgagttttgtacaaaaatggccgcaggtgtaccggtagataagcaaataaccttgccctgtagcgttgaaaaaatagcagacaaacaatttagtattattttaaagcaagggcttaataggcaaattagaaaaatggcacactattgtggttacaaggtaattgacttgtatcgcgagcaaattagcgagctaaccctgcaaacgctaaaccttgcccaagggcaatatattgcaattaataaaagcgatattataaagtaa

SEQ ID NO: 25168 - protein, 166 aa, Unknown
  Obtained from environmental sample
  DOMAIN (1)...(128): RNA pseudouridylate synthase
  misc_feature (1)..(166): Xaa is any amino acid
MYFAYHKPVGIDCKLDQNDPASLYHHLPTITRVYPIGRLDKDSRGLLILTNDGELCNQLIHPDFHQPKRYLVSVNKSIDAEFCTKMAAGVPVDKQITLPCSVEKIADKQFSIILKQGLNRQIRKMAHYCGYKVIDLYREQISELTLQTLNLAQGQYIAINKSDIIK

SEQ ID NO: 25169 - DNA, 384 bp, Unknown
  Obtained from environmental sample
  misc_feature (1)..(384): n is a, c, g, or t
atgaaaacactaaaacagcttttatttataaccgcatttgcgctattatcatttacatcagtgcacaaatactatgtaagtatcacgcaaattgaatacgtaaaagagaaacaatcacttcaaattatttcaagaatttttgtagacgattttgaaaaattaatacgcaaacgttacgatagtaatattactttaaataatggtggtaacgaggaggttatcaatcaatacgttaaaaagtatttgttagaaaaaattgaaatttcgataaatgatgagccaaaaaaaataacatttataggaaaaaaatatgatgacgatataatgtattgttatctacaaatagaaaacttgcctcaatcaagagctttcaataacacataa

SEQ ID NO: 25170 - protein, 127 aa, Unknown
  Obtained from environmental sample
  SIGNAL (1)...(19)
  misc_feature (1)..(127): Xaa is any amino acid
MKTLKQLLFITAFALLSFTSVHKYYVSITQIEYVKEKQSLQIISRIFVDDFEKLIRKRYDSNITLNNGGNEEVINQYVKKYLLEKIEISINDEPKKITFIGKKYDDDIMYCYLQIENLPQSRAFNNT

SEQ ID NO: 25171 - DNA, 450 bp, Unknown
  Obtained from environmental sample
  misc_feature (1)..(450): n is a, c, g, or t
atggaaagtaacacttacatatctaaagaatatatgcctttaaaaattggagaaaagagaaaggtttttttaaaaaatggctcttcaataattacgaaatggaaaagtttaaatgagtacattattcgctataagcctgaaaatgatacagactattttacaccttattttcttttaaaatttaaaaatgggaatttaagacggctttttccatatcctaattttagggcatttttaatagctataatctctgttttgggggttatttattttaaaaaagtaaaaacggatttatcctttatgcttttcagtgttgctcttatctttactgttttaattcaggttttagcagggaatgtatcttattttaaaataaaagaaaatgttttcaaaaaaaagaataattttaaaaatacaaaaaaagctccctccaaaatgcccccattgtaa

SEQ ID NO: 25172 - protein, 149 aa, Unknown
  Obtained from environmental sample
  misc_feature (1)..(149): Xaa is any amino acid
MESNTYISKEYMPLKIGEKRKVFLKNGSSIITKWKSLNEYIIRYKPENDTDYFTPYFLLKFKNGNLRRLFPYPNFRAFLIAIISVLGVIYFKKVKTDLSFMLFSVALIFTVLIQVLAGNVSYFKIKENVFKKKNNFKNTKKAPSKMPPL

SEQ ID NO: 25173 - DNA, 309 bp, Unknown
  Obtained from environmental sample
  misc_feature (1)..(309): n is a, c, g, or t
atgccaaagcaaccattacataaacgtttttttatctggagaattaaaaatatctccgaaaaaaacttcacttatattttaagtggattggttgggctattggcaggattagctgcggtaacattaagaaacataacgtttacaatagaaagtgctttagataatttagtcgtgttttctaaaaaccaagtctattttatactacctgtttttggtttgtttttagtgtatttatttacaaaatatgtctctaaaaaaaaggtagacacgccaaccttctatttattctcgaccgatcttgatccatag

SEQ ID NO: 25174 - protein, 102 aa, Unknown
  Obtained from environmental sample
  misc_feature (1)..(102): Xaa is any amino acid
MPKQPLHKRFFIWRIKNISEKNFTYILSGLVGLLAGLAAVTLRNITFTIESALDNLVVFSKNQVYFILPVFGLFLVYLFTKYVSKKKVDTPTFYLFSTDLDP

SEQ ID NO: 25175 - DNA, 327 bp, Unknown
  Obtained from environmental sample
  misc_feature (1)..(327): n is a, c, g, or t
atgctgtcttctggtcagcgacaactcatctcgtttttaagggcttatgtcacgaatcctagtattttggtgttagatgaggcaacctcatctgtcgattcatattctgaacaactcattcaaaatgccacagataaaattactaaggggaggacttctattgttattgctcaccgattggcaaccgttaaaaaggctgataaaattatagtcatggacgctggtaatatcgtagagcagggcactcataaggaattactcaaaaaagaagacgggtactataaaaacttatacgaagttcagtttttacaggaggaagttatataa

SEQ ID NO: 25176 - protein, 108 aa, Unknown
  Obtained from environmental sample
  misc_feature (1)..(108): Xaa is any amino acid
MLSSGQRQLISFLRAYVTNPSILVLDEATSSVDSYSEQLIQNATDKITKGRTSIVIAHRLATVKKADKIIVMDAGNIVEQGTHKELLKKEDGYYKNLYEVQFLQEEVI

SEQ ID NO: 25177 - DNA, 558 bp, Unknown
  Obtained from environmental sample
  misc_feature (1)..(558): n is a, c, g, or t
ttgttagaaagtagcgattatcacgctaatgacaatagtttttcttatatatgctttaacccaatcgcctcaattaaagttgacgataaagcaattacacaaacatttcctgatggtagtgaaatgaaaaacaaggtgcgtaatgtaaccgagatgatacataagtttaccaaacgctttaaagtaaaatcggacgaggattttaagtttatcaacaacggaatatttggctacacagcttatgatgctgttaaacactttgaagatgtagagatttctaaaaaaccagattctttagagattcctgacgtttactatgcagtttaccaaaatataattgctataaaccactttaaaaacgaagcctatatttttgcacattgttttgaaacagaaaacaatatagacgaagttttacaactaataagctctaaaaactttgcgacttataagtttacaacaaactctgatatacaatcaaatttaacggatgacgagtataaagaccaggtcatattggctaaacaacattgtgctagagtgatgtgttccagttag

SEQ ID NO: 25178 - protein, 185 aa, Unknown
  Obtained from environmental sample
  DOMAIN (1)...(124): Anthranilate synthase component I, N terminal region
  misc_feature (1)..(185): Xaa is any amino acid
MLESSDYHANDNSFSYICFNPIASIKVDDKAITQTFPDGSEMKNKVRNVTEMIHKFTKRFKVKSDEDFKFINNGIFGYTAYDAVKHFEDVEISKKPDSLEIPDVYYAVYQNIIAINHFKNEAYIFAHCFETENNIDEVLQLISSKNFATYKFTTNSDIQSNLTDDEYKDQVILAKQHCARVMCSS

SEQ ID NO: 25179 - DNA, 594 bp, Unknown
  Obtained from environmental sample
  misc_feature (1)..(594): n is a, c, g, or t
gtgttacaacgcaaaaccacagaaaaaattgcagagcaagccattgatgactcccttaatacaaatgttataaagtttgcctcttatgaaagccgctctgaagagcgaatgaactattcaattaaagtaacggttgaatacaacgacaaaaaaagtattgctgctagcacttccgatatatccctcagtggttgtaaaataaagctagccactcgttatgtactaaaaaaaggacatttaatcgccttgcgtttggtaggtttagagcaagactttgagctaggtttaaaaaatggcattcagtatgaggttgtcgccgtagaaaatatttctaaagagtttaatcatattcgtttaaaacgcacctttattgaaaataatgaagcgttggataattttttagaaagcttaatccacggtaataaacgtcgctataaagtaaaccttgataatacgctcgatgctgtggtttctaagggttacgagcaatactatattccacgcgtcacctctttatatgtgtttttaagtaaaaaagacaatgtacttaatcctagcttaagtctaaccaccgaaaacaacatttttattcaa

SEQ ID NO: 25180 - protein, 198 aa, Unknown
  Obtained from environmental sample
  misc_feature (1)..(198): Xaa is any amino acid
MLQRKTTEKIAEQAIDDSLNTNVIKFASYESRSEERMNYSIKVTVEYNDKKSIAASTSDISLSGCKIKLATRYVLKKGHLIALRLVGLEQDFELGLKNGIQYEVVAVENISKEFNHIRLKRTFIENNEALDNFLESLIHGNKRRYKVNLDNTLDAVVSKGYEQYYIPRVTSLYVFLSKKDNVLNPSLSLTTENNIFIQ

SEQ ID NO: 25181 - DNA, 462 bp, Unknown
  Obtained from environmental sample
  misc_feature (1)..(462): n is a, c, g, or t
ttgatagataataatgcttgggaaaatacaattaaaccttcgctcattgaaatactagacgaaaaaaaaccaaccattaactcgacaaataaaaatgcttattcaatattcaaatgtcaaattggggatttaaatcgcagaaaaaacagcaccgttcaaaaaatgtatgatctattagaattcggttgtattccaagaaatgaaaatgtggaaaacttagtaaatatagaacgtcataatgcagttcataacggtgtatttggagaaaatacaaccgagatgcttataaattaccaaaagctagaccacataatccgagatataatattaaatataattgactatagaaacttgagaaaaagtgtatatgagtatgctagtgttgatgaaagaaaaaaagcatatcccaaaagggaaatcaaaacaccaacattatattgttcagaacctttaaaccgataa

SEQ ID NO: 25182 - protein, 153 aa, Unknown
  Obtained from environmental sample
  misc_feature (1)..(153): Xaa is any amino acid
MIDNNAWENTIKPSLIEILDEKKPTINSTNKNAYSIFKCQIGDLNRRKNSTVQKMYDLLEFGCIPRNENVENLVNIERHNAVHNGVFGENTTEMLINYQKLDHIIRDIILNIIDYRNLRKSVYEYASVDERKKAYPKREIKTPTLYCSEPLNR

SEQ ID NO: 25183 - DNA, 528 bp, Unknown
  Obtained from environmental sample
  misc_feature (1)..(528): n is a, c, g, or t
atggatcaagaatcggtcgagtgtctcacaacagacattatttgctatatgtattttgattatgatggaaaagatcctttaaaagagcgtgatgaaatatatagtgtactaaaatctattgcagaccgagaaatggcattagacactatggcttacggaatagataagcgtttgcctaaagtatttccaaaactgataaaacgtgtggatttaggaccaattcataatgtatttgcaaaggacgaaaataaagtgacacatgccattttaaaaagtatagcaaataaagagattccattaggatcctatgctatttctcttaaaatagacgaattaaaatcagctagcgaatttaaagaaggtggtttttttagtaaacaaacctttcaacgatgggatgccatgtatagacaacgctatattttcgcaccacaccgaattatacaaatgctgtacaataaaacaccagaaattatgaataagttggcgcaaagtccgattcaagtttctgaattaaatatgaaataa

SEQ ID NO: 25184 - protein, 175 aa, Unknown
  Obtained from environmental sample
  misc_feature (1)..(175): Xaa is any amino acid
MDQESVECLTTDIICYMYFDYDGKDPLKERDEIYSVLKSIADREMALDTMAYGIDKRLPKVFPKLIKRVDLGPIHNVFAKDENKVTHAILKSIANKEIPLGSYAISLKIDELKSASEFKEGGFFSKQTFQRWDAMYRQRYIFAPHRIIQMLYNKTPEIMNKLAQSPIQVSELNMK

SEQ ID NO: 25185 - DNA, 348 bp, Unknown
  Obtained from environmental sample
  misc_feature (1)..(348): n is a, c, g, or t
atggctaaattatgcccagaatgcggagataaaattgttggtagagtagaccaaaaattctgtagcgacggttgccgaaacgcctacaacaataaaatgaataaagatggcaaaaacctaatccggaatataaataaccgattacgtaaaaactggcgcatattagaagcgcttaaccccgacccaaaaaccaaaaccaccaagactaaattaatagagaaggggtttgattttaattatttcacaagtatttatactacaaaagctggaaaagtgtattattttgtttacgatcaagggtatttgccaatagacaatgatttttatgcgctcgtaaaacgtaactaa

SEQ ID NO: 25186 - protein, 115 aa, Unknown
  Obtained from environmental sample
  misc_feature (1)..(115): Xaa is any amino acid
MAKLCPECGDKIVGRVDQKFCSDGCRNAYNNKMNKDGKNLIRNINNRLRKNWRILEALNPDPKTKTTKTKLIEKGFDFNYFTSIYTTKAGKVYYFVYDQGYLPIDNDFYALVKRN

SEQ ID NO: 25187 - DNA, 741 bp, Unknown
  Obtained from environmental sample
  misc_feature (1)..(741): n is a, c, g, or t
ttggcaattcaaaaaccgagccatactttagcaaaaatacatttaaaagcattgcatacaaatagatttcatagactttttgccttaagttttacactgtttattaacacgttgagctttgcacaagatagacccagctctggaattccaattactcccaaacctaacacaccaaaaccattaaccgacaacgactccatacctaactctgaggatctccttattattaatgaaaaaattcttgattctactttaaccgattcgacgaaacaaaaaaaaggttttttagagggtattgtaagttacaaagcaacggattacacctcttttaaccaaagagaggagaaactatacctatataatgaagctgaaattatctaccaagatatgcagattaatgcaggaaccattgtaatagattatagtaaaaatgaagtgtatgcaggacgtttaaaggattctttaggcgaatacacacaacgccccatttttaaacaaggcgaaagtattgtcgaacccgactctatacgatttaatctagacaccgaaaaagcattgatttggaactctcgaacagaacaaaacggaggaactattattgccgaaaaaactaaaaaagaaaacgattctgtattttttatttccaatggaaaatttacaacctccaaaaatttagacgacccagaatattattttttattgcgtaatactnaaattgttccagataaaaaagtcgtttaa

SEQ ID NO: 25188 - protein, 246 aa, Unknown
  Obtained from environmental sample
  misc_feature (1)..(246): Xaa is any amino acid
MAIQKPSHTLAKIHLKALHTNRFHRLFALSFTLFINTLSFAQDRPSSGIPITPKPNTPKPLTDNDSIPNSEDLLIINEKILDSTLTDSTKQKKGFLEGIVSYKATDYTSFNQREEKLYLYNEAEIIYQDMQINAGTIVIDYSKNEVYAGRLKDSLGEYTQRPIFKQGESIVEPDSIRFNLDTEKALIWNSRTEQNGGTIIAEKTKKENDSVFFISNGKFTTSKNLDDPEYYFLLRNTXIVPDKKVV

SEQ ID NO: 25189 - DNA, 525 bp, Unknown
  Obtained from environmental sample
  misc_feature (1)..(525): n is a, c, g, or t
gtgaggcattgtatgctgtttgaacaggatatagtaaataaatacgatcctaaaactaaaaataaactaagagcttacagagcatatataagtaattatatttcaaacagaaccgctttagagcaaaccgttactccacataccaaagcggtatatgatgtattaaaatctaaacaagaattatgggatggtaaccatttaaattataatagtacaggtataacttgtataatagacagtataaaagacaaagggttacaacaaactttaaatgccttaaaaagtacaaatagcatgaattctgagatatttgctccaccattacgaagcaatacgtcttattctagggacacaaacctagcgacctttatagcattagacttattttattcaaaatttaatacaatagattttacaactgtagacttatctcttaatcaacttaaagatcaaccaatagattttaacaaaagttatgtcaatgcacctgtaaagcaacaaattcagcactcggccaattcttga

SEQ ID NO: 25190 - protein, 174 aa, Unknown
  Obtained from environmental sample
  misc_feature (1)..(174): Xaa is any amino acid
MRHCMLFEQDIVNKYDPKTKNKLRAYRAYISNYISNRTALEQTVTPHTKAVYDVLKSKQELWDGNHLNYNSTGITCIIDSIKDKGLQQTLNALKSTNSMNSEIFAPPLRSNTSYSRDTNLATFIALDLFYSKFNTIDFTTVDLSLNQLKDQPIDFNKSYVNAPVKQQIQHSANS

SEQ ID NO: 25191 - DNA, 780 bp, Unknown
  Obtained from environmental sample
  misc_feature (1)..(780): n is a, c, g, or t
atgagagatgttgcgatcgatgaacaaacagagtatgctgttgaagatgctgatatcaccctacaattaaaagaagtctttgaaaaagagcttgaaaaaaattcactaagcagtttatttaaggatattgagatcccccttgttgacgtccttgcttccatggaaatggagggcatcaatttggatgaaaatttccttaagtcattgtctagtgacctaaccaaagatattgagcatttagagaattccatttacaaagaagctgatacagattttaaccttgcttcacccaaacaacttggagttgttttatttgagaaaatgaaattaatagaaaagcccaagaaaactaaaactgggcaatatgctacaggtgaagaaatactatctaaactggctaataaacatgacattgtaaaaaatattcttgaatggagaggccttgttaaactgaaaaatacttatatcgattctttgcccaacgaagtgaatagttcttctggaagaatacacaccacttatagtcaaaccgtggcagccacaggaaggctaagttctaacaatcctaatcttcagaatattcctatccgaacagaaagaggtaaacaagtcaggaaagctttcattcctagagattccaattacacactgctagcagcagattattctcaaattgagctaagactcattgctgaaatgagtggagatgaagaaatgaaatcctcttttataagagggaagacattcataaatctacagctgcgaaagtatntcaggtag

SEQ ID NO: 25192 - protein, 259 aa, Unknown
  Obtained from environmental sample
  DOMAIN (61)...(259): DNA polymerase family A
  misc_feature (1)..(259): Xaa is any amino acid
MRDVAIDEQTEYAVEDADITLQLKEVFEKELEKNSLSSLFKDIEIPLVDVLASMEMEGINLDENFLKSLSSDLTKDIEHLENSIYKEADTDFNLASPKQLGVVLFEKMKLIEKPKKTKTGQYATGEEILSKLANKHDIVKNILEWRGLVKLKNTYIDSLPNEVNSSSGRIHTTYSQTVAATGRLSSNNPNLQNIPIRTERGKQVRKAFIPRDSNYTLLAADYSQIELRLIAEMSGDEEMKSSFIRGKTFINLQLRKYXR

SEQ ID NO: 25193 - DNA, 1023 bp, Unknown
  Obtained from environmental sample
  misc_feature (1)..(1023): n is a, c, g, or t
ttggctcggggcatgcatattcctataattgaagtcgagggatacgaagctgatgacttaattggcactttgtcggttcaggcagaaaaagctggctataaaacttttatggtaactcctgataaggattttgctcagttggttactgataatgtagttatgtatcgcccggcaagaatgggcaatggaatagagatttgggatgtagcaagagtaaaagaaaaatttgaaattgaagaccccaaacaggtgattgattttttgggaatgatgggagattcagtagataacattcctggtttgccaggtgtgggtgaaaaaactgctaaaaaatttctaaaacaatacggtagtatggaagtgctgcttgaaaacacacatgaacttaaagggaaattgaaagaaaagatcgaagcaaataaagagcttggcattctatcaaaagaactggcaacaatcatactcgattgccccgttgaatttcatgaagaagattttgagttaaatacacctgatattgaaaaagttactcaaatatttcaagaccttgaatttagaagggcacttgaaaatttacatcgaatttttaaaatagatggaaataatgaggctccgaaagtagcaactgagaaggttttaacaacagatgccgagacaaatcaacaatacgatatgttttcaacttcgggtggttcatcttcaactgctgaaacaattggaggctataaaaaagcggatagtaaagatcatttttatcaatctgttactacagaattttctcaaaacattttgctaaaaaaacttttgaaacagacatctgtgtgttttgatacagaaacaaccagtctaaatacattggaggctaaattggttggaatcgcttttttcattgaaaaaggcaaagggtattatgtgcccattcctgaaaacgatactgaaactgagttgtttttagaaagatttaaccctttcttttcagctaaaaaatatcgaaaaaaattggtcaaaaaccttaaattatga

SEQ ID NO: 25194 - protein, 340 aa, Unknown
  Obtained from environmental sample
  DOMAIN (1)...(76): 5'-3' exonuclease, N-terminal resolvase-like domain
  misc_feature (1)..(340): Xaa is any amino acid
MARGMHIPIIEVEGYEADDLIGTLSVQAEKAGYKTFMVTPDKDFAQLVTDNVVMYRPARMGNGIEIWDVARVKEKFEIEDPKQVIDFLGMMGDSVDNIPGLPGVGEKTAKKFLKQYGSMEVLLENTHELKGKLKEKIEANKELGILSKELATIILDCPVEFHEEDFELNTPDIEKVTQIFQDLEFRRALENLHRIFKIDGNNEAPKVATEKVLTTDAETNQQYDMFSTSGGSSSTAETIGGYKKADSKDHFYQSVTTEFSQNILLKKLLKQTSVCFDTETTSLNTLEAKLVGIAFFIEKGKGYYVPIPENDTETELFLERFNPFFSAKKYRKKLVKNLKL

SEQ ID NO: 25195 - DNA, 546 bp, Unknown
  Obtained from environmental sample
  misc_feature (1)..(546): n is a, c, g, or t
ttggtcttaataaaccaagacgtcagtggtctgaaaaaggactttcttttcgctagaaaagagctgacaggtaatcaaagaattactaactcaaagttattgttcaaatacgatagcgaagacagagagtgggcgatcaacgaaggtgcgggcaccgaagtccaataccacatctacttatcagacaataaaattggttacggtttaggatttaatacgctttacgtcagatttaaagaagaaaaaacaccaatagaatatatcaagccgtttatggatgcttttatagctttgagagacagtgaagagattactaagcttgctaagagaggctttacattaaacacggatgaatacggctttcaaaaccctgtcaaagacgagcattacttattcggtcgaataatggagttagattatgaacagagactgtctttgcttgattactacagtatcatcaatgatctaaaaggcgatttgtttgaagcttataaaaatgtttttaagcttgctaataagtcnataatgcactcgaccgattcttga

SEQ ID NO: 25196 - protein, 181 aa, Unknown
  Obtained from environmental sample
  misc_feature (1)..(181): Xaa is any amino acid
MVLINQDVSGLKKDFLFARKELTGNQRITNSKLLFKYDSEDREWAINEGAGTEVQYHIYLSDNKIGYGLGFNTLYVRFKEEKTPIEYIKPFMDAFIALRDSEEITKLAKRGFTLNTDEYGFQNPVKDEHYLFGRIMELDYEQRLSLLDYYSIINDLKGDLFEAYKNVFKLANKSIMHSTDS

SEQ ID NO: 25197 - DNA, 666 bp, Unknown
  Obtained from environmental sample
  misc_feature (1)..(666): n is a, c, g, or t
ttgttctgtcatatcaatatgattgctgttattagtctattaatgcaaaaaaaagcggttatccctatttatttagtatgtagtggccgaattgaagatgataaagggttaaaaggcttatcgcaattaacaccacatcagcttaaagaacattactctaataaaataaaactaacagtagacgatattgcattggcaaaaaaggcgtggactatttattgtggtaacgaccataatttattaataccattaattgtaagaccttctaattttatatacctaagtaattgtttaaaagcccatttaagacgttttgcagacacaagaagcggactgaataccttagaatataacattcttaaattaataaatacacataccatttcttccaaacatcatctttctggttatgttttgcattaccaagggtattatgggtatggagatatacaaataaatcgtataattaataatttggatgttttttatacagaaacagaagagcaattagtattaaacagagatggttatttgcttttagagcatcaaaaaaatgtttttaataccatcgataaagatatggtgtatggtggcgttaaaaaatgcgactatacctattttaaagatcaaaataaacttattaaaancacattaaatgcccattaa

SEQ ID NO: 25198 - protein, 221 aa, Unknown
  Obtained from environmental sample
  misc_feature (1)..(221): Xaa is any amino acid
MFCHINMIAVISLLMQKKAVIPIYLVCSGRIEDDKGLKGLSQLTPHQLKEHYSNKIKLTVDDIALAKKAWTIYCGNDHNLLIPLIVRPSNFIYLSNCLKAHLRRFADTRSGLNTLEYNILKLINTHTISSKHHLSGYVLHYQGYYGYGDIQINRIINNLDVFYTETEEQLVLNRDGYLLLEHQKNVFNTIDKDMVYGGVKKCDYTYFKDQNKLIKXTLNAH

SEQ ID NO: 25199 - DNA, 300 bp, Unknown
  Obtained from environmental sample
  misc_feature (1)..(300): n is a, c, g, or t
ttggcccaaatgatttgtatttttattgaagggtataactaccgtgttaaagatgacgactttataacaggtaataatcaccagaaatacattacattagcagacagccatgagttagtattttacaaaaatattaaaacaggacgttggtggatagaaataccttttttagcaaatgttaataataaattaaaaaagcatacgttattaccttgtactcataaagattatttggacgcatgtaacgacctaatacccgatagatggtataaagcttttcaaaaaaacagcatatattag

SEQ ID NO: 25200 - protein, 99 aa, Unknown
  Obtained from environmental sample
  misc_feature (1)..(99): Xaa is any amino acid
MAQMICIFIEGYNYRVKDDDFITGNNHQKYITLADSHELVFYKNIKTGRWWIEIPFLANVNNKLKKHTLLPCTHKDYLDACNDLIPDRWYKAFQKNSIY

SEQ ID NO: 25201 - DNA, 387 bp, Unknown
  Obtained from environmental sample
  misc_feature (1)..(387): n is a, c, g, or t
atgaaaagaaagataaaagctgtaaaaaagttccataaagcatttggtataggctatgaaaaagagccaattgccaagttgtctgagaaaaaactacaactgcgttttgacctgatggaagaagagaaccgtgaatatttggaagctgccagaaataatgatctggttgaagtggcagatgctctaggtgatatgttgtatatattatgcggtactatattagaacacggaatgcaatataaaatagaggaggtttttaacgagatacagcgaagtaatatgagtaaattaggtgctgatggtaaaccaatttaccgtgaagatggtaaggtgatgaaagggccaaattattttaggccggatatttcaacaattttagataaataa

SEQ ID NO: 25202 - protein, 128 aa, Unknown
  Obtained from environmental sample
  misc_feature (1)..(128): Xaa is any amino acid
MKRKIKAVKKFHKAFGIGYEKEPIAKLSEKKLQLRFDLMEEENREYLEAARNNDLVEVADALGDMLYILCGTILEHGMQYKIEEVFNEIQRSNMSKLGADGKPIYREDGKVMKGPNYFRPDISTILDK

SEQ ID NO: 25203 - DNA, 681 bp, Unknown
  Obtained from environmental sample
  misc_feature (1)..(681): n is a, c, g, or t
atgagactaacattcatatttacattattaataattggacaatttagttacggacaaaaagaaaaaatggaacaaacggaaagatataaagcaggttgggaaaaactaaaggaaattgatggagaagcaggggaaaaagtaattgaaagtttaaaagatatttcacctgaactcggaactttcattattgaatatgcttttggagatatttatacgagagaaggattggatctaaaatcaaaggaaattgcagttgtatctgctctcactgcaatgggaacggcagaaccccaattgaaagtacatataaatggagctttgaacactggaagcactataaatgaattgaaagaaataattcttcaaatgtcagtttattcgggtttcccaagctgtataaacgctatgaactcattaaaagatgttttgaacgaaagagaaaaacaaggaattaaagatactattggagatttttcaaatacaccaatttcaaacagacttaaaacaggagagttggaattatcaaaattggacagtacacaagttgaaaaactacaaatcgcttataatgaattttcgcctgaattagttcagtttgtacttgaatacggatatgcagatattttttcgagagacaatttagacgacaaataccgacaaatcgcaacaatcgctgcttaa

SEQ ID NO: 25204 - protein, 226 aa, Unknown
  Obtained from environmental sample
  SIGNAL (1)...(18)
  DOMAIN (51)...(141): Carboxymuconolactone decarboxylase family
  misc_feature (1)..(226): Xaa is any amino acid
MRLTFIFTLLIIGQFSYGQKEKMEQTERYKAGWEKLKEIDGEAGEKVIESLKDISPELGTFIIEYAFGDIYTREGLDLKSKEIAVVSALTAMGTAEPQLKVHINGALNTGSTINELKEIILQMSVYSGFPSCINAMNSLKDVLNEREKQGIKDTIGDFSNTPISNRLKTGELELSKLDSTQVEKLQIAYNEFSPELVQFVLEYGYADIFSRDNLDDKYRQIATIAA

SEQ ID NO: 25205 - DNA, 579 bp, Unknown
  Obtained from environmental sample
  misc_feature (1)..(579): n is a, c, g, or t
atggataatatagcaacattaaatacataccaattgcaaaaaaatattggtagcaaagacgcttttgtttgtaagttcgaaaatcagattgtaaagaaatggggtacttattatggaggagaaagagaagaacgaaatgccaattttcatccttataaagacggaacaaaattttatattgtcggggaaacccaaagtttaacacagatagcatcagaaaatggtttacaaccaaacaaacaagtttacaatactgcaaacggaaatacacagtttgcatacacactatttattgcacattttgctccaaaatcactttcaataaatgaagttattaatcaaaatgattttactcttttcccaaatcctaacaagggaagttttaccgttaaattaaattctctttcttttgggaaaatagatttagaattacataacgttttgggtaacaaaatttattcgcaacctctcacagaagttcaaacaacaataaatacccaaaacattcaaaaagggctctattttgtgaaaattataacaaatggacaacctgcgactttggaaatcatcattgagtaa

SEQ ID NO: 25206 - protein, 192 aa, Unknown
  Obtained from environmental sample
  misc_feature (1)..(192): Xaa is any amino acid
MDNIATLNTYQLQKNIGSKDAFVCKFENQIVKKWGTYYGGEREERNANFHPYKDGTKFYIVGETQSLTQIASENGLQPNKQVYNTANGNTQFAYTLFIAHFAPKSLSINEVINQNDFTLFPNPNKGSFTVKLNSLSFGKIDLELHNVLGNKIYSQPLTEVQTTINTQNIQKGLYFVKIITNGQPATLEIIIE

SEQ ID NO: 25207 - DNA, 360 bp, Unknown
  Obtained from environmental sample
  misc_feature (1)..(360): n is a, c, g, or t
atgcgatttgatgaaattgaaaaggcatttggttggattgatatgatagattttttcaaaacacttgattcgtcttttgatgttggctatagattttcgccttctgatgttgttaatcagttgaaaaataatgcggacttaaagtctaagttagataatttcaaaaaacttagtggagataaaaagaactattcagatagagtaaaaaaaattattgaaaagttggaaaaagacaactttataacattagaaaacgaaattaccgaatcatataaagtacttacttcatttaactaccttaaagacattgtttcaattataaatattcccgaagaaatagaaaatgagatacctgaataa

SEQ ID NO: 25208 - protein, 119 aa, Unknown
  Obtained from environmental sample
  misc_feature (1)..(119): Xaa is any amino acid
MRFDEIEKAFGWIDMIDFFKTLDSSFDVGYRFSPSDVVNQLKNNADLKSKLDNFKKLSGDKKNYSDRVKKIIEKLEKDNFITLENEITESYKVLTSFNYLKDIVSIINIPEEIENEIPE

SEQ ID NO: 25209 - DNA, 570 bp, Unknown
  Obtained from environmental sample
  misc_feature (1)..(570): n is a, c, g, or t
atgagatacctgaataaaataatctttataaatagtgcttcggtaaaatatactgaaattgaattggatggcaacgttcatttaataggcacgcaaggcgtagggaaaagtactttgcttcgtgctattttatttttttacaatgcaaacaaaacgaaactcggtattccaagagagaaaaaggggtttgatgattattattttgaatttcaaaactcgtacattatttatgaaattgtaaaagacggatttccattttgcgtgttagcttataaatccaatggcaaagtagcttttaggttttttaattctgcatacaaaagagagttatttattgatgaaaataatagagcatttgaaagttgggacaaaataagaaatgccttgngtagagaaatacattacagctcattggttacaagttatgaggaatttcgaaagataatttacggagataacatagggctaaagcctgattttagaaaatacgcactcgttgaaagtaaacaatttcaaaatatcccaagaacgattcagaatgtatttctgaactcaantttagaaacctaa

SEQ ID NO: 25210 - protein, 189 aa, Unknown
  Obtained from environmental sample
  misc_feature (1)..(189): Xaa is any amino acid
MRYLNKIIFINSASVKYTEIELDGNVHLIGTQGVGKSTLLRAILFFYNANKTKLGIPREKKGFDDYYFEFQNSYIIYEIVKDGFPFCVLAYKSNGKVAFRFFNSAYKRELFIDENNRAFESWDKIRNALXREIHYSSLVTSYEEFRKIIYGDNIGLKPDFRKYALVESKQFQNIPRTIQNVFLNSXLET

SEQ ID NO: 25211 - DNA, 747 bp, Unknown
  Obtained from environmental sample
  misc_feature (1)..(747): n is a, c, g, or t
ttgacttacgtccatcccgatgacatcgaaaaactaaacatgcaattcaaagagatgaaagaaaatgtggagctaccttacatttattatcgtgtagtccacaaaaatggtaatattaaacatttaaaagcctacggaaagtctgttgtaaatgaagatgacgaaacagtattgctaggtactactgcagatattacagatgaaattaataatcttagaatattagaagaacgtaatgctgagttagaacgtaataataaagaattatcgtcttttaactacgtagccagtcatgatttacaagaaccactaagaaaaatccaaacctttttatctagactgatagacgaggaagagggcaaactatctgcaaaaggaaataaatatattgatcgtatacaaaatgctgctaccagaatgcgtttgctaatcgatgatttattacaattttctagatctaacaaagcagacaaagtctttgaggagtctaacattaatctgcttttagaagctgcaaaacaggatttagcagaagttatttcagctgaaaatgctgttataacctcagacacattccctactataaccgttataccttttcaaattcagcaattatttgtaaacctattaggtaatgctatcaaatataaattagatggtaaaataccaaaaattaatattacgcatcaaattgtagaagcagatggagaagacagtattgtaaaacctaaatactctcactaccat

SEQ ID NO: 25212 - protein, 249 aa, Unknown
  Obtained from environmental sample
  DOMAIN (88)...(156): His Kinase A (phosphoacceptor) domain
  misc_feature (1)..(249): Xaa is any amino acid
MTYVHPDDIEKLNMQFKEMKENVELPYIYYRVVHKNGNIKHLKAYGKSVVNEDDETVLLGTTADITDEINNLRILEERNAELERNNKELSSFNYVASHDLQEPLRKIQTFLSRLIDEEEGKLSAKGNKYIDRIQNAATRMRLLIDDLLQFSRSNKADKVFEESNINLLLEAAKQDLAEVISAENAVITSDTFPTITVIPFQIQQLFVNLLGNAIKYKLDGKIPKINITHQIVEADGEDSIVKPKYSHYH

SEQ ID NO: 25213 - DNA, 387 bp, Unknown
  Obtained from environmental sample
  misc_feature (1)..(387): n is a, c, g, or t
atgtttgggattataaaacaagaacctatgcaaaagcttaccaataaagaagaagaaataatgcacattttatgggctctagaaaacgcatttgtaaaagaagttctggcagaaataaaagacgacaaacctcattacaatacactttctacaattattagaaatctggaagagaaaggatatgtagcgtataacgcttttggaaaaacccaccagtactaccctattatttctaaagaagcatataagaaacgttttatgaccaccgccatcgaaaactactttaacagctcctataaaaatatggtttccttttttgctaaagaagaaaaaattagcgtggaagaacttaaagagattattgatttaattgaaaataaaaaataa

SEQ ID NO: 25214 - protein, 128 aa, Unknown
  Obtained from environmental sample
  DOMAIN (10)...(127): Penicillinase repressor
  misc_feature (1)..(128): Xaa is any amino acid
MFGIIKQEPMQKLTNKEEEIMHILWALENAFVKEVLAEIKDDKPHYNTLSTIIRNLEEKGYVAYNAFGKTHQYYPIISKEAYKKRFMTTAIENYFNSSYKNMVSFFAKEEKISVEELKEIIDLIENKK

SEQ ID NO: 25215 - DNA, 342 bp, Unknown
  Obtained from environmental sample
  misc_feature (1)..(342): n is a, c, g, or t
gtgcacggattttggtactactacaatactaacattgaaactgacagcattgtaaaacctgattttgcagacattgtaaactttaattatgacgtaaaagatttagatggacaaaccatttatactcaagcagaattaaaaactcaaagttacgcaatggaccaacaagaactttttacaggtttacgtgaaggtctaaaactaatgcaagcaggagaaacggtaacctttttgtttccatcacacaaggcttatggctattatggagacgaaaataaaataggtactaacattccattagtttgtaaagtaaccgttaattcaataacaaaaaaagaatag

SEQ ID NO: 25216 - protein, 113 aa, Unknown
  Obtained from environmental sample
  DOMAIN (14)...(107): FKBP-type peptidyl-prolyl cis-trans isomerase
  misc_feature (1)..(113): Xaa is any amino acid
MHGFWYYYNTNIETDSIVKPDFADIVNFNYDVKDLDGQTIYTQAELKTQSYAMDQQELFTGLREGLKLMQAGETVTFLFPSHKAYGYYGDENKIGTNIPLVCKVTVNSITKKE

SEQ ID NO: 25217 - DNA, 501 bp, Unknown
  Obtained from environmental sample
  misc_feature (1)..(501): n is a, c, g, or t
ttgaatattattttggaagacaatagtcatcgagaattacccaaaagttccattgtaaaaaaaatcagtaatcaggtgcatgagagtaatagtgaaattagattaacaaatataaatgtaagtgacatgaaagacagggtaatttcgaaaaaaattcttgatagatctatttcgaaagaaaatcctctcgaaatagctcagaaggtaaaaggtgatacagagtatctgttgactgttaactgtcatacgaatgaagcaacaaatactaaaggagcagttgcgaatataaccttctatgataagaacaagaatattttaccaaagccttatgttggaacaaattcttctaaattatttgaagcctatttttatattacaacatttaataaaaaagaagctgaaccaagaagttatacaataaaaactccagaaacagctgtagaagtaaatgtaaagcttgtagcttttgatagtatagatggttttattctaactgatggn

SEQ ID NO: 25218 - protein, 167 aa, Unknown
  Obtained from environmental sample
  misc_feature (1)..(167): Xaa is any amino acid
MNIILEDNSHRELPKSSIVKKISNQVHESNSEIRLTNINVSDMKDRVISKKILDRSISKENPLEIAQKVKGDTEYLLTVNCHTNEATNTKGAVANITFYDKNKNILPKPYVGTNSSKLFEAYFYITTFNKKEAEPRSYTIKTPETAVEVNVKLVAFDSIDGFILTDG

SEQ ID NO: 25219 - DNA, 453 bp, Unknown
  Obtained from environmental sample
  misc_feature (1)..(453): n is a, c, g, or t
gtgactggacttcaaagctataatgagcaaactgtaaagacatatacaggtcttaggttagaacagccaattaccctgccgggagaacagataagtgctataatcaataaactttggggtcttgaactcttcacggatattgatttctacattaccgatattcaagacgaaaatgtctttcttgaattggtaattttggaaaggcccacactgtccaatgtgaccatgaatggtgtgaaggatagaaaggtagatgagatactcaaggataccgatcttaaaaaaggaaagaaaattactgaaagtcttatcgccaacagtaaaaattatatacagaacaagttcaagaaaaaagggtactacaatactaaggtaacatcatcacggttaaagacacttctgaaacgaatgccagagtatggtatgaatctcgagccgattcttgatccttag

SEQ ID NO: 25220 - protein, 150 aa, Unknown
  Obtained from environmental sample
  misc_feature (1)..(150): Xaa is any amino acid
MTGLQSYNEQTVKTYTGLRLEQPITLPGEQISAIINKLWGLELFTDIDFYITDIQDENVFLELVILERPTLSNVTMNGVKDRKVDEILKDTDLKKGKKITESLIANSKNYIQNKFKKKGYYNTKVTSSRLKTLLKRMPEYGMNLEPILDP

SEQ ID NO: 25221 - DNA, 513 bp, Unknown
  Obtained from environmental sample
  misc_feature (1)..(513): n is a, c, g, or t
atgacgcttccgtatattaaagcgaacgataccgttttggatatcggctgttttgataatagcttattggaaaaattaaaaagtaaaccaataaactttagttttggtttagatcctttgttagaaagttctgtaattactgaaaattataaattactaccaggacgttttcctgaaaatttaccagaagaagttacctttaattgtattgctatgctcgctgtattagagcatattcctacacaggagcagcataagcttagtgtggattattataaacacttaaaacctaaagggcgggttattattacagtaccttctccttttgtagattatattcttttggttttatctaaattacgcttaatagatggtatgtctttagaggagcattatggttttaaaattgaagatgtgcctattatatttaataaggaacatttcaaacttattaaccataaaagatttcaattaggattaaacaatctttttgtttttgaaaaatataaatag

SEQ ID NO: 25222 - protein, 170 aa, Unknown
  Obtained from environmental sample
  misc_feature (1)..(170): Xaa is any amino acid
MTLPYIKANDTVLDIGCFDNSLLEKLKSKPINFSFGLDPLLESSVITENYKLLPGRFPENLPEEVTFNCIAMLAVLEHIPTQEQHKLSVDYYKHLKPKGRVIITVPSPFVDYILLVLSKLRLIDGMSLEEHYGFKIEDVPIIFNKEHFKLINHKRFQLGLNNLFVFEKYK

SEQ ID NO: 25223 - DNA, 558 bp, Unknown
  Obtained from environmental sample
  misc_feature (1)..(558): n is a, c, g, or t
atgttgtatatttgcacgcgaattttgtacgatagttttggggaactattttgctgtaaaaatttagctgttatgattaaaagtagcgttaagaatatagtaataccattttcaatttgtgtacttatagcattagctttgtatccaaattccactctcaatccagagtcgtattcaaccgaaggattagagcttaactataatatttcggaagatttagctatggtagctcaagataaacctactcaacaaaatttattcacaccacatttagggaaatcttttgagggtttcaaagaagccttagcttttaaagaatctagaggagattattttacagtaaatacattgggttacttggggaaatatcagtttggatcggaaaccttaaaactattaggaatctatacgcctaaccagtttttatataatccagaattacaagaaaaagcgtttattgctaatgctgagcgtaataagtgggttcttagaaaagacataaagcgctttgaacggaaacacatttccggtgtacacattacgaatcaggtattctag

SEQ ID NO: 25224 - protein, 185 aa, Unknown
  Obtained from environmental sample
  misc_feature (1)..(185): Xaa is any amino acid
MLYICTRILYDSFGELFCCKNLAVMIKSSVKNIVIPFSICVLIALALYPNSTLNPESYSTEGLELNYNISEDLAMVAQDKPTQQNLFTPHLGKSFEGFKEALAFKESRGDYFTVNTLGYLGKYQFGSETLKLLGIYTPNQFLYNPELQEKAFIANAERNKWVLRKDIKRFERKHISGVHITNQVF

SEQ ID NO: 25225 - DNA, 480 bp, Unknown
  Obtained from environmental sample
  misc_feature (1)..(480): n is a, c, g, or t
atgagtaaaacaatttttctttttctgatactaactacagttcttagtgcgcagaataatgatactataaaacatgcgaagtatttagaagatcaaatttacattggcttgtcaatcatttccttgactaatttatctgataatgttgcgcaaagcggtttttcaaatagtttgggtttaggttttatcaaagatattcctactaatactaaaggtaatcttgcttttggaattgggttgggatacggacgtaacacatattttcaaaatataaaaataacagaatttgacaatgtttcgcaatttgaaattgctggtgatgatattagcaagaacaagttttctatccatagcatagacttcccacttgaaattcgattgagaacatcaacaatagataaatacaagttttggagaatatatgccggtagtaacgataagtcatgtcttggcatcaaattccaaattcacagcagatag

SEQ ID NO: 25226 - protein, 159 aa, Unknown
  Obtained from environmental sample
  SIGNAL (1)...(19)
  misc_feature (1)..(159): Xaa is any amino acid
MSKTIFLFLILTTVLSAQNNDTIKHAKYLEDQIYIGLSIISLTNLSDNVAQSGFSNSLGLGFIKDIPTNTKGNLAFGIGLGYGRNTYFQNIKITEFDNVSQFEIAGDDISKNKFSIHSIDFPLEIRLRTSTIDKYKFWRIYAGSNDKSCLGIKFQIHSR

SEQ ID NO: 25227 - DNA, 459 bp, Unknown
  Obtained from environmental sample
  misc_feature (1)..(459): n is a, c, g, or t
ttgtataaattcaaagccaacaaaaagaaaaaatttcaatatattattgaagagtggggagccgatttacaaagtgaacatgagcgttttttagttgaaaaatattttaaatgtcctataatactttttgattatcctgctaatattaaagcgttctacatgcgcctaaatgaagacggtaaaactgtaagagcaatggacgttttattccctggaattggtgaaattgtaggtggttctcaacgtgaagaacgattagatgttcttaaagataaaattaaagcattagatattgacgaaaaagaattgtggtggtatttagatttgagaaaatttggaacagctatacattcaggtttcggtttaggctttgaacgtttagtacaattttctactggcatgagtaacataagagatgtcattccgttcccaagaacacctcaaaatgctgaattttag

SEQ ID NO: 25228 - protein, 152 aa, Unknown
  Obtained from environmental sample
  DOMAIN (1)...(148): tRNA synthetases class II (D, K and N)
  misc_feature (1)..(152): Xaa is any amino acid
MYKFKANKKKKFQYIIEEWGADLQSEHERFLVEKYFKCPIILFDYPANIKAFYMRLNEDGKTVRAMDVLFPGIGEIVGGSQREERLDVLKDKIKALDIDEKELWWYLDLRKFGTAIHSGFGLGFERLVQFSTGMSNIRDVIPFPRTPQNAEF

SEQ ID NO: 25229 - DNA, 666 bp, Unknown
  Obtained from environmental sample
  misc_feature (1)..(666): n is a, c, g, or t
atgatggttacaaaagtagatagcaaaacatttgtaggaaaagatattattcacgttgccgtctttaagaaaaaagataaacgcaccatatataatatgatgtatcgcgacgcaagatccggaccaacttatgtaaaacgatttgcagtaacctcaataactagagatagagaatacgatttaactaacggaagtaaaaattctgtaatgtggtatttttctgcaaacccaaatggagaagcagaagttgtaactgtgttattaagacaggtagggagtattaagaaattaaagtgggatattgattttgctgaaatcttaattaaaggacgcgcttcaaaaggaaacttagttactaaatatcctattaagcgtattgatttaaaagaaaaaggagtctctacattaaagccgcgtaaaatttggtttgatgatactgtaaaaagattaaatgtagatggtagaggtgatcttgtaggagagtttaaaggagaagaccgtattttaattatcacacaatcgggaattataaaaacaatagttccagaaatgactgcgcattttgatgccgatatgattgtgatggaaaaatggattccaaataaacctatttctgctatttattacaatggtgaaaaagaactctattatgtaaacgatttttag

SEQ ID NO: 25230 - protein, 221 aa, Unknown
  Obtained from environmental sample
  misc_feature (1)..(221): Xaa is any amino acid
MMVTKVDSKTFVGKDIIHVAVFKKKDKRTIYNMMYRDARSGPTYVKRFAVTSITRDREYDLTNGSKNSVMWYFSANPNGEAEVVTVLLRQVGSIKKLKWDIDFAEILIKGRASKGNLVTKYPIKRIDLKEKGVSTLKPRKIWFDDTVKRLNVDGRGDLVGEFKGEDRILIITQSGIIKTIVPEMTAHFDADMIVMEKWIPNKPISAIYYNGEKELYYVNDF

SEQ ID NO: 25231 - DNA, 600 bp, Unknown
  Obtained from environmental sample
  misc_feature (1)..(600): n is a, c, g, or t
ttggacaatatactggccctctccgcatatttgggccatcccgaacgaaaatttaaaagtatacatgtggctgggaccaacgggaaaggatccagtagtcatatgctggcctcaattctacaagaggcgggttatagggtcggtttgtacacctctccacatttaaaggattttagggaacggattaggattaacggaacaccggttagcaaaaaatttgtagtcgattttataaagaaaaataaacttttttttgaggcacacgacctttcgttttttgaaatgacagtgggaatggcctttcagtattttgaaaaggaaaaaattgatattgccattgtagaggttggactgggaggtcgtttggattctaccaatataattatcccagaagtttcattgattacgaatatcggctatgatcatgtggagatgttgggcgataccattgctaaaatagcctttgagaaagcaggaatcattaagccagggataccagtggtcatcagcgaattgcaggaagaaacagccactgtttttaacagtatagctggcgaaagaagctccaaaataatttttgcaggcgaggtaatccctggn

SEQ ID NO: 25232 - protein, 200 aa, Unknown
  Obtained from environmental sample
  DOMAIN (1)...(200): Mur ligase family, catalytic domain
  misc_feature (1)..(200): Xaa is any amino acid
MDNILALSAYLGHPERKFKSIHVAGTNGKGSSSHMLASILQEAGYRVGLYTSPHLKDFRERIRINGTPVSKKFVVDFIKKNKLFFEAHDLSFFEMTVGMAFQYFEKEKIDIAIVEVGLGGRLDSTNIIIPEVSLITNIGYDHVEMLGDTIAKIAFEKAGIIKPGIPVVISELQEETATVFNSIAGERSSKIIFAGEVIPG

SEQ ID NO: 25233 - DNA, 480 bp, Unknown
  Obtained from environmental sample
  misc_feature (1)..(480): n is a, c, g, or t
atgagaaaattaaaaaataacgagttaggtagaatttcggttgatgaatttaaatcgacaaaaaaaacaccgttaataatcgttttagataatgttagaagtttaaataatattggttctgtattcagaacttcggatgcttttttgattgaaaaaatctatttatgtggcatttgcgcaactccaccaaataaagatattcataaaacagctttaggcgcaactgaatctgtggaatgggaatatgtagaagatactttagaattggttgaaaaattaaaaactgagaacgtaaaagtcttggcgattgaacaagcagaaaattcgaccaaattagatactttttatccagaaaaagatacaaagtatgcaattgtgatgggaaatgaagtaaaaggtgtgcagcaagaagtggtaaatgcaagtgatttttgtattgagattccacaattgggaaccaagcattccttgaatatttct

SEQ ID NO: 25234 - protein, 160 aa, Unknown
  Obtained from environmental sample
  DOMAIN (24)...(160): SpoU rRNA Methylase family
  misc_feature (1)..(160): Xaa is any amino acid
MRKLKNNELGRISVDEFKSTKKTPLIIVLDNVRSLNNIGSVFRTSDAFLIEKIYLCGICATPPNKDIHKTALGATESVEWEYVEDTLELVEKLKTENVKVLAIEQAENSTKLDTFYPEKDTKYAIVMGNEVKGVQQEVVNASDFCIEIPQLGTKHSLNIS

SEQ ID NO: 25235 - DNA, 726 bp, Unknown
  Obtained from environmental sample
  misc_feature (1)..(726): n is a, c, g, or t
atggttcgcggtgttggaaatccagagtttaaaaatgaaaatccctatgctaacatgccatatccagatgatggttttagattattatcggtttataaatactggaatatgattaattatttttttccttataaacatataatggataaagactggaatgaaagtttaaaagaaaatattccaccatttattaatgctaaaaacgaattagaatatgaattagcagctttaaagatgattgcagacattaaagacactcatgctaatctttggggaggaaaagataaaattaacgaaatacttggtgacaactatccaaatttccatgtttcatttattgaaaacaagctggttatagacaacttttataatgaagacagtcctagaaacggtttaaaaataggagatattattacgcgtattaacggaaaaaaagttgaagacatcgttacagataatcaagatttttatccagcgtcaaaccagccaactcgtttaagagatattagttttaatttattacgtactacaagcaatagcttagatattgaggtagaagatactggtatcaaattaattaaaacaatacctgtatacaacaaaaaagacattaaggacttttacaaatggtacacaaaagaagaaaacattagtagttatagactacttaaaaataacattggatatgtttcacttaaacaccttaccgatgaggacgtnnnngnn

SEQ ID NO: 25236 - protein, 242 aa, Unknown
  Obtained from environmental sample
  misc_feature (1)..(242): Xaa is any amino acid
MVRGVGNPEFKNENPYANMPYPDDGFRLLSVYKYWNMINYFFPYKHIMDKDWNESLKENIPPFINAKNELEYELAALKMIADIKDTHANLWGGKDKINEILGDNYPNFHVSFIENKLVIDNFYNEDSPRNGLKIGDIITRINGKKVEDIVTDNQDFYPASNQPTRLRDISFNLLRTTSNSLDIEVEDTGIKLIKTIPVYNKKDIKDFYKWYTKEENISSYRLLKNNIGYVSLKHLTDEDVXX

SEQ ID NO: 25237 - DNA, 714 bp, Unknown; identical to SEQ ID NO: 21265
  Obtained from environmental sample
  misc_feature (1)..(714): n is a, c, g, or t

SEQ ID NO: 25238 - protein, 237 aa, Unknown; identical to SEQ ID NO: 21266
  Obtained from environmental sample
  misc_feature (1)..(237): Xaa is any amino acid

SEQ ID NO: 25239 - DNA, 555 bp, Unknown
  Obtained from environmental sample
  misc_feature (1)..(555): n is a, c, g, or t
gtgggggcaaaggatagaatggaaatgcagaaagtgccagaagcgggatatgtaattaaaggattatggatttcgggattgcaacgaagtttgtcttttaaaaatttgatgtttccatttaaattaatttcgagcttgttgacttctaaaaaaatattaaaatcttttattcctgatgttgctattgggacaggaggttatgcaagtgcgccgttgttaaaagtggcttcaaataaaggaataccctgtttaatacaagagcaaaattctcatgcaggaattacgaacaaatggttgagcaataaagtgaaaagtatttgtgttgcttatgagggaatggggcaattctttccttctgaaaaaattaaacttacaggaaacccagttcgacaagatttaatcgatatagattctaaaagaggagaaggcttgaattactttaagttgaatccaaacaaaaagacattgttgattttaggcggaagtcttggagcaaaaagaataaacgaacttattgatgattctttaggattattttcaagattaaatgtacnt

SEQ ID NO: 25240 - protein, 185 aa, Unknown
  Obtained from environmental sample
  DOMAIN (1)...(108): Glycosyltransferase family 28 N-terminal domain
  misc_feature (1)..(185): Xaa is any amino acid
MGAKDRMEMQKVPEAGYVIKGLWISGLQRSLSFKNLMFPFKLISSLLTSKKILKSFIPDVAIGTGGYASAPLLKVASNKGIPCLIQEQNSHAGITNKWLSNKVKSICVAYEGMGQFFPSEKIKLTGNPVRQDLIDIDSKRGEGLNYFKLNPNKKTLLILGGSLGAKRINELIDDSLGLFSRLNVX

SEQ ID NO: 25241 - DNA, 936 bp, Unknown
  Obtained from environmental sample
  misc_feature (1)..(936): n is a, c, g, or t
gtggatcaagattcggctcgagatgtgaacatttngagccacatacaaaaaatggtatggagcaacggagctgttcctattgcctgtatcttttacaggacagaaataaaaatactcgattgtacccaacatattcaagatgacaataagcccgtttacctagcaagtttaaaaattgtagccaaagcacatcagctttataataaaaattttgctgttaagataaaaactggtacgttctgggaagaatctagtgtcaaaaataaatttaaattcaatgcctcttcctacgatatccttatacggtggatacgagagatagctaaacaaattgcattctcaaattccaatgccgatgagcgaataataaaaaaaatcattattcagtctataatgattaaatatctggaggaaagaaaagatccagatggcaatagctcttttaatcaaaaatatttccagaaatatggcagttgccaagaatttgtagatgttctgtctaatggaaattttgttgctttgctagacgatttacagcaagatttaaatggtaatctttttgagtggaattccgaagagaagaatctaataccaactttaaatttaaatggtctggtagaagctttaaaagcttataaaagacccgaagagagccacaaccaaattctggaacttattagatactatgagttcagctacattcctgtagaattgataagtcgtatctacgaagagtttttagcaggtggcgatgatactttatttagtcaaaaagagaaaaaacaaaaagatggcatctttaacacaccatctcatctggcgcagttaatagtcgatgagattatgccattacatcagtatatcagtattgatatccaatcatttacgattttggatccagattgtggatcgggaattntcttgtattgcctttaa

SEQ ID NO: 25242 - protein, 311 aa, Unknown
  Obtained from environmental sample
  misc_feature (1)..(311): Xaa is any amino acid
MDQDSARDVNIXSHIQKMVWSNGAVPIACIFYRTEIKILDCTQHIQDDNKPVYLASLKIVAKAHQLYNKNFAVKIKTGTFWEESSVKNKFKFNASSYDILIRWIREIAKQIAFSNSNADERIIKKIIIQSIMIKYLEERKDPDGNSSFNQKYFQKYGSCQEFVDVLSNGNFVALLDDLQQDLNGNLFEWNSEEKNLIPTLNLNGLVEALKAYKRPEESHNQILELIRYYEFSYIPVELISRIYEEFLAGGDDTLFSQKEKKQKDGIFNTPSHLAQLIVDEIMPLHQYISIDIQSFTILDPDCGSGIXLYCL

SEQ ID NO: 25243 - DNA, 402 bp, Unknown
  Obtained from environmental sample
  misc_feature (1)..(402): n is a, c, g, or t
gtgtgtggtcaaaagctttgggagaaaataagagataaaccccttcctgacgcattgtggcggcatccaatattgtctgtgagatatgcagatacaagcgtgaataaagcagaggattggctgcggtggtgtaaggcaggcggatttgaattgccaagcgatataaagataaatcattttagtcatgtactactagcgatagaagccgcaaggtacaatctgggcattactcttaccaataattatatgatgcaggatgacgcttataaacaaaatatcgttagaattccaatgcacgaatttctaacaggggaccaattttacttcgtttgcaaggaattaaagaataatcaggatgatattattaaattaagcgaatggctgaaatcccaatgtaattaa

SEQ ID NO: 25244 - protein, 133 aa, Unknown
  Obtained from environmental sample
  misc_feature (1)..(133): Xaa is any amino acid
MCGQKLWEKIRDKPLPDALWRHPILSVRYADTSVNKAEDWLRWCKAGGFELPSDIKINHFSHVLLAIEAARYNLGITLTNNYMMQDDAYKQNIVRIPMHEFLTGDQFYFVCKELKNNQDDIIKLSEWLKSQCN

SEQ ID NO: 25245 - DNA, 612 bp, Unknown
  Obtained from environmental sample
  misc_feature (1)..(612): n is a, c, g, or t
atgatcgattttgagatcccgaaaataaaagtggtgtttatggatatcgggggtgtcttgctcaccaatggttggggacatgaatcgcgtcaaaaagcagcaaaaatttttggatttgattatgaagagatggacctcttgcaccactttatttataatgtttttgaaattgggagcattacattagatgtctatctcgatacggtgctatttaagcaatcgcgtgatttcactaaagctgattttaagcagtttatgaacgaacagtcagtagaattgcctgaaatgttgtcctggttaaaatcatggaaaaaaaagacccaactgcccgtatttgcccttaataacgaaagtttggagctcaatgattatcgcataacaaaatttaagcttcacgatgtatttgacgattttttttcatcctgttatcttcgttgtagaaaaccggatccgcgtatttatcaaaccgctctaaaaatcactcgggttaatcctgacgaatgcctttacttagatgatagaccaatgctggtcgatgcagcaaaaaaacaaggcatccgtagtatgcttcatgaaaactatgacaacacaagatatattcttgagaaatga

SEQ ID NO: 25246 - protein, 203 aa, Unknown
  Obtained from environmental sample
  DOMAIN (9)...(194): haloacid dehalogenase-like hydrolase
  misc_feature (1)..(203): Xaa is any amino acid
MIDFEIPKIKVVFMDIGGVLLTNGWGHESRQKAAKIFGFDYEEMDLLHHFIYNVFEIGSITLDVYLDTVLFKQSRDFTKADFKQFMNEQSVELPEMLSWLKSWKKKTQLPVFALNNESLELNDYRITKFKLHDVFDDFFSSCYLRCRKPDPRIYQTALKITRVNPDECLYLDDRPMLVDAAKKQGIRSMLHENYDNTRYILEK

SEQ ID NO: 25247 - DNA, 420 bp, Unknown
  Obtained from environmental sample
  misc_feature (1)..(420): n is a, c, g, or t
atgaatccatttaaagcatttgttgctacttttttttctagaagtaatcctaaaattgatttaaaaaatctaccaagcatctacgatattaaaattaatagtttgcaaggacaaccaattaatttaagtgcttttaaaggcaagcacatcttaattgttaacgttgcttccaaatgtggttttacaccacaatacaaagatttacaaatcttacacgatacatataaagataaattacaaattataggagtgccatgtaatcaatttggaaatcaagaacctggagatgctaatgcgatagaagaattttgtgaagtaaattacggagtttcatttttaattaccgaaaaaatagatgttaaaggacacaatcaacatcctttatatgcttggcttacacaacaacaaaaaaaacggtaa

SEQ ID NO: 25248 - protein, 139 aa, Unknown
  Obtained from environmental sample
  DOMAIN (26)...(133): Glutathione peroxidase
  misc_feature (1)..(139): Xaa is any amino acid
MNPFKAFVATFFSRSNPKIDLKNLPSIYDIKINSLQGQPINLSAFKGKHILIVNVASKCGFTPQYKDLQILHDTYKDKLQIIGVPCNQFGNQEPGDANAIEEFCEVNYGVSFLITEKIDVKGHNQHPLYAWLTQQQKKR

SEQ ID NO: 25249 - DNA, 456 bp, Unknown
  Obtained from environmental sample
  misc_feature (1)..(456): n is a, c, g, or t
gtgagagaagaacttaaaaatacagattggcatacatacggattatcaatttctgactacgactacaccaaaagattaatcaatgaattaattgatgatagaaataagcagattgaaatcaaaggaaaagaattagaagcgccaaaaattgactctgaagcaatttcggacttaaattattacgcttatattgataatttatttatctggcattttggaatttggcgcttacaaggaatatttgaaggaattttaaagcaggaatattttcctgaaaagaatatgcttggattaaaatcaaaactagattataccagaaaagtttcacaaaagataaatcaagaggattataatgaattacttgaatggggaaagttacgaaatgctctttctcattttccacctgaacaatatagaccatcattaattcaggaaagtgattttaatgatatctag

SEQ ID NO: 25250 - protein, 151 aa, Unknown
  Obtained from environmental sample
  misc_feature (1)..(151): Xaa is any amino acid
MREELKNTDWHTYGLSISDYDYTKRLINELIDDRNKQIEIKGKELEAPKIDSEAISDLNYYAYIDNLFIWHFGIWRLQGIFEGILKQEYFPEKNMLGLKSKLDYTRKVSQKINQEDYNELLEWGKLRNALSHFPPEQYRPSLIQESDFNDI

SEQ ID NO: 25251 - DNA, 480 bp, Unknown
  Obtained from environmental sample
  misc_feature (1)..(480): n is a, c, g, or t
gtggaagctagagctttaatcgagtcgagactcatttgtaattactacaaagcattaacgatggaaattaaatctgataaaagaggaagtttagaatgcacaaagctctgtatagaaaataataaggttgtaaaatttataatagaagttgcagcattaacaagtaaagaaattattgtaatttcacaattgataaaagaggttattttaaataattttgatgagcaagtaactcaaaaagtatttgtgaaatcgtctacaggattttttaaaaccgaaaataataaaccaaatggagcaacttttgaaactataaagctaatttcagaaaatgcgaaaacacttcaaataaaagctgcaggtggtgttagagattatggtacagctttaaaaatgatctccttaggagttgatagaattggaacctcatcagctaaagaaatttgcttaaaccaggaaaagaacaataacgattattaa

SEQ ID NO: 25252 - protein, 159 aa, Unknown
  Obtained from environmental sample
  misc_feature (1)..(159): Xaa is any amino acid
MEARALIESRLICNYYKALTMEIKSDKRGSLECTKLCIENNKVVKFIIEVAALTSKEIIVISQLIKEVILNNFDEQVTQKVFVKSSTGFFKTENNKPNGATFETIKLISENAKTLQIKAAGGVRDYGTALKMISLGVDRIGTSSAKEICLNQEKNNNDY

SEQ ID NO: 25253 - DNA, 627 bp, Unknown
  Obtained from environmental sample
  misc_feature (1)..(627): n is a, c, g, or t
atgatacagctcagtgaacttaggccatctgggaagcagcgtgtttatgatattttaaccgcattagagtttgatatggctgattggagtgaatcacttaccaataaagagcgtagcccgtcgtcaaatccaaaatattgctataattggtcttttgttcgtgatgataaaaaagtcattgttctctttttgtggtatgaagaaatgcgaattatcaacgggagaatctatcaagagcatagcttcaagaagtatgctgaggagcaagaaaaggggagaaagaaacgttcgcttgaaattgactatgcgatagggttggcatatgagaagaaattatctattgatgttgtaatatgccaaggaaacgaaaatactaaaggggttcttaaaagagaactggatcaagaaaagtggtttgtgactggttatgatgacaaaactggagcttgcattatcgaaagaagcaacagctaccaaacttctaagcttgctgaccagtttgatgcgaacaatattaaaaatccaaaatacgaatacgaaaaagttgggagtttgagtatgccccgtttcaagtgtttatacgaagaaaaagtaattgctaccgaatcaaatggggtaaagtgttga

SEQ ID NO: 25254 - protein, 208 aa, Unknown
  Obtained from environmental sample
  misc_feature (1)..(208): Xaa is any amino acid
MIQLSELRPSGKQRVYDILTALEFDMADWSESLTNKERSPSSNPKYCYNWSFVRDDKKVIVLFLWYEEMRIINGRIYQEHSFKKYAEEQEKGRKKRSLEIDYAIGLAYEKKLSIDVVICQGNENTKGVLKRELDQEKWFVTGYDDKTGACIIERSNSYQTSKLADQFDANNIKNPKYEYEKVGSLSMPRFKCLYEEKVIATESNGVKC

SEQ ID NO: 25255 - DNA, 597 bp, Unknown
  Obtained from environmental sample
  misc_feature (1)..(597): n is a, c, g, or t
atgaattatttacaaaaaaaattagtgatttttggaaatggagaattagcagagttagctaacttctattttagtaaagatagtaactataccgttgaagcttttgttttagactcgacttatattgaagaagataattatttaaacaaaccactcgtttcatttgaaaatgttcaagagatttattctccagaagagtttgaaatgtttatagccattggctattctaaactaaatgaaaacagaaaaaataaatacattcaagcaaaggacaaaggttatactttggctagttatgtatcatcaaaatcaacatcttgggaaggcttaaaagttggagagaatacatttattatggaagacaatacaattatgcctttttgtaaaattggaaataatgttttggtttgggtaaatagtattttggcgcaccacatggtaatagaagaccatgtaaccatcacttctcattgtgcaattgggggaaatgtaataataaaggagcaagcctttattggtttaaattcctcattaagaaataatattacgattggtaaaggggcaataattggaacatctgcaaatgttgttaaaaat

SEQ ID NO: 25256 - protein, 199 aa, Unknown
  Obtained from environmental sample
  misc_feature (1)..(199): Xaa is any amino acid
MNYLQKKLVIFGNGELAELANFYFSKDSNYTVEAFVLDSTYIEEDNYLNKPLVSFENVQEIYSPEEFEMFIAIGYSKLNENRKNKYIQAKDKGYTLASYVSSKSTSWEGLKVGENTFIMEDNTIMPFCKIGNNVLVWVNSILAHHMVIEDHVTITSHCAIGGNVIIKEQAFIGLNSSLRNNITIGKGAIIGTSANVVKN

SEQ ID NO: 25257 - DNA, 456 bp, Unknown
  Obtained from environmental sample
  misc_feature (1)..(456): n is a, c, g, or t
atgtcaggtaaacctgtagcagagcaagaaattggtcaagcactattgcaagaggtagtcgctttcgcggaaacttcaatatcaagacgtaaattcatattgcattatttgggtgaatcatttgataacaaaacaggtgaaggtggagatatggatgatactatgcgtcatccaaaggaaaaacaagaagctaaggatgatgtaaaacttgttctagaaattgtcgatgctaccaatgaaaaatataaggctaaagagttagtaaacgttattgtaggtaaatctaacgcgttaattagctctcataaaaccgacgatcaaccctttttgggtaaaggaaaagataaagataaatcctattggatggctttaacacgacaaatattagtatcaggatccctaaaaaaggatattgaaacctatggtgtcattaagcttacagataacggaaacgag

SEQ ID NO: 25258 - protein, 152 aa, Unknown
  Obtained from environmental sample
  misc_feature (1)..(152): Xaa is any amino acid
MSGKPVAEQEIGQALLQEVVAFAETSISRRKFILHYLGESFDNKTGEGGDMDDTMRHPKEKQEAKDDVKLVLEIVDATNEKYKAKELVNVIVGKSNALISSHKTDDQPFLGKGKDKDKSYWMALTRQILVSGSLKKDIETYGVIKLTDNGNE

SEQ ID NO: 25259 - DNA, 777 bp, Unknown
  Obtained from environmental sample
  misc_feature (1)..(777): n is a, c, g, or t
atgtttaatattaaaggtaaagattctgataagtacttcaaagaggtagaaaataaactggttgaagaaaccaattatatcttagagcttgaacaaagtcaagaaatagcaaaagcatgttctcatattcccaatttaagattccccgattattatccagaattatcttccgaacggattattactatggattacatgatgggtaaacatttgtctgaattcacagcaaaaaacaccaatcaggatatggccaataccattggacaatcgctttgggatttctacatgtttcaaattcataagcttaaaaaagttcatgccgatccgcacccgggaaattttctaatttcaaatgacgggcacttaattgctttagattttggatgtatgaaaaccattcctgaagatttctatgtaccctattttgaattagctgaaaaggaaagcattgaaaacccgaaaatctttcgagaaaaaatgttcaaattagaaattttaaaaccagacgattcgcctgaagaattagaatttttctcaactatgtttcatgaaatgttaagcattttcacccaaccatttcatgcggaaacttttgatttttcagatccatcattctttggacgcattgcagaattgggtgaaaaatattcaaaaaatacggaattgcgtaaaatgaatggaaaccgaggttctaaacattttatttatataaaccgaacattttttggactttataatttaatgttcgacttaaaagcgaaagatgtacaactcnnn

SEQ ID NO: 25260 - protein, 259 aa, Unknown
  Obtained from environmental sample
  misc_feature (1)..(259): Xaa is any amino acid
MFNIKGKDSDKYFKEVENKLVEETNYILELEQSQEIAKACSHIPNLRFPDYYPELSSERIITMDYMMGKHLSEFTAKNTNQDMANTIGQSLWDFYMFQIHKLKKVHADPHPGNFLISNDGHLIALDFGCMKTIPEDFYVPYFELAEKESIENPKIFREKMFKLEILKPDDSPEELEFFSTMFHEMLSIFTQPFHAETFDFSDPSFFGRIAELGEKYSKNTELRKMNGNRGSKHFIYINRTFFGLYNLMFDLKAKDVQLX

SEQ ID NO: 25261 - DNA, 630 bp, Unknown
  Obtained from environmental sample
  misc_feature (1)..(630): n is a, c, g, or t
atgggtgttcaaataattggtaagccaagcaatatagaggaacttttaggcataaaaccattgtcatataaagaagctgtttccttagcttttgaaaaaatagaacaaaatagtattatttctagttggaaagattccatggtgagtagcgnccgactcaaaaataatttccataaatatgtgaatgtaccaaaatatggttgttttaaagattataaggaacgtcctattacagatccagaagaaaccattcggaaaatttgggctattggcggcaataccggttggtattatggaacccgtttatggcgattgcgtggttatatggacaaaatggtgggcggcattggtttacgccgcggacgtacaagtccaacagaattgcatgtaggcgattcacttgatttttggcgtgtcatttttgcggataaagacaaacaaaagctcctactctacgccgaaatgaaattacctggcgaagcttggttagaatttaaaattgaagataataagctgaaacaaaccgctacgtttagaccacggggtttggcaggacgactctattggtatagcgttttaccatttcatggttttatttttagaggtatgattaacaaacttgccagctaa

SEQ ID NO: 25262 - protein, 209 aa, Unknown
  Obtained from environmental sample
  misc_feature (1)..(209): Xaa is any amino acid
MGVQIIGKPSNIEELLGIKPLSYKEAVSLAFEKIEQNSIISSWKDSMVSSXRLKNNFHKYVNVPKYGCFKDYKERPITDPEETIRKIWAIGGNTGWYYGTRLWRLRGYMDKMVGGIGLRRGRTSPTELHVGDSLDFWRVIFADKDKQKLLLYAEMKLPGEAWLEFKIEDNKLKQTATFRPRGLAGRLYWYSVLPFHGFIFRGMINKLAS

SEQ ID NO: 25263 - DNA, 342 bp, Unknown
  Obtained from environmental sample
  misc_feature (1)..(342): n is a, c, g, or t
gtgcttaaagcgttaatgaataaaggctttaatgttgcaattgatgactttggaacgggttactctagtttgtcttatttatcgcgtcagccggcaaatataataaaaatagatcgtgaatttaccattggcgccgaattagctgggcaaaaaagagcattgctagaaggcattattaatatttgtacacagttaaataaaacagtggtagtagagggtgtagaaagccctgagctgatcggttatttatctaagttcaataatattcgaatacaaggcttttattactgtaaacctatgcctttggataaacttatagaatatatacagagtaataaatag

SEQ ID NO: 25264 - protein, 113 aa, Unknown
  Obtained from environmental sample
  DOMAIN (1)...(99): EAL domain
  misc_feature (1)..(113): Xaa is any amino acid
MLKALMNKGFNVAIDDFGTGYSSLSYLSRQPANIIKIDREFTIGAELAGQKRALLEGIINICTQLNKTVVVEGVESPELIGYLSKFNNIRIQGFYYCKPMPLDKLIEYIQSNK

SEQ ID NO: 25265 - DNA, 387 bp, Unknown
  Obtained from environmental sample
  misc_feature (1)..(387): n is a, c, g, or t
ttgcgtaaagtaaaaccaagttctccagatacattctttttaccagacttgtttaaagacgaagatgatagagcctatgctttagagttgtttaagaaaaccattttaaaacagaatggtttaaatgacacgatagcacaaaaaactcaaaattgggatgcagatcgtattgctaatatagatacggttttactgcaaatggcaatatgtgagttaaccaatttcccatcaattcccgtgaaagtaaccattaatgaatatttggaaattgctaaagaatattcaacaccaaaaagtagtgtgtttattaatggtatcttagataagttggtaaaagaatacgcagaatctgataccttaattaacatacgacgtgggttgtgttag

SEQ ID NO: 25266 - protein, 128 aa, Unknown
  Obtained from environmental sample
  DOMAIN (4)...(114): NusB family
  misc_feature (1)..(128): Xaa is any amino acid
MRKVKPSSPDTFFLPDLFKDEDDRAYALELFKKTILKQNGLNDTIAQKTQNWDADRIANIDTVLLQMAICELTNFPSIPVKVTINEYLEIAKEYSTPKSSVFINGILDKLVKEYAESDTLINIRRGLC

SEQ ID NO: 25267 - DNA, 693 bp, Unknown
  Obtained from environmental sample
  misc_feature (1)..(693): n is a, c, g, or t
ttgtacaaaggtgaaagtaaaacttttgctgatatgttttttgttattaaacatccagaaggtaatttgctttgggatgcaggattagcagaaggtttagttggacaaaaaccttttactactcctgatggtgcatttaccgtgtctagagatcaaggtattgaagaacaactaaaaacaataggtttacaaactaaagatattgactatatagccttatcacacacacattttgatcactcaggatctgcatcaaaattagctcatgccacttggattgttcaagaagtagaatatgactttgttaaaagtatagagcaacaaaaaaacaatcctgataattacaacgcgataaaggatttaaaaataactaaaaaaatcaatggagatttggatgtttttggagatggtaaagtgattattaagtccactccaggtcatacaccaggtcaccaatctttatttttagatttagagcaagaaggaccattatttttagcaggagatttatatcattttgaagaaaacagaacgaatcatattgtaccaagtttcaactttagtgtagaggacacaaaagcatcaatggaaacttttgaagcttttgcaaaacaaaaagaagcacgagtgatcattcagcattcaacaaaagattacaatagtttaaatcacgctccagagcctattcaataa

SEQ ID NO: 25268 - protein, 230 aa, Unknown
  Obtained from environmental sample
  DOMAIN (9)...(214): Metallo-beta-lactamase superfamily
  misc_feature (1)..(230): Xaa is any amino acid
MYKGESKTFADMFFVIKHPEGNLLWDAGLAEGLVGQKPFTTPDGAFTVSRDQGIEEQLKTIGLQTKDIDYIALSHTHFDHSGSASKLAHATWIVQEVEYDFVKSIEQQKNNPDNYNAIKDLKITKKINGDLDVFGDGKVIIKSTPGHTPGHQSLFLDLEQEGPLFLAGDLYHFEENRTNHIVPSFNFSVEDTKASMETFEAFAKQKEARVIIQHSTKDYNSLNHAPEPIQ

SEQ ID NO: 25269 - DNA, 975 bp, Unknown
  Obtained from environmental sample
  misc_feature (1)..(975): n is a, c, g, or t
ttgaaggctataacgtggttgtttgcagatgctattaaaaaaagagagttcaagacagcaacctttcaggcaaatcaattacatattcagttttcagatggaaattataaaatgcatntttaccatcctgaaattatcgaaactacatttttgccaacaggtgaaacatttgataaagagtcacacgctgttgttatagataaagtactttctgaggtgaaatttaatgaaacagaaaatgaaattacttttcaatctgaaaaattaactgtaaaaatcaccaagtctccttttcatatttcgtattggaaagatggaaaaaaagttacttctgtgaaaaatagttttcaaaaaacggacgactttgaaaccattagttttaatttaaaactagaggaagtactgtatggtggaggcgcaagagcgttagggatgaatagacgtggtaatcgtttagagttgtacaataaagcacattatggttacgaagatagtagtgagttaatgaattacacgatgccaattgtggtgtcttctaacaagtatcttattcattttgataatgcaccaattggctttttagatttagatagcaaagctgataacacactaacatacgaaactatttctggtagaaaaacctatcaaattgtcgttggtgattcttggttagatcttactaaaaactatactcaacttacaggaacacaacctatgccaccacgttgggctttgggtaatttttctagccgatttggataccattcacaagaagaagtaactgctacagtagaaaaatttagagaagagaatattcctctagatgcgataattattgacattttctggttcggaaaaactattcaaggtactatgggaaatctagcgtttgatcgtgattcttttccaaacccaaaacaaatgctaaaaggtttaaaaaataataatgttaaaaccgttaccgagccgatctga

SEQ ID NO: 25270 - protein, 324 aa, Unknown
  Obtained from environmental sample
  misc_feature (1)..(324): Xaa is any amino acid
MKAITWLFADAIKKREFKTATFQANQLHIQFSDGNYKMHXYHPEIIETTFLPTGETFDKESHAVVIDKVLSEVKFNETENEITFQSEKLTVKITKSPFHISYWKDGKKVTSVKNSFQKTDDFETISFNLKLEEVLYGGGARALGMNRRGNRLELYNKAHYGYEDSSELMNYTMPIVVSSNKYLIHFDNAPIGFLDLDSKADNTLTYETISGRKTYQIVVGDSWLDLTKNYTQLTGTQPMPPRWALGNFSSRFGYHSQEEVTATVEKFREENIPLDAIIIDIFWFGKTIQGTMGNLAFDRDSFPNPKQMLKGLKNNNVKTVTEPI

SEQ ID NO: 25271 - DNA, 570 bp, Unknown
  Obtained from environmental sample
  misc_feature (1)..(570): n is a, c, g, or t
gtggttctatgggaggtcgattattctttatttatttttgttcataacagtaacaattttatgagatcaatacttctttttttaagttttgttttggctttttcttgtaaaaagccaactactaaagtgatttcatcatttaacatagctgacatcaagacctataatttttcggaacttgaaccattactaaattataaggataataatacttatgttattaatttttgggcaacttggtgtgctccatgtataaaagaacttccatattttcaagaaatacatgataaatatggtagtcaaaatttaaaggttattctggtaagtttagacttcccggataaatttgaaagtcaattaaaaccatatgtcaaaaagaataatttaacccctcaagttattttattggatgacccgaatgaaaacgaatggatcccaatggttgatgaatcatggtctggtgctttaccagctacattgatctataataaagataaaagagctttttatgaacaatcttttacaaaagaatcattatttaaagaaattaataaatttactaaactctaa

SEQ ID NO: 25272 - protein, 189 aa, Unknown
  Obtained from environmental sample
  misc_feature (1)..(189): Xaa is any amino acid
MVLWEVDYSLFIFVHNSNNFMRSILLFLSFVLAFSCKKPTTKVISSFNIADIKTYNFSELEPLLNYKDNNTYVINFWATWCAPCIKELPYFQEIHDKYGSQNLKVILVSLDFPDKFESQLKPYVKKNNLTPQVILLDDPNENEWIPMVDESWSGALPATLIYNKDKRAFYEQSFTKESLFKEINKFTKL

SEQ ID NO: 25273 - DNA, 405 bp, Unknown
  Obtained from environmental sample
  misc_feature (1)..(405): n is a, c, g, or t
gtggtggaacaaacgcttcttccaagtaaaattgtggtggtcaatgacgcatccacagatgaaactcagaagattatggaccaattttcagaaaaatataattttatggaaagtgtttttcacaattcaaaaaaacttcacgagcctggaagcaaagtaataaatgctttttacaaaggtttggacacgctggacaccaacttcgatattatctgcaagtttgatgcagatttaattttcccaaagaactatttagaaaaaattgccgtagccttccaaagcgacaattccattggaatggcaggcggctttggctatattgaaaaaaatggcgaatgggttttacagaacctaactaataaagaccacattcgcggagcactaaaagcatatagaaaagaatgc

SEQ ID NO: 25274 - protein, 135 aa, Unknown
  Obtained from environmental sample
  misc_feature (1)..(135): Xaa is any amino acid
MVEQTLLPSKIVVVNDASTDETQKIMDQFSEKYNFMESVFHNSKKLHEPGSKVINAFYKGLDTLDTNFDIICKFDADLIFPKNYLEKIAVAFQSDNSIGMAGGFGYIEKNGEWVLQNLTNKDHIRGALKAYRKEC

SEQ ID NO: 25275 - DNA, 711 bp, Unknown
  Obtained from environmental sample
  misc_feature (1)..(711): n is a, c, g, or t
atgaaacacctcgtttacgtaggaaataaactcagtaaatctgggcgtactcaaagtacaatagacaccttaagcaccttattacaggcggaaggatttattgtaaatacagcttctacacacactaataaattgttgcgtcttggtgatatggtatggacgattataaaatatgcaaagcgcaccgattatgtattaatagatacgtatagcacacaaaacttttactacgcttatatttgtgctttattctgccagctattagggttgcgctatatacctatacttcacgggggcaatttgccaaaacgtttagagacacatcctaaattaagtgcagccctatttaaaaaggcctatattaactgtgcgccgtcgccttatataaaagcagcttttttacattgtggttatactaatgtaataggaattccaaacagtgttactatccacacgtatccatttaaaatgagagtaatggataatattaatatcttatgggtacgttctttttctgaaatttataatcctaaattagctgttaacatactaaaagggttgcatcaacgcggtatatcggcagggttatgtatggttgggccggaagtagatggtgctttaaaggcaactaaaaactatgcaaaaacaatgaatgttgacgtgacttttacaggacaactcagtaataaggaatctcgagccgattcttga

SEQ ID NO: 25276 - protein, 236 aa, Unknown
  Obtained from environmental sample
  misc_feature (1)..(236): Xaa is any amino acid
MKHLVYVGNKLSKSGRTQSTIDTLSTLLQAEGFIVNTASTHTNKLLRLGDMVWTIIKYAKRTDYVLIDTYSTQNFYYAYICALFCQLLGLRYIPILHGGNLPKRLETHPKLSAALFKKAYINCAPSPYIKAAFLHCGYTNVIGIPNSVTIHTYPFKMRVMDNINILWVRSFSEIYNPKLAVNILKGLHQRGISAGLCMVGPEVDGALKATKNYAKTMNVDVTFTGQLSNKESRADS

SEQ ID NO: 25277 - DNA, 618 bp, Unknown
  Obtained from environmental sample
  misc_feature (1)..(618): n is a, c, g, or t
ttgaaacgacaagacggtttacataaattaggaaaaaaaaacaagaattatgaaagtggaatttattttatcatagaggaaaaagaaggagagttattttttagagatgaaaatgaatcaaatataataatgactagcaatagagagcaatataaaattaaaatacctaacacaattaaacttaattggcaatctagtgattgtaataataaaggagaagatattaatttcttttattttacttctgaaaaatcgagtttatctaattttgatggtgaagttgctatttcgtcttcaatacacgatgtaagtttagtagatgttaaaggaccagtttctattaatactattggtgggaatgtaactattaaatttgataaaaaaacaccacaaaagctatattcgatttactcaaataatggtttcatagatattacattacctaaacattcagatttaaaattagatatttctgcaagtaatatttttagtgatatcgattttaaagttgaagaagaaaaagaggacaagaatctacaaagcatgaaattaaaattaaataaaggtggtgtaccactgacacttaaatgccaacttagggaatatttatctgcgtaa

SEQ ID NO: 25278 - protein, 205 aa, Unknown
  Obtained from environmental sample
  misc_feature (1)..(205): Xaa is any amino acid
MKRQDGLHKLGKKNKNYESGIYFIIEEKEGELFFRDENESNIIMTSNREQYKIKIPNTIKLNWQSSDCNNKGEDINFFYFTSEKSSLSNFDGEVAISSSIHDVSLVDVKGPVSINTIGGNVTIKFDKKTPQKLYSIYSNNGFIDITLPKHSDLKLDISASNIFSDIDFKVEEEKEDKNLQSMKLKLNKGGVPLTLKCQLREYLSA

SEQ ID NO: 25279 - DNA, 432 bp, Unknown
  Obtained from environmental sample
  misc_feature (1)..(432): n is a, c, g, or t
atggaaaaacaaacatttttaagctatctaggttttatatttataataataatgtatgccttattattatacgtctggtccaacgcaaaaaagcatttaacaccagtaatacgcaacactatttttgtaggtatcatttatattggatcattaaaaagcatggattttgcaaacggattaaacctgtttgatcgctatttaattgtacacttatttttagcatcattaatctactttattttaatagggtttaggtttcacaacaaagtcagttatgcctggagaataactaaactaaaaaacgtctttaaatgggaacgttgcaaagtgtcttttggcttaatgcgtcaaattattaaagaaaaacagatgcaacaaaaaatagcagccaccaatactaaatgttgtactaaaaactgtgacaaatgttaa

SEQ ID NO: 25280 - protein, 143 aa, Unknown
  Obtained from environmental sample
  misc_feature (1)..(143): Xaa is any amino acid
MEKQTFLSYLGFIFIIIMYALLLYVWSNAKKHLTPVIRNTIFVGIIYIGSLKSMDFANGLNLFDRYLIVHLFLASLIYFILIGFRFHNKVSYAWRITKLKNVFKWERCKVSFGLMRQIIKEKQMQQKIAATNTKCCTKNCDKC

SEQ ID NO: 25281 - DNA, 306 bp, Unknown
  Obtained from environmental sample
  misc_feature (1)..(306): n is a, c, g, or t
ttgaagctgtggatagagctgggtttactggacgaaaagcgccttaaaaaagcctgtaataaagctaaaaaagtggtgctttacacttatggcgaaaacaaccaggctatttggtggcaaaaacagcagcctaaattacgtgattttaaaaatcttagtatatttagtttagattatagtgttacccaagctttggccaatttggttgatcgtaatataaagcttgctattactattcaagatggcgagatgtgggttaataccgacacgaccaatattgaaataaaaccacagcagttaatgtga

SEQ ID NO: 25282 - protein, 101 aa, Unknown
  Obtained from environmental sample
  DOMAIN (1)...(100): YaeQ protein
  misc_feature (1)..(101): Xaa is any amino acid
MKLWIELGLLDEKRLKKACNKAKKVVLYTYGENNQAIWWQKQQPKLRDFKNLSIFSLDYSVTQALANLVDRNIKLAITIQDGEMWVNTDTTNIEIKPQQLM

SEQ ID NO: 25283 - DNA, 540 bp, Unknown
  Obtained from environmental sample
  misc_feature (1)..(540): n is a, c, g, or t
gtggatcatagaatcggctcgagaggaatttacatcagctcagcttatatgattttgacaatttttaataagctttatatggatgctgtttttaaaaaatcttttgaaaaagcaggaatttcttatactcgttttacagctcaacctacaattttaaataatattttgtggtatgcagttgcagaaactgataacgattatcattttgctttttattctttgtttgataaaagtgcactctcagaaaagattatcaaaattgaaaaaaaccacgatattattgatatgaatgatgataatttacaaacacttgcttggtttagtaatggttattttaaaatcaccaaaaaagaaaaaataggcacttataaatatatcgatttaagatatccaccattaaatcctgatgatgccaatacatccgtttttaactttacactttataacgaaaatgatgagtgggatattctaccatttaatggaaatccgccaaatggagaggattttgggaagtttgttgagagattaaaaggaatttag

SEQ ID NO: 25284 - protein, 179 aa, Unknown
  Obtained from environmental sample
  misc_feature (1)..(179): Xaa is any amino acid
MDHRIGSRGIYISSAYMILTIFNKLYMDAVFKKSFEKAGISYTRFTAQPTILNNILWYAVAETDNDYHFAFYSLFDKSALSEKIIKIEKNHDIIDMNDDNLQTLAWFSNGYFKITKKEKIGTYKYIDLRYPPLNPDDANTSVFNFTLYNENDEWDILPFNGNPPNGEDFGKFVERLKGI

SEQ ID NO: 25285 - DNA, 720 bp, Unknown
  Obtained from environmental sample
  misc_feature (1)..(720): n is a, c, g, or t
gtggtcttttcgattgtttttgttattgcttttcagcgaagaaaaaacaaatttcttaaggaacgctatgaagccgaaaaacgctaccaaagagaacttacaaattcacaaattgaaatacaggaacaaacacttaaaaacatagcttgggagttgcacgataacgtagggcagttgctttctgttgtcaatattcaattgaatgtattgatgaattcagttccagaagcttatcatggacaaataaaagaaacaaagggagtagtgcaggaaaccgtacaagaaatccgttcgctctccaaagtcctcaataatgacgttgttttgaaaaacggacttttagcatccctacaggtggagcttgacagatttaaccgtttggactatttaaaagcgtccttaaaaataacgggagatatagtgcccttgaatagtgcaagggaaatcataatattccgaattattcaagagtttctgtctaacgttatcaaacatgccagagcatcaaaattattcgtacatttagaatataaagagaaaacattagaaatatccgttcaagatcacggcgttggctttgatactacacaaaaaacagatagttcggggattgaaacaatgagtagccgtgccgaattattagatgctgaactttctatattgtcagaaatagggaagggaacccaantaaatataatatacccatataaaaacaagtaa

SEQ ID NO: 25286 - protein, 239 aa, Unknown
  Obtained from environmental sample
  DOMAIN (146)...(237): Histidine kinase-, DNA gyrase B-, and HSP90-like ATPase
  misc_feature (1)..(239): Xaa is any amino acid
MVFSIVFVIAFQRRKNKFLKERYEAEKRYQRELTNSQIEIQEQTLKNIAWELHDNVGQLLSVVNIQLNVLMNSVPEAYHGQIKETKGVVQETVQEIRSLSKVLNNDVVLKNGLLASLQVELDRFNRLDYLKASLKITGDIVPLNSAREIIIFRIIQEFLSNVIKHARASKLFVHLEYKEKTLEISVQDHGVGFDTTQKTDSSGIETMSSRAELLDAELSILSEIGKGTQXNIIYPYKNK

SEQ ID NO: 25287 - DNA, 453 bp, Unknown
  Obtained from environmental sample
  misc_feature (1)..(453): n is a, c, g, or t
atgtcctgcatttgcaaaggcaataaagctggtgcagtccctcgatattgtgcttctatagaaaccaagatactatcgaaaaaacctaacacttgtgtcgagaaaatgaccaaaaggactatggcaaaattcttggccaattcgcctggactcaatccccaagtatacccgtccttatctgcaacaccttcattgtatatcttacggatatttaccagaaaaaaccaaacagcaagtgtttacattcctgcaatagtatattgcgagaaactgctggttagtatcgtctggaaaaccgtatctatatattccagtccaatccctaaaatgatggttgcggacatctttaatattcggatacgaggttataaattttatccttgcatttttctgaccgaaataatatccttgcatcgaaaggttatggatatgacgttaaaaacatttctttga

SEQ ID NO: 25288 - protein, 150 aa, Unknown
  Obtained from environmental sample
  misc_feature (1)..(150): Xaa is any amino acid
MSCICKGNKAGAVPRYCASIETKILSKKPNTCVEKMTKRTMAKFLANSPGLNPQVYPSLSATPSLYILRIFTRKNQTASVYIPAIVYCEKLLVSIVWKTVSIYSSPIPKMMVADIFNIRIRGYKFYPCIFLTEIISLHRKVMDMTLKTFL

SEQ ID NO: 25289 - DNA, 804 bp, Unknown
  Obtained from environmental sample
  misc_feature (1)..(804): n is a, c, g, or t
gtggatcaagaatcggctcgagaaatcaatgcggatgataatgcacggattattcgtggtcatctcaatattgtctattgggcaaaggaagccaaagaactggacaaaatcacgtccaaaatcaagaccgaatttaaggaactggatatcatcccatattatccacgtggcgaagagcgtaaaaactatattcttaatagttactgctgcttttcttccaacttttcaaatcacgatttatatgtgacagatttaaagcacgctctgtgtctgttcattaacaataccaattacaaatccgataacaccggaatcatcttcaatgatagagaacataacattccagtgctaaaagatgtttgggatgaaaaaaagaaacggatcaaggcacgtaattttgccatttttgcaccaacaggcgaaggcaaatcctttttggcaaacaatattctgcgccaatattttgaaagtggtgtacggttggtcattattgatttaggtggttcttacaccaaattcgccaagctctatcctgaaaaatatacggttctcagatatgaaagcggtaaaaacttaggcatcaatccattttacatcagcgatgttaaagacttgacacctgaacgtttggaagacctatctgttttcctttttgaactgttcgcttcagatttaaaagttacaaaagcacaatcagtctcggttaaaaagatattgcaacactattataataacacttcagaaaatcattccttagatggtttttacagctttatagaaaggaaacaaaaagaccttttagan

SEQ ID NO: 25290 - protein, 268 aa, Unknown
  Obtained from environmental sample
  misc_feature (1)..(268): Xaa is any amino acid
MDQESAREINADDNARIIRGHLNIVYWAKEAKELDKITSKIKTEFKELDIIPYYPRGEERKNYILNSYCCFSSNFSNHDLYVTDLKHALCLFINNTNYKSDNTGIIFNDREHNIPVLKDVWDEKKKRIKARNFAIFAPTGEGKSFLANNILRQYFESGVRLVIIDLGGSYTKFAKLYPEKYTVLRYESGKNLGINPFYISDVKDLTPERLEDLSVFLFELFASDLKVTKAQSVSVKKILQHYYNNTSENHSLDGFYSFIERKQKDLLX

SEQ ID NO: 25291 - DNA, 732 bp, Unknown
  Obtained from environmental sample
  misc_feature (1)..(732): n is a, c, g, or t
gtggatcaagaatcggccgagaaattattttgttgctcccgaggaattcctgagtatttaatgaatgattcagattgggagaatttagaagaatatatcaagaaaataaatccagatgtgttatttatagatagtctaacgcatatgtgtatgggagaaatcgaaaaaagttctgttgcgcaggagtttacaagaaaacttaaaaaatatattgcctatttaaatataacaacttttattattcaccataacactaaaggtaatgataaaccaatgacgcaggacagtattgcaggaagtagaataattacacaagaatttgattttgcattaggtcttggcaatgttccaacagctaaaggaggaacgtactcttgcattttatataacaaagattctggtaaagaaaataataaagctataacgtattcttttgatgagaattataatgttcttagactaggagagtcaaatgtctacgatttatacgctgaaactaaaacggatggaagaaagaatgataaaaataaaaatatagttgttgattatattttgggtaaacatagtcaaggtagtcaatctattacatcgaatgaactaaaaagtgaatttgtagaaaacaacactttttctaaacaaactttgtatagtgttataaaatgtttgaaggaagatggtagtataattatggataatgaaacaaaaggaaattattttataaatatagactaa

SEQ ID NO: 25292 - protein, 243 aa, Unknown
  Obtained from environmental sample
  misc_feature (1)..(243): Xaa is any amino acid
MDQESAEKLFCCSRGIPEYLMNDSDWENLEEYIKKINPDVLFIDSLTHMCMGEIEKSSVAQEFTRKLKKYIAYLNITTFIIHHNTKGNDKPMTQDSIAGSRIITQEFDFALGLGNVPTAKGGTYSCILYNKDSGKENNKAITYSFDENYNVLRLGESNVYDLYAETKTDGRKNDKNKNIVVDYILGKHSQGSQSITSNELKSEFVENNTFSKQTLYSVIKCLKEDGSIIMDNETKGNYFINID

SEQ ID NO: 25293 - DNA, 450 bp, Unknown
  Obtained from environmental sample
  misc_feature (1)..(450): n is a, c, g, or t
atgcaagagttaaactttccaaagtttgtgtttcgattcaaaaataacgaaaataaagtatctatttttgatgttatacgtaaaagatttatggtcttacaacctgaagaatgggtaagacaacattgtgtacattacttaatagaagttaaaaaatatccaatctctttgattaatgtcgaaaaagaactaaaagtcaacgatttaaaaaagcgttatgacattgttatttttaatactgacggaagcatacatttaattgtagaatgtaaagcgcctaaaatagaaatcaaacaaaacacttttgaccaaatagcacgttataatttggcattaaatgcaacctatttgatggtaacaaatggtattaatcactattattgcagtatggattttaaagcagaacagtatcactttttaaaagacataccagattatcaagaacactag

SEQ ID NO: 25294 - protein, 149 aa, Unknown
  Obtained from environmental sample
  DOMAIN (65)...(136): Type I restriction enzyme R protein N terminus (HSDR_N)
  misc_feature (1)..(149): Xaa is any amino acid
MQELNFPKFVFRFKNNENKVSIFDVIRKRFMVLQPEEWVRQHCVHYLIEVKKYPISLINVEKELKVNDLKKRYDIVIFNTDGSIHLIVECKAPKIEIKQNTFDQIARYNLALNATYLMVTNGINHYYCSMDFKAEQYHFLKDIPDYQEH

SEQ ID NO: 25295 - DNA, 381 bp, Unknown
  Obtained from environmental sample
  misc_feature (1)..(381): n is a, c, g, or t
gtgccaaaagattttgattttaatccgttttttaatggaatgtttgcaaagaaagagatcatcaacaatgcaaaatatgccaataattacgattataacaaagctgtatacttaatgagtgagttcgatttgttagaaaatggttttttaatgattaaggaagatgaaagttactcatctcctattgcaaccgttttttatgaatattatgacaatgaaatcgacttaaaaataaaattgcatcaagataaagataaaatacagtgtattgttgctaaagattttttagagaacgaagttgcttttgggcaaactcagcatcctaaattaaatgattttgctgatggtgtaaatacgttggaatttttagcaggaatctag

SEQ ID NO: 25296 - protein, 126 aa, Unknown
  Obtained from environmental sample
  misc_feature (1)..(126): Xaa is any amino acid
MPKDFDFNPFFNGMFAKKEIINNAKYANNYDYNKAVYLMSEFDLLENGFLMIKEDESYSSPIATVFYEYYDNEIDLKIKLHQDKDKIQCIVAKDFLENEVAFGQTQHPKLNDFADGVNTLEFLAGI

SEQ ID NO: 25297 - DNA, 807 bp, Unknown
  Obtained from environmental sample
  misc_feature (1)..(807): n is a, c, g, or t
gtgatgcgaaagaaggtggtttccaattacttcgtgtttccgtggtttactaagaacaaagcattgataaaattcctttcagaagaaggtgttaaacaaattcttcagaaaacggaaaatcattatatgagtgacaacaaccgggaaatgcctaaggttgatgccgaactctattttgttattgacgaaaaaaacaatcaaatagaacttaccgataaaggtgtagattatctttctggtgaaggcgatcctgatttcttcgtaatgccagaaattggaactgaaatagcagatattgaaaaaaagggccttccaaaagaagaggaagttgcacagaaagaagaacttttccgtgaattctctgtgaaaagtgaacgcatccacacgatgaatcaattgttgaaagcttacacgctttttgaaaaagatgatcaatatgtggtgatggagaataaagtgatgatcgtggatgagcagactggccgtattatggacgggcgccgatatagcgacggacttcaccaagccattgaagcaaaagaagatgtgaagattgaagcaatgacgcaaaccttcgcaaccattacacttcagaattacttccgtatgtaccgcaaactttcggggatgacgggtactgcagtaacagaagctggcgaactttgggaaatctacaaattagatgtggttgaaataccaaccaaccgtccaatagcacgtcacgatcgtgaagataaaatttacaaaacaaaacgtgaaaaatacaacgccgttggtgaagaagttgtagccctttcattagcnnan

SEQ ID NO: 25298 - protein, 269 aa, Unknown
  Obtained from environmental sample
  DOMAIN (8)...(178): SecA preprotein cross-linking domain
  misc_feature (1)..(269): Xaa is any amino acid
MMRKKVVSNYFVFPWFTKNKALIKFLSEEGVKQILQKTENHYMSDNNREMPKVDAELYFVIDEKNNQIELTDKGVDYLSGEGDPDFFVMPEIGTEIADIEKKGLPKEEEVAQKEELFREFSVKSERIHTMNQLLKAYTLFEKDDQYVVMENKVMIVDEQTGRIMDGRRYSDGLHQAIEAKEDVKIEAMTQTFATITLQNYFRMYRKLSGMTGTAVTEAGELWEIYKLDVVEIPTNRPIARHDREDKIYKTKREKYNAVGEEVVALSLAX

SEQ ID NO: 25299 - DNA, 435 bp, Unknown
  Obtained from environmental sample
  misc_feature (1)..(435): n is a, c, g, or t
gtgaagaaattcctggttgggagttgtttcagtattacgatgctaatggggaaaaacaaaaaggttgatagtgctatgttaaataagtatttacaggatttaagtgggacgctttttactgcaaaagattttaggacatgggctgcaagtataatttgttttgaaaccttgaaggaattaggatacacagaagatccaaaattaaataaggaacatattttacacgccatggatgttacctctagtcaattaggaaatacaagaaatgtctgtcgtaaatattatatacatcctgcaattattaaaaactacgaagaaggtaccattgtcaactattttgaatctcctaaaaaaaagaaacaaattttaagtcacttcacacccatggaaagcgctttaatgcgacttttaaaatcatatcagccagaattttaa

SEQ ID NO: 25300 - protein, 144 aa, Unknown
  Obtained from environmental sample
  SIGNAL (1)...(17)
  misc_feature (1)..(144): Xaa is any amino acid
MKKFLVGSCFSITMLMGKNKKVDSAMLNKYLQDLSGTLFTAKDFRTWAASIICFETLKELGYTEDPKLNKEHILHAMDVTSSQLGNTRNVCRKYYIHPAIIKNYEEGTIVNYFESPKKKKQILSHFTPMESALMRLLKSYQPEF

SEQ ID NO: 25301 - DNA, 324 bp, Unknown
  Obtained from environmental sample
  misc_feature (1)..(324): n is a, c, g, or t
atgataataatagatatacctaacgagttcacaaggacaccaggttggcgtacttatgatgatggtcctttttcaggacaacaattttatgatgacttactaaaagaaaggtttgaagatgcaaaaagtaaagatgtaaaactcaaagttattttagatggttctaatggttatacgacatcctttttaaacgaagcattccgtttgttgggtggtgcatttggcgcaaatgaagtttgggagcgattagtaattgtatctaatgaggtgccgaaatatattgaacgtataaaaaagggggtctatgcaatggaaaaaaaataa

SEQ ID NO: 25302 - protein, 107 aa, Unknown
  Obtained from environmental sample
  misc_feature (1)..(107): Xaa is any amino acid
MIIIDIPNEFTRTPGWRTYDDGPFSGQQFYDDLLKERFEDAKSKDVKLKVILDGSNGYTTSFLNEAFRLLGGAFGANEVWERLVIVSNEVPKYIERIKKGVYAMEKK

SEQ ID NO: 25303 - DNA, 336 bp, Unknown
  Obtained from environmental sample
  misc_feature (1)..(336): n is a, c, g, or t
atgcaatggaaaaaaaataagtggcaactattaatagcattcttagcaggtgttctaatttgttttattaccacacgatttcactattttgaaattaaaaaagaacttgacttaccgggtttaattattggtggtctgggtcttgtaattggtttatatattgctgatacaattcaaaaaagaattaaccgcaatcaaaacagatattcatatttagaatctaaagtagatagctgttggactgaatttactaacattgcaaaggttatcagtattagtgataacatagcagttgaatccataaccagattaactacggaagtatctctcaaatag

SEQ ID NO: 25304 - protein, 111 aa, Unknown
  Obtained from environmental sample
  misc_feature (1)..(111): Xaa is any amino acid
MQWKKNKWQLLIAFLAGVLICFITTRFHYFEIKKELDLPGLIIGGLGLVIGLYIADTIQKRINRNQNRYSYLESKVDSCWTEFTNIAKVISISDNIAVESITRLTTEVSLK

SEQ ID NO: 25305 - DNA, 462 bp, Unknown
  Obtained from environmental sample
  misc_feature (1)..(462): n is a, c, g, or t
ttgaataatagagaagcatatcaaattcaattttattcttattttgaaagtaatgctgataaaaaaatcaatctaaaaaaacatattttagaaaacgaactttggaatcaacttagaatttctccaaaaaatttgcctgttggcgaattacaaattataccttcttttgaatttttagggttacatcacaaagaatttaaagcattttctgcgattgcttctttagaagagcaaggagcttttttaatttacactataaattatccgaagttagacagaacgctatctataaaagtaactaaagattttccaaatacaattgaatcttgggaagaaacattttctagtcgtggaaaaatattgactacaaaagctgaaaaaattacaacaatacaatctgcttattggagtaaaaacggagttgcagatattaaggaacgaaaagaattgggtttagactaa

SEQ ID NO: 25306 - protein, 153 aa, Unknown
  Obtained from environmental sample
  misc_feature (1)..(153): Xaa is any amino acid
MNNREAYQIQFYSYFESNADKKINLKKHILENELWNQLRISPKNLPVGELQIIPSFEFLGLHHKEFKAFSAIASLEEQGAFLIYTINYPKLDRTLSIKVTKDFPNTIESWEETFSSRGKILTTKAEKITTIQSAYWSKNGVADIKERKELGLD

SEQ ID NO: 25307 - DNA, 450 bp, Unknown
  Obtained from environmental sample
  misc_feature (1)..(450): n is a, c, g, or t
atgaaaaaacatattataacattactagttttagtgttttcttttagtgcaattgcacaaaaagataaaataaaacaacacgaaaaacttaaagctttaaaagtagcacacattacagagcagttagatttttcctccaaggaagcagaagctttttggcctgtttacaatgactttgaagaacaaaaaaacaaattaagagaagcgtctgacatcaaacgtaaggatattgatgttacaaaattaactaacaaagaagctgaaaccctaattaaggacatgcaagatttggaagacgctagagtaaaaagttataaaatttacgttgataagctttcaaaaataattagttacaaaaaaattgtattactatttaatgctgaacgctcctttaaaagaaaaatgatagaagagtttagaggaagacacaaagacaataataaagactaa

SEQ ID NO: 25308 - protein, 149 aa, Unknown
  Obtained from environmental sample
  SIGNAL (1)...(19)
  misc_feature (1)..(149): Xaa is any amino acid
MKKHIITLLVLVFSFSAIAQKDKIKQHEKLKALKVAHITEQLDFSSKEAEAFWPVYNDFEEQKNKLREASDIKRKDIDVTKLTNKEAETLIKDMQDLEDARVKSYKIYVDKLSKIISYKKIVLLFNAERSFKRKMIEEFRGRHKDNNKD

SEQ ID NO: 25309 - DNA, 708 bp, Unknown
  Obtained from environmental sample
  misc_feature (1)..(708): n is a, c, g, or t
atgctaaaaattagtgtaaatcttacactttttgtttttgttttcatgcctatttctggttttataatttctagaattggtaaaaatttaaaatcaaaatcaacaaaagctcaagaagaatcaggaaaactcatatcaattgtagaagaaagcctaacaggattaaaggttgttaaaagctacaatgcagaatctagttttacaaaaaaattcaataattctgttgaccgtttattaaaattatcaaatagtataggtaacaaaaacaacttagcctcaccaatgagtgaatttatgggtattgttacaattgctattcttttatggtatggaggtaatttagtattagttgaaaaaacactagaaggcgaattatttttagtgtatctactactagcgtataacattttaacaccagcaaaagcaatctctaaagcatcatattctgtaaaaaatggactagctgctgcagagcgagtatttgaaatattagaacaagaggaaactataacagcaaatagtgatgctattgacttaacgggcttttcacacgaaattaatatcaaaaacatcaattttagatacgaagaagaaaatgtgcttaaaaaattcagcttaaaagtacctaaaggaaaatctgttgctcttgtaggacaatctggaagtggaacaagtacaatagctaatttacttgactcgttttcatga

SEQ ID NO: 25310 - protein, 235 aa, Unknown
  Obtained from environmental sample
  misc_feature (1)..(235): Xaa is any amino acid
MLKISVNLTLFVFVFMPISGFIISRIGKNLKSKSTKAQEESGKLISIVEESLTGLKVVKSYNAESSFTKKFNNSVDRLLKLSNSIGNKNNLASPMSEFMGIVTIAILLWYGGNLVLVEKTLEGELFLVYLLLAYNILTPAKAISKASYSVKNGLAAAERVFEILEQEETITANSDAIDLTGFSHEINIKNINFRYEEENVLKKFSLKVPKGKSVALVGQSGSGTSTIANLLDSFS

SEQ ID NO: 25311 - DNA, 579 bp, Unknown
  Obtained from environmental sample
  misc_feature (1)..(579): n is a, c, g, or t
atgaaaaaatcaataataactattattctacttgtatttgttgcaactcaatcttttgcacattacttatggattgaaacaaatccttcaggaaaaattggccaagaacaagaagtaaaggttttttacggagaatatacttacggagttatagaaaaagtaaatggtgaagcatttcctaaagtaaaagacttttcactttggattgtagatgcaaatggagttaaaaagcaactaaaagttactgctaaagaaaatcattatttagcaagttttactccaaaaaataacggaacatatactgttgttttagataatgataaaattgatgttatagattatacacaatatgatttcggaatttttaaaacacattacaactcaagtacaaaagtacaagtaggtgaaaaaatttctgaaactattgcaaacaacaaaaacggaattactgtaaaagatatttctaaaactgttgatgaagttaaactacaagttatatataaaggaaaagctttaaaagacaacgaagtacaaatttacgttgcagatttatggtctaaaactttacttacagattaa

SEQ ID NO: 25312 - protein, 192 aa, Unknown
  Obtained from environmental sample
  SIGNAL (1)...(20)
  misc_feature (1)..(192): Xaa is any amino acid
MKKSIITIILLVFVATQSFAHYLWIETNPSGKIGQEQEVKVFYGEYTYGVIEKVNGEAFPKVKDFSLWIVDANGVKKQLKVTAKENHYLASFTPKNNGTYTVVLDNDKIDVIDYTQYDFGIFKTHYNSSTKVQVGEKISETIANNKNGITVKDISKTVDEVKLQVIYKGKALKDNEVQIYVADLWSKTLLTD

SEQ ID NO: 25313 - DNA, 393 bp, Unknown
  Obtained from environmental sample
  misc_feature (1)..(393): n is a, c, g, or t
atgttgaataaacataacaactctgacactaaagtgttcagagttgttttaattatagaaaacatggtttctacaactatcttcattgtttttctatcctgttattggttttacaatacatctaaaaaagtaaaatacaattctaaaaaaacagaaaactggataaatgaaaacattcaattaacaaaaataatagcagctatattattaattatttcaataatactaaacatctatctatttggttttggagcaggaagcttactgtttattatcgtttttatgacaataggaagcttaataatcatattaactccattaaaactaatccgctataaaagtgttcttctactatttataacctcacttttatttgaacttttcatcttttaa

SEQ ID NO: 25314 - protein, 130 aa, Unknown
  Obtained from environmental sample
  misc_feature (1)..(130): Xaa is any amino acid
MLNKHNNSDTKVFRVVLIIENMVSTTIFIVFLSCYWFYNTSKKVKYNSKKTENWINENIQLTKIIAAILLIISIILNIYLFGFGAGSLLFIIVFMTIGSLIIILTPLKLIRYKSVLLLFITSLLFELFIF

SEQ ID NO: 25315 - DNA, 396 bp, Unknown
  Obtained from environmental sample
  misc_feature (1)..(396): n is a, c, g, or t
ttgtcttgtaaaaatgaggtcaaggaatcaaataaactagaaaatagttttttcaagtttgttctttctgacacgttagcctttggaaaaaatcttggtcgcatatctgaatattctcacaaattaaaagaaaatcaaacctctcttattgctgtaattgttgaaaatcaaatgaaagatggaacaattagaaatgacacttttagtgatggactaaaaacacccttttttggaatttcaaggtatcaagttggaaagcatacattaaaattttctattgaggagaacataatgaccacaaaaaagcttgagaatgattctacggaattagaagttacagatattacttatcgctataatttcgacgtctttgttaacatcaggattatctannnc

SEQ ID NO: 25316 - protein, 132 aa, Unknown
  Obtained from environmental sample
  misc_feature (1)..(132): Xaa is any amino acid
MSCKNEVKESNKLENSFFKFVLSDTLAFGKNLGRISEYSHKLKENQTSLIAVIVENQMKDGTIRNDTFSDGLKTPFFGISRYQVGKHTLKFSIEENIMTTKKLENDSTELEVTDITYRYNFDVFVNIRIIXX

SEQ ID NO: 25317 - DNA, 363 bp, Unknown
  Obtained from environmental sample
  misc_feature (1)..(363): n is a, c, g, or t
atgcaaaacacacgcacatttaaagataaactatttttaatcttaaaaggattaggcatgggagcagctaataaagttcctggtgtatctggtggtgtcgtggcatttgttgcaggtttttacgaagagtttatacactccctacaaaaggtaaatagcactgcttttaaattacttttaaaaggacgctttaaagcgttttatcattatataaatggacgttttttaagcttactgttttttggaatgatagtaagctattttagtatttcaaaaatcctagactatcttattacgcactaccaactctatgtttggagtgtctttttcgggatgattatagttcgattattacataagtaa

SEQ ID NO: 25318 - protein, 120 aa, Unknown
  Obtained from environmental sample
  misc_feature (1)..(120): Xaa is any amino acid
MQNTRTFKDKLFLILKGLGMGAANKVPGVSGGVVAFVAGFYEEFIHSLQKVNSTAFKLLLKGRFKAFYHYINGRFLSLLFFGMIVSYFSISKILDYLITHYQLYVWSVFFGMIIVRLLHK

SEQ ID NO: 25319 - DNA, 387 bp, Unknown
  Obtained from environmental sample
  misc_feature (1)..(387): n is a, c, g, or t
atgaagccgagcaagcttataattatgcccttcatcttgataaaaacaacaacacagcacaaggtaatcttgctatgttgtacttacttacagaacgtgagatgcaaggggctcaaatacttaatcagcttgataaacagcgccaaagtaatccttattaccatatatcacttggtaataccgagtacgtacataaatattacgctaaagcactcaaacactttaaaaaggcctatacattatcccccacacttcacgaaagtcattttggcttggcgcgagtttattttcagtggggcgatacaaagcaagcaaagtaccatttacgcaaagccggaaaaaatgctgattttacacatgacaaaaaacgttatgacgcaaagttaa

SEQ ID NO: 25320 - protein, 128 aa, Unknown
  Obtained from environmental sample
  misc_feature (1)..(128): Xaa is any amino acid
MKPSKLIIMPFILIKTTTQHKVILLCCTYLQNVRCKGLKYLISLINSAKVILITIYHLVIPSTYINITLKHSNTLKRPIHYPPHFTKVILAWREFIFSGAIQSKQSTIYAKPEKMLILHMTKNVMTQS

SEQ ID NO: 25321 - DNA, 513 bp, Unknown
  Obtained from environmental sample
  misc_feature (1)..(513): n is a, c, g, or t
atggtggttcctgaatggaagaataaaatatcaatgaaaacatattctcataatctaaaaaaggaaattttcaggttgattacatccacaaaaaataaagtttacaaaagcatgttttatcagccattgacactgataagattcttattgccacatgctcgttcaaaaggacgttttaatgcaactgaaccagaaccaagaaaaggttcaaaaggaggtcatatacctaactccattagttttcctatttctgatatgattgtagatggtaaactaaaatcagccagcaagcaattaaccgatatatttacagacaaaaaatccctgaacaataaacgcatttccatataccccctctgtggcatccagcgaaattcactgcgagcttgctctcgagctttacacgcagcctgcaccatagcctggtttctcaaaacaacccatagcttgtgctatgcatcggttccttggaaccacacatgggccattccaacagcaaaaatttcaacctaa

SEQ ID NO: 25322 - protein, 170 aa, Unknown
  Obtained from environmental sample
  misc_feature (1)..(170): Xaa is any amino acid
MVVPEWKNKISMKTYSHNLKKEIFRLITSTKNKVYKSMFYQPLTLIRFLLPHARSKGRFNATEPEPRKGSKGGHIPNSISFPISDMIVDGKLKSASKQLTDIFTDKKSLNNKRISIYPLCGIQRNSLRACSRALHAACTIAWFLKTTHSLCYASVPWNHTWAIPTAKIST

SEQ ID NO: 25323 - DNA, 549 bp, Unknown
  Obtained from environmental sample
  misc_feature (1)..(549): n is a, c, g, or t
gtgaaattcgtgtctgaaaatatcgtcttaaaaactgaaaacctttctattggttatcaatctaaaaaaacgcaaaatattgtggcttctaagattgatattgctattgaaaaagggaaattagttgcagttttaggtaaaaacggaatcggaaaatctacattattaagaacggttgctaaagtacaaaaacctttgaatggcgaaattttcatcaaccaaaaaaacatagaaaaatttacgaataaagaactttctacagtgttaagtttggtattaactgaacgtttaccagaaagccaaatgaccgtttttgaactggttgctttaggcagacaaccttatacaaattggatcgattcgctttctaaaactgatttagaaaaaataaattgggctattgagcagactgaaatcagtcatttaagagataaattcttttatgaattgagtgatggtcaattacaacgtgttttaatagcaagagctttggcacaagatacagacattattattttagatgaacccactgctcatttagatttgccn

SEQ ID NO: 25324 - protein, 183 aa, Unknown
  Obtained from environmental sample
  DOMAIN (39)...(183): ABC transporter
  misc_feature (1)..(183): Xaa is any amino acid
MKFVSENIVLKTENLSIGYQSKKTQNIVASKIDIAIEKGKLVAVLGKNGIGKSTLLRTVAKVQKPLNGEIFINQKNIEKFTNKELSTVLSLVLTERLPESQMTVFELVALGRQPYTNWIDSLSKTDLEKINWAIEQTEISHLRDKFFYELSDGQLQRVLIARALAQDTDIIILDEPTAHLDLP

SEQ ID NO: 25325 - DNA, 759 bp, Unknown
  Obtained from environmental sample
  misc_feature (1)..(759): n is a, c, g, or t
ttggaagaaaaattaacaagacttaataaataccttagcgaagctggtttttgctcgcgtcgtgaaggtgataaattaattgatgctggacgtgttacaattaatggcgttgtaccagaaatgggcacaaaagtaagtccaaatgatgttgttgctgtagatggtgaaattattaaaaacaatactgacaagccaatttacttagcttttaacaaacctgtaggtattgtatgtactacagatacctctgttgaaaaagacaatattatagattacataaactatccaaaacgtatttttcctattggacgtttagataagttaagtgatggattaatttttatgaccgacgatggtgatattgtaaacaaaattttacgtgctagtaacaatcatgacaaagagtatattgttactgtagacaaaccaatatcacaaacctttataaacagaatggcaagtggtatttatctagaagatttagatcgtacgactaaaaaatgttcggttaaaaaaatagactcgcataccttcagtattattttaacacaaggtttaaatagacagattagacgtatgtgcgagtatctaacttatgaagtaacctcattaagacgtgttagaatcatgaatattaaattggatgttcctgttggagaatacagagaatttacagaaaaagagctaaaaacactgcatttgcttttagaggattcgaccaagatacacgaagctaaaacagcaaaagatagtcccttn

SEQ ID NO: 25326 - protein, 253 aa, Unknown
  Obtained from environmental sample
  DOMAIN (6)...(51): S4 domain
  misc_feature (1)..(253): Xaa is any amino acid
MEEKLTRLNKYLSEAGFCSRREGDKLIDAGRVTINGVVPEMGTKVSPNDVVAVDGEIIKNNTDKPIYLAFNKPVGIVCTTDTSVEKDNIIDYINYPKRIFPIGRLDKLSDGLIFMTDDGDIVNKILRASNNHDKEYIVTVDKPISQTFINRMASGIYLEDLDRTTKKCSVKKIDSHTFSIILTQGLNRQIRRMCEYLTYEVTSLRRVRIMNIKLDVPVGEYREFTEKELKTLHLLLEDSTKIHEAKTAKDSPX

SEQ ID NO: 25327 - DNA, 642 bp, Unknown
  Obtained from environmental sample
  misc_feature (1)..(642): n is a, c, g, or t
atggctgggaagcaaaagtggacaggtttttacaaaaaagtgaagaatgacgatggtagcagcgaaattctttcgctcgaccttaattctttagaatatagaagtgcaaaaaaagcttctttcggcactttggaaaaaacgaaacctgttgataaagtaacagagcgtttcccaattcttgtggctggagatgataaagcaggcgaattctaccggaaaaatttcggggcaatgttcgcttatgtttcaaaaagaattcctgaaataacggacgaactttacaagattgacgacgcaatgaaagctggtttcggctgggataatggtccgtttgaaatttgggatgccgttggcgttaaaaaaggaattgaacttattaaagaattaggaaaagaaccagccacttgggtaaatgaaatgcttgaagctggcgttgattctttctacactataaaagaaggaaatacttattactacgatattcctcagaaaaaacatgtaaaagttcccggacaggattcatttataattttggacaacatccgcaaaacttccgaagttttcagaaatagcggagttgtggttgaagatttaggcgatgggattttaaatgtggaatttataagcaaaatgaattccgnc

SEQ ID NO: 25328 - protein, 214 aa, Unknown
  Obtained from environmental sample
  misc_feature (1)..(214): Xaa is any amino acid
MAGKQKWTGFYKKVKNDDGSSEILSLDLNSLEYRSAKKASFGTLEKTKPVDKVTERFPILVAGDDKAGEFYRKNFGAMFAYVSKRIPEITDELYKIDDAMKAGFGWDNGPFEIWDAVGVKKGIELIKELGKEPATWVNEMLEAGVDSFYTIKEGNTYYYDIPQKKHVKVPGQDSFIILDNIRKTSEVFRNSGVVVEDLGDGILNVEFISKMNSX

SEQ ID NO: 25329 - DNA, 672 bp, Unknown
  Obtained from environmental sample
  misc_feature (1)..(672): n is a, c, g, or t
ttgcataaaggtaaaattgacattgtcataaccttcatgggttatgaaactttaataacttcagttgaaattaaaaagaataccaatcaggatttcgttttatatgagtctgtttttaaaatggatgaaatgatcatttcaacacctttcaacaaattacaaagtcataatgtaatgaaagttgaaaatataaaactcgctattagtaatataggcgcaattaacctaactgaaaaaatgtcagccattccagggatttccagtgtttcgacaggcaatggaattgggaaacctgtgatccgaggtttaagtggcaatagagtattagtttatacacaaggcattagatatgaaaatcaacaatttggtgaaaaacacggattaggaattaatgaaagtggtattgaaaatgttgaaattattaaaggtcctgcttctttactttacggtagtgatgctctcggaggcgtgatttatttagtgccagaaaaatttgaaaattctaataaaaccacttcaaatttaagttcaacttttcaaagcaatactataggttttaataatagtttaggtgttaaaaccactaaaaataaatataaatttctcgccagagctacttacaatacacaatctgattacaaaacgggagaaggcatcagggttttcaattcc

SEQ ID NO: 25330 - protein, 224 aa, Unknown
  Obtained from environmental sample
  misc_feature (1)..(224): Xaa is any amino acid
MHKGKIDIVITFMGYETLITSVEIKKNTNQDFVLYESVFKMDEMIISTPFNKLQSHNVMKVENIKLAISNIGAINLTEKMSAIPGISSVSTGNGIGKPVIRGLSGNRVLVYTQGIRYENQQFGEKHGLGINESGIENVEIIKGPASLLYGSDALGGVIYLVPEKFENSNKTTSNLSSTFQSNTIGFNNSLGVKTTKNKYKFLARATYNTQSDYKTGEGIRVFNS

SEQ ID NO: 25331 - DNA, 702 bp, Unknown
  Obtained from environmental sample
  misc_feature (1)..(702): n is a, c, g, or t
ttgtctataatgaattataacgtccgtttatttaatctttatgattggataccagaaaaggatatagatttaaagttagtacaatttgttaaggagcaaagtccgcaaattttatgtattcaagagtatcatcctcaggataatattgatttttcgttttataaatttaattatcaaaaactagaaggtaaaaaaactaaattaggtcaagctattttttctcaatatccaattattaattcgggttctgttaattttcctaatacagccaataatgccatatttgcagatatagttaaaggtaaagatactgtcagagtttataatttacatctgcaatcgctaaggattgatcctagagttcaaagcttaacgaccgaaaattctgaaaaattattaaacggaatcggaaagaccttcaagcttcaacaaacgcaaaccgagttgtttttagagcacaagaaaaaaagtccttataaagtcattatttctggagactttaacaattctgctttttcatatgtttacaatgctataaaggatgatatgaaagacacctttaagcaacagggtaatggttttggacgttcttataattctaaattttttccattaaggatagactttatattagtagataaatcatggacagtcaatagttttaagacctttgatgtggagtttcggaccactatcctataa

SEQ ID NO: 25332 - protein, 233 aa, Unknown
  Obtained from environmental sample
  DOMAIN (1)...(232): Endonuclease/Exonuclease/phosphatase family
  misc_feature (1)..(233): Xaa is any amino acid
MSIMNYNVRLFNLYDWIPEKDIDLKLVQFVKEQSPQILCIQEYHPQDNIDFSFYKFNYQKLEGKKTKLGQAIFSQYPIINSGSVNFPNTANNAIFADIVKGKDTVRVYNLHLQSLRIDPRVQSLTTENSEKLLNGIGKTFKLQQTQTELFLEHKKKSPYKVIISGDFNNSAFSYVYNAIKDDMKDTFKQQGNGFGRSYNSKFFPLRIDFILVDKSWTVNSFKTFDVEFRTTIL

SEQ ID NO: 25333 - DNA, 687 bp, Unknown
  Obtained from environmental sample
  misc_feature (1)..(687): n is a, c, g, or t
atgaaaaaaatccttgtaacaggttcaaacggacaactaggatcatgtttaaaaataaaatctaaagaacaagacactttagattgtgtttttatagatagtaaagggttagatgttactaatgtcaaccagattaataaagtttttagtgaaaacaactttgattactgtattaattgtgctgcatatacagcagttgaccaagcagaagacgatagtgatatagcttataatataaatactttaggagctaaaaatttagctgaagcctctaaaaaatttaaagtaattttaattcatatttcaacagattttgtttttaacggtaaagcggaaacgccatacaaagaaacagataccacaaaccctttaggtgtttacggatctactaaattgcaaggagaacatgaaatccgatttatactaagcgactattatataattagaacttcttggttatatcctgaatttaaaaataatttggtaaaaacgatgctaaatctagcatcaaaaagaagtgaattaagtattgttaatgatcaaaaagggactcctacaaatgcaaacgatttatcagaagctattgtaaaggtaattaatagcgataaaaaagcatgtgggctatatcattttagtaccttaggtgaaacaacgtggttaaattttgcgaataagatattgaattaa

SEQ ID NO: 25334 - protein, 228 aa, Unknown
  Obtained from environmental sample
  DOMAIN (4)...(224): NAD dependent epimerase/dehydratase family
  misc_feature (1)..(228): Xaa is any amino acid
MKKILVTGSNGQLGSCLKIKSKEQDTLDCVFIDSKGLDVTNVNQINKVFSENNFDYCINCAAYTAVDQAEDDSDIAYNINTLGAKNLAEASKKFKVILIHISTDFVFNGKAETPYKETDTTNPLGVYGSTKLQGEHEIRFILSDYYIIRTSWLYPEFKNNLVKTMLNLASKRSELSIVNDQKGTPTNANDLSEAIVKVINSDKKACGLYHFSTLGETTWLNFANKILN

SEQ ID NO: 25335 - DNA, 633 bp, Unknown
  Obtained from environmental sample
  misc_feature (1)..(633): n is a, c, g, or t
gtgttcaggcaaatacggaacaggccgttattcatttttgagatggctactttaaaaatctatgcagagaaagatggtaaaaagagcagaacaatagccactgagtttttcaaatttgatcctaatagaaccctcacgttgcaaaccaactatgctgatgcctacagtgctggtggccctaatactttaattgacggaattaagggcactaaagaccacagaacgggcttatggcaaggttatgaaggtgaagacgtgatagcaattgtcgatttaggcgaagcacatcacctccaaaaagtctctctcaatgtgttgcaggaccaacgctcttggatattctacccctcggaagtattttgttacacttctactgatggtcaaacctttcaatttattggcaagcaaaacttaaatgccagcaaaagatccgaagacgtcaacattaaaacagtaacatttgatttaaaagacaaaaccgccacccatattaaagtcatcgccaaaaagctggacaaacttcctaaatggcaccccggcgctaaggacaagggtaatagctggatttttgtggatgagattagtattaaatcgacccctgttgtggatagtttacagaccacaaaaaattag

SEQ ID NO: 25336 - protein, 210 aa, Unknown
  Obtained from environmental sample
  misc_feature (1)..(210): Xaa is any amino acid
MFRQIRNRPLFIFEMATLKIYAEKDGKKSRTIATEFFKFDPNRTLTLQTNYADAYSAGGPNTLIDGIKGTKDHRTGLWQGYEGEDVIAIVDLGEAHHLQKVSLNVLQDQRSWIFYPSEVFCYTSTDGQTFQFIGKQNLNASKRSEDVNIKTVTFDLKDKTATHIKVIAKKLDKLPKWHPGAKDKGNSWIFVDEISIKSTPVVDSLQTTKN

SEQ ID NO: 25337 - DNA, 516 bp, Unknown
  Obtained from environmental sample
  misc_feature (1)..(516): n is a, c, g, or t
atgaatattaccaaagaaaatatcgacgagttaaatgccattgtaaaaattgacattactcaggatgattaccaaaataaagtagacgaaattttaaaagattatcgtaaaaaagctaatattcctggttttcgaaaagggcatgtaccgatgagcttagtaaaaaagcaatatgctaaacctgtaatgattgatgaggtaaataaattattacaagaatcattaagtaaatttttggttgaggaaaaattagatgtattaggtaatccattgccaaaggcacaagacgatttttcctgggaagctaatgcattttcatttgaatttgaactgggcttagcacctgagttcgaagtgaacttacaaactaaaaaggcaattacacaatacaaaattacggcagataaaaaaatgttggatgaccaggctgccaatattcaggagagctatggtaaaataatttcgcaaatcgaaattgctgataacttcaaatgttaccggaaactttgtccatga

SEQ ID NO: 25338 - protein, 171 aa, Unknown
  Obtained from environmental sample
  DOMAIN (1)...(153): Bacterial trigger factor protein (TF)
  misc_feature (1)..(171): Xaa is any amino acid
MNITKENIDELNAIVKIDITQDDYQNKVDEILKDYRKKANIPGFRKGHVPMSLVKKQYAKPVMIDEVNKLLQESLSKFLVEEKLDVLGNPLPKAQDDFSWEANAFSFEFELGLAPEFEVNLQTKKAITQYKITADKKMLDDQAANIQESYGKIISQIEIADNFKCYRKLCP

SEQ ID NO: 25339 - DNA, 675 bp, Unknown
  Obtained from environmental sample
  misc_feature (1)..(675): n is a, c, g, or t
atgccaagaatcagtactattgataagcttcaagctaaaatagaaaaggatatcgcttggagaaagaaagagtgtgcagatatcttcgctatcaactctctccaaacagagtataaccagaaggtgagtataaaagcttcagtagttattttatactcacattgggaaggctttgtgaagaaggcctcagcattttacttagactttctatctagtcaacgattgaagtacagggacttagacgagaggtttattatccattacattagtcaagcatactgcgatataaatactaagttcacaaagtctcttatatacgatatccatttccaagataagattggtcatgcagaggatgtctttaaagtcgacggcttcacagagctgaataagttttctaacataaacagcgagcaattctttgacatacttagaaccatttgcatagacgagagtagtccagcagtcaagtactttgacctaaagagaaatttcttagatgagacaatagtagggaaaagaaactcaatagcccatggcaattacacagacatagactttgagatgtatcagaacatgcatgaggtcatcatggaaatgttgaaccgatactcaacgttactactagacatagcagaaaataaagaatacttgagggagccacaagaagcctag

SEQ ID NO: 25340 - protein, 224 aa, Unknown
  Obtained from environmental sample
  misc_feature (1)..(224): Xaa is any amino acid
MPRISTIDKLQAKIEKDIAWRKKECADIFAINSLQTEYNQKVSIKASVVILYSHWEGFVKKASAFYLDFLSSQRLKYRDLDERFIIHYISQAYCDINTKFTKSLIYDIHFQDKIGHAEDVFKVDGFTELNKFSNINSEQFFDILRTICIDESSPAVKYFDLKRNFLDETIVGKRNSIAHGNYTDIDFEMYQNMHEVIMEMLNRYSTLLLDIAENKEYLREPQEA

SEQ ID NO: 25341 - DNA, 591 bp, Unknown
  Obtained from environmental sample
  misc_feature (1)..(591): n is a, c, g, or t
ttgactcggctcgantgtgctgatggcttacagcctataaaacttacaaacatgaaaaattcggtattgttagtgttggatataatgatgccaaaaaaagacggatttacactggcagaagaaataagaaaagaagatcctgcaattccaataatttttttaaccgccaaatcacaaacagaagacgtagtacacgggtttaccattggaggtaatgattatttaaaaaaaccattcagcatggaagagctcattgtacggatcaatgcgctattaaatagaaataaaaatataaatgatcctatcaagctggggaattatttattcaatcttaagaaacaaacgcttcaaattaattctgaaattgaaactttaacacacagggaagcacatttactgtatcacttaattaagaatcaaaatgaagttttagaacgttcttttattttaaaaaaattatggggcgatgatgattttttcaatgcgcgtagtatggatgtatttattactaaacttcgaaaaaaactaaataaagacgacacccttcaaatagtaaatgtacgtggttatggttataaattaatatgttaa

SEQ ID NO: 25342 - protein, 196 aa, Unknown
  Obtained from environmental sample
  DOMAIN (2)...(96): Response regulator receiver domain
  misc_feature (1)..(196): Xaa is any amino acid
MTRLXCADGLQPIKLTNMKNSVLLVLDIMMPKKDGFTLAEEIRKEDPAIPIIFLTAKSQTEDVVHGFTIGGNDYLKKPFSMEELIVRINALLNRNKNINDPIKLGNYLFNLKKQTLQINSEIETLTHREAHLLYHLIKNQNEVLERSFILKKLWGDDDFFNARSMDVFITKLRKKLNKDDTLQIVNVRGYGYKLIC

SEQ ID NO: 25343 - DNA, 360 bp, Unknown
  Obtained from environmental sample
  misc_feature (1)..(360): n is a, c, g, or t
ttgctttttaatattttaacgtgtatgattttaattgccgatagcggatcgacaaaatgtgattggatagctgtagatgaaaacggcatattaccgattcaaaaaattagaaccaaaggtcttaatccagctattttaactgcggaagaacttcaagaaattataagtcattctgaagctctaacaactcttaaaaataagattaccaaaatatattttcatggtgctggctgcggaacagaaattcctaaagtgcttttaaaaacggtcttagaaaggttattcactaaagttaaagttagcgtgaaagagatactatgcgtgtatttatgcggcaattaccaagaagatgaagtgggn

SEQ ID NO: 25344 - protein, 120 aa, Unknown
  Obtained from environmental sample
  misc_feature (1)..(120): Xaa is any amino acid
MLFNILTCMILIADSGSTKCDWIAVDENGILPIQKIRTKGLNPAILTAEELQEIISHSEALTTLKNKITKIYFHGAGCGTEIPKVLLKTVLERLFTKVKVSVKEILCVYLCGNYQEDEVG

SEQ ID NO: 25345 - DNA, 744 bp, Unknown
  Obtained from environmental sample
  misc_feature (1)..(744): n is a, c, g, or t
ttgggtcttaaaaatatcaaaaaggtcttggagctattacctgcattgaatagggacaaacgtgatgatgacctattggataggctatatgacaagactttggaactatggctcgatgaaatgaagcacgtcacatccttaatcgggggggttaccgtttataataaggctggatttcaaaagggagatgtttttgaacctacgcccatcgatgaacaaagaagagcgttgaaatttttgattgaaaatgcttttttagtaccggattggctgagtagcccaagttttgtgaatagactttcctattccacaggttcggacatactcatgatccatcaaatcaatttattatcggatgtgttgaacgtgcaaagaatgcgaaggttggaatttatggaaaagcgaccggaatatcgaaattttatagcaccactcctagcggaactacaagctggccttttccatgaattacatgaaaaggaaatccaaatatcaaaacgtcgacaagagttgcagttggaatatatcacgttattgataaatcacttgaaatcggagacaaattatgattatataaaagtgctacaattaggacgtagcacaagccagtctctcaaaagtacttacgccgaaaatttgcgggaccttgcgaaacaaattcaatctgcgctaaagaaaatcgaaggtggtaataacaaggaacatttaaaaatatgtctagtgaaaatcgatcctgatttatag

SEQ ID NO: 25346 - protein, 247 aa, Unknown
  Obtained from environmental sample
  misc_feature (1)..(247): Xaa is any amino acid
MGLKNIKKVLELLPALNRDKRDDDLLDRLYDKTLELWLDEMKHVTSLIGGVTVYNKAGFQKGDVFEPTPIDEQRRALKFLIENAFLVPDWLSSPSFVNRLSYSTGSDILMIHQINLLSDVLNVQRMRRLEFMEKRPEYRNFIAPLLAELQAGLFHELHEKEIQISKRRQELQLEYITLLINHLKSETNYDYIKVLQLGRSTSQSLKSTYAENLRDLAKQIQSALKKIEGGNNKEHLKICLVKIDPDL

SEQ ID NO: 25347 - DNA, 711 bp, Unknown
  Obtained from environmental sample
  misc_feature (1)..(711): n is a, c, g, or t
atgaagacaaaagcaaagcgggaattgttattagatacggtaatagaaatgtttcctgaaatcacttcgcttcagtatgtaataaatgaaaaaggaaacgataccatttacgatcaggaagttgtttgctataaaggtcgtgaccatatttttgagcaaatggaagggcttcagtttaaaataaacgcaaaatccttttaccaaaccaattcggcccaggcttacgaattataccaaataacccgggattttgccgatttaaaaggagacgaaatagtttacgatctttatacaggaaccggaactatcgctcaatttgttgcaactaaagctaaaaaagtaattggggttgaagttgtaccagaagccattattgatgccaaagaaaacgcaggacgcaaccaaattgaaaatgccgagttttttgtaggcgatatgaaaaaagttttttctaaagaatttatcaataatcatggtcagccagacgttataattaccgatcctccacgggacgggatgcacaaggacgtaattgctcaaataattggtatattgccacaacgcattgtttatgtgagttgcaactcggccacacaggcccgcgatctctctatgttagatgaatattataaggttacaagggtacagccggtagatatgtttccacaaacccatcacgtagaaaatgttgtttgtttagaaagaaaataa

SEQ ID NO: 25348 - protein, 236 aa, Unknown
  Obtained from environmental sample
  DOMAIN (5)...(236): tRNA (Uracil-5-)-methyltransferase
  misc_feature (1)..(236): Xaa is any amino acid
MKTKAKRELLLDTVIEMFPEITSLQYVINEKGNDTIYDQEVVCYKGRDHIFEQMEGLQFKINAKSFYQTNSAQAYELYQITRDFADLKGDEIVYDLYTGTGTIAQFVATKAKKVIGVEVVPEAIIDAKENAGRNQIENAEFFVGDMKKVFSKEFINNHGQPDVIITDPPRDGMHKDVIAQIIGILPQRIVYVSCNSATQARDLSMLDEYYKVTRVQPVDMFPQTHHVENVVCLERK

SEQ ID NO: 25349 - DNA, 663 bp, Unknown
  Obtained from environmental sample
  misc_feature (1)..(663): n is a, c, g, or t
atgaaatctataaaagagtgtttaatagcttcaagttttgacgttgatctattggttatgtcttccgcgtttagtacaataactggaaaaataaaatgctatttatcttactattataatttattgacatttaaaaactacgaaagttatgactacgtttatataaataattatccgcattcatttttaccattaatatttaattttaataaaatgaataaagtaattattcattggcatggtgatgatattgaaagtgttggccaatttaagaagatttttaataaaatttcttatgcatttattccaaaaaaagcattgcatttttcaccttcaaactattttgcttataatattaatgaaaaattaggagtggataaagaagctatttttgtaacgcctagtggaggtgtagatgttaatgtttttaagcctttaaacgcaattaaagagcgtcataatacgaaagtaaagattggtttctcttctcatttatcctcggaaaaaggtcttgatttaataatagaagttttaaataatgccgcaaacttacagtttaatagggaggtagtacttgaatttcattatattaaatatggagcagataaggagaaatattctaaaattttaaagtctattgtgaatacggttgacactcggtga

SEQ ID NO: 25350 - protein, 220 aa, Unknown
  Obtained from environmental sample
  misc_feature (1)..(220): Xaa is any amino acid
MKSIKECLIASSFDVDLLVMSSAFSTITGKIKCYLSYYYNLLTFKNYESYDYVYINNYPHSFLPLIFNFNKMNKVIIHWHGDDIESVGQFKKIFNKISYAFIPKKALHFSPSNYFAYNINEKLGVDKEAIFVTPSGGVDVNVFKPLNAIKERHNTKVKIGFSSHLSSEKGLDLIIEVLNNAANLQFNREVVLEFHYIKYGADKEKYSKILKSIVNTVDTR

SEQ ID NO: 25351 - DNA, 762 bp, Unknown
  Obtained from environmental sample
  misc_feature (1)..(762): n is a, c, g, or t
gtgtatcatcaggatacctcagacattatagaagatcaaggtgtaaaaattcatgtaatttctaaaaagacatcaccattatttacatggtatttttatagaaagcgcctgcaaaattatattaattctgttgtagaaacacagaagatagatgtaatagaagcacctgattggacaggtattacagcttttatgaagctaacagcacctgtagtcattaagcttcatggtagtgatgcttacttttgcaagctagaggaaagacgtcagaaatttaaaaattttgtttttgaaaaattagcactacaatcagctactgcttacatcgctccaactacctttgcaggagaagttactgctaagattttcggtttaaaccgaaaaaaaataaagacgattcataatggagtacaactagattattttaataattatacacctgaaatttacgaccctaaaacgttaatatatgttggaacgattatcagaaaaaaaggtgttttggagctagctgaaatctttaatgcaattttagagacagaacctaacgctaaattaaaattaataggaggtgatgcttcagacataaaaacaggacaaacatctacttatgctttaatgcaatctatcttttcagatcaagctaaacaaaatgtagagtatttgggtaaaataccttacagcgatgttaaagcacatattaaaaaagcccatgtctgtacttttcctgttttgacagactcgaccgatcttgatccatag

SEQ ID NO: 25352 - protein, 253 aa, Unknown
  Obtained from environmental sample
  misc_feature (1)..(253): Xaa is any amino acid
MYHQDTSDIIEDQGVKIHVISKKTSPLFTWYFYRKRLQNYINSVVETQKIDVIEAPDWTGITAFMKLTAPVVIKLHGSDAYFCKLEERRQKFKNFVFEKLALQSATAYIAPTTFAGEVTAKIFGLNRKKIKTIHNGVQLDYFNNYTPEIYDPKTLIYVGTIIRKKGVLELAEIFNAILETEPNAKLKLIGGDASDIKTGQTSTYALMQSIFSDQAKQNVEYLGKIPYSDVKAHIKKAHVCTFPVLTDSTDLDP

SEQ ID NO: 25353 - DNA, 306 bp, Unknown
  Obtained from environmental sample
  misc_feature (1)..(306): n is a, c, g, or t
atgatgtttagttttaagttagtcaacgatggtaaggttattttttacgaacttgncggaattagacaagtggatgacaccttaatttttcagcttaaacattttggtaacgactttaaaggttgggaagaaaaggacgaaactgtagatgctaaattgataaaaatagatagcaatcgtgcatattttgatcaatttacatttgaaagaataagtgataccgaaattaatatctacgttgtaattgaagaaaatggacaaactgaagaagtaaaatttaactacaaaaagactaatgacttttaa

SEQ ID NO: 25354 - protein, 101 aa, Unknown
  Obtained from environmental sample
  misc_feature (1)..(101): Xaa is any amino acid
MMFSFKLVNDGKVIFYELXGIRQVDDTLIFQLKHFGNDFKGWEEKDETVDAKLIKIDSNRAYFDQFTFERISDTEINIYVVIEENGQTEEVKFNYKKTNDF

SEQ ID NO: 25355 - DNA, 348 bp, Unknown
  Obtained from environmental sample
  misc_feature (1)..(348): n is a, c, g, or t
atgaaaaaaatatttcttttattaattattgtttttgtgagttgttcagacgatcctaaagaattttcagaagaagcaaacctagagatgttaattggtttggaggattctaaaattacgttgagagaagttttatatcaacaaaaagggaaaaaaatatttattgatgtttgggcttcttggtgtaaagattgtattgcaggttttcctaaagtaaaggaattacagaaagaatttcctgatgttgcttttttatatttatctgtagatattagcaatccttcttggaaaagagccattgaaaaatataatttagttggtgagcattataattaccaaaagggatga

SEQ ID NO: 25356 - protein, 115 aa, Unknown
  Obtained from environmental sample
  SIGNAL (1)...(16)
  misc_feature (1)..(115): Xaa is any amino acid
MKKIFLLLIIVFVSCSDDPKEFSEEANLEMLIGLEDSKITLREVLYQQKGKKIFIDVWASWCKDCIAGFPKVKELQKEFPDVAFLYLSVDISNPSWKRAIEKYNLVGEHYNYQKG

SEQ ID NO: 25357 - DNA, 438 bp, Unknown
  Obtained from environmental sample
  misc_feature (1)..(438): n is a, c, g, or t
atggaaaacagtatagtttttgaaactacaattgaagcatcaacagaaaaagtatgggagacacttacaaatcccgataaaatcgaacaatatatgtttggctctcgctgcgacagtaactggacaccgggaagcaaagctaattactacattaagcaaaatggtaaagaagttactgtagtaaagggagaagtgatacgggttatacctaacaaattattagaacacactatattcccctcaaaatctggcattgaagatacattagaaaactatatcgttattatttacgaattagaagaagaagatagcaaaacagaattgaccatcactcagaaaggctttaaatacgtcgagaacggtcaagaacgatacatagatacccaaaaaggttggaaggctgtactcccgaaattaaaggaaactgctgaaaaataa

SEQ ID NO: 25358 - protein, 145 aa, Unknown
  Obtained from environmental sample
  misc_feature (1)..(145): Xaa is any amino acid
MENSIVFETTIEASTEKVWETLTNPDKIEQYMFGSRCDSNWTPGSKANYYIKQNGKEVTVVKGEVIRVIPNKLLEHTIFPSKSGIEDTLENYIVIIYELEEEDSKTELTITQKGFKYVENGQERYIDTQKGWKAVLPKLKETAEK

SEQ ID NO: 25359 - DNA, 306 bp, Unknown
  Obtained from environmental sample
  misc_feature (1)..(306): n is a, c, g, or t
ttggatattggttatttttgtaagcaattatttctaatagagtctgacaaaagccaatacgaactgaaagttcaaagttttttaaaaggatatcataaaattaaaaaattatcggataaggaacaaaaattaataccaaaagctggaacatcagtttttgtgttttatcttggaatacaagcacaaagatttgattggtctaatatatttttatcagaaaattatttgaaaatgtttgttgggagaataaaatcttggaatgaatattacgagcggaaagaaataactgtggctaacaccgtataa

SEQ ID NO: 25360 - protein, 101 aa, Unknown
  Obtained from environmental sample
  misc_feature (1)..(101): Xaa is any amino acid
MDIGYFCKQLFLIESDKSQYELKVQSFLKGYHKIKKLSDKEQKLIPKAGTSVFVFYLGIQAQRFDWSNIFLSENYLKMFVGRIKSWNEYYERKEITVANTV

SEQ ID NO: 25361 - DNA, 309 bp, Unknown
  Obtained from environmental sample
  misc_feature (1)..(309): n is a, c, g, or t
atgaatagacttctaattttacttttttcaatatttttaattagttgttacaatgaatcaaagttgttgaataacggcctgactcaaaaagcaaaacaaattaccgaatacacaattaaagttgaaaatgattctctgaataataagattcaagacacgcttgtaattaccgaaaagaaatacaacgaaaataaccaaataatcagcagacatcaacggaatttatttgctgacgaaacaatggatattgaattcatttacaataataggaaaaaaataaaaagagaaattgtgacgctttcaaaatga

SEQ ID NO: 25362 - protein, 102 aa, Unknown
  Obtained from environmental sample
  SIGNAL (1)...(18)
  misc_feature (1)..(102): Xaa is any amino acid
MNRLLILLFSIFLISCYNESKLLNNGLTQKAKQITEYTIKVENDSLNNKIQDTLVITEKKYNENNQIISRHQRNLFADETMDIEFIYNNRKKIKREIVTLSK

SEQ ID NO: 25363 - DNA, 534 bp, Unknown
  Obtained from environmental sample
  misc_feature (1)..(534): n is a, c, g, or t
ttgactcggctaataatacctggcgtaaatacacttntatgtagttggagaaaaacactatntagtagtgcattaactttaaataaaaatttagtttgtaatcaaatgattctcgataagcctatcgatattagtataaatgaacagattattgaattaaaaaccaaacatcaaaaaactgaattgtttgatttagttaatatgattcaacctggttattttaacaataaaacatctgatttaggaaagtatttcggaatatataaaaacgaaaaactaattgctgtaacgggagaaagaatgaaaatgaatgaattcacagaggtaagtgctattgttactcatcctgaacatactgggaaaggttatgcaaaacaattaataaaacaaattacaaatcaaatatttaatgaaaataaaattccttacttacatgttgctgaatcaaatattggagcaatcaagctttatgaaaaactaggatttacgacaagacggaaaataagtttttggaatttcaaacagcataaataa

SEQ ID NO: 25364 - protein, 177 aa, Unknown
  Obtained from environmental sample
  DOMAIN (85)...(163): Acetyltransferase (GNAT) family
  misc_feature (1)..(177): Xaa is any amino acid
MTRLIIPGVNTLXCSWRKTLXSSALTLNKNLVCNQMILDKPIDISINEQIIELKTKHQKTELFDLVNMIQPGYFNNKTSDLGKYFGIYKNEKLIAVTGERMKMNEFTEVSAIVTHPEHTGKGYAKQLIKQITNQIFNENKIPYLHVAESNIGAIKLYEKLGFTTRRKISFWNFKQHK

SEQ ID NO: 25365 - DNA, 471 bp, Unknown
  Obtained from environmental sample
  misc_feature (1)..(471): n is a, c, g, or t
atgaaaacagatataaatattacagaacttttgggggaaaaagcagccttctatttggatcacgtttgtgaaaaaataaccaaggatgaattgcaaacccccagcaagagcagtcttgacaaggtatttggcaatagcaacagaaatccgcaggtactgcgaagccttgcacaattgtacaaccacggaaacctgggcggtaccggctacctgagtatcctgcccgtggatcaaggtattgaacacagtgcagccttttcattttataaaaatccagactacttcgacccggagaatattataaaactcgctattgaagctggttgcaacggtgtagcatcaacttttggagtccttgggttgaacgctcgaaaatatgcccataaaatttcatttatagttaagattaatcacaatgatttgctcacctaccccaataaatatgacccaaaccttatttgggaaaagtaa

SEQ ID NO: 25366 - protein, 156 aa, Unknown
  Obtained from environmental sample
  misc_feature (1)..(156): Xaa is any amino acid
MKTDINITELLGEKAAFYLDHVCEKITKDELQTPSKSSLDKVFGNSNRNPQVLRSLAQLYNHGNLGGTGYLSILPVDQGIEHSAAFSFYKNPDYFDPENIIKLAIEAGCNGVASTFGVLGLNARKYAHKISFIVKINHNDLLTYPNKYDPNLIWEK

SEQ ID NO: 25367 - DNA, 474 bp, Unknown
  Obtained from environmental sample
  misc_feature (1)..(474): n is a, c, g, or t
ttggaaaaagtagttggagatttgccaacaaattatcatttcaaaaattcaggattactgtttttgactttagttgaatggaaaaaaattaatgagatagagggtataaaattggagcgacaaattggagcagtttttccaataaaaccctcagtttcttatattatatctacttattacaaaaaattaaacattactcaacaaggtaataggctaaccattgaaggagaattacataaaaacatatttgacttattccagaaacatttcggtttaagctatcgtggtaacgagttgtcttttaagttccaaaacgctgaagacttaaaaaataaagtcaaaagattagagaacgagggagttgaacttcctaagccacaggaaagtattttgacttttaattatggaattgggtcttatgagaaacatcaatctgatttaaactttgaggcctatcgtttaaagcaagcttaa

SEQ ID NO: 25368 - protein, 157 aa, Unknown
  Obtained from environmental sample
  misc_feature (1)..(157): Xaa is any amino acid
MEKVVGDLPTNYHFKNSGLLFLTLVEWKKINEIEGIKLERQIGAVFPIKPSVSYIISTYYKKLNITQQGNRLTIEGELHKNIFDLFQKHFGLSYRGNELSFKFQNAEDLKNKVKRLENEGVELPKPQESILTFNYGIGSYEKHQSDLNFEAYRLKQA

SEQ ID NO: 25369 - DNA, 336 bp, Unknown
  Obtained from environmental sample
  misc_feature (1)..(336): n is a, c, g, or t
atgagaaaaattatggggaaactatttgcgcttttacttttcgtcccgatacttttggggatttttggaggttgtgataaaacaccgccaaaaacaggaactctgatggattttgttcccgaaaatgcttctgtggtttttaagatttcaaattttgaaaacttgcaggcagatattgaaaacaattcgctgctttccaaatttggaaaaacgtcgccttattcgtttttttctgaaaaagcaaccttattaaaaaacttacatcccacaacccagagtcttttttgcattaataaagtgaatgattccgttgcggcatatacctttatttcatga

SEQ ID NO: 25370 - protein, 111 aa, Unknown
  Obtained from environmental sample
  misc_feature (1)..(111): Xaa is any amino acid
MRKIMGKLFALLLFVPILLGIFGGCDKTPPKTGTLMDFVPENASVVFKISNFENLQADIENNSLLSKFGKTSPYSFFSEKATLLKNLHPTTQSLFCINKVNDSVAAYTFIS

SEQ ID NO: 25371 - DNA, 861 bp, Unknown
  Obtained from environmental sample
  misc_feature (1)..(861): n is a, c, g, or t
ttgagttatgaagataaattttcaaggtataatcaaagcaacccatacacgccttatgggccgtcattcgaaacatcaaatctagggacttatacaaagctggaagatttcaacgcgaaggcgtatgcagatgtcaacaattccctcattgggaaaattacggcttggccagtttatactgattttaactatggctacaattcggttttaatacttgatgaagaacggattccaaatagaattaaaggaaatataattgaagctggagcggggtatgaaaaggaatatcgtggctttaaactttccggaaaaggcgcgattaatgttgctggcgattttgatggaaactatattcaaggtgcagcttcctatgatctgaataaagaatacaatgcgaaagcatccattacagttcattcagtggcgccaaatttcaacttcctgttgtatcagagcgattaccaaaactacaattggaaaacggagcttaacaatgtaaaaactcaggaattaaagttcgaaattaacaccaaaaaattcggaaatgcttctgtaagttatactggaattgatgattatgcgtactttggaataaaggctaatgacagcacgccttcgccattgcaggcttccgaacgggtggattatttaaaaataaaagctgaaaaagaatttacgtttggggtttttgctttagaaaatacgctgatgtaccaacaagttttgagtggtgaaagcgtttttaatgtgccacaaattattacgcgtaattcactctactatcaagaccattggtttaagcgtgcgctttttatgcaaatagggcttacgcttaaatacttcacaaaattcacctgctga

SEQ ID NO: 25372 - protein, 286 aa, Unknown
  Obtained from environmental sample
  misc_feature (1)..(286): Xaa is any amino acid
MSYEDKFSRYNQSNPYTPYGPSFETSNLGTYTKLEDFNAKAYADVNNSLIGKITAWPVYTDFNYGYNSVLILDEERIPNRIKGNIIEAGAGYEKEYRGFKLSGKGAINVAGDFDGNYIQGAASYDLNKEYNAKASITVHSVAPNFNFLLYQSDYQNYNWKTELNNVKTQELKFEINTKKFGNASVSYTGIDDYAYFGIKANDSTPSPLQASERVDYLKIKAEKEFTFGVFALENTLMYQQVLSGESVFNVPQIITRNSLYYQDHWFKRALFMQIGLTLKYFTKFTC

SEQ ID NO: 25373 - DNA, 300 bp, Unknown
  Obtained from environmental sample
  misc_feature (1)..(300): n is a, c, g, or t
atgagttttgcaaaattaaaccatactttgaaaaaactgctattattcatattgtcattattctttgccaacgcaaatgcacaatcggaatttgatttagaaaaagttttgaaaatcgaaagacgagaaatgattgttatggaaattgactcatatctgaatgaaaaatcagaatatggagaaaagattgagaaactgaattcttcacaacaaacttttctttttgtggaaaatttggaacgtgagataaataatggtggatttaatcaattctattttcaattcaagtggaaattttag

SEQ ID NO: 25374 - protein, 99 aa, Unknown
  Obtained from environmental sample
  misc_feature (1)..(99): Xaa is any amino acid
MSFAKLNHTLKKLLLFILSLFFANANAQSEFDLEKVLKIERREMIVMEIDSYLNEKSEYGEKIEKLNSSQQTFLFVENLEREINNGGFNQFYFQFKWKF

SEQ ID NO: 25375 - DNA, 303 bp, Unknown
  Obtained from environmental sample
  misc_feature (1)..(303): n is a, c, g, or t
atggtggatttaatcaattctattttcaattcaagtggaaattttagtcaagaaacagtagatactcttttagaaattggagcaaaaaaaacggcggaaattataaaaaaagcaaattctgaatttaaaaccggaattgttccaaaagacagaactgaaagacaaaccgaattggaactgattgaaaaaaatgcggaagaaaactggaataaatgcgattcggaattttatgaatataacgatgacttgaccgaattattaattgtttatgcgattaagaaccaaactgaatttcaacaataa

SEQ ID NO: 25376 - protein, 100 aa, Unknown
  Obtained from environmental sample
  misc_feature (1)..(100): Xaa is any amino acid
MVDLINSIFNSSGNFSQETVDTLLEIGAKKTAEIIKKANSEFKTGIVPKDRTERQTELELIEKNAEENWNKCDSEFYEYNDDLTELLIVYAIKNQTEFQQ

SEQ ID NO: 25377 - DNA, 618 bp, Unknown
  Obtained from environmental sample
  misc_feature (1)..(618): n is a, c, g, or t
atgaattttaaagcatggtttgaagatacttttaaaccagaagattttgactattttgagtcatttgaagaggaagttgagacaagaaagcagggggaatatttaaagtggtgtggagataacaggctttttataaatgatttaaatgacgtttgcgtatctgaaattgtctatcaagacattatgactctcccctctttttctcaacaaataaacttcgttttatcgatgcatgaagagcttatgtatcatggaaacttcgatgaattaaagaacgatttttgctatgcgcgttatctaattttttcggctagaaacatacctagtgaccatacacatttcttcaacaaaacatatcctcacgttgatgatatgtcacactccattaccaacctaaaagctagtcattataaaagcgcgttcagaacgctttactcgctatttgataaaattgcttactttatcaatcgcttttttgatctgaatgatatcaagtatgatcataaaatcagctttgacagtatttttagtgagctgaaaggaagtaagagctggaaaccacacagtaagcttaaagacagtcagaattgctttatccatgccttattctacatcctt

SEQ ID NO: 25378 - protein, 206 aa, Unknown
  Obtained from environmental sample
  misc_feature (1)..(206): Xaa is any amino acid
MNFKAWFEDTFKPEDFDYFESFEEEVETRKQGEYLKWCGDNRLFINDLNDVCVSEIVYQDIMTLPSFSQQINFVLSMHEELMYHGNFDELKNDFCYARYLIFSARNIPSDHTHFFNKTYPHVDDMSHSITNLKASHYKSAFRTLYSLFDKIAYFINRFFDLNDIKYDHKISFDSIFSELKGSKSWKPHSKLKDSQNCFIHALFYIL

SEQ ID NO: 25379 - DNA, 822 bp, Unknown
  Obtained from environmental sample
  misc_feature (1)..(822): n is a, c, g, or t
ttgaatcggctcgaggtgctttgcgtaatcttttatttgaggctatgttcttgttatttttttacgaaaccaaaatcggaccaagctgttttagatacgtttaaagaatttgaatcaaagccaactttaacaatcgaaaaatttaaagagtatcgttttagaaaattaacatttataaataatgatacgttgccaaccatggtttttgttcatggaactattggttcatcaaaagattttattgggtatatagtagattctgttttatctaaaaaagcaaattttatcagttatgatagggttggttataattatcaagataagcatgaaacccaagcttctattgcttttgaaagagatttgttacaacatataaccaaagatttaaataaaaaaaagacaattattgtagggtattcttatggaggaccaatagctttggcagataaaaccaagtataaaaaaacaattttaattgcgccagcagtttacagtaatgtagaacctaattttgggtttacaaatatttataaatggaaattaacacgttggctaatcccaaatatttggaaacaagcaggaaaagaaaaattaacacataaagaagatttgagaaaatttgaggatgattggacaaccaataaaaataatattgtaagtattcatggtactaatgatattattgtgccatttgcaaactcaaaattcttagacaaaaaatttcctanaaatcagtttgagttaattaatattccaaatgcaaatcattatttaatttggactgaatctaaacaaattagaaaacaatttttaaatgcttaa

SEQ ID NO: 25380 - protein, 273 aa, Unknown
  Obtained from environmental sample
  misc_feature (1)..(273): Xaa is any amino acid
MNRLEVLCVIFYLRLCSCYFFTKPKSDQAVLDTFKEFESKPTLTIEKFKEYRFRKLTFINNDTLPTMVFVHGTIGSSKDFIGYIVDSVLSKKANFISYDRVGYNYQDKHETQASIAFERDLLQHITKDLNKKKTIIVGYSYGGPIALADKTKYKKTILIAPAVYSNVEPNFGFTNIYKWKLTRWLIPNIWKQAGKEKLTHKEDLRKFEDDWTTNKNNIVSIHGTNDIIVPFANSKFLDKKFPXNQFELINIPNANHYLIWTESKQIRKQFLNA

SEQ ID NO: 25381 - DNA, 315 bp, Unknown
  Obtained from environmental sample
  misc_feature (1)..(315): n is a, c, g, or t
ttgattttgacaaaagtaaatccatacaaagatagcgacttaggaaagaaagaacaggtaactaaaatgtttgataccatttctggtgaatatgatggtttaaaccgagtaatttcttttggaatagatattaaatggcgaaaaaaagtagttgacattgttaaagctactaatccagataatgttttagatattgccacaggaactggtgatttagctattaaccttgctgaaactagcgcaaaaaaaattattggtttagacattagtagtggtatgctagaagttggaaagcttaaaataaaagctaaaaan

SEQ ID NO: 25382 - protein, 105 aa, Unknown
  Obtained from environmental sample
  DOMAIN (13)...(105): ubiE/COQ5 methyltransferase family
  misc_feature (1)..(105): Xaa is any amino acid
MILTKVNPYKDSDLGKKEQVTKMFDTISGEYDGLNRVISFGIDIKWRKKVVDIVKATNPDNVLDIATGTGDLAINLAETSAKKIIGLDISSGMLEVGKLKIKAKX

SEQ ID NO: 25383 - DNA, 837 bp, Unknown
  Obtained from environmental sample
  misc_feature (1)..(837): n is a, c, g, or t
atggacgattctacgaatgacggaaaacgatgctggaggcatatttataaagttgacataaattctggcgaacaaactttggtgacgccctttgattatgatatagcttcgatgcgagttcccaatgagaaacatgtttattatatggcttcacctgccaatagtatgcaacggtatctttttcatacagatataaaagggaaaggaaagcagcagcgtcttacacctgaagagtttgagggggtgaataactataatgtatctccaaatggggcatttgcgattcatagccatcagagtgcgaaaaaagtgagaaccgttaggtttattagtcttccggatcataagcttatcaagacactggttgataatataacctatgaagaacaattagctggcttgtcaatgccagatgttatttttaaacaagtcacaacagaagaaggggtagtgattgatgcaagaatagtgttacccctgaattatgataaagataaaaaatacccagtgctttttcatgtttatggagagccttgggggcaggtggccacagatactcaggtcggcctttggaatatcatgatggcacaaaaaggttatgtgatcatcgacatggataacagagggactccctgcttaaaaggtagtcaatggcggaaaagtatttatagacaggttggaagaataaattcaaaagaccaggcaatggcggncaaagagattctgaaattagattatctggatgaaaatagaacagctgtttggggttggagtggcggaggaactatgaccttgaatttcatgttcacgtatcttgaaattataaaacgggtgtag

SEQ ID NO: 25384 - protein, 278 aa, Unknown
  Obtained from environmental sample
  misc_feature (1)..(278): Xaa is any amino acid
MDDSTNDGKRCWRHIYKVDINSGEQTLVTPFDYDIASMRVPNEKHVYYMASPANSMQRYLFHTDIKGKGKQQRLTPEEFEGVNNYNVSPNGAFAIHSHQSAKKVRTVRFISLPDHKLIKTLVDNITYEEQLAGLSMPDVIFKQVTTEEGVVIDARIVLPLNYDKDKKYPVLFHVYGEPWGQVATDTQVGLWNIMMAQKGYVIIDMDNRGTPCLKGSQWRKSIYRQVGRINSKDQAMAXKEILKLDYLDENRTAVWGWSGGGTMTLNFMFTYLEIIKRV

SEQ ID NO: 25385 - DNA, 324 bp, Unknown
  Obtained from environmental sample
  misc_feature (1)..(324): n is a, c, g, or t
atggatgttaaatactataacaacaacattgatatgcttgtagagctcgctaaaaaatataccctctattatgaaaacttttttgaagttgctgacaattatcaaaaccggattattgaagccataaatgtagcccaagcaaatgggatcatcgaatctaaaaaagataatggacaagagttaacgcctgcacaagtctatgctgagatcataaggaatttaaaagacaagaaagttcagagggataatggcatcagaaatagtatcaacataccagaactgaaacaaaaaatggagagtgttgaagattttaaattaatttaa

SEQ ID NO: 25386 - protein, 107 aa, Unknown
  Obtained from environmental sample
  misc_feature (1)..(107): Xaa is any amino acid
MDVKYYNNNIDMLVELAKKYTLYYENFFEVADNYQNRIIEAINVAQANGIIESKKDNGQELTPAQVYAEIIRNLKDKKVQRDNGIRNSINIPELKQKMESVEDFKLI

SEQ ID NO: 25387 - DNA, 813 bp, Unknown
  Obtained from environmental sample
  misc_feature (1)..(813): n is a, c, g, or t
gtgtacctattgttgtacttgggtactcgtttgcatcgctttgcacacctttataaccagtgcattatgtcttcaataaaactaattttaagaaataacaaagtagataaagcaggggaagcacctctttatataagagtaatcaaagaccgtaaaactaaattcatttcgttaagcctaaaattaaagcctaatgaatgggatgaagataagcaaaaagtaaagaagaatcacagtaattcaacaagactaaatgcttacatatctcaaaaggtagctgatgcaaaaggtgaaattgcagaccttgaaagaaggaaccaatctacaactgcaagaaagctaaaagaggccataaaaggtaaacccttaacaaacttctttgattattcagataatcgttgtgagaagctaaaagacactttagcttactcaacttacaagaactataaaacctatttaaagaagtttgaaaagtttgtagggcatcgtgaattaatgtttgaagatattacagtaaccacgctaaaggattacgcatcctattgcagctctactttaggcaacaacaatacaactataaatttttctttaaagattatgaagattatgtttaaggaagcacaaagagaagatttaatacctttggatttatttccttttaacaagttcacagtaaagaaagaaaagagtacaaaacgctatttatctgcggtacaatttaaagcttttatgaatttagaagtttcaaataaagacaagctacagattataaaagatatgttattttttctgatctctcgagccgatgcttga

SEQ ID NO: 25388 - protein, 270 aa, Unknown
  Obtained from environmental sample
  misc_feature (1)..(270): Xaa is any amino acid
MYLLLYLGTRLHRFAHLYNQCIMSSIKLILRNNKVDKAGEAPLYIRVIKDRKTKFISLSLKLKPNEWDEDKQKVKKNHSNSTRLNAYISQKVADAKGEIADLERRNQSTTARKLKEAIKGKPLTNFFDYSDNRCEKLKDTLAYSTYKNYKTYLKKFEKFVGHRELMFEDITVTTLKDYASYCSSTLGNNNTTINFSLKIMKIMFKEAQREDLIPLDLFPFNKFTVKKEKSTKRYLSAVQFKAFMNLEVSNKDKLQIIKDMLFFLISRADA

SEQ ID NO: 25389 - DNA, 573 bp, Unknown
  Obtained from environmental sample
  misc_feature (1)..(573): n is a, c, g, or t
gtgatttggtctcaagatactcaaattacaggagatagtattcatctaatttcgaatcccaaaactgaaaaattagatagtttaaaagtgttacagcatgcttttattattcaaaaggattctactggtttcaatcaaattaaaggtagaaatattttaggaaaatttattgaaaatgatttgcatgatattaatgtaattgggaattcagaaagcattttatatttgagaaatgataatgacaaaagccttatagggatagataaaactacctgtagttctatttatattgagttaaaaaataatgaaatattatctacaatatattatacaaaccctgacggtgagacgaatccaccttcaagactacctgaaaatgttaggttgtttaaaggtttcctttggcgcgaaagtgaaaggcctctaactaaagatgatatttttatcaaaaatgataatatcgaaaaaacagaagtttatgatataaaaggacttgaggaagataaacttagagccaagttcaataaaatcttaagtgaagataaaaaaagtaaagaaaaaaaagaaaattag

SEQ ID NO: 25390 - protein, 190 aa, Unknown
  Obtained from environmental sample
  misc_feature (1)..(190): Xaa is any amino acid
MIWSQDTQITGDSIHLISNPKTEKLDSLKVLQHAFIIQKDSTGFNQIKGRNILGKFIENDLHDINVIGNSESILYLRNDNDKSLIGIDKTTCSSIYIELKNNEILSTIYYTNPDGETNPPSRLPENVRLFKGFLWRESERPLTKDDIFIKNDNIEKTEVYDIKGLEEDKLRAKFNKILSEDKKSKEKKEN

SEQ ID NO: 25391 - DNA, 693 bp, Unknown
  Obtained from environmental sample
  misc_feature (1)..(693): n is a, c, g, or t
gtggcactagctgaaatagatagaaaaacggtagatttagaaattgatcaagtaaagagtgcacttccagagcctacagaagtagagaaattacaagacaaacgttataaagaagaacaagagcgacgtaaaaagaagaaaaaagtggtgttaaccgtaatcctttctttagtgttagtttttgcaacattcgttggttttattgcaacctatgggtttacttatgtaaaagatacgattattggtaacgaaactaaagccttgcttgaaggccattgggtgactagtgagtatggttttccaccgattacgatctctactccagaagtgttaaaacgtgtggaagcgccaattccagatgcactgaaagcgcaagtaaaaaatacaatgtttagctatggtcgtttaattggtaatttaaatattgtggtgacaacaacaacatttactgcgccacaacagcaacaaggcgaaacacagcaagaaccaaaaatcgatttaaatcaagcggtcgacggtgctctaaaagaatgggaaaatcgcggggctataaatatagtacttaataaagaaaaatttgtaacaccacgaggagccgaaggtttaaaagcatttggtactgccgatttgccctcagtactctctgaaaaaactgaaaaaggaaaatatgttatttttagttttacctctcan

SEQ ID NO: 25392 - protein, 231 aa, Unknown
  Obtained from environmental sample
  misc_feature (1)..(231): Xaa is any amino acid
MALAEIDRKTVDLEIDQVKSALPEPTEVEKLQDKRYKEEQERRKKKKKVVLTVILSLVLVFATFVGFIATYGFTYVKDTIIGNETKALLEGHWVTSEYGFPPITISTPEVLKRVEAPIPDALKAQVKNTMFSYGRLIGNLNIVVTTTTFTAPQQQQGETQQEPKIDLNQAVDGALKEWENRGAINIVLNKEKFVTPRGAEGLKAFGTADLPSVLSEKTEKGKYVIFSFTSX

SEQ ID NO: 25393 - DNA, 705 bp, Unknown
  Obtained from environmental sample
  misc_feature (1)..(705): n is a, c, g, or t
atgtataaggaaataaaagatattaaatattatgaagataaaaaactctggataaaagatgatttaggtgttattaaaaacttgttcttttattaccaaattccctacggaagttttgtgattatcaaatcggatggaacttttatatcattacatggagagcataataaagatatggtttatcaaatcgctgaagaaataaaaaaagacatcaaaaaagtagaacattacacttatgactttaaacagaaaatagaaccatcaaaatttgatagtctattatataattcaaataaaggatacagaaattttgaattaaattttgaaagcgatagcattttttataagatgatacatcctgcaagacgttatggtatatttaaaaaacaccaactagactcagttaaaaactatattaacaaaatctcaaaaacccaaaatacctttaaagattatattgttataaattacaactctggtgatgctccaaataaagatttaagtagcgaaagcacagcttatatatacaaaactgattatcaaaaacaacttaatacaattatcgattgcaatcaattttgggtctttaaagatgataaagacataaaataccgcaatataaaaaatataaattggattaaggacgacgcttctgtttttaaaatctgttttttaaatatcaaattccatttgatagttttgtaa

SEQ ID NO: 25394 - protein, 234 aa, Unknown
  Obtained from environmental sample
  misc_feature (1)..(234): Xaa is any amino acid
MYKEIKDIKYYEDKKLWIKDDLGVIKNLFFYYQIPYGSFVIIKSDGTFISLHGEHNKDMVYQIAEEIKKDIKKVEHYTYDFKQKIEPSKFDSLLYNSNKGYRNFELNFESDSIFYKMIHPARRYGIFKKHQLDSVKNYINKISKTQNTFKDYIVINYNSGDAPNKDLSSESTAYIYKTDYQKQLNTIIDCNQFWVFKDDKDIKYRNIKNINWIKDDASVFKICFLNIKFHLIVL

SEQ ID NO: 25395 - DNA, 480 bp, Unknown
  Obtained from environmental sample
  misc_feature (1)..(480): n is a, c, g, or t
atgaaaagttgcttcgttttaatcattttgctttgtagctccttttgtatttctcaaaacaaattagcgcaacaaacaattgaccaattaaacgaacaattaaaaatttatgaaaccctttcgcctcatggagatttgtattcatttaaagatttaaaactatccaaaactgatattaagtcatatgaaaatacagatgatgttataaacgattccttgcaagcttatgctgctattgaaaccattcagcataaaatattaaccttaattaatgttatttttattttgaaatctactgaagattttgatttaacaaacaaattgtacaatgagattagttatataaatagtgacgataataagctgcataatttagtattatatgccaaatctggaggctcttatcaatccagaatatctgttatttattataaacaaaacaccgaataccaaaaagtttacgatacttataccagatga

SEQ ID NO: 25396 - protein, 159 aa, Unknown
  Obtained from environmental sample
  SIGNAL (1)...(18)
  misc_feature (1)..(159): Xaa is any amino acid
MKSCFVLIILLCSSFCISQNKLAQQTIDQLNEQLKIYETLSPHGDLYSFKDLKLSKTDIKSYENTDDVINDSLQAYAAIETIQHKILTLINVIFILKSTEDFDLTNKLYNEISYINSDDNKLHNLVLYAKSGGSYQSRISVIYYKQNTEYQKVYDTYTR

SEQ ID NO: 25397 - DNA, 429 bp, Unknown
  Obtained from environmental sample
  misc_feature (1)..(429): n is a, c, g, or t
ttgccttgtagccaagaaaagtctgttaagaattacttcaaaagaagtaaggacacctatggcttatgttataagattacggagaaagaggacgtaggaatctattgttatattgaattgaatcatcatttatattacagcatcacgctagcaaataaagacgggctgcgcctgccagaatgcccactcgatatggtaggttttgaagaaaaggttggggaattgtgcaaaaactggaaatatcaagataaaaagaaaaatttaggtggtcagatttaccctcaacgaccagttaactttaaaaatcccaatgataatttttttgatatcgtatacgagcagaagctccaacaatggatagctgaaacggctgatgatattattcagctgattaatgatgtaaagaatatcaatgtacagcaagcgtga

SEQ ID NO: 25398 - protein, 142 aa, Unknown
  Obtained from environmental sample
  misc_feature (1)..(142): Xaa is any amino acid
MPCSQEKSVKNYFKRSKDTYGLCYKITEKEDVGIYCYIELNHHLYYSITLANKDGLRLPECPLDMVGFEEKVGELCKNWKYQDKKKNLGGQIYPQRPVNFKNPNDNFFDIVYEQKLQQWIAETADDIIQLINDVKNINVQQA

SEQ ID NO: 25399 - DNA, 306 bp, Unknown; identical to SEQ ID NO: 21567
  Obtained from environmental sample
  misc_feature (1)..(306): n is a, c, g, or t

SEQ ID NO: 25400 - protein, 101 aa, Unknown; identical to SEQ ID NO: 21568
  Obtained from environmental sample
  DOMAIN (1)...(101): Transposase
  misc_feature (1)..(101): Xaa is any amino acid

SEQ ID NO: 25401 - DNA, 675 bp, Unknown
  Obtained from environmental sample
  misc_feature (1)..(675): n is a, c, g, or t
gtgccgcaagagtttaattttagccaatttgaaaccctaacccgaatattagtaactcaagcgggttattatggtgtaccacgcggcgaagcacataaacgcgccgaaaaatatttaacccaattggggttactagataaaaaagataaacaagcgcgtacgctttcaggtggcatgaaacgccgtttaatgattgctcgcgcacttatgcatgagcctaaattactgattttagatgagccaacggctggtgttgatatagagctgcgtcgttcaatgtgggattttttacgccaaattaatgagcagggcgtcaccattattttaaccactcattacttagaagaagcagagttattgtgtaaaaacatagccataatagacaatggcttgattgttgaaaacaccacaattaaagcactgttatctaagcttgataaagaaacctttattttagatttaaaaacaccggctaagccagttacgcttgagggttataaatttactatggacgacgagcatactattgaagttgaagtggctaaatcgcaaggcttaaacgctgtatttagtgcgctaactgagcaaggtaataccgtattgagtatgcgtaacaaagcaaatagattagaagagttatttgttggattattagaacaaggtcgaggcaagtaa

SEQ ID NO: 25402 - protein, 224 aa, Unknown
  Obtained from environmental sample
  DOMAIN (1)...(130): ABC transporter
  misc_feature (1)..(224): Xaa is any amino acid
MPQEFNFSQFETLTRILVTQAGYYGVPRGEAHKRAEKYLTQLGLLDKKDKQARTLSGGMKRRLMIARALMHEPKLLILDEPTAGVDIELRRSMWDFLRQINEQGVTIILTTHYLEEAELLCKNIAIIDNGLIVENTTIKALLSKLDKETFILDLKTPAKPVTLEGYKFTMDDEHTIEVEVAKSQGLNAVFSALTEQGNTVLSMRNKANRLEELFVGLLEQGRGK

SEQ ID NO: 25403 - DNA, 543 bp, Unknown
  Obtained from environmental sample
  misc_feature (1)..(543): n is a, c, g, or t
gtgttagctgaatataaaaatgaactaattgtttatttcagcagttgtgatgtcgttaataatcatttgaaacacttaaaatactatcaacataaattaaatcttgaaaacataataacaaaaaaatcaaaaaattatataatttttagattgccacaagttgttggtaaaggcggaaatgagaataattttttaaactattttgtccataatattcagaataaaaataaaatacaggcctatatcgaaacaaaaaaaaatatattagacttagatgatgtctacaagatatgtgactatatattgtcgaaacatgtttacagaaatcaggtagttaatttggttaatacagaatatttttatgtattagatattatcaaaactatagaagaagtcttcaatatcagagcaaatgttgaaagaaaaaatattgatctaggctggcactataataatgatatttcaaatgatatgattaaggcaagtggtgtagtatttaataaaaattatattagagaagtattgcttaagtactatttataa

SEQ ID NO: 25404 - protein, 180 aa, Unknown
  Obtained from environmental sample
  misc_feature (1)..(180): Xaa is any amino acid
MLAEYKNELIVYFSSCDVVNNHLKHLKYYQHKLNLENIITKKSKNYIIFRLPQVVGKGGNENNFLNYFVHNIQNKNKIQAYIETKKNILDLDDVYKICDYILSKHVYRNQVVNLVNTEYFYVLDIIKTIEEVFNIRANVERKNIDLGWHYNNDISNDMIKASGVVFNKNYIREVLLKYYL

SEQ ID NO: 25405 - DNA, 420 bp, Unknown
  Obtained from environmental sample
  misc_feature (1)..(420): n is a, c, g, or t
atgttaaaagagaaaagatttttacacattgctagtgatgaaaagtttattaatagtgcgtatgcacaattcgaaaagagttttccaaaatcgaacatttttaaaatttatacgaatgaagataattataaaataaaacatgtgagtcaagatgttaattttgatatcatcaacattaataatttagatataggtgcatttattgaaggttttgaaaaatatgatcttgtattatttcatgggttaagtattttttcaagtagactaattataaacgcacctaaaagcactaaaaattttatggttttttttgggggaggaaaaaatttaataatcatcccttatgaacccattagggagacattatatgggtcaaaaagaacaagaaaaagttttttaaaaataaaaaaccaacttcct

SEQ ID NO: 25406 - protein, 140 aa, Unknown
  Obtained from environmental sample
  misc_feature (1)..(140): Xaa is any amino acid
MLKEKRFLHIASDEKFINSAYAQFEKSFPKSNIFKIYTNEDNYKIKHVSQDVNFDIININNLDIGAFIEGFEKYDLVLFHGLSIFSSRLIINAPKSTKNFMVFFGGGKNLIIIPYEPIRETLYGSKRTRKSFLKIKNQLP

SEQ ID NO: 25407 - DNA, 342 bp, Unknown
  Obtained from environmental sample
  misc_feature (1)..(342): n is a, c, g, or t
ttgagcggttgcggtaatttcaatagttccttctggaatagttacaattacatcatacgtttcggctatgccaaagagaaatctgcttttggaaacgggttgcacgtcaacaccatcactggaaaccaacattgggttacctccgccaaagtccatccaataataggtagaagccgatgcgttaatgaagcgaagccttactttttcgccagccgtaaattctggatactctgccagttttttaccgttggacaaaaatgcgggataataaatgtctgcaatatcagccccttccatacggtctctccaaaatttaagttgagcaccaaaggcaccttctga

SEQ ID NO: 25408 - protein, 113 aa, Unknown
  Obtained from environmental sample
  misc_feature (1)..(113): Xaa is any amino acid
MSGCGNFNSSFWNSYNYIIRFGYAKEKSAFGNGLHVNTITGNQHWVTSAKVHPIIGRSRCVNEAKPYFFASRKFWILCQFFTVGQKCGIINVCNISPFHTVSPKFKLSTKGTF

SEQ ID NO: 25409 - DNA, 345 bp, Unknown
  Obtained from environmental sample
  misc_feature (1)..(345): n is a, c, g, or t
atgaagactttggtcgtagataaaattcatcattcttcaggggaattacatataaaatggggagaatatataagtcaaaacctacatctcgattataaatatcttggttcactgttctcatctgttgaaagtattacgcttgaacaatatatcatcaatcagaagattgagcgtgtaaaagaattaataatctatgatgaattaacattgagtcagatagcttttaaacttgactatagtagtgtcgcctatctaagtaatcaatttaaaaaagttacgggaatgacgcctacaaaattcaaaaaaagcaccaataagaaccgaaaatctttggatgaaatttaa

SEQ ID NO: 25410 - protein, 114 aa, Unknown
  Obtained from environmental sample
  DOMAIN (58)...(102): Bacterial regulatory helix-turn-helix proteins, AraC family
  misc_feature (1)..(114): Xaa is any amino acid
MKTLVVDKIHHSSGELHIKWGEYISQNLHLDYKYLGSLFSSVESITLEQYIINQKIERVKELIIYDELTLSQIAFKLDYSSVAYLSNQFKKVTGMTPTKFKKSTNKNRKSLDEI

SEQ ID NO: 25411 - DNA, 555 bp, Unknown
  Obtained from environmental sample
  misc_feature (1)..(555): n is a, c, g, or t
ttggaacaacttgttaaagatattaaagcccgtggcactttttattacagtggaaactacagtctaggaatctcagatattttaaccgggatgcttgagttcactgcggaaaactttacccgaaaactatttttggaaggtatggcctaccagattttaacacatcagattctgcaatatcaagatgataagaaagacgaaggcaaccgtaccctcttgcgttcttcggaactaaaacagataaaccatatctccgaccttattgaaagcaatatttcagatgttcccactgtggaaaatttggcaagagaagctggactgaacgtaaacaaactgcaagaaggtttcaaaaaattatatggtacaacggtaaataattacgtacaaaaagcaagactggatgcggcttataatctattgaccaaaacagatctaagtatttcggaaattgtgagtgccattggcctgagcagtaaaagctacttctcaaagattttcaaggaaaaacacagcatctcaccatcagaattcagaaaaaaacagcggaacaaataa

SEQ ID NO: 25412 - protein, 184 aa, Unknown
  Obtained from environmental sample
  DOMAIN (135)...(179): Bacterial regulatory helix-turn-helix proteins, AraC family
  misc_feature (1)..(184): Xaa is any amino acid
MEQLVKDIKARGTFYYSGNYSLGISDILTGMLEFTAENFTRKLFLEGMAYQILTHQILQYQDDKKDEGNRTLLRSSELKQINHISDLIESNISDVPTVENLAREAGLNVNKLQEGFKKLYGTTVNNYVQKARLDAAYNLLTKTDLSISEIVSAIGLSSKSYFSKIFKEKHSISPSEFRKKQRNK

SEQ ID NO: 25413 - DNA, 525 bp, Unknown
  Obtained from environmental sample
  misc_feature (1)..(525): n is a, c, g, or t
gtggatcaagaatcggctcgagtatggagcactggtgccattggttctgctgctgtacaattattaaaacattttggggcaacgataactgcaatatgtaatacaaaaaatgtagatcttataaagtcgctcggtgcagacattgttattgattatcaaacacaagattttacacagacaaaaaataaatttgaattcatttttgacgcagtgggtaaaagctcatttggtcaatgcaaacctttgctaactgaaaaaggaatttacatttcaaccgaacttgggaaaaatggagagaatatttttcttgcacttactactccactttggcaaggcaagaaactattatttccaattccatcaattactaaaaaggatgtgatttttcttaaagaacttgctgaaaaaggacaatacaagcctgtaattgacagacagtataagttagaccaaattgtggaagcctataaatatgtggaatctggtcaaaaaacgggaaatgttatattaaaaatagttgaataa

SEQ ID NO: 25414 - protein, 174 aa, Unknown
  Obtained from environmental sample
  misc_feature (1)..(174): Xaa is any amino acid
MDQESARVWSTGAIGSAAVQLLKHFGATITAICNTKNVDLIKSLGADIVIDYQTQDFTQTKNKFEFIFDAVGKSSFGQCKPLLTEKGIYISTELGKNGENIFLALTTPLWQGKKLLFPIPSITKKDVIFLKELAEKGQYKPVIDRQYKLDQIVEAYKYVESGQKTGNVILKIVE

SEQ ID NO: 25415 - DNA, 684 bp, Unknown
  Obtained from environmental sample
  misc_feature (1)..(684): n is a, c, g, or t
atgcttggcatgatgaaacgggcgtttccaaatctgccgagctactcgcgatttatagagcttgtgccgcgcagtatcatgccactgtgtgcctacttgcaaagcatgatgggcgactgtacgggtatcagctatattgattcaaccaagatagcagtttgtcataacaagcgtatctaccgtcataaagtctttaagggacttgcaacccgaggcaaaagcagcatgggctggttctatggctttaagctacacgccattatcaatcataagggcgagcttgtatctgttaaagtcactgcgggtaatacggatgacagagtgcctgttaaggatatggcaacgcctgtgtttggcaaggtgtttggggatagaggctatatcagtaaagccttaaacgagtggctcacaaaacacagtgataccacgttgataaccaaacttcggcgtaatatgaaaccccaattacttgagcctatggatgaggcactactcaatcatcgctctttggttgaaacggtgtttggagagcttaaaaacttgtgccaaatcgaacactcacgccatcgtagtgtcacggggtttatcacaaacttgctgtcaggtttaattgcttattgctggtttccctataaanccaccatcanaaatatgcctcagcagggacaggtagccatattgtaa

SEQ ID NO: 25416 - protein, 227 aa, Unknown
  Obtained from environmental sample
  DOMAIN (43)...(208): Transposase DDE domain
  misc_feature (1)..(227): Xaa is any amino acid
MLGMMKRAFPNLPSYSRFIELVPRSIMPLCAYLQSMMGDCTGISYIDSTKIAVCHNKRIYRHKVFKGLATRGKSSMGWFYGFKLHAIINHKGELVSVKVTAGNTDDRVPVKDMATPVFGKVFGDRGYISKALNEWLTKHSDTTLITKLRRNMKPQLLEPMDEALLNHRSLVETVFGELKNLCQIEHSRHRSVTGFITNLLSGLIAYCWFPYKXTIXNMPQQGQVAIL

SEQ ID NO: 25417 - DNA, 438 bp, Unknown
  Obtained from environmental sample
  misc_feature (1)..(438): n is a, c, g, or t
atgaaatttaatgttttcgaaatattaaagaagaaattaaaaagaattatttcttttgttattaaacatccttttaaaagtttgtttcacttaattactttcgttttctgtttttcgactttattagtaatatttacttacgtaggcgctttcggtaaattacctacaaaagatttcttattacaattaaaaacaccacttacttctacgctttacgccagcaataaagaacaaattggattttattatcttcaaaatagatctaatatagatagtacagaagtaccaaaagccttaaaaaatgctttaattgcaacagaagataatagattttacgaacataatggactcgattttcaaagttatgggcgtgtttttataaaatcggtaatcttaagacaaaatgctggaggaggaagccctgaacacaacagttag

SEQ ID NO: 25418 - protein, 145 aa, Unknown
  Obtained from environmental sample
  DOMAIN (69)...(145): Transglycosylase
  misc_feature (1)..(145): Xaa is any amino acid
MKFNVFEILKKKLKRIISFVIKHPFKSLFHLITFVFCFSTLLVIFTYVGAFGKLPTKDFLLQLKTPLTSTLYASNKEQIGFYYLQNRSNIDSTEVPKALKNALIATEDNRFYEHNGLDFQSYGRVFIKSVILRQNAGGGSPEHNS

SEQ ID NO: 25419 - DNA, 357 bp, Unknown
  Obtained from environmental sample
  misc_feature (1)..(357): n is a, c, g, or t
atgactgcgcaatctggcaaacaattgtttagtgacacgcatacgcttttaaaaaatagagaagaattaatattgtctttaaaaactaaacctatatacaatgacactatttccattcccttaggaattaaacatattaaaataaacagcggaaccttaacttttacatcggttgatagcattttggatcatcacgcaaatactgtttttgtagatcaagataaattggagtttccgttaacagtacgacattgggaaactggggattacttttatcctttaggaatgccgggaaaaaagaaattggtaaattttttaaagatgaaaaactatctgtttaagagaaagaaaaggtga

SEQ ID NO: 25420 - protein, 118 aa, Unknown
  Obtained from environmental sample
  misc_feature (1)..(118): Xaa is any amino acid
MTAQSGKQLFSDTHTLLKNREELILSLKTKPIYNDTISIPLGIKHIKINSGTLTFTSVDSILDHHANTVFVDQDKLEFPLTVRHWETGDYFYPLGMPGKKKLVNFLKMKNYLFKRKKR

SEQ ID NO: 25421 - DNA, 756 bp, Unknown
  Obtained from environmental sample
  misc_feature (1)..(756): n is a, c, g, or t
atgattcaggctaaaactttangttctttaataacacctaaattaccagttgattatataaatgaagctattgtaactatagaacaaaggttaaataccaatgacatttttttaacaaaagggttgttacaaattaaagaagctttaaaacaattagtcttattgagtaataaatatcattgtatagttgacaatccaccttatatgggtgctaggaaaatggacgctaatttaaaagttttattaaataagatgtacccccaagcttatcaagatttatttacttgttttattgttagagctaaaacccaattaaagcaaaacggtttagcttctttaattacattacaaggctggatgtttatatcatcatttgagaagtttagaatatggcttttaaacaattttacttttaattcgttaatccaaattggcgggaatagttttccctcattaaattctcaagttgcaagagctgtaatgtttactctacaaaatagtaacaatataaaaaatagtacaatatcttttgatttagactcaatagcgaaaacacataatattgataaaaaaaacctttttgaagaatatattttaaatagaagtcatactgaaagaaattttaattcttttaaaaaaattaatagatatacctttttacactcattatcaaacaatttatttgaggtgtctgtttcatcaaaacctttcgaaaaattagcaaanctaaacaggtttagccacaggcaaaaatga

SEQ ID NO: 25422 - protein, 251 aa, Unknown
  Obtained from environmental sample
  misc_feature (1)..(251): Xaa is any amino acid
MIQAKTLXSLITPKLPVDYINEAIVTIEQRLNTNDIFLTKGLLQIKEALKQLVLLSNKYHCIVDNPPYMGARKMDANLKVLLNKMYPQAYQDLFTCFIVRAKTQLKQNGLASLITLQGWMFISSFEKFRIWLLNNFTFNSLIQIGGNSFPSLNSQVARAVMFTLQNSNNIKNSTISFDLDSIAKTHNIDKKNLFEEYILNRSHTERNFNSFKKINRYTFLHSLSNNLFEVSVSSKPFEKLAXLNRFSHRQK

SEQ ID NO: 25423 - DNA, 312 bp, Unknown
  Obtained from environmental sample
  misc_feature (1)..(312): n is a, c, g, or t
atgaaaagtttgctttcttcatatatcaaccctttgttaaaagaaggtgtagattgtttggttttaggttgtacacattatccatatttaattccacaaataagagaactagttggtgataaaatagaaattatagactcaggccaagcagttgcaaaacaaacaaaggttgttcttgaaaaacatcaactagtaaatactaatgatataaaaggtaaacatcaattttacatcaataaaaataaagatgttttatctatgatgatttcagaaaaaaataattttattactattgatgaaagagacttttaa

SEQ ID NO: 25424 - protein, 103 aa, Unknown
  Obtained from environmental sample
  misc_feature (1)..(103): Xaa is any amino acid
MKSLLSSYINPLLKEGVDCLVLGCTHYPYLIPQIRELVGDKIEIIDSGQAVAKQTKVVLEKHQLVNTNDIKGKHQFYINKNKDVLSMMISEKNNFITIDERDF

SEQ ID NO: 25425 - DNA, 882 bp, Unknown
  Obtained from environmental sample
  misc_feature (1)..(882): n is a, c, g, or t
ttgagacgtgtctttttagagcataatgaaaaaaatgaaatagcatacattaaaggagttgaagataattatgcagaaataacaagcatagattcagctttagaaattggtaattggttagataaagaatatacaaatacagctgtaattggtagaaccattgcagcaaaattatctttaggaattagaagttttggtgaacccttatccattttagtgccaaaaccaggaacaggttttataaacccaaacaatgctttttacaaaacagatgttcaaattattggcttgtatgtgggtacagaagattttgaaagtaaatatgtatttgtaaatttagaacaagcaaaagatttattaaagttcgatgaaaaccagattacaggtttagaactaaaattagtagattctttaaatgcggatgctgttgcagaagaacttcaaaagaatttaagcaccacttttagagttcaaactaaagaacagttaaatgaggttttttataaagtaattaataccgagaattttgtttcttatttaatttttacattgattgttattattgcattattcaatgtaattggtactataatcatgatgattattgataaaaaagcaaatcttaaaacattgtataatttaggtacaacagtaaaacagataaaaaaaatatttgtcctgcaaggatttctacttactttttttggaatgattataggattgctaattggtgtaattgctgtttttctacaaagtaaatatggcttttttatgattacagaaagtctaccttatcctgtagaatttagatttttaaatctattgatttgtattttaacgattacagtttttaggttttatcgcaccaaaaaatgcgagtag

SEQ ID NO: 25426 - protein, 293 aa, Unknown
  Obtained from environmental sample
  DOMAIN (127)...(292): Predicted permease
  misc_feature (1)..(293): Xaa is any amino acid
MRRVFLEHNEKNEIAYIKGVEDNYAEITSIDSALEIGNWLDKEYTNTAVIGRTIAAKLSLGIRSFGEPLSILVPKPGTGFINPNNAFYKTDVQIIGLYVGTEDFESKYVFVNLEQAKDLLKFDENQITGLELKLVDSLNADAVAEELQKNLSTTFRVQTKEQLNEVFYKVINTENFVSYLIFTLIVIIALFNVIGTIIMMIIDKKANLKTLYNLGTTVKQIKKIFVLQGFLLTFFGMIIGLLIGVIAVFLQSKYGFFMITESLPYPVEFRFLNLLICILTITVFRFYRTKKCE

SEQ ID NO: 25427 - DNA, 804 bp, Unknown
  Obtained from environmental sample
  misc_feature (1)..(804): n is a, c, g, or t
ttgtacagagattctataaaagcaattcataatggtgcagatgacaatgcttctggagttgcagttttactaaacttagctgcaaaattaaaaacaaaaaacactaataataattatctttttatggcattttctggtgaagaaatgggtcttttaggttctaattatttcgcaaaaaacccaacaatcgacattaaaaaaatatcttatatgattaatatggatatggttggcagaatgaaaaaagattcttctttggctgtttatggaactggaacttcgccaatttttaagcaagttttaaaatctcataatgacaattttaaattggttcagcaagaatctggagttggcccaagtgatcatacaagtttttatttggctgatattcctgtgttacatttttttactggtcaacatgaagattatcataaaccaggagatgattcagaaaaactgaactatgatggaatgcacttaattgctgattatatctttaacattattactgatttagatgataatggaaaaattacattcagaaaaacgaaaaatgaaagtgaagatactccacgttttaaagttggtttaggtgtaatcccagattatttattcgacggaaaaggaatgcgaattgatggaatttctgaagacaaacctgcacaaaaagcaggtcttaaaaaaggtgatattgtaattaaattaggtgatagtttaataacaaatatgatgagctacatgcgtgctttatccatttttgaagaaggagattctacaaaagttattgtaaaacgtaaaaaatga

SEQ ID NO: 25428 - protein, 267 aa, Unknown
  Obtained from environmental sample
  DOMAIN (4)...(159): Peptidase family M28
  misc_feature (1)..(267): Xaa is any amino acid
MYRDSIKAIHNGADDNASGVAVLLNLAAKLKTKNTNNNYLFMAFSGEEMGLLGSNYFAKNPTIDIKKISYMINMDMVGRMKKDSSLAVYGTGTSPIFKQVLKSHNDNFKLVQQESGVGPSDHTSFYLADIPVLHFFTGQHEDYHKPGDDSEKLNYDGMHLIADYIFNIITDLDDNGKITFRKTKNESEDTPRFKVGLGVIPDYLFDGKGMRIDGISEDKPAQKAGLKKGDIVIKLGDSLITNMMSYMRALSIFEEGDSTKVIVKRKK

SEQ ID NO: 25429 - DNA, 789 bp, Unknown
  Obtained from environmental sample
  misc_feature (1)..(789): n is a, c, g, or t
atggatggattaaccttgctctccagactcaacgaattaagccctttgattaaatcagttattgtttctgcttatggagatatggataacataagaacagcaatgaatagaggtgctttcgattttatcaccaaacctatcaattttgaggatttaacgctcacgatggaaaaaaccctgaaacatgctcagcacattaaggagactctacaggctataaaggaaaacaacattttaaaaatgtatgtcgatgaaaatgtgctcaattttatggggaatcgcgattatgaatctaccatcatggccaatgaaacaatagaagctactgtggtttttatagatatttgtggttttaccaaaattagtgaaactactgaagccgatactgtggttaaactaattaattcttattttgatgagatggtaaaggaaatcatggagcacaaaggctacattgataaatttattggtgatgctattatggctgtttttaaaggcgactatcatttagatcgcgctattgatgcatcactagctgtatgcgaaaaaatcaataatctaccggcacttgatggtaatttagactataaaccaaaagtatctataggcctaaagagtggagaaatgatttcaggaaacattggatccgtgagtttaaaacgtttagactacactgttattggtgataccgttaatacagctgcgcgtttacaagatgcggctaaagaaaaccaaattataatttcagaagattgttataatcaagtcaaggaatcttttaagttgtga

SEQ ID NO: 25430 - protein, 262 aa, Unknown
  Obtained from environmental sample
  DOMAIN (100)...(261): Adenylate and Guanylate cyclase catalytic domain
  misc_feature (1)..(262): Xaa is any amino acid
MDGLTLLSRLNELSPLIKSVIVSAYGDMDNIRTAMNRGAFDFITKPINFEDLTLTMEKTLKHAQHIKETLQAIKENNILKMYVDENVLNFMGNRDYESTIMANETIEATVVFIDICGFTKISETTEADTVVKLINSYFDEMVKEIMEHKGYIDKFIGDAIMAVFKGDYHLDRAIDASLAVCEKINNLPALDGNLDYKPKVSIGLKSGEMISGNIGSVSLKRLDYTVIGDTVNTAARLQDAAKENQIIISEDCYNQVKESFKL

SEQ ID NO: 25431 - DNA, 414 bp, Unknown
  Obtained from environmental sample
  misc_feature (1)..(414): n is a, c, g, or t
ttgagttcggttttatattatcaagtaaatataaaaattacatggtacaaaccggttataaacaaaataataagtcctattgctaaaagactaatagcgcgttttacatttctaaatttccaatctgatattttagaaattataaaaatttgctctcctaattgcataaacaattcgtcctcgtctttgctcttgttcaaaaaggttcttgaaaattctttaacatctccaaattttgtaataatgtccttaaagaagaacatgtttgtggagaaattaccttcaatttttggaataaaacagcgtatacaaaagaatatagaagccgacgtgcaaagaatccaggcaccaatgagaatatatagaatagtatcattatttaattggcttgaaaaattctcagtgccttggtag

SEQ ID NO: 25432 - protein, 137 aa, Unknown
  Obtained from environmental sample
  misc_feature (1)..(137): Xaa is any amino acid
MSSVLYYQVNIKITWYKPVINKIISPIAKRLIARFTFLNFQSDILEIIKICSPNCINNSSSSLLLFKKVLENSLTSPNFVIMSLKKNMFVEKLPSIFGIKQRIQKNIEADVQRIQAPMRIYRIVSLFNWLEKFSVPW

SEQ ID NO: 25433 - DNA, 495 bp, Unknown
  Obtained from environmental sample
  misc_feature (1)..(495): n is a, c, g, or t
atgccttatgcagatcaaatgtttgatttatttaatgaaagctacgcctcactatcttcatttgttgcgattacagatattcaaaaagaatattttaaaaagaagtttataagttttattaatccagaatatatcaaatttgttattgacaaagacaacaaattggtagcatttgctgtagttatgcctagatttgcggatgcattacaacaaatgaaaggtaaattattaccatttggatttttaaaattattaaaagctaaaaaagaaagcaaagacgttatgttttacttgataggtgtccatcctgagtatcaaaataaaggtgtacatgctgttatttttaacgaatattacaacacgtttactgaaagaggaatacaaacctgttatagaacacctgaattagaggataacgaagctatacataaaatttggaaacactttgatccagaggtatatataagacgttgtacttttaaaaaagaattataa

SEQ ID NO: 25434 - protein, 164 aa, Unknown
  Obtained from environmental sample
  misc_feature (1)..(164): Xaa is any amino acid
MPYADQMFDLFNESYASLSSFVAITDIQKEYFKKKFISFINPEYIKFVIDKDNKLVAFAVVMPRFADALQQMKGKLLPFGFLKLLKAKKESKDVMFYLIGVHPEYQNKGVHAVIFNEYYNTFTERGIQTCYRTPELEDNEAIHKIWKHFDPEVYIRRCTFKKEL

SEQ ID NO: 25435 - DNA, 804 bp, Unknown
  Obtained from environmental sample
  misc_feature (1)..(804): n is a, c, g, or t
gtgggttatgtattaacggttattaccgaacacattttaagtggcaataatctcgagcaattaaaacaaaagaagatgcagaaaaaaattgatagtttaaagaatcatattattatatgtggttacgggcgaaatggaaaacaagccgctaagaaattattaaattataaaaagccttttgttattatcgaaaaaaacaaagagattatcgataagaatcaaacggatgaaattgcgtttgtttttggaaacgcgaatgaagatgaggtacttttagaagcgggagtagatagagcgctgactttaatttctgcgctacccaacgatgccgataatttgtttgttgtgctttctgcaagacaaataaataagaatatgacaattattagtcgtgtttctcaagaaacgtcttataaaaaattaaaattagcaggcgccaataatgttattttaccagaccgtattggaggcgatcatatggcatcattagttgtcgttccagatttaattgagtttatcgataacctttcaattataggagaatcaaacattaatattgtagaaattcacgtaaataaactctatgatgttgtggctaatgttaagactattaaagatttagacttacgcaacaaaaccgggtgtactgtaattggctttaaatccagtaatggagattatatcgttaatccagaagccgaaataaagttagttcccaattctaaagtcattgttttagggcgcccagaacaaattaaaaaactaaattcaatatataatttggattacatcatactatttnnt

SEQ ID NO: 25436 - protein, 268 aa, Unknown
  Obtained from environmental sample
  DOMAIN (197)...(260): TrkA-C domain
  misc_feature (1)..(268): Xaa is any amino acid
MGYVLTVITEHILSGNNLEQLKQKKMQKKIDSLKNHIIICGYGRNGKQAAKKLLNYKKPFVIIEKNKEIIDKNQTDEIAFVFGNANEDEVLLEAGVDRALTLISALPNDADNLFVVLSARQINKNMTIISRVSQETSYKKLKLAGANNVILPDRIGGDHMASLVVVPDLIEFIDNLSIIGESNINIVEIHVNKLYDVVANVKTIKDLDLRNKTGCTVIGFKSSNGDYIVNPEAEIKLVPNSKVIVLGRPEQIKKLNSIYNLDYIILFX

SEQ ID NO: 25437 - DNA, 471 bp, Unknown
  Obtained from environmental sample
  misc_feature (1)..(471): n is a, c, g, or t
atgagcgagaataaagaattagatttagctaataatttcgttaataatacgaatagaaatattttcctaactggtaaagcaggtacgggtaaaacgacgtttcttcataaattaaaaaagaattccttaaaaagaatagttatagtggctccaactggagttgctgctattaatgcaaaaggggttacaattcattcattttttcaacttccttttggaccgattttaccaaatgacgatttaaactctagtgatggatttaatcgaaagtttggtaaaactaaaatcaatattattaagtcattggacttattaatcatcgatgaaataagtatggtcaaagcggacgtacttgatggtattgataaaactttgcgtcgttatagaaataaaaatctagttttcggaggtgtacaagtcttgatgataggggattacagcagctatctccgttgtaaagatatgacnntn

SEQ ID NO: 25438 - protein, 157 aa, Unknown
  Obtained from environmental sample
  misc_feature (1)..(157): Xaa is any amino acid
MSENKELDLANNFVNNTNRNIFLTGKAGTGKTTFLHKLKKNSLKRIVIVAPTGVAAINAKGVTIHSFFQLPFGPILPNDDLNSSDGFNRKFGKTKINIIKSLDLLIIDEISMVKADVLDGIDKTLRRYRNKNLVFGGVQVLMIGDYSSYLRCKDMTX

SEQ ID NO: 25439 - DNA, 498 bp, Unknown
  Obtained from environmental sample
  misc_feature (1)..(498): n is a, c, g, or t
atgcgctcgataatcactattttagtggataaatttactgattctcatcctatagttaaagaggctaaacagtatttttcacctaagcgtaggcgttttgctggggtggctattgatgtggtgtttgatcactttttaattatgcattggcaaaaatataacctacagccattaaacgactttaaacaaactagctttgcgcttttgcataagcgtatgcctgtaatgccgtcgcgaatgcagcatgttgtaaaacacatgaccgataacgattggtttaaagagtacgaaacccttgatggggtagggctagcacttgataatatagccaagcgcattcgctttactaatacctttgctggtgctgttgatgatatagcaaagcattatgatgaattaaatgctgtgtttttagcttttttccctgagctgattacgcatgtaaatcagtttaatcttgaaaacgctaaaaaaatccgtgggttttatactttatag

SEQ ID NO: 25440 - protein, 165 aa, Unknown
  Obtained from environmental sample
  DOMAIN (2)...(152): Protein of unknown function, DUF479
  misc_feature (1)..(165): Xaa is any amino acid
MRSIITILVDKFTDSHPIVKEAKQYFSPKRRRFAGVAIDVVFDHFLIMHWQKYNLQPLNDFKQTSFALLHKRMPVMPSRMQHVVKHMTDNDWFKEYETLDGVGLALDNIAKRIRFTNTFAGAVDDIAKHYDELNAVFLAFFPELITHVNQFNLENAKKIRGFYTL

SEQ ID NO: 25441 - DNA, 564 bp, Unknown
  Obtained from environmental sample
  misc_feature (1)..(564): n is a, c, g, or t
atgtctttatatccaaatgaagataattggaaaaatatggtagatgacacatacaataatatggtagatttaaaaactcgttatcaaaaagacgttatgatggtagaaattggctttaatgcaaatcaaccagaaatttctcaccaatttgtaaaatatatgattgaaaaaacaagacaagctcaaggtttaggtgttttttattgggaaccaatagcacataataattggaattcatattccaaaggtgcttgggattcagatggaagtccatctattgttatggatgcttttaaaaatgaaactccactaagtgtagaaaatttaatggttggaaataaacaagagttttctgtatttccaaaccctagtaataatttaattactgtaaaatcttcttgctcagttataaaatcgatcaaaatttatgatagttcaggtaaattaattaaaaatataaaaaaagaaagtgcttctaaacctattgatatttctgaattaatagctggtatttatgtcttaaaaataaataattcgaaatcaataaaatttattaaaaactaa

SEQ ID NO: 25442 - protein, 187 aa, Unknown
  Obtained from environmental sample
  misc_feature (1)..(187): Xaa is any amino acid
MSLYPNEDNWKNMVDDTYNNMVDLKTRYQKDVMMVEIGFNANQPEISHQFVKYMIEKTRQAQGLGVFYWEPIAHNNWNSYSKGAWDSDGSPSIVMDAFKNETPLSVENLMVGNKQEFSVFPNPSNNLITVKSSCSVIKSIKIYDSSGKLIKNIKKESASKPIDISELIAGIYVLKINNSKSIKFIKN

SEQ ID NO: 25443 - DNA, 765 bp, Unknown
  Obtained from environmental sample
  misc_feature (1)..(765): n is a, c, g, or t
atgcgtggnactggtgaanacgaaatcgaaacagatagacgtatcgtacgtgacaggatctccttattaaaagacaaaattaaaactatagataagcaaatgtctgtccaacgtggtaatcgtggacaaatggtacgcgttgcactagttggatacaccaacgttggtaaatctactttaatgaataccgttagtaagtcagaggtatttgccgaaaataaactttttgcaaccctagacacaaccgttagaaaagtagtcatccaaaacctaccatttttattaacagataccgttggatttatccgcaagttaccaacccaattggtagacagttttaaaagtacattggatgaggttagagaagcagatttactattgcacgtagtcgatatctctcacccaaattttgaagaccatatagaatctgtaaataaagttttaggcgaaattaaaagtgcagacaaaccaataatcatggtctttaataagattgatgcttaccaagcaaaaccttttgacgagaccgacttaattgcagagcgtacagaagaacattacagtcttgccgagtggaaaaagacctggatgaatcgcgtaggagaggacaacgcattatttatatcagcattaaacaaacgtaatctagaagactttaaaaagcgcgtttatgatgaggttagagacatacacgtcacacgttttccttacaatcacttcctgtatccagattatgattacgataatctaggcgaagaagaataa

SEQ ID NO: 25444 - protein, 254 aa, Unknown
  Obtained from environmental sample
  misc_feature (1)..(254): Xaa is any amino acid
MRGTGEXEIETDRRIVRDRISLLKDKIKTIDKQMSVQRGNRGQMVRVALVGYTNVGKSTLMNTVSKSEVFAENKLFATLDTTVRKVVIQNLPFLLTDTVGFIRKLPTQLVDSFKSTLDEVREADLLLHVVDISHPNFEDHIESVNKVLGEIKSADKPIIMVFNKIDAYQAKPFDETDLIAERTEEHYSLAEWKKTWMNRVGEDNALFISALNKRNLEDFKKRVYDEVRDIHVTRFPYNHFLYPDYDYDNLGEEE

SEQ ID NO: 25445 - DNA, 942 bp, Unknown
  Obtained from environmental sample
  misc_feature (1)..(942): n is a, c, g, or t
atgagccaatggttaatgacctggattaacgatggaaaatataaagaaaaccagatcttaccagagacttatgtaaaagaagccatgagctctcagatgattgtatctgctgggtttccgtcaaaagaattgccagatgtacaatttgccaattatggttacggttggtttttacatgcgtacaaaggccattatatggtagaacatggaggtaacataaacggattttcggctagtgtagcgctgtacccttcagatagtttgggcattgtggttttagcaaatcaaaatggctcacaagtaccacgacttattagaaatattgccgcagaccatatgctacaagttaagaaaacagaatgggcaaaaaagtacaaggaagatctgcaaaaagcgctaaagatgcaagaagaagctaaagaggagatggaaacgtctaatgtaaaaaacaccaaaccctcccatacacaaatagactatacagggatatatgagcacaaaggttatggaacttttgaaattgaaatagaaaatgattccttatttaccgccttaaatgataaaaaaatatttttaaatcattttcattatgatacgtttgagatgttatatgttgaaaacggaaaagtagataccaccgaaattggaaacgctattaaactacactttagtaccaatattgcaggagatatagattatgcacgtattgatatagaaaatttagtagatcctatagcatttaagcgcacaccaaacaccattgatgtagacgccaaaacgtttagacaatacgtaggtgactttgatttaatgggtacagaaataaaagcctatatcaaagaagacaatgtactttatgtatttattaaaggacagccccgatatgccttaataccctacgcaacacacaaatttaatttcaaaacttttaaaaggctttaa

SEQ ID NO: 25446 - protein, 313 aa, Unknown
  Obtained from environmental sample
  misc_feature (1)..(313): Xaa is any amino acid
MSQWLMTWINDGKYKENQILPETYVKEAMSSQMIVSAGFPSKELPDVQFANYGYGWFLHAYKGHYMVEHGGNINGFSASVALYPSDSLGIVVLANQNGSQVPRLIRNIAADHMLQVKKTEWAKKYKEDLQKALKMQEEAKEEMETSNVKNTKPSHTQIDYTGIYEHKGYGTFEIEIENDSLFTALNDKKIFLNHFHYDTFEMLYVENGKVDTTEIGNAIKLHFSTNIAGDIDYARIDIENLVDPIAFKRTPNTIDVDAKTFRQYVGDFDLMGTEIKAYIKEDNVLYVFIKGQPRYALIPYATHKFNFKTFKRL

SEQ ID NO: 25447 - DNA, 456 bp, Unknown
  Obtained from environmental sample
  misc_feature (1)..(456): n is a, c, g, or t
atggatatcaagccttacgtagatggacttaatgacgtagcattagcttatgcaaacatgccagaggctattaaagcggaagctatagttaacagcttaaaatctgtaagtgataaaacgtttaaaccaaatacggagtctacgtcctttaaagtattgttccaatttgaaaaaaacaatactgaagcgataactgcatttaaaaaaatattagacgaggtaacacctaaggtgcaatattataatttgtcaacatctgtagatgtttataatcccgaaacttcatttgtagtggttcatggtttaaaaagcgtagatggagcaaaagggtttgcagagattttaaaagcagaagataaatataaaatagatagaccttattttggaatttcttctgacaattataaaatacttcaaatacataaaaatctaaatcaatatttagaaaatcaataa

SEQ ID NO: 25448 - protein, 151 aa, Unknown
  Obtained from environmental sample
  misc_feature (1)..(151): Xaa is any amino acid
MDIKPYVDGLNDVALAYANMPEAIKAEAIVNSLKSVSDKTFKPNTESTSFKVLFQFEKNNTEAITAFKKILDEVTPKVQYYNLSTSVDVYNPETSFVVVHGLKSVDGAKGFAEILKAEDKYKIDRPYFGISSDNYKILQIHKNLNQYLENQ

SEQ ID NO: 25449 - DNA, 774 bp, Unknown
  Obtained from environmental sample
  misc_feature (1)..(774): n is a, c, g, or t
atgaaaaaattagctgtattaattgtattagtatgcacaatattatcgtgcaacgaagggacaaaacaaaaccagcgtatggtcccaaaatcttcaggaaacttatataacgttagtgttgttgtagataacgagttatggaaaggtaatgttggagacgctattagagacgtattaactactgtagtacctggattaccacaaccagagcctatgtttgatattaatcaaattccgccacaagtattctctggatttgctgcaaaaaatagaattgttttaaaaatagaacaaagcgaaaagtctgagattaaaatagctacagatgcgtatgcacaacctcaaaaggtagtagttgtatcaggaccaaatgacagcaaaattattgaggttttaaagtctaataaagataaaattttagatacgtttaaaaaccaagaaattgaagcacgtcaaacgttgacaaacaactcactgcatacaaataataacatagaaaaaaaattaggaatctcggttaagtttccttctatctatagaatagctaaagaggatggtgattttttctgggttagaaaaaatttaacaacaggaactaataattttatggtgtaccaagtaccattagatgctatagataaagaaggagatattacacagcaaattataactattagagatagtgttggtaaaaaggtatattcctggaccaatagatggctcatacatgaaaaccgaagaagcttacacacccttttctcgagccgattctga

SEQ ID NO: 25450 - protein, 257 aa, Unknown
  Obtained from environmental sample
  SIGNAL (1)...(19)
  misc_feature (1)..(257): Xaa is any amino acid
MKKLAVLIVLVCTILSCNEGTKQNQRMVPKSSGNLYNVSVVVDNELWKGNVGDAIRDVLTTVVPGLPQPEPMFDINQIPPQVFSGFAAKNRIVLKIEQSEKSEIKIATDAYAQPQKVVVVSGPNDSKIIEVLKSNKDKILDTFKNQEIEARQTLTNNSLHTNNNIEKKLGISVKFPSIYRIAKEDGDFFWVRKNLTTGTNNFMVYQVPLDAIDKEGDITQQIITIRDSVGKKVYSWTNRWLIHENRRSLHTLFSSRF

SEQ ID NO: 25451 - DNA, 363 bp, Unknown
  Obtained from environmental sample
  misc_feature (1)..(363): n is a, c, g, or t
atggccattaagtttagaatggatgaaaaacagtttgatgttgatggagcttacaatattcgttacgaaattattaaaaaacgaattgacaaagcctttataaagaatacagaagaacgtttaactgtacctggtaaaatagccattgtatactcacaagacaaagatgctttagagtatataaaatatataaacttcttacaatctaaaaaacaattgggcaaattagagtttttagaattagaagttttacaaggtgctgctggtttaaaagctttacgtgtagaagttatttaccaagaagattttgatgagaaaaaagtaattacttttaacgatttaattaaggaaatatctaactaa

SEQ ID NO: 25452 - protein, 120 aa, Unknown
  Obtained from environmental sample
  misc_feature (1)..(120): Xaa is any amino acid
MAIKFRMDEKQFDVDGAYNIRYEIIKKRIDKAFIKNTEERLTVPGKIAIVYSQDKDALEYIKYINFLQSKKQLGKLEFLELEVLQGAAGLKALRVEVIYQEDFDEKKVITFNDLIKEISN

SEQ ID NO: 25453 - DNA, 708 bp, Unknown
  Obtained from environmental sample
  misc_feature (1)..(708): n is a, c, g, or t
ttgaatcggctcgagtacagtggaaagtgtcggaaaaagatgggttnttcatggtgggtaaaacgatttaagcatatgttttctatttgtgatgccatcaggntagatcatttcaggggatttgatgaatattgggaagttaagtcatcggaaaaaacagctgaaaacggacgatgggtaaaggggccgggtgaaaagttgttcgatacgatacttgaaaagtgtggagatcttcctattcttgctgaagatttaggctttgtaacaaaaggcgttgagcaattacgggataagtacgattttccaggaatgaaaatcatccaatttgcttttgattcggactcaacaaatagttttttaccacataattatcatcaaaattgtgttgtatattctggtacgcatgataacgataccagtattggttggtataattctacacaagaagaagaaaaacacaaagccagaatgtatacacgatctaatggaagcgaaataaattgggactttattcgattagggatgtattcggttgctgatcaagcaatatttccgttgcaagattttatgggattggataaatctcatcgaacaaatataccagggacatcatctggtaattggctttggagatatacatcggatatgttacaagaagttgagaatgagagaattaaggatttgataatcaattcaaacagaaagtag

SEQ ID NO: 25454 - protein, 235 aa, Unknown
  Obtained from environmental sample
  DOMAIN (1)...(233): 4-alpha-glucanotransferase
  misc_feature (1)..(235): Xaa is any amino acid
MNRLEYSGKCRKKMGXSWWVKRFKHMFSICDAIRXDHFRGFDEYWEVKSSEKTAENGRWVKGPGEKLFDTILEKCGDLPILAEDLGFVTKGVEQLRDKYDFPGMKIIQFAFDSDSTNSFLPHNYHQNCVVYSGTHDNDTSIGWYNSTQEEEKHKARMYTRSNGSEINWDFIRLGMYSVADQAIFPLQDFMGLDKSHRTNIPGTSSGNWLWRYTSDMLQEVENERIKDLIINSNRK

SEQ ID NO: 25455 - DNA, 492 bp, Unknown
  Obtained from environmental sample
  misc_feature (1)..(492): n is a, c, g, or t
ttgactgtaaaacaaattattcagtcaattaaggatgtaacaaatgtagttaaggaatataaaactattgaaggcgtagaagagcaatatcaaaagcaaaatgagaaattaaacaccctaaaaaatcaactcttaaaaaagaaaggtaatcttgaaaagttatctgaaatattagaactcaaagatgacacctcatttgcatcacagcttcttaataagaagcagagtatttctcttggacaagagaccgtacttcgctcttttctgttagacactaaatggaattttccggaagaagttgtagatcaagtaatgtattcctctagtttagatattctcaacgaggagtttatagaagaggatgagaaaaaacaaggatggtggtataacataggaggtataaacagatttataaaatcactttcttcagatcgtttgtttgatgacaaagatgctttgtccaatgcttttagcattaaaaagcagaattaa

SEQ ID NO: 25456 - protein, 163 aa, Unknown
  Obtained from environmental sample
  misc_feature (1)..(163): Xaa is any amino acid
MTVKQIIQSIKDVTNVVKEYKTIEGVEEQYQKQNEKLNTLKNQLLKKKGNLEKLSEILELKDDTSFASQLLNKKQSISLGQETVLRSFLLDTKWNFPEEVVDQVMYSSSLDILNEEFIEEDEKKQGWWYNIGGINRFIKSLSSDRLFDDKDALSNAFSIKKQN

SEQ ID NO: 25457 - DNA, 321 bp, Unknown
  Obtained from environmental sample
  misc_feature (1)..(321): n is a, c, g, or t
ttgaaaataataatatacttgatggcaataattaataaactaatagttcccaaccttcaacttctaaaatcactaaagactgaccgtaaaggtgttttagaagtaggcacatcacccaaacatccctatacaaacctaaattgtaatatatcttttattgataatatcaccttagagccagatccatacataactaaaaaaatgcaaggagcagattataaaataaaagctgaaactgaattaaaactaagctgtactgatattgactattacatattaggaaagcatattataccaaaacatattcttttccaaatttga

SEQ ID NO: 25458 - protein, 106 aa, Unknown
  Obtained from environmental sample
  misc_feature (1)..(106): Xaa is any amino acid
MKIIIYLMAIINKLIVPNLQLLKSLKTDRKGVLEVGTSPKHPYTNLNCNISFIDNITLEPDPYITKKMQGADYKIKAETELKLSCTDIDYYILGKHIIPKHILFQI

SEQ ID NO: 25459 - DNA, 537 bp, Unknown
  Obtained from environmental sample
  misc_feature (1)..(537): n is a, c, g, or t
gtggacgccatcgattcgagttttaatataaactttgtagataataaaaaccaacagttcttgtacgttttacaatgctatgatccaaacgttattattctatgtgagaacgggaattttttagacagagataaattaccaagagaaaatgggtatgaactgtggtatgctggtggtaagaatgttccaaagttagagtatacttatgaattaagaagaggattgcccatttattattcagcagattgggataaagatggtttagaaatatatcaattagtgaagaatataattccagatatacagcttttacatcccgatggaatttctagaggtataaaagatacagatcataaaagtcattggaaggattctgagaatcctgatagtttatctggtttaaaaaaagaattttattcagaaagagacatatctctcattaaagaattaatacataaaaatcattggattacggaagaaggaaacaacctcaaaataatgattgaaaataataatatacttgatggcaataattaa

SEQ ID NO: 25460 - protein, 178 aa, Unknown
  Obtained from environmental sample
  misc_feature (1)..(178): Xaa is any amino acid
MDAIDSSFNINFVDNKNQQFLYVLQCYDPNVIILCENGNFLDRDKLPRENGYELWYAGGKNVPKLEYTYELRRGLPIYYSADWDKDGLEIYQLVKNIIPDIQLLHPDGISRGIKDTDHKSHWKDSENPDSLSGLKKEFYSERDISLIKELIHKNHWITEEGNNLKIMIENNNILDGNN

SEQ ID NO: 25461 - DNA, 390 bp, Unknown
  Obtained from environmental sample
  misc_feature (1)..(390): n is a, c, g, or t
ttgaaatcaattttggaatggttgtctttaattctaaaccattttacaaataacggtaaaaataaaagaggaactagttttgttgaaattgacagcgcaaagactacagcagcccattgccatttgtttttatgtaataagtataagcttagtattaaaaagaatatcatgacaccttcaaagtgtaaattccctgttagttctattataataaatgggtttagggtataccagaatattttatgtggttttagtcctagtctttttaatagtttagctccaaaatatagggttccgatatctgcagctattattataagtcttaatcctattactgatcccagaatgcttgaagaagagaataaattagctagcgtaaatagtaattga

SEQ ID NO: 25462 - protein, 129 aa, Unknown
  Obtained from environmental sample
  misc_feature (1)..(129): Xaa is any amino acid
MKSILEWLSLILNHFTNNGKNKRGTSFVEIDSAKTTAAHCHLFLCNKYKLSIKKNIMTPSKCKFPVSSIIINGFRVYQNILCGFSPSLFNSLAPKYRVPISAAIIISLNPITDPRMLEEENKLASVNSN

SEQ ID NO: 25463 - DNA, 390 bp, Unknown; identical to SEQ ID NO: 25461
  Obtained from environmental sample
  misc_feature (1)..(390): n is a, c, g, or t

SEQ ID NO: 25464 - protein, 129 aa, Unknown; identical to SEQ ID NO: 25462
  Obtained from environmental sample
  misc_feature (1)..(129): Xaa is any amino acid

SEQ ID NO: 25465 - DNA, 372 bp, Unknown
  Obtained from environmental sample
  misc_feature (1)..(372): n is a, c, g, or t
atgaccatcactatttacggtattaaatcttgtagcacgatgaaaaaggcttttactaagctcgatgagctaggcatcagctatgattttcatgattataaaaaacaaggtatcgataaagaaacgcttcagcgttgggtcaacgagcttggcattgataaagtattaaacaagcgcggcaccacatggcgtaagctcaccgatgagcaaaagcaagccgctgatactaatgtaactaatgccattgatttacttgtcgaaaataccagcatgattaaacgtcccatcgtcgaaggtcagcttaagaataaggatcaggcggtcttattgtgcggttttgatgaagaagcattcgatatgaacttttcgtaa

SEQ ID NO: 25466 - protein, 123 aa, Unknown
  Obtained from environmental sample
  DOMAIN (6)...(123): ArsC family
  misc_feature (1)..(123): Xaa is any amino acid
MTITIYGIKSCSTMKKAFTKLDELGISYDFHDYKKQGIDKETLQRWVNELGIDKVLNKRGTTWRKLTDEQKQAADTNVTNAIDLLVENTSMIKRPIVEGQLKNKDQAVLLCGFDEEAFDMNFS

SEQ ID NO: 25467 - DNA, 549 bp, Unknown
  Obtained from environmental sample
  misc_feature (1)..(549): n is a, c, g, or t
atgctaagggaaggaatgagttttacagaatttacttatcaattgatccaaggctatgagtttgtacatttatattctaaaaataactgtaaacttcaaatgggtggttctgaccaatggggaaatataaccacaggtactgaattaattagacgtaaagtacaaggaaaagcatttgctattacttgccctttgatcactaaagcagacggaacgaaatttggcaaatcagaagncggtaatatctggttagacgccgaaaggacctccccttataaattttatcaatactggttgaatgcttctgatgctgatgcagaaaagtatattaaaattttcacctttttagataaagaaatggttgaagaattaattaatgagcataatgaagctcctcatttgcgattgcttcaaaaaagggtagccacagaagtaacacaaatggtacactctaaagatgctttagataatgccataaaggcgtcaaacattttatttggccaatctacggctgatgatttaaaaagtttggatgaaaaacttttttag

SEQ ID NO: 25468 - protein, 182 aa, Unknown
  Obtained from environmental sample
  DOMAIN (1)...(167): tRNA synthetases class I (W and Y)
  misc_feature (1)..(182): Xaa is any amino acid
MLREGMSFTEFTYQLIQGYEFVHLYSKNNCKLQMGGSDQWGNITTGTELIRRKVQGKAFAITCPLITKADGTKFGKSEXGNIWLDAERTSPYKFYQYWLNASDADAEKYIKIFTFLDKEMVEELINEHNEAPHLRLLQKRVATEVTQMVHSKDALDNAIKASNILFGQSTADDLKSLDEKLF

SEQ ID NO: 25469 - DNA, 891 bp, Unknown
  Obtained from environmental sample
  misc_feature (1)..(891): n is a, c, g, or t
gtggaaagaattcaggaaaactgttcaacttcgaattttgacccgttcaagctcttcagccaatccacccattcgggccattatcatcggttccccctttttatctcacctcaagtggtattatcagccaccgggaactataagagataccccggaatctggcagtggaatgttcaacagggaaaagagaaaaagaaaatctccaagtcccgtatcagtggaatgacgcacttcaaagaaggggagaaaatctattattccgccaccgactactacaaaacgttctattatttctccgatatttacgaatgggatctccgggagaataaatcccgaaaattgtccaaagggaagcgactttcatatccagtcaggcagggagacatcatctactgcgtgaaaagaaagaaatccaaatcatatctctgtcgatttgatttaaaagagaaaagtgtcaaaatcctgtcgcagccttttgatgccatggcttttatatcggtatctccagagggggaaaaaatagccgcttcggtcaaaacgagagggaatcgatggggaatcggcatttttaacccatccggctcgttgatcaagatattaagtcaccctgatgggaaaaattactaccccctgtggaaaaccagtaaagacctctattttgtctcccagatcgacgatacatatcgactggcaaaatatcaaccggaggtaaacaaatgctggattcaaagcacccccaatctccctccgatccaatatttcaattggacgccaaataagcagggtttgattctgacatttttcaatgccagcggatatgatctggggatacttcctgagtccggaattgaatttgacgtccatcaagacatcaacattcaagaaaannna

SEQ ID NO: 25470 - protein, 297 aa, Unknown
  Obtained from environmental sample
  misc_feature (1)..(297): Xaa is any amino acid
MERIQENCSTSNFDPFKLFSQSTHSGHYHRFPLFISPQVVLSATGNYKRYPGIWQWNVQQGKEKKKISKSRISGMTHFKEGEKIYYSATDYYKTFYYFSDIYEWDLRENKSRKLSKGKRLSYPVRQGDIIYCVKRKKSKSYLCRFDLKEKSVKILSQPFDAMAFISVSPEGEKIAASVKTRGNRWGIGIFNPSGSLIKILSHPDGKNYYPLWKTSKDLYFVSQIDDTYRLAKYQPEVNKCWIQSTPNLPPIQYFNWTPNKQGLILTFFNASGYDLGILPESGIEFDVHQDINIQEXX

SEQ ID NO: 25471 - DNA, 540 bp, Unknown
  Obtained from environmental sample
  misc_feature (1)..(540): n is a, c, g, or t
atggaagtttgtcacaccagtaacccagcacttattcttataccagatattagtgggtttaccaaatacattgccacttctgaaattaggcatagtcaggaaaaaattgcactattgctcgaatcaattttagaaaataatatactaaattttaaagtgtctgaaatcgaaggcgatgctattttattttacagttatgaatttccatattcagcaacggaaatcattaatcaatgtcaattgatgttcgacaaattccatcagagaatagatgaatttaaactatcgaaatgtatgtgtgggtcttgccaaaaactgtataagctttcattaaaatttgtactccattttggacaacttggttctgtaatggtaaaagactattgtaaactctttggtaaagatttaataatagcacatcggcttcttaaaaacaaaattagctcaaatgagtacatacttttcacggaaattttagcaatcatttccacttatagcactcatctgataccatacgaatgtcaacgacatttcatttag

SEQ ID NO: 25472 - protein, 179 aa, Unknown
  Obtained from environmental sample
  misc_feature (1)..(179): Xaa is any amino acid
MEVCHTSNPALILIPDISGFTKYIATSEIRHSQEKIALLLESILENNILNFKVSEIEGDAILFYSYEFPYSATEIINQCQLMFDKFHQRIDEFKLSKCMCGSCQKLYKLSLKFVLHFGQLGSVMVKDYCKLFGKDLIIAHRLLKNKISSNEYILFTEILAIISTYSTHLIPYECQRHFI

SEQ ID NO: 25473 - DNA, 531 bp, Unknown
  Obtained from environmental sample
  misc_feature (1)..(531): n is a, c, g, or t
atggaagtttgtcacaccagtaacccagcacttattcttataccagatattagtgggtttaccaaatacattgccacttctgaaattaggcatagtcaggaaaaaattgcactattgctcgaatcaattttagaaaataatatactaaattttaaagtgtctgaaatcgaaggcgatgctattttattttacagttatgaatttccatattcagcaacggaaatcattaatcaatgtcaattgatgttcgacaaattccatcagagaatagatgaatttaaactatcgaaatgtatgtgtgggtcttgccaaaaactgtataagctttcattaaaatttgtactccattttggacaacttggttctgtaatggtaaaagactattgtaaactctttggtaaagatttaataatagcacatcggcttcttaaaaacaaaattagctcaaatgagtacatacttttcacggaaaattttagcaatcaatttccacttataggcactcatcttgataaccatacggaattgtaa

SEQ ID NO: 25474 - protein, 176 aa, Unknown
  Obtained from environmental sample
  misc_feature (1)..(176): Xaa is any amino acid
MEVCHTSNPALILIPDISGFTKYIATSEIRHSQEKIALLLESILENNILNFKVSEIEGDAILFYSYEFPYSATEIINQCQLMFDKFHQRIDEFKLSKCMCGSCQKLYKLSLKFVLHFGQLGSVMVKDYCKLFGKDLIIAHRLLKNKISSNEYILFTENFSNQFPLIGTHLDNHTEL

SEQ ID NO: 25475 - DNA, 720 bp, Unknown
  Obtained from environmental sample
  misc_feature (1)..(720): n is a, c, g, or t
gtggttctttacctgctatttgtaaaagcagatgacgacttgttatacgttttaaagtttagaggtncagttcaaggaaaaaaagcattaattgccgaatttattggaggcgaattagcaagagctattgggttaaaagtaccagagttggtttttatgaatttggatgactcgtttagcaaaacagaaccagatgaagaaatacaagacttacttaagtttagcgtaggtttaaacctaggactacattatttaagtggtagtataacctttgatcctttggcatctgttgcagatcctttgacagcatccaaagtattattattagatagcattattagtaatattgacagaacagttaaaaaccctaatgtacttaattggaataaagagttatgggttattgataatggagcaagtttttattttcatcataattgggagacttgggagaatcatttaaccagaacatttccgttaattaaagatcatgttttattagatcgtgcttcaaaatttgatgaagcatcgcaacaaattattgaaaaattaagtttaaatactattgacactataattaataccatacctgaagattggctaataaatgagtctgacacttttacgccaaaccaaatgaaagctgcttacaaaacgtatttaaactccaggcttgaaaagattaacttactagttaaagaagctaaagatgcaagataa

SEQ ID NO: 25476 - protein, 239 aa, Unknown
  Obtained from environmental sample
  misc_feature (1)..(239): Xaa is any amino acid
MVLYLLFVKADDDLLYVLKFRGXVQGKKALIAEFIGGELARAIGLKVPELVFMNLDDSFSKTEPDEEIQDLLKFSVGLNLGLHYLSGSITFDPLASVADPLTASKVLLLDSIISNIDRTVKNPNVLNWNKELWVIDNGASFYFHHNWETWENHLTRTFPLIKDHVLLDRASKFDEASQQIIEKLSLNTIDTIINTIPEDWLINESDTFTPNQMKAAYKTYLNSRLEKINLLVKEAKDAR

SEQ ID NO: 25477 - DNA, 516 bp, Unknown
  Obtained from environmental sample
  misc_feature (1)..(516): n is a, c, g, or t
ttgtcttctggtattaatgctttattacagcgtatcgagaatgctatcgaaagagaacgtcaatttacatcggacgcttctcacgaattacgtacacctttagcaactttaaaagggacgctggaagtattaattcgtaaaccaagggagcaatcagaatatgaagacaaaattaagtttagtcttacagaaatagacagaatgactgccactatcgaacaattattgttgttagcaagattagatactaattcaaagcaaaaaaacaaagcgtccatttccttaacaacaatcattgacgaaattctttcaagacataaaaatcagattacaaaaaagaaactctcgattgattttaaaaatgaaacagtaaatgacacctcagtccctcagtattttagtaaccttatattagaaaatattattggtaatgctataaaatatgctaaggatgctaccaaaatacacatatcaattacccaattagattcagaaactattgcaaagttcaaatga

SEQ ID NO: 25478 - protein, 171 aa, Unknown
  Obtained from environmental sample
  DOMAIN (18)...(84): His Kinase A (phosphoacceptor) domain
  misc_feature (1)..(171): Xaa is any amino acid
MSSGINALLQRIENAIERERQFTSDASHELRTPLATLKGTLEVLIRKPREQSEYEDKIKFSLTEIDRMTATIEQLLLLARLDTNSKQKNKASISLTTIIDEILSRHKNQITKKKLSIDFKNETVNDTSVPQYFSNLILENIIGNAIKYAKDATKIHISITQLDSETIAKFK

SEQ ID NO: 25479 - DNA, 552 bp, Unknown
  Obtained from environmental sample
  misc_feature (1)..(552): n is a, c, g, or t
atggaagctattgatcaaataaaagagaagattaccacgcagaaaagttttgtattggaagctggtgcaggtgcaggaaaaacttatgcactaattcaaactattaaccatctcattgacactaagggtaaagacctatctcttaataatcaaaaaattgtctgcattacttacactaatgtagccaaaaatgaaattatagatcgccttgagaataatcctttagtattagtttctacaattcacgagttcctgtgggatagtataagactatttaacaagcagttaattatagaatttgatgctatcaataccattaaacacgaagaaaagccagacaaacatatccttggattagctgaccgtataaaatctgttgagtattcggatagagcttttagtgattttgaaaatggaaccgtaggacacgatgacttaattcttttgtctcaaagaatgtctgagaattatgagttattaacatcaattattacatcgaaatatccatatcttttggtcgatgaatatcaagatacggncccagaatnnntn

SEQ ID NO: 25480 - protein, 184 aa, Unknown
  Obtained from environmental sample
  misc_feature (1)..(184): Xaa is any amino acid
MEAIDQIKEKITTQKSFVLEAGAGAGKTYALIQTINHLIDTKGKDLSLNNQKIVCITYTNVAKNEIIDRLENNPLVLVSTIHEFLWDSIRLFNKQLIIEFDAINTIKHEEKPDKHILGLADRIKSVEYSDRAFSDFENGTVGHDDLILLSQRMSENYELLTSIITSKYPYLLVDEYQDTXPEXX

SEQ ID NO: 25481 - DNA, 810 bp, Unknown
  Obtained from environmental sample
  misc_feature (1)..(810): n is a, c, g, or t
ttgaaaagttatgttgatgcaaaacggattgaaaatattgacaaaattgaaaattaccgcagttgtcaagaggttattgacttacttaacaatgttagaacaaacataaaacaggaaataccaaagggtgctgaaaaggaaaaaggtagtgtagagtttataaatagtgaaaattatcctgacaaaattaagggtcaaaaggtaaaagaatatgaagattcattgatgccacaaaaaagtaaaaactatgattacgttataaaggagttagagtcaaaaggctgggaattcggagcaggaagcgaagataaaattctaattatagcaaatagccgtgttgctcgaagaggtggttttggaaaactttacgggatttataatcgtagatttcctcttggtgctgcagatgctctaattaaacgagagcatcctttaacagccctttttgttgggtctatggataaaaaaacatctatagagaggaagactggaatagaacatttagtaaatcattatgataatggttcgtataatgaaatatctagttttttaaaacgtaatggctctcaatcaatcaatttaaaaaagcattccgataagaaggttattaacgaaaaaattgaaggattgataactacaagaaatacaaaatcaactaaagatgttttagattatgcactagaaaacaagcttattgttctttcgaaaggtatgtatagattacaagaaaaggttaataaaaatacagatggactatctgatgatgaaaaggctaaaatagaaaaagagaaatcttttacgattctgtaa

SEQ ID NO: 25482 - protein, 269 aa, Unknown
  Obtained from environmental sample
  misc_feature (1)..(269): Xaa is any amino acid
MKSYVDAKRIENIDKIENYRSCQEVIDLLNNVRTNIKQEIPKGAEKEKGSVEFINSENYPDKIKGQKVKEYEDSLMPQKSKNYDYVIKELESKGWEFGAGSEDKILIIANSRVARRGGFGKLYGIYNRRFPLGAADALIKREHPLTALFVGSMDKKTSIERKTGIEHLVNHYDNGSYNEISSFLKRNGSQSINLKKHSDKKVINEKIEGLITTRNTKSTKDVLDYALENKLIVLSKGMYRLQEKVNKNTDGLSDDEKAKIEKEKSFTIL

SEQ ID NO: 25483 - DNA, 732 bp, Unknown
  Obtained from environmental sample
  misc_feature (1)..(732): n is a, c, g, or t
atgtnttctttgnaaaagttagtatttccagacatacnacaagaagtagtcctattgttgtgtgagaaaaacaattctaaaacacacttgattgagcatttagaagtgaaaaatgcagaagaactagaaaaactagatgtatcaaaactaaaaagtccaaaaaagaaaattgatttcaaatcaaacaaatggactttttacttcttggaacaaaacgaaatcgactttttagaaaaacttcaaaacgacaaaataattccaagacttaaagaatatgcaaaagtagaagttggaatcacaacaggttcaaatccatttttcacagttccgctttctattgtgcaattttacaatcttgaaaagtatgcaaaaccattagtcggcagaagcgttcaggttccaagtgcaattttcacagaaaaagactggattaaaaacagaaattcagaagcaagaacgcactttttatcatttccaaaaatggacgaactaaatggttctgttggagctagagaatatattgcttggggagtagaaaagaaaattcacaaaggttataaatgcaggattcgtgatgaatggcaaattgtgccatcacaaagaatatctgatgcattgtttattaggaggaataataagtatccacaactcataatcaacgaagcagaggcttttacaacagatacaatgcacagagtaactgtaaaagagaaaacgaacataaaagcttga

SEQ ID NO: 25484 - protein, 243 aa, Unknown
  Obtained from environmental sample
  misc_feature (1)..(243): Xaa is any amino acid
MXSLXKLVFPDIXQEVVLLLCEKNNSKTHLIEHLEVKNAEELEKLDVSKLKSPKKKIDFKSNKWTFYFLEQNEIDFLEKLQNDKIIPRLKEYAKVEVGITTGSNPFFTVPLSIVQFYNLEKYAKPLVGRSVQVPSAIFTEKDWIKNRNSEARTHFLSFPKMDELNGSVGAREYIAWGVEKKIHKGYKCRIRDEWQIVPSQRISDALFIRRNNKYPQLIINEAEAFTTDTMHRVTVKEKTNIKA

SEQ ID NO: 25485 - DNA, 843 bp, Unknown
  Obtained from environmental sample
  misc_feature (1)..(843): n is a, c, g, or t
gtgtttgctataaaacttctagaaaatgaagacaatgcaacaataacaacacctgcattaccaactcttgaccaaaatattcagtttggaaacagcctaattgagacatcagaaagaaataaaaaaaatcaaaatgaaataaacccttttgattttggtaaaactcgtttcgatgttgttgttggcaatccgccatatttggctacagagcatatgaaagagtttacacctcttgaattacccatttacaaatcaaaattcaattcatcatacaaacagtttgacaaatactttctttttattgaaagaggtctagaactcttaaaggaaggtggatattttggttatatagttccaagtaagtttgcgaaggttggagctggtaagaagttgagagaattacttgttgacaacaaagcaatacagcaaataatatcctttggggcaaatcaagtttttcaaaacaaaactacttatacttgtctcttaattctcaaaaaagaaaaactagaacaagtcaaatatcttgaagtaaattcgttcaaaaattggaaaacaagaaatattggttcagaaaattttgacgaatttaatatagattctttagaagcagatggttgggtcctttatccaagtattttaaaaccaatttatacatctattgtttcacaatcgaatacattagaggagcttattggttctgaaaatatatacaatggtattcaaacaagtgccaataacgtttatattcattcgatagaaaaaaaagataaagactttctttatttcataaaagacggtattcaatggaaagttgaagaaactttaacaagaccatannng

SEQ ID NO: 25486 - protein, 281 aa, Unknown
  Obtained from environmental sample
  DOMAIN (56)...(169): Eco57I restriction endonuclease
  misc_feature (1)..(281): Xaa is any amino acid
MFAIKLLENEDNATITTPALPTLDQNIQFGNSLIETSERNKKNQNEINPFDFGKTRFDVVVGNPPYLATEHMKEFTPLELPIYKSKFNSSYKQFDKYFLFIERGLELLKEGGYFGYIVPSKFAKVGAGKKLRELLVDNKAIQQIISFGANQVFQNKTTYTCLLILKKEKLEQVKYLEVNSFKNWKTRNIGSENFDEFNIDSLEADGWVLYPSILKPIYTSIVSQSNTLEELIGSENIYNGIQTSANNVYIHSIEKKDKDFLYFIKDGIQWKVEETLTRPXX

SEQ ID NO: 25487 - DNA, 816 bp, Unknown
  Obtained from environmental sample
  misc_feature (1)..(816): n is a, c, g, or t
atgaaatggatgatgggttggatgcatgatacgttacaatatttttcaaaagaaccaatttatagaaaacaccatcaaaatgatattaccttttcattaacctacgcatttacagaaaactttatgctgcctttaagtcatgatgaagtggtgtatggtaaaaaatctatcttaggaaggatgccaggagatgagtggcaacgttttgctaatgttagattgttatacagttatatgtttgctcatccaggtacaaaattattgtttcaaggtgctgaaattggtcaaagtgaagaatggaattttgaaactagtcttgattggcatttattggattatccatcgcataaagggttaaatagatttataaaagatattaatacgttttataaaacagaaccagcactttatcaaaaacaattttcaagtgatggttttgagtggattgattatggagattcagaacattctgtaatagtgtttatgcgtaaaggaaataagcctaaagacaacattattgtagcttgtaatatgacaccagtacctctaaataattacagaattggactacctaaaaaaggacaattaatagaagtatttaatagcgataataagcaatactttggaacaggagattttcaaaataagtcaatagttagccaattaaaactatggcattctagaaaaaattcagttgaaattacaataccacctttaggtatgatagccttaaaatatcaacctttaaaaaaaggaatattacgattatataatatatgtaattctcatttttactggttgataattagcgtttaa

SEQ ID NO: 25488 - protein, 271 aa, Unknown
  Obtained from environmental sample
  misc_feature (1)..(271): Xaa is any amino acid
MKWMMGWMHDTLQYFSKEPIYRKHHQNDITFSLTYAFTENFMLPLSHDEVVYGKKSILGRMPGDEWQRFANVRLLYSYMFAHPGTKLLFQGAEIGQSEEWNFETSLDWHLLDYPSHKGLNRFIKDINTFYKTEPALYQKQFSSDGFEWIDYGDSEHSVIVFMRKGNKPKDNIIVACNMTPVPLNNYRIGLPKKGQLIEVFNSDNKQYFGTGDFQNKSIVSQLKLWHSRKNSVEITIPPLGMIALKYQPLKKGILRLYNICNSHFYWLIISV

SEQ ID NO: 25489 - DNA, 759 bp, Unknown
  Obtained from environmental sample
  misc_feature (1)..(759): n is a, c, g, or t
atgagtaataatgatattataaactcaattagaagtaaaaacattccaattaaattaagctttaacaatcaagagcgtatccaaaatcttgcaggtcgtatagcacaacaaattgaaccggatagtttacagcttttatctgtaatgacggataatacttttttaacagagcataaatttactgatgcaacagttttaaatatgtatgtacctaatagttatgagtttttttggaatacgtcagccgaaggttttagagaacgtatgttaaaagaatattatcgtttttggaataccactagacaaacaaagcgtaaagctttaaacctatccgttaacgaggttatgactatagcatccatcgtacaaaaagaaactgctaaagttgacgaaagaccacgagtggctggagtatatttaaatagaataaaaaaaggaatgccattacaagcagatcctactgtgattttttctaaaaagttagaagaaaatgattttgatcaaattataaaacgtgtgtcatataaagaccttgaaattgattcgccatacaacacgtataaatatgctggtattcctcctggaccaataacaatgcctgatgtatcagcaattgatgctgtactaaatccagaatctcatgattactattactttgtcgttaatggtgcaaactttgggtatcataaatttgctaaaacctttaagtcacataatgccataaaaacgaattgtacgttggataatagtcaggtgtaa

SEQ ID NO: 25490 - protein, 252 aa, Unknown
  Obtained from environmental sample
  DOMAIN (1)...(244): Aminodeoxychorismate lyase
  misc_feature (1)..(252): Xaa is any amino acid
MSNNDIINSIRSKNIPIKLSFNNQERIQNLAGRIAQQIEPDSLQLLSVMTDNTFLTEHKFTDATVLNMYVPNSYEFFWNTSAEGFRERMLKEYYRFWNTTRQTKRKALNLSVNEVMTIASIVQKETAKVDERPRVAGVYLNRIKKGMPLQADPTVIFSKKLEENDFDQIIKRVSYKDLEIDSPYNTYKYAGIPPGPITMPDVSAIDAVLNPESHDYYYFVVNGANFGYHKFAKTFKSHNAIKTNCTLDNSQV

SEQ ID NO: 25491 - DNA, 330 bp, Unknown
  Obtained from environmental sample
  misc_feature (1)..(330): n is a, c, g, or t
atgatggcttctggtatgaatggtcaaagttttgcttttaatggttatttacctattgataaaggagagcgtaaagcagaattaaaacgattagaacgtttaagttttgaacataaccagacacagtcttttattgaaacaccttaccgaaacaataaattattagaagatttatgtaacacattaagcgaaaatacagaaatttgcgtggcgtgtgatataacattacctactgagtttattaaaacaaaaacagtaaatcaatggaaaacaaatagtgttgacctacataaaagaccaacactatttataatacacaaaagcttttaa

SEQ ID NO: 25492 - protein, 109 aa, Unknown
  Obtained from environmental sample
  misc_feature (1)..(109): Xaa is any amino acid
MMASGMNGQSFAFNGYLPIDKGERKAELKRLERLSFEHNQTQSFIETPYRNNKLLEDLCNTLSENTEICVACDITLPTEFIKTKTVNQWKTNSVDLHKRPTLFIIHKSF

SEQ ID NO: 25493 - DNA, 474 bp, Unknown
  Obtained from environmental sample
  misc_feature (1)..(474): n is a, c, g, or t
ttgatcagttttaagtataaattaacagcatatgtattagatattataaaaatttacactttttcaaaaaaatggataattagtatgagcaaatttgagcataaagttggggtatcagaggtgaatttagtggttcgttatttaaagctcactaatgtagatggaactaaagtagatgcgattcttcatgatattgatactacttttggcgttaataaagtgtcatttgagtatgagaagcaaactctacacgtcagctatgatgcaacacattgcagcttacagagcattaaaaatacaataaaaataaatggagcagatatttcgtatgattggtggactaactttaaagaaggctattatgagttcgtagataaaaatattagagaaaatgctaagcacaagccatggagttgccatgcatcgncaccgggtagtgcaaaaagtacaaaatcacgagacaaaaaaaattag

SEQ ID NO: 25494 - protein, 157 aa, Unknown
  Obtained from environmental sample
  misc_feature (1)..(157): Xaa is any amino acid
MISFKYKLTAYVLDIIKIYTFSKKWIISMSKFEHKVGVSEVNLVVRYLKLTNVDGTKVDAILHDIDTTFGVNKVSFEYEKQTLHVSYDATHCSLQSIKNTIKINGADISYDWWTNFKEGYYEFVDKNIRENAKHKPWSCHASXPGSAKSTKSRDKKN

SEQ ID NO: 25495 - DNA, 696 bp, Unknown
  Obtained from environmental sample
  misc_feature (1)..(696): n is a, c, g, or t
atggtgatgaaaggcgtctttaaagctttaaaatgcctgcctattgaagatgtttggggattgggaaggcagttgtctaagcaattattggcaaaagattgcaatactgcttacgattgtacacaattatctgatgtttgggttcaaaaaaacttttcggttgtggagtctaaattaaaacgagatttacaagggattccaactttaaagttggacgaaatagttacccaaaaaaagatgattgcaactacacgtagctttgattatagttattcggatatagaatatattaaagaacgtgttgcgacctttgcagttagttgtgccgaaaaattaagaaaacaaggctctagttgttatgtaataatagtaatgttaaaaagtgacaagcataaaaaagaattagaacaacatcgcattagtacaagtgtaaatttgacgtatcccactaactcgtctttaattataagtaattgtgccatcagtgcattaatgtctatctttaaaaaaggaatacagtacaaaaaagcaggtgttagtgttacaggattagtgccaatggataatcatcaattacatttgtttgatcaagaaaatccaaaacatgaaccactaatgaagtctattgatagcataaatgctaagtacacaaataataaagtaaaaatagcacatcaagatttaaagcatacctga

SEQ ID NO: 25496 - protein, 231 aa, Unknown
  Obtained from environmental sample
  misc_feature (1)..(231): Xaa is any amino acid
MVMKGVFKALKCLPIEDVWGLGRQLSKQLLAKDCNTAYDCTQLSDVWVQKNFSVVESKLKRDLQGIPTLKLDEIVTQKKMIATTRSFDYSYSDIEYIKERVATFAVSCAEKLRKQGSSCYVIIVMLKSDKHKKELEQHRISTSVNLTYPTNSSLIISNCAISALMSIFKKGIQYKKAGVSVTGLVPMDNHQLHLFDQENPKHEPLMKSIDSINAKYTNNKVKIAHQDLKHT

SEQ ID NO: 25497 - DNA, 507 bp, Unknown
  Obtained from environmental sample
  misc_feature (1)..(507): n is a, c, g, or t
atgagaaaattaagtattttaaaagctatagtagattttttttggataatctctcttccattaattcctctgttatttatttttattgggtttgtaatatttgataatagtttggaagggtttcctattaaaataaataatattgaggttacaagttttgatggtctaagcaaagctattttaataaccttaatgtgctcttatttaattttaatgtattgtgtgtttttatttaaaaaggtactgaggtattttactaaagttaatttgtttgacaatgtagttatctataatctaaataacattggtatttggttagtggttgctgctttattgcaaggtgttccaacttttatttataaaattttgtacaaacagaaattagagcttgaaattggttttagttcttttttaataatgctttgttttggattattttttatggtcctaagcgaagtgtttaaggtagctaagtttgcaaaacaagaaaacgacctaaccatatag

SEQ ID NO: 25498 - protein, 168 aa, Unknown
  Obtained from environmental sample
  misc_feature (1)..(168): Xaa is any amino acid
MRKLSILKAIVDFFWIISLPLIPLLFIFIGFVIFDNSLEGFPIKINNIEVTSFDGLSKAILITLMCSYLILMYCVFLFKKVLRYFTKVNLFDNVVIYNLNNIGIWLVVAALLQGVPTFIYKILYKQKLELEIGFSSFLIMLCFGLFFMVLSEVFKVAKFAKQENDLTI

SEQ ID NO: 25499 - DNA, 507 bp, Unknown
  Obtained from environmental sample
  misc_feature (1)..(507): n is a, c, g, or t
atgagaaaattaagtattttaaaagctatagtagattttttttggataatctctcttccattaattcctctgttatttatttttattgggtttgtaatatttgataatagtttggaagggtttcctattaaaataaataatattgaggttacaagttttgatggtctaagcaaagctattttaataaccttaatgtgctcttatttaattttaatgtattgtgtgtatttatttaaaaaggtactgaggtattttactaaagttaatttgtttgacaatgtagttatctataatctaaataacattggtatttggttagtggttgctgcttttttgcaaggtgttccaacttttatttataaaattttgtacaaacagaaattagagcttgaaattggttttagttcttttttaataatgctttgttttggattattttttatggtcctaagcgaagtgtttaaggtagctaagtttgcaaaacaagaaaacgacctaaccatatag

SEQ ID NO: 25500 - protein, 168 aa, Unknown
  Obtained from environmental sample
  misc_feature (1)..(168): Xaa is any amino acid
MRKLSILKAIVDFFWIISLPLIPLLFIFIGFVIFDNSLEGFPIKINNIEVTSFDGLSKAILITLMCSYLILMYCVYLFKKVLRYFTKVNLFDNVVIYNLNNIGIWLVVAAFLQGVPTFIYKILYKQKLELEIGFSSFLIMLCFGLFFMVLSEVFKVAKFAKQENDLTI

SEQ ID NO: 25501 - DNA, 306 bp, Unknown
  Obtained from environmental sample
  misc_feature (1)..(306): n is a, c, g, or t
atggcttccaaagtagaaaaacgtatggctttagctttacctgttttaagtatggatagattagctgtggttataccaacaatttcagctaactcgttacttttcatgtttcgcttttctagcattatgtccaaatttactattataggcataagctatatggttaggtcgttttcttgttttgcaaacttagctaccttaaacacttcgcttaggaccataaaaaataatccaaaacaaagcattattaaaaaagaactaaaaccaatttcaagctctaatttctgtttgtacaaaattttataa

SEQ ID NO: 25502 - protein, 101 aa, Unknown
  Obtained from environmental sample
  misc_feature (1)..(101): Xaa is any amino acid
MASKVEKRMALALPVLSMDRLAVVIPTISANSLLFMFRFSSIMSKFTIIGISYMVRSFSCFANLATLNTSLRTIKNNPKQSIIKKELKPISSSNFCLYKIL

SEQ ID NO: 25503 - DNA, 333 bp, Unknown
  Obtained from environmental sample
  misc_feature (1)..(333): n is a, c, g, or t
ttgtanttgtccttcatcagttttcttatggagcatgcnttacgggatactgccttgaagctgatttccaaagttgctttatatcgtggtattcgttatcgtttatttatatctaaagaaaacgacgaaaaagctcaaaaaagcattcgaaaaaacaatccattcctcaatcaagacaaaatttgtgttactcatgaggctccacaaaatacgatttgtgttacccgtaaggttccacaaatgaaaattaaacttaagggtaaatcggacaagcttaaatattttgagacttataaagaggctgctgttttcgcaaaaagaattgtcaagtag

SEQ ID NO: 25504 - protein, 110 aa, Unknown
  Obtained from environmental sample
  misc_feature (1)..(110): Xaa is any amino acid
MXLSFISFLMEHALRDTALKLISKVALYRGIRYRLFISKENDEKAQKSIRKNNPFLNQDKICVTHEAPQNTICVTRKVPQMKIKLKGKSDKLKYFETYKEAAVFAKRIVK

SEQ ID NO: 25505 - DNA, 342 bp, Unknown
  Obtained from environmental sample
  misc_feature (1)..(342): n is a, c, g, or t
gtgtatcgcatgattgataacgatggacaattttatggcgcagatgctgtcgcgatttatgccgaaggtgagattgatcaaatggaacactcttttgatgtaaccaaacaaataaatattaaggcgttaaaaaaagagccattattagagctagtaatggaggatggtaagcgtgtaatacctgcaagaacggttaacgaaattgctgaatattcgcaatcgcgtttagctcaacttccggatgaatataaacgttttcaaaatccgcatacctataaaattggattaagtagtcaacttaaaaaggaacgaaatgatctaattaacaaacataaaaactaa

SEQ ID NO: 25506 - protein, 113 aa, Unknown
  Obtained from environmental sample
  misc_feature (1)..(113): Xaa is any amino acid
MYRMIDNDGQFYGADAVAIYAEGEIDQMEHSFDVTKQINIKALKKEPLLELVMEDGKRVIPARTVNEIAEYSQSRLAQLPDEYKRFQNPHTYKIGLSSQLKKERNDLINKHKN

SEQ ID NO: 25507 - DNA, 465 bp, Unknown
  Obtained from environmental sample
  misc_feature (1)..(465): n is a, c, g, or t
ttggttacaggacgaccagacgctgcgttagatggtgtatataaattatctgaatacaatggtgatccaagaattaaactctctgaaaacattataaaagtatcactaccgtttaaaaaacaagtgtatcgcatgattgataacgatggacaattttatggcgcagatgctgtcgcgatttatgccgaaggtgagattgatcaaatggaacactcttttgatgtaaccaaacaaataaatattaaggcgttaaaaaaagagccattattagagctagtaatggaggatggtaagcgtgtaatacctgcaagaacggttaacgaaattgctgaatattcgcaatcgcgtttagctcaacttccggatgaatataaacgttttcaaaatccgcatacctataaaattggattaagtagtcaacttaaaaaggaacgaaatgatctaattaacaaacataaaaactaa

SEQ ID NO: 25508 - protein, 154 aa, Unknown
  Obtained from environmental sample
  misc_feature (1)..(154): Xaa is any amino acid
MVTGRPDAALDGVYKLSEYNGDPRIKLSENIIKVSLPFKKQVYRMIDNDGQFYGADAVAIYAEGEIDQMEHSFDVTKQINIKALKKEPLLELVMEDGKRVIPARTVNEIAEYSQSRLAQLPDEYKRFQNPHTYKIGLSSQLKKERNDLINKHKN

SEQ ID NO: 25509 - DNA, 336 bp, Unknown
  Obtained from environmental sample
  misc_feature (1)..(336): n is a, c, g, or t
atgaaaaaaggcacattttcgataaaaaacattatttatttaatcattattatagcgcttatcattccgcaatcgcgtaaacaaatacagattgttttgaataaaggaattgcgttatttggtccgagtattaaatctgatgacgcgactaaaaaaataagtagttacgattggactttgcaaagtatagacggtgaagcattcgattttaacagtactaaaaacaaagtcgttttggtaaacttgtgggcaacgtggtgcccgccgtgtatagccgaaatgccatctattcaagcgttacacgatgattataaagataaaattaatttgttttag

SEQ ID NO: 25510 - protein, 111 aa, Unknown
  Obtained from environmental sample
  misc_feature (1)..(111): Xaa is any amino acid
MKKGTFSIKNIIYLIIIIALIIPQSRKQIQIVLNKGIALFGPSIKSDDATKKISSYDWTLQSIDGEAFDFNSTKNKVVLVNLWATWCPPCIAEMPSIQALHDDYKDKINLF

SEQ ID NO: 25511 - DNA, 336 bp, Unknown; identical to SEQ ID NO: 25509
  Obtained from environmental sample
  misc_feature (1)..(336): n is a, c, g, or t

SEQ ID NO: 25512 - protein, 111 aa, Unknown; identical to SEQ ID NO: 25510
  Obtained from environmental sample
  misc_feature (1)..(111): Xaa is any amino acid

SEQ ID NO: 25513 - DNA, 420 bp, Unknown
  Obtained from environmental sample
  misc_feature (1)..(420): n is a, c, g, or t
gtgactaaaaacttgattgaaaaatcaaatgccatacatctagagattactaaaaatgatagtttgaaggtcgatttaccatttactaaatccgaaattttagcattaacgcctaaaagttatgaggctttaaaaactgattttccgcatttggaataccatcctaaaagtttaaaaaagtcattatttagttacccattaacttacatgggttttagtggttatcttaatccattaaccaatgaggctcaggtggatgatatgattcctgtgtacaaatttccgaccactgctgcacatgaagtagcacaccaattgggttatgctaaagaaaacgaggctaattttattgggctttttagcggactattagcaatactaatatctactttaaatattcgggttacacctttggtttaa

SEQ ID NO: 25514 - protein, 139 aa, Unknown
  Obtained from environmental sample
  misc_feature (1)..(139): Xaa is any amino acid
MTKNLIEKSNAIHLEITKNDSLKVDLPFTKSEILALTPKSYEALKTDFPHLEYHPKSLKKSLFSYPLTYMGFSGYLNPLTNEAQVDDMIPVYKFPTTAAHEVAHQLGYAKENEANFIGLFSGLLAILISTLNIRVTPLV

SEQ ID NO: 25515 - DNA, 672 bp, Unknown
  Obtained from environmental sample
  misc_feature (1)..(672): n is a, c, g, or t
gtgactaaaaacttgattgaaaaatcaaatgccatacatctagagattactaaaaatgatagtttgaaggtcgatttaccatttactaaatccgaaattttagcattaacgcctaaaagttatgaggctttaaaaactgattttccgcatttggaataccatcctaaaagtttaaaaaagtcattatttagttacccattaacttacatgggttttagtggttatcttaatccattaaccaatgaggctcaggtggatgatatgattcctgtgtacaaatttccgaccactgctgcacatgaagtagcacaccaattgggttatgctaaagaaaacgaggctaattttattggctttttagcgactattagcaatactaatatctactttaaatattcgggttacacctttggtttaaggcattgtctaggtgaaatttttagacgtgatcctgatttatattataaattattaccaacgattaatataggtattttaaaaaactatcaagaggttagagacttttggaatgattacaaaaacccgttggaaccaatttttagatctacttacacgtcttacctaaaagctaacaaccaagccaaaggtatggatagctatagctatgtggtggctttattggttaattatttggaagataaaatcttataa

SEQ ID NO: 25516 - protein, 223 aa, Unknown
  Obtained from environmental sample
  misc_feature (1)..(223): Xaa is any amino acid
MTKNLIEKSNAIHLEITKNDSLKVDLPFTKSEILALTPKSYEALKTDFPHLEYHPKSLKKSLFSYPLTYMGFSGYLNPLTNEAQVDDMIPVYKFPTTAAHEVAHQLGYAKENEANFIGFLATISNTNIYFKYSGYTFGLRHCLGEIFRRDPDLYYKLLPTINIGILKNYQEVRDFWNDYKNPLEPIFRSTYTSYLKANNQAKGMDSYSYVVALLVNYLEDKIL

SEQ ID NO: 25517 - DNA, 807 bp, Unknown
  Obtained from environmental sample
  misc_feature (1)..(807): n is a, c, g, or t
ttgtataaaattgtgtcaacaattaatttaactaagcaattaaaaatacaatatccagaatataattttgtgcctatctattggatggcttcagaggatcatgattttgaagaaataaattatttcaattttaaaggtaaaaagatacgttggaacaaaaatgcttcaggagcagttggagatttagatactactggtttagataatgtattagacctttttgcaaaagagttagggattggtcaaaatgctaaatttttaaaaacactatttgaaaacgcttacttaaaccatgataatttagctaaagctacacattatttagcaaatgcattatttggtgagcatggtttggtaattatagatgctaataataaagatttaaaaacattatttatacctcaaattaaaacagagttatttaataatacatcatttcaaaaagttactgaaacatcaaatcaattaagtcaagtatcagaaaactactctatacaagtaaatcctagagatataaatttattttacatcactaaaaatgtaagagaacgtatagtttttaaagatcaaaaatattctgttttaaacacgtcaatatcttggactaaagaagagttgtcaaaacatatagaccaggctccagaatgttttagtcctaatgtaattatgcgtccattgtatcaagaagttattttgccaaatttatgttacattggtggaggtggtgagctagcttactggtttcagttaaaagctattttgaagctaatatgtcgttttccaatattatttacgtatccggtttaa

SEQ ID NO: 25518 - protein, 268 aa, Unknown
  Obtained from environmental sample
  misc_feature (1)..(268): Xaa is any amino acid
MYKIVSTINLTKQLKIQYPEYNFVPIYWMASEDHDFEEINYFNFKGKKIRWNKNASGAVGDLDTTGLDNVLDLFAKELGIGQNAKFLKTLFENAYLNHDNLAKATHYLANALFGEHGLVIIDANNKDLKTLFIPQIKTELFNNTSFQKVTETSNQLSQVSENYSIQVNPRDINLFYITKNVRERIVFKDQKYSVLNTSISWTKEELSKHIDQAPECFSPNVIMRPLYQEVILPNLCYIGGGGELAYWFQLKAILKLICRFPILFTYPV

SEQ ID NO: 25519 - DNA, 633 bp, Unknown
  Obtained from environmental sample
  misc_feature (1)..(633): n is a, c, g, or t
ttgattcggnctgagaaaatacaaagtgatgctacagttgtaaaaacttctattcctggtattcagaaaacataccaaagaaaagttatggtaaagccaccaactacaactatggtaaaaactgaagcagaataccaaacaatagaaaaaactgttttagtaaaagatgcaagatcagaagaagttgttataccagctgtttacagatcaattacaaaagaaattttagtacaaaaaggaggtttaacttcatggaaagctgtagattgtcaattaatagataatacacctttaccaattaattgggatttttctagtgctgttttaaatgatggtgcaaagcaaattatagatgctcgtttattaccaatattaaatgatggtgtagctgtatttattgagtctcatacagatatgagaggaactaaaaaagataaccaagaattatctgacagaagagcaaaagctgtaactgattatttaatttctaaaggaattaacagaactcaattatatgcaaaaggttttggtgaatctagattgcttaacaaatgttctgatggagttgtttgtgcagaaaacgaacatgctgtaaatagaagaactacttttagagttacaaaccagaattaa

SEQ ID NO: 25520 - protein, 210 aa, Unknown
  Obtained from environmental sample
  DOMAIN (101)...(200): OmpA family
  misc_feature (1)..(210): Xaa is any amino acid
MIRXEKIQSDATVVKTSIPGIQKTYQRKVMVKPPTTTMVKTEAEYQTIEKTVLVKDARSEEVVIPAVYRSITKEILVQKGGLTSWKAVDCQLIDNTPLPINWDFSSAVLNDGAKQIIDARLLPILNDGVAVFIESHTDMRGTKKDNQELSDRRAKAVTDYLISKGINRTQLYAKGFGESRLLNKCSDGVVCAENEHAVNRRTTFRVTNQN

SEQ ID NO: 25521 - DNA, 747 bp, Unknown
  Obtained from environmental sample
  misc_feature (1)..(747): n is a, c, g, or t
atgcgaacagatcaaatgaagaatctctttttgctctcccttgtaatctccttgttgtcatgtaaaggagaaatttctgaagaaaaaaacatcgaagaaaaaattatagctccaagggttatccaaaaatttggatataccttaaataattataaagtagttgaagacactattaaaaaaggagaaaattttggtgaaattttatatagaaatcatatagaatacccagaggtttataatattgttgaaggttctaaggattcgttcgatgtacgaaggcttaatgcagggaaaccatatacaatactggctaaaaatgattcaaccgaaaaagcacaagtttttatttaccaacccagtaaagttgaatatgtagttattgattttacggattctgtttttgctcagttacataaaaagaaaattaagactgttaccaaaacggccacaggaataattaaatcatcattgtctgaagctattaatgataaaggattagattatgaattagttaatgaaatgtctgatatttatgcttggacaattgatttttttcaccttcagaaaaaggataatttcaaagttatttatgaagaaaaatttattgatgattcagtctacgttggcataggcgaaataaaagctgcttattttgagcataataaaacaccattttacgctttcanttttgtgacagattcaactaaaacatttacgattattatgatgaccatgctagtaatttaa

SEQ ID NO: 25522 - protein, 248 aa, Unknown
  Obtained from environmental sample
  misc_feature (1)..(248): Xaa is any amino acid
MRTDQMKNLFLLSLVISLLSCKGEISEEKNIEEKIIAPRVIQKFGYTLNNYKVVEDTIKKGENFGEILYRNHIEYPEVYNIVEGSKDSFDVRRLNAGKPYTILAKNDSTEKAQVFIYQPSKVEYVVIDFTDSVFAQLHKKKIKTVTKTATGIIKSSLSEAINDKGLDYELVNEMSDIYAWTIDFFHLQKKDNFKVIYEEKFIDDSVYVGIGEIKAAYFEHNKTPFYAFXFVTDSTKTFTIIMMTMLVI

SEQ ID NO: 25523 - DNA, 936 bp, Unknown
  Obtained from environmental sample
  misc_feature (1)..(936): n is a, c, g, or t
atggtagtagatgcattgcagtatataaaaaatcatttaaaaacacatttcatttcaaatattgatggtgaccatgttactgagacattaaaagaattgaatcctgaaacaccgctatttataattgtttcaaaaacctttacaacacaagaaacgttaaccaacgctgaaactgttaaaaaatggtttttatccctaaaattcggaactaaagaatcagagataaaatacaattttgttgcagtttcaaccaatttagagaaggttgcagattttggcattgcccaggaaaatattttcaccatgtgggattgggttggaggccgttattcattatggagtgccgtaggattgtctataagcatttctatcggatttgataacttcaagcagtttttaaccggagcttatgaaatggatgaacatttcaaaacagaaccctttcataaaaatattcccgctgtgctggcattactgagcatttggtataataatttttttaatactgaatctgaggttgtcatacctttttcacaatatttgaatcaattagtgccttattttcaacaactttctatggagagtaatggtaaatctgttgatagagatggtcatagagttaattatcaaaccgggaatgtagtttggggtaataccggtacgaatgtacaacatgcttttatgcagttaattcatcaaggcacaaaattaattcctgttgattttattggattctcatcttcactgtatggcaacaaggagcatcatgacaaactaatggctaatttctacgcccaagcagaagcattgtatttaggaaaaacaaaagaaaatgttcatttagagttaaaactttcaaataaaaaagaaaaaattgaacaattgctaccttttaaggtatttcaaggtaataaaccttctctcgagccgatctga

SEQ ID NO: 25524 - protein, 311 aa, Unknown
  Obtained from environmental sample
  DOMAIN (1)...(311): Phosphoglucose isomerase
  misc_feature (1)..(311): Xaa is any amino acid
MVVDALQYIKNHLKTHFISNIDGDHVTETLKELNPETPLFIIVSKTFTTQETLTNAETVKKWFLSLKFGTKESEIKYNFVAVSTNLEKVADFGIAQENIFTMWDWVGGRYSLWSAVGLSISISIGFDNFKQFLTGAYEMDEHFKTEPFHKNIPAVLALLSIWYNNFFNTESEVVIPFSQYLNQLVPYFQQLSMESNGKSVDRDGHRVNYQTGNVVWGNTGTNVQHAFMQLIHQGTKLIPVDFIGFSSSLYGNKEHHDKLMANFYAQAEALYLGKTKENVHLELKLSNKKEKIEQLLPFKVFQGNKPSLEPI

SEQ ID NO: 25525 - DNA, 726 bp, Unknown
  Obtained from environmental sample
  misc_feature (1)..(726): n is a, c, g, or t
atggaactcgtacttttaaaatccgctgcctgtttagccctttttatagtcttctataaattagttttagagaaagaaacaatgcacacttttaaacgcttttatttattagctgctttagggctttctataacgattccttttatcacgtttactgaatatataaacgtagctacaacagcacctacactaatcgcagacacggggcaatttcctctagctagtcaagaccaaaacattatagatcctataaattatttacaatacattctttggtcgttgtactgtttaggtgtattagtgttcgggttaaaatttggaattaacctgtttacaataaaacaacgcattgtaaataacccaaaacataaaacaaaacatattaccaatgttcttatagatggtgaggtaacaccccatacttttttaaactatattttttttaataaaaccaccttcgaaaacaataccattcctcaggaaattaaattacacgaagaaacgcacgctttacaaaaacattctttagacattttatttatcgaaacactgttggtgttcttttggtttaatccgttgctttatattattaaaaaacacattaagcttaatcacgaattccttgccgatgctggtgttttaaaacgtggtattaagccatcaacgtatcaaaacttattacttgcattctcatcacgtgccaaatataaccctttggcaaatgga

SEQ ID NO: 25526 - protein, 242 aa, Unknown
  Obtained from environmental sample
  DOMAIN (158)...(228): BlaR1 peptidase M56
  misc_feature (1)..(242): Xaa is any amino acid
MELVLLKSAACLALFIVFYKLVLEKETMHTFKRFYLLAALGLSITIPFITFTEYINVATTAPTLIADTGQFPLASQDQNIIDPINYLQYILWSLYCLGVLVFGLKFGINLFTIKQRIVNNPKHKTKHITNVLIDGEVTPHTFLNYIFFNKTTFENNTIPQEIKLHEETHALQKHSLDILFIETLLVFFWFNPLLYIIKKHIKLNHEFLADAGVLKRGIKPSTYQNLLLAFSSRAKYNPLANG

SEQ ID NO: 25527 - DNA, 780 bp, Unknown
  Obtained from environmental sample
  misc_feature (1)..(780): n is a, c, g, or t
ttggatgaagaggagcgtcaaattgccgaattccttgttggaagtgtagatgaaagcggatatattcgtcgcgaattgagtgatataatggacgatttggcgtttacacaaaatgtatataccactgaagagaaaatacaacaagttttaaaaattgtacaccaattagatccttctggtgttggcgcacgtaaccttcaggagtgtttaagtattcaattagaacgcaaagaacaaaagcccgatgtggccttggctttagatattataaataatgcattcgatcagtttacaaaaaaacattatcaaaaactgatgcagaaattcgatattaccgaaattcaacttaaagatgcaatacacgaaattgaaagattaaaccctaaacctggcggttcttacgctggaaatagtcgtattgtgcagcacgttgttcccgattttgctataaaaattgtaaatggtgaattggaactgactttaaatggccgtaatgcgcctgaactacacgtatctcgagagtataataatatgcttaaagggtataaggaaactaaagaacgtaccaaagcacaaaaagatgctgtacagtttattaaacagaaactagacgctgcgaaatggtttatagatgccattaagcaacgccagcaaacgttgtttgttacaatgagtgctattatgcattatcaaaaagaattctttttaacaggcgatgagcgcaaattaagaccgatgattcttaaggacattgcagacgaaactcgagccgattcttga

SEQ ID NO: 25528 - protein, 259 aa, Unknown
  Obtained from environmental sample
  DOMAIN (196)...(259): Sigma-54, DNA binding domain
  misc_feature (1)..(259): Xaa is any amino acid
MDEEERQIAEFLVGSVDESGYIRRELSDIMDDLAFTQNVYTTEEKIQQVLKIVHQLDPSGVGARNLQECLSIQLERKEQKPDVALALDIINNAFDQFTKKHYQKLMQKFDITEIQLKDAIHEIERLNPKPGGSYAGNSRIVQHVVPDFAIKIVNGELELTLNGRNAPELHVSREYNNMLKGYKETKERTKAQKDAVQFIKQKLDAAKWFIDAIKQRQQTLFVTMSAIMHYQKEFFLTGDERKLRPMILKDIADETRADS

SEQ ID NO: 25529 - DNA, 873 bp, Unknown
  Obtained from environmental sample
  misc_feature (1)..(873): n is a, c, g, or t
atgcttgctgagcatcactatcccaagataatcgcgccacaacctactaaaattaatccactaattacaaatacagcttggttaaaagacggtaaggcgctggtcaaaattattcgcgcagtagagcataattgggagcaaacagccgattatagccaagatcagattataggctggctgatattctcaggaattgtatatggtggcataaacgaggtacaaatgcttcaaggctggcttatctcattactcaccaaagagtatcagccattcatcaaagaaaggataatggtctcgccgcgctttgtacaaaagcgctttggtaacgagcgagaagaagaaagtgaccagctttataacaccaagcaaatcattgtagatatggtcagtcagtgttggctgatgcgttaccataaaagcagcagtccagcagagaccacacatatcattgccaagctgtcaaaagataagataaaacaatatttgaccgtggctttatctgacgtgatcaagcctttgggtattaagccacttcccttttcaagatttttatattacgccagttattactgggaggatttcgatgacgctagtatcgaccatgcttcagttggggtgctgcgaggtatgcataatactgcaggattaagtacgcaagactttggacggtttttgaaccaaaaatatcagtataaagaggagccgtatgatctagaacatattttgacgctgtctatcagcaaaagctctgttaatcaaaacgagacacctagcacttctaccaagaaaatagaggtcagaaagtctgatttaattatgaatctgactaaagatttcaaatgggtgaaaaacggaaaagaaaaaaacaggaan

SEQ ID NO: 25530 - protein, 291 aa, Unknown
  Obtained from environmental sample
  misc_feature (1)..(291): Xaa is any amino acid
MLAEHHYPKIIAPQPTKINPLITNTAWLKDGKALVKIIRAVEHNWEQTADYSQDQIIGWLIFSGIVYGGINEVQMLQGWLISLLTKEYQPFIKERIMVSPRFVQKRFGNEREEESDQLYNTKQIIVDMVSQCWLMRYHKSSSPAETTHIIAKLSKDKIKQYLTVALSDVIKPLGIKPLPFSRFLYYASYYWEDFDDASIDHASVGVLRGMHNTAGLSTQDFGRFLNQKYQYKEEPYDLEHILTLSISKSSVNQNETPSTSTKKIEVRKSDLIMNLTKDFKWVKNGKEKNRX

SEQ ID NO: 25531 - DNA, 813 bp, Unknown
  Obtained from environmental sample
  misc_feature (1)..(813): n is a, c, g, or t
gtgttgcgagttatgcataatactgcaggattaagtacgcaagactttggacggtttttgaaccaaaaatatcagtataaagaggagccgtatgatctagaacatattttgacgctgtctatcagcaaaagctctgttaatcaaaacgagacacctagcacttctaccaagaaaatagaggtcagaaagtctgatttaattatgaatctgactaaagacttcaaaatggatgaaaaacagaaaaagaaaaaaaccagcaaaaagccgcctactcttattgaaagagtacaaaaacgctatgaacaatacgatgacttaagtgaaaaaattttattagattgggtgataagtttactcaatcgaaaagagtcaaaatcgcttagtaatgagtctattttgaaatatattagaaccataggctatgaatggttatatttcaccacagcgcagccgcttgatatttggttagaggaagaatttgaggaactttacgaagagattttagagtacaaagctgtcgtacggaacaatactgacattggatactctgctaatttattgaagagtatgcacaactttgcaaagagcaaatacaacctaccctccgtgaacttccaacagtccaaaaatggtcggcgtgtacgtgcggagctgatatcaccgcaagcgtaccaagctattattacgcagatactgggttctgtagatatattggagcaggaaatgttcgcgcttttatttatcttagtctatcgtactggcatgcgcaaaaaagagttgttgggacttaagtataatgatatcgaagtttaa

SEQ ID NO: 25532 - protein, 270 aa, Unknown
  Obtained from environmental sample
  misc_feature (1)..(270): Xaa is any amino acid
MLRVMHNTAGLSTQDFGRFLNQKYQYKEEPYDLEHILTLSISKSSVNQNETPSTSTKKIEVRKSDLIMNLTKDFKMDEKQKKKKTSKKPPTLIERVQKRYEQYDDLSEKILLDWVISLLNRKESKSLSNESILKYIRTIGYEWLYFTTAQPLDIWLEEEFEELYEEILEYKAVVRNNTDIGYSANLLKSMHNFAKSKYNLPSVNFQQSKNGRRVRAELISPQAYQAIITQILGSVDILEQEMFALLFILVYRTGMRKKELLGLKYNDIEV

SEQ ID NO: 25533 - DNA, 810 bp, Unknown
  Obtained from environmental sample
  misc_feature (1)..(810): n is a, c, g, or t
ttgcgaggtatgcataatactgcaggattaagtacgcaagactttggacggtttttgaaccaaaaatatcagtataaagaggagccgtatgatctagaacatattttgacgctgtctatcagcaaaagctctgttaatcaaaacgagacacctagcacttctaccaagaaaatagaggtcagaaagtctgatttaattatgaatctgactaaagacttcaaaatggatgaaaaacagaaaaagaaaaaaaccagcaaaaagccgcctactcttattgaaagagtacaaaaacgctatgaacaatacgatgacttaagtgaaaaaattttattagattgggtgataagtttactcaatcgaaaagagtcaaaatcgcttagtaatgagtctattttgaaatatattagaaccataggctatgaatggttatatttcaccacagcgcagccgcttgatatttggttagaggaagaatttgaggaactttacgaagagattttagagtacaaagctgtcgtacggaacaatactgacattggatactctgctaatttattgaagagtatgcacaactttgcaaagagcaaatacaacctaccctccgtgaacttccaacagtccaaaaatggtcggcgtgtacgtgcggagctgatatcaccgcaagcgtaccaagctattattacgcagatactgggttctgtagatatattggagcaggaaatgttcgcgcttttatttatcttagtctatcgtactggcatgcgcaaaaaagagttgttgggacttaactatnatgatatcgaagtctaa

SEQ ID NO: 25534 - protein, 269 aa, Unknown
  Obtained from environmental sample
  misc_feature (1)..(269): Xaa is any amino acid
MRGMHNTAGLSTQDFGRFLNQKYQYKEEPYDLEHILTLSISKSSVNQNETPSTSTKKIEVRKSDLIMNLTKDFKMDEKQKKKKTSKKPPTLIERVQKRYEQYDDLSEKILLDWVISLLNRKESKSLSNESILKYIRTIGYEWLYFTTAQPLDIWLEEEFEELYEEILEYKAVVRNNTDIGYSANLLKSMHNFAKSKYNLPSVNFQQSKNGRRVRAELISPQAYQAIITQILGSVDILEQEMFALLFILVYRTGMRKKELLGLNYXDIEV

SEQ ID NO: 25535 - DNA, 768 bp, Unknown
  Obtained from environmental sample
  misc_feature (1)..(768): n is a, c, g, or t
ttggtgatactaactggtacagataaggatgattatattgaagttaataggattgcagataatcaaacgcaagttgtaatttcaagaataaaagatggtaaaaaagcagatgttatagtagatcgtacttttgataaggatataactaaggagttatggatttatgctttagatgatgatgatataattgaagttagcggtaaggctagtaacttaatttttacacgtattattggtgggcaaaataacgacgaatatattattaataatggaagacgtgtacgtatttatgaccataaatcaaaaccaaataccataactaaaaacaatggagctaaggttaaatttacagatatttacaataataacctgtttgattttcagaaaaacatagttaaaacaagtgtggttaccccaagtcttgggtataatccagatgatggttttaaagtaggtgtaggcttaaattatactgtaaaaggattttctcgtaacccatactcgcaacaacatcgttttaaaagtggttacttttttgcaactagtggttttagtttaaattatgatggtgaatttgcaaacctttttggcgaatggaacttgcatgtcgcaggacaactaacaagcgagaattttaccaataacttttttggttatggtaatgaaaccgttaacaatgatgattacttagatttagattataatagaattaaaacaagtatatatgcagctagtgtaggtgtccttcaaaaaggaatactcatctga

SEQ ID NO: 25536 - protein, 255 aa, Unknown
  Obtained from environmental sample
  misc_feature (1)..(255): Xaa is any amino acid
MVILTGTDKDDYIEVNRIADNQTQVVISRIKDGKKADVIVDRTFDKDITKELWIYALDDDDIIEVSGKASNLIFTRIIGGQNNDEYIINNGRRVRIYDHKSKPNTITKNNGAKVKFTDIYNNNLFDFQKNIVKTSVVTPSLGYNPDDGFKVGVGLNYTVKGFSRNPYSQQHRFKSGYFFATSGFSLNYDGEFANLFGEWNLHVAGQLTSENFTNNFFGYGNETVNNDDYLDLDYNRIKTSIYAASVGVLQKGILI

SEQ ID NO: 25537 - DNA, 564 bp, Unknown
  Obtained from environmental sample
  misc_feature (1)..(564): n is a, c, g, or t
atgaaaggtgtacaaaaaaacaccggggttaaaattgatgccgcagcgcatagattatacacccttactaaagacaataagatcaaaaccattattggctatggcaatgaaggtgttatagacgaaatcagggcaagtttcgccgatagaaccaatggcaccatctacaaccatcatgaaaacatcaatactgttaggaaattgatgtatgccatggaaaacaacgattgggacaaaacgtacagtttttatgatgaagacgtacgcttcctagactcgagctctccaacgtttgagagtgtttctttggaggaacagaaagtcgtggacaaacaaattttagacaaatttgaagttactagcatcgatatggtaggctatcctgactatttacattatgaaatgggagacgcccgtgtggtacaatcgtggtggaatataaatttaatccgcaaagcggacaaaaaagctattattctacccattcattatctaatggatttcaataaagaaggaaaaataacttcagaaacagcatattataacgcaaaattattggactaa

SEQ ID NO: 25538 - protein, 187 aa, Unknown
  Obtained from environmental sample
  misc_feature (1)..(187): Xaa is any amino acid
MKGVQKNTGVKIDAAAHRLYTLTKDNKIKTIIGYGNEGVIDEIRASFADRTNGTIYNHHENINTVRKLMYAMENNDWDKTYSFYDEDVRFLDSSSPTFESVSLEEQKVVDKQILDKFEVTSIDMVGYPDYLHYEMGDARVVQSWWNINLIRKADKKAIILPIHYLMDFNKEGKITSETAYYNAKLLD

SEQ ID NO: 25539 - DNA, 651 bp, Unknown
  Obtained from environmental sample
  misc_feature (1)..(651): n is a, c, g, or t
atgcttttggcgcgcatccatcctcgtggtaattatctatacagcgatttgaatgtgattctcgaacaacacatggtggaggctaaaaccggtaggccattggacgtccttgccaaagagaacttcagtccgttaggcatttcgaaaattggatataatcctttaaaatggacgattgcacaacatgtgataccgaccgagattgacaatttttttagaaaagacactctacaggggtatgtgcacgatgaaactgctgctattttgggtggtgtttcaggaaatgccggcttatttgccaatgcagcttccatctctgtcatttgtcaaatgctgcttaataaaggagcatatcaagataaacaaattctcaaatcaaaagtggtaagaaagttcaccaaatcgccactgaccaaaaaaggaatttatcgtggcattggttttgataaacgaaaacccaatgagttttataaaaaacacgattttggccatacgggctatactggcacttttttctttatgaaccctgataatgatcgatttttgattatccttaccaatcgtgtcaatccaacccgaagcaacagattgatgtatgaagatgattttggtccgaaaatttggaaacacataaatacttctaaaaattga

SEQ ID NO: 25540 - protein, 216 aa, Unknown
  Obtained from environmental sample
  misc_feature (1)..(216): Xaa is any amino acid
MLLARIHPRGNYLYSDLNVILEQHMVEAKTGRPLDVLAKENFSPLGISKIGYNPLKWTIAQHVIPTEIDNFFRKDTLQGYVHDETAAILGGVSGNAGLFANAASISVICQMLLNKGAYQDKQILKSKVVRKFTKSPLTKKGIYRGIGFDKRKPNEFYKKHDFGHTGYTGTFFFMNPDNDRFLIILTNRVNPTRSNRLMYEDDFGPKIWKHINTSKN

SEQ ID NO: 25541 - DNA, 693 bp, Unknown
  Obtained from environmental sample
  misc_feature (1)..(693): n is a, c, g, or t
atgtgtctgaatccagaattttataaaaccgtttcaaatgaaatagctttggcgcgcatccatcctcgtggtaattatctatacagcgatttgaatttgattctcgtacaacacatggtggaggctaaaaccggtaggccattggacgtccttgccaaagagaacttcagtccgttaggcatttcgaaaattggatataatcctttaaaatggacgattgcacaacatgtgataccgaccgagattgacaatttttttagaaaagacactctacaggggtatgtgcacgatgaaactgctgctattttgggtggtgtttcaggaaatgccggcttatttgccaatgcagcttccatctctgtcatttgtcaaatgctgcttaataaaggagcatatcaagataaacaaattctcaaatcaaaagtggtaagaaagttcaccaaatcgccactgaccaaaaaaggaatttatcgtggcattggttttgataaacgaaaacccaatgagttttataaaaaacacgattttggccatacgggctatactggcacttttttctttatgaaccctgataatgatcgatttttgattatccttaccaatcgtgtcaatccaacccgaagcaacagattgatgtatgaagatgattttggtccgaaaatttggaaacacataaatacttctaaaaattga

SEQ ID NO: 25542 - protein, 230 aa, Unknown
  Obtained from environmental sample
  misc_feature (1)..(230): Xaa is any amino acid
MCLNPEFYKTVSNEIALARIHPRGNYLYSDLNLILVQHMVEAKTGRPLDVLAKENFSPLGISKIGYNPLKWTIAQHVIPTEIDNFFRKDTLQGYVHDETAAILGGVSGNAGLFANAASISVICQMLLNKGAYQDKQILKSKVVRKFTKSPLTKKGIYRGIGFDKRKPNEFYKKHDFGHTGYTGTFFFMNPDNDRFLIILTNRVNPTRSNRLMYEDDFGPKIWKHINTSKN

SEQ ID NO: 25543 - DNA, 336 bp, Unknown
  Obtained from environmental sample
  misc_feature (1)..(336): n is a, c, g, or t
ttgccattaattggattggtttttttaaacgaaccccccatttggaaggttatttttccgcagggccttttaaaaccaaggcccaattttttgaaagtaaaaaaccaatcggaaaaaggcattgtaatttacgagcgtattatagctaattactccgatggaattttagcagacgatgctatttacgctgtcgctttattatacgataaacagttagaacaaccagataaagcaaaatcctactacgaaaaaatcatttttaaccaccaagacagtatcttttttgtcgaagcacgtaaacgatttagagcactcagaggcgattctattcaataa

SEQ ID NO: 25544 - protein, 111 aa, Unknown
  Obtained from environmental sample
  misc_feature (1)..(111): Xaa is any amino acid
MPLIGLVFLNEPPIWKVIFPQGLLKPRPNFLKVKNQSEKGIVIYERIIANYSDGILADDAIYAVALLYDKQLEQPDKAKSYYEKIIFNHQDSIFFVEARKRFRALRGDSIQ

SEQ ID NO: 25545 - DNA, 501 bp, Unknown
  Obtained from environmental sample
  misc_feature (1)..(501): n is a, c, g, or t
atgccccaaaaaatatgtattatcagttttgatcattggaattacgataaacacatcactactgcgctacaaaaaaggggtatagatagttaccatattaaaattggaaattacaaacacgcatcggtttttgataaaataacgaacgctattagcaaagtgtttttaaataaaaacttaaaaaaaataagacgccaagattttattgtagacgaattagatcgtttaggatttcaagatcaaatacttgttattaaccccgaagtgattgacttagaccaccatttacaaataaaaaaacggactgcaaaatatagtgcgtatttatacgatagtatggagagaaacccaataactcacttgttggaaggtgtttttgatactatttattcttttgatgtcaacgacgttaagcgatataattttcttcccattacgaattacaattacctttcagaagttaaaaataaagtaaaggaagtttacgacgcggtttatggn

SEQ ID NO: 25546 - protein, 167 aa, Unknown
  Obtained from environmental sample
  misc_feature (1)..(167): Xaa is any amino acid
MPQKICIISFDHWNYDKHITTALQKRGIDSYHIKIGNYKHASVFDKITNAISKVFLNKNLKKIRRQDFIVDELDRLGFQDQILVINPEVIDLDHHLQIKKRTAKYSAYLYDSMERNPITHLLEGVFDTIYSFDVNDVKRYNFLPITNYNYLSEVKNKVKEVYDAVYG

SEQ ID NO: 25547 - DNA, 501 bp, Unknown
  Obtained from environmental sample
  misc_feature (1)..(501): n is a, c, g, or t
atgccccaaaaaatatgtattatcagttttgatcattggaattacgataaacacatcactactgcgctacaaaaaaggggtatagatagttaccatattaaaattggaaattacaaacacgcatcggtttttgataaaataacgaacgctattagcaaagtgtttttaaataaaaacttaaaaaaaataagacgccaagattttattgtagacgaattagatcgtttaggatttcaagatcaaatacttgttattaaccccgaagtgattgacttagaccaccatttacaaataaaaaaacggactgcaaaatatagtgcgtatttatacgatagtatggagagaaacccaataactcacttgttggaaggtgtttttgatactatttattcttttgatgtcaacgacgttaagcgatataattttcttcccattacgaattacaattacctttcagaagtaaaaaattacgtaaaggaagtttacgacgcggttnnnnnn

SEQ ID NO: 25548 - protein, 167 aa, Unknown
  Obtained from environmental sample
  misc_feature (1)..(167): Xaa is any amino acid
MPQKICIISFDHWNYDKHITTALQKRGIDSYHIKIGNYKHASVFDKITNAISKVFLNKNLKKIRRQDFIVDELDRLGFQDQILVINPEVIDLDHHLQIKKRTAKYSAYLYDSMERNPITHLLEGVFDTIYSFDVNDVKRYNFLPITNYNYLSEVKNYVKEVYDAVXX

SEQ ID NO: 25549 - DNA, 309 bp, Unknown
  Obtained from environmental sample
  misc_feature (1)..(309): n is a, c, g, or t
atgagagaaatctatattacagaagaatgtttggaatttatcgacaaacagaatgatagagtttcgctgaaattcttccaactaattgaagttattggagaaattaagattgtaaactcaaactttctcaaaagacttcaatctacacaattttatgaattgaggtttaaagctggaaatgaatatcgaattgtactctttgctatcgaccatctgaattttgctgaatgtacgaaagcagtttgtttatgtgggtttcagaataaaggtactacagattataagaaagcaattatacaagcagattaa

SEQ ID NO: 25550 - protein, 102 aa, Unknown
  Obtained from environmental sample
  misc_feature (1)..(102): Xaa is any amino acid
MREIYITEECLEFIDKQNDRVSLKFFQLIEVIGEIKIVNSNFLKRLQSTQFYELRFKAGNEYRIVLFAIDHLNFAECTKAVCLCGFQNKGTTDYKKAIIQAD

SEQ ID NO: 25551 - DNA, 918 bp, Unknown
  Obtained from environmental sample
  misc_feature (1)..(918): n is a, c, g, or t
gtgcgtgtaaatcattcatcttacacgatgcaacaagcggttgaagataaaaccgtaaccccacttttgtatgaagaacgtattcctgagctaaacgttaacgataaggcgattgatgcgtggtttgatcgtagtaccagtaagctgagcgacaaacaaaaaaccgatttaaagaagaagttttcgcaaaaaggtcagatttatcaaactgccgatcgcattatgttgattgcttacgatattgccgaccattttcaaaactttaagcatcaaggtttaaaaggtcagttagcttgtgattctaaagcctctgcaatacgttataaagaggctttagataaaattggcaccgtgacatcagttgttgcaatgtcagctcctgacacgcgtgaggggcatgatgtagttgatcaagaaagcaaagacattgtacaaaattggtggaaagccaatgttgataaaatggatgaaaaagcctacaccaaagccattattgaagactttggcagagatgacggccctgacatcatgatagtggttgataaactactaacgggctttgatgagccaaagaacaccgtactgtacatcgataaacctctaaaagaacataaccttattcaagccattgcccgcgttaaccgattgcacagcaaaaagcagtttggttacttaattgattaccgaggcattttaaaagagcttgataccaccattgaaaagtaccaagaccttgctgagcgtactcaaggcggttttgatatagatgacctaaaaggtttatataaccgaatggatacggaatacaaaaagcttccggggctgcacagcgatttgtgggcgatatttgatggggttaaaaacaagctccaacccgcatcattgagtcaggcactagcacccaaaatacaagaanna

SEQ ID NO: 25552 - protein, 306 aa, Unknown
  Obtained from environmental sample
  misc_feature (1)..(306): Xaa is any amino acid
MRVNHSSYTMQQAVEDKTVTPLLYEERIPELNVNDKAIDAWFDRSTSKLSDKQKTDLKKKFSQKGQIYQTADRIMLIAYDIADHFQNFKHQGLKGQLACDSKASAIRYKEALDKIGTVTSVVAMSAPDTREGHDVVDQESKDIVQNWWKANVDKMDEKAYTKAIIEDFGRDDGPDIMIVVDKLLTGFDEPKNTVLYIDKPLKEHNLIQAIARVNRLHSKKQFGYLIDYRGILKELDTTIEKYQDLAERTQGGFDIDDLKGLYNRMDTEYKKLPGLHSDLWAIFDGVKNKLQPASLSQALAPKIQEX

SEQ ID NO: 25553 - DNA, 339 bp, Unknown
  Obtained from environmental sample
  misc_feature (1)..(339): n is a, c, g, or t
ttgaagtttttacatcaacttattaaggaatatttcaaacttattttaaagaatgcagatagtgatgttgtaagagaaatggaaatgaatttattggaaatagatggtaaatgttcattgttattaaaacgagtaaacactcatttattccatttgtctgaattaatagatgatccgtttaaatatgattcacataaatttagaatagaacacgagcaattagaagacgatattaatacttttattaagatctttagagataacagaaaagatgtttttaacattacagattatgttatagacagtgagacgatttctttaaaattaagcggtaaataa

SEQ ID NO: 25554 - protein, 112 aa, Unknown
  Obtained from environmental sample
  misc_feature (1)..(112): Xaa is any amino acid
MKFLHQLIKEYFKLILKNADSDVVREMEMNLLEIDGKCSLLLKRVNTHLFHLSELIDDPFKYDSHKFRIEHEQLEDDINTFIKIFRDNRKDVFNITDYVIDSETISLKLSGK

SEQ ID NO: 25555 - DNA, 774 bp, Unknown
  Obtained from environmental sample
  misc_feature (1)..(774): n is a, c, g, or t
ttgagcgttgtaaaatcagggatcatatgggggtcaaaatgccttaatggtggaacatctaatttaattagagaagaagttcttgaagtgaatatagaggtcacttttacgaatggttataaagttgaagactttgaagcagcaatacgaccggataccaagttgattcatatcgaaacaccttcaaatcccttgcttaccataacagacattaaagcaattgccaatttaggtaaacaaaaaagcattgtaacaagtatagataatacgtttgcaagtccagtaaatcaaaacccaatagattttggtattgatttagtaatgcactcggcaactagatattttggaggtcatagtgatatttgtgcaggagcagtagcaggaagtaaagatcatttagatgaaatctggaatgtatctaaaaattatggaggtagtttaagcgattttacggtttggatgttggagcgtagcatgaaaactatgggtttacgtgtaaaagcacaaactaaaaatgctaacaaattagcaaaatggttagataaacaaacatttgttaaacaagtgtattatcctggcttaaagagtcacccagaacataagttagcaaaatctcaaatgaagggttttggagctatgttgtcttttgaacttatagatagtataaattctgatcaattcatgaagcaattacagttaattaaagcttctatgagtttagcaggtatagaaagcacaatgttatctccaacacaaacatcacactcgttatga

SEQ ID NO: 25556 - protein, 257 aa, Unknown
  Obtained from environmental sample
  DOMAIN (1)...(256): Cys/Met metabolism PLP-dependent enzyme
  misc_feature (1)..(257): Xaa is any amino acid
MSVVKSGIIWGSKCLNGGTSNLIREEVLEVNIEVTFTNGYKVEDFEAAIRPDTKLIHIETPSNPLLTITDIKAIANLGKQKSIVTSIDNTFASPVNQNPIDFGIDLVMHSATRYFGGHSDICAGAVAGSKDHLDEIWNVSKNYGGSLSDFTVWMLERSMKTMGLRVKAQTKNANKLAKWLDKQTFVKQVYYPGLKSHPEHKLAKSQMKGFGAMLSFELIDSINSDQFMKQLQLIKASMSLAGIESTMLSPTQTSHSL

SEQ ID NO: 25557 - DNA, 600 bp, Unknown
  Obtained from environmental sample
  misc_feature (1)..(600): n is a, c, g, or t
ttgaaacgtttttatgaaaacgatgtcaaccattctgggcgacacattatgagttcaacttcactggagatggaagaaataataaaacgcgccagggaatttaagacggttactgttttccctcatccttattcccctgtttttaccggaatttacaatgattattttcccgaagagcgactggaccaattatttaaattgatcgacggtgtggaggtgatcaattcgggcaatcttaaaaaatcgaatttaaaatgcgccctactcggttttaatcttaacaaagccatttcaggcggaagcgatgggcacgctctggtctgtttgggcaaagttgtcagttatgctcagtgcaaacccagcaggaaagcctttcttgatgctgtaaagagaaaaaagaacaaagtaatcggaaaagagattaacatgctcagaaaggtgacatccaacggccggaaaattagtacgggccttaaacattatccggaccttgttgaaaagaatctaaaatatggctatacgtttatcaatttgaaatccaaacgactgaaagataatgtgaaacgcagaattaatgggaaaacaggtacaatcatataa

SEQ ID NO: 25558 - protein, 199 aa, Unknown
  Obtained from environmental sample
  misc_feature (1)..(199): Xaa is any amino acid
MKRFYENDVNHSGRHIMSSTSLEMEEIIKRAREFKTVTVFPHPYSPVFTGIYNDYFPEERLDQLFKLIDGVEVINSGNLKKSNLKCALLGFNLNKAISGGSDGHALVCLGKVVSYAQCKPSRKAFLDAVKRKKNKVIGKEINMLRKVTSNGRKISTGLKHYPDLVEKNLKYGYTFINLKSKRLKDNVKRRINGKTGTII

SEQ ID NO: 25559 - DNA, 678 bp, Unknown
  Obtained from environmental sample
  misc_feature (1)..(678): n is a, c, g, or t
gtgcgtaagcatcaaacccgtatcagtggccttgatgataaaataatcatgttttatgccaagggtcaaaccaccactgaaattgtcgaaaccatcaaagacatctacgacgttgatatatcaagctctcttgtctcaagagtcacggataacctcttagatgacatcaccgcatggcagaacaggccactgagcagcatctatcctattgtctacctagactgcattgtcgttaaagtacgtcaagacaagcagatcatcaacaaggctatctatctggcgctaggcgtggggcttaacggtaaaaaagagctgcttggtatgtggttatcagagaatgagggcgctaagttctggctgggcgttctcactgagctacaagacagcggagtacaagacatcctcattgcctgtgtagacggcctaaagggcttccctgatgccattaacaccgtttatcccaatgctcaggttcagctgtgtatcgtgcatatggtgcgttactccatgaagtttgtaccatggacggataaaaaggccgtagcggctgatttaaaggccatttacggcgctgatacgcttgagatggcagaggccaaccttgagcactttgatgagacttggggcaaggagtatccgcacgtggttaagtcttggcgcaataactgggaggcttaa

SEQ ID NO: 25560 - protein, 225 aa, Unknown
  Obtained from environmental sample
  DOMAIN (1)...(225): Transposase, Mutator family
  misc_feature (1)..(225): Xaa is any amino acid
MRKHQTRISGLDDKIIMFYAKGQTTTEIVETIKDIYDVDISSSLVSRVTDNLLDDITAWQNRPLSSIYPIVYLDCIVVKVRQDKQIINKAIYLALGVGLNGKKELLGMWLSENEGAKFWLGVLTELQDSGVQDILIACVDGLKGFPDAINTVYPNAQVQLCIVHMVRYSMKFVPWTDKKAVAADLKAIYGADTLEMAEANLEHFDETWGKEYPHVVKSWRNNWEA

SEQ ID NO: 25561 - DNA, 723 bp, Unknown
  Obtained from environmental sample
  misc_feature (1)..(723): n is a, c, g, or t
ttgcccttaatttttaaaaaaactacattgaatcgatctttagaaataatagatttaggattaaaggattaccaagaaacctgggattttcaggaatcactcttccaaaatattctgcaactaaaaagcaccaacagaaaagataatttggaacaggatactccaaattatcttttgtttgtagagcatccgcacgtatataccctcggaaaaagcggccatattgaaaatctactcatttctgaagaaaaattaaaagccataaatgctaaattctacaaaataaaccgcggcggcgacataacctatcacggcccgggacagattgtaggctaccccatcttggatttggaaaatttttttactgatatccacaaatacctccgtttactggaagaaatgattattctcaccctagcggaatacggtctaaaagtagaacgcagcaaaggggaaaccggtgtgtggctagatgtgggcacgcctttcgcaagaaaaatatgcgccttgggcgtccgcgccagccgttgggtgaccatgcacggttttgccctaaatgtaaataccaatcttggttattttgacaatatgatcccctgcggcatcaaaggcaaggcagtaacttccttaaatgtggaactgggaaaggttgaaatttctatggaagaagtgacagaaaaacttttgaaacattttctgantctttttgaagctgaagtgtaa

SEQ ID NO: 25562 - protein, 240 aa, Unknown
  Obtained from environmental sample
  DOMAIN (69)...(193): Biotin/lipoate A/B protein ligase family
  misc_feature (1)..(240): Xaa is any amino acid
MPLIFKKTTLNRSLEIIDLGLKDYQETWDFQESLFQNILQLKSTNRKDNLEQDTPNYLLFVEHPHVYTLGKSGHIENLLISEEKLKAINAKFYKINRGGDITYHGPGQIVGYPILDLENFFTDIHKYLRLLEEMIILTLAEYGLKVERSKGETGVWLDVGTPFARKICALGVRASRWVTMHGFALNVNTNLGYFDNMIPCGIKGKAVTSLNVELGKVEISMEEVTEKLLKHFLXLFEAEV

SEQ ID NO: 25563 - DNA, 381 bp, Unknown
  Obtained from environmental sample
  misc_feature (1)..(381): n is a, c, g, or t
atgaaaccaatcttttcttttttcatttgtatgtctatttgtacaaccatcttttcccaagaaaaatatcctgttcccgaggaaacatcaactaggttgttttatattcagcatagtaaaaaccataatacttatgtctatgatgcaaaaatgaaaggagattctataagtttagagaacccaattaatgaatatcgcattgtatatacagaaggtggtgagaaaaaaccattaaataaaattcaaaagcagtttgcttacggtatggttaccaaatcaatagcaccaaatcttattgaaatgcatttggtggcatcatcaaaattaaaattttatctaatccataatcctattgaaaacctagatttatgtactatatng

SEQ ID NO: 25564 - protein, 127 aa, Unknown
  Obtained from environmental sample
  SIGNAL (1)...(19)
  misc_feature (1)..(127): Xaa is any amino acid
MKPIFSFFICMSICTTIFSQEKYPVPEETSTRLFYIQHSKNHNTYVYDAKMKGDSISLENPINEYRIVYTEGGEKKPLNKIQKQFAYGMVTKSIAPNLIEMHLVASSKLKFYLIHNPIENLDLCTIX

SEQ ID NO: 25565 - DNA, 345 bp, Unknown
  Obtained from environmental sample
  misc_feature (1)..(345): n is a, c, g, or t
atgaagaagttaaaaatgcctgtacaatatgtattagcacttaatgatgcattgaatgttataaacggaaaatggaaaacacctattattggaactttattgtttggtaaaatgcgttttaaagagttagaacggaatattgataaaatttcaccaagaatgttatctaaagaattaaaagatttagaggttaatggtattgtaaaacgtacagtttatgatacaactcctgttacagttgaatatgaattaacagaatctggaaaaacatttcaatgcgttttagatattatggtaaaatgggctgtggaacatagagaccgtactttgggattaaaaaaataa

SEQ ID NO: 25566 - protein, 114 aa, Unknown
  Obtained from environmental sample
  DOMAIN (20)...(110): Transcriptional regulator
  misc_feature (1)..(114): Xaa is any amino acid
MKKLKMPVQYVLALNDALNVINGKWKTPIIGTLLFGKMRFKELERNIDKISPRMLSKELKDLEVNGIVKRTVYDTTPVTVEYELTESGKTFQCVLDIMVKWAVEHRDRTLGLKK

SEQ ID NO: 25567 - DNA, 351 bp, Unknown
  Obtained from environmental sample
  misc_feature (1)..(351): n is a, c, g, or t
gtgttttcatttagtcatgacgaaccctaccgaatcgagttttttggagacgaagtagatagtatcaggacttttgatgtagaaacacaattgtctacagagcaaattaaaaaaattagtatcataccaaatgttgctaataaattaatggatgagtccagacaaagttttttaaaatacattgcacaaaaaacagtcgtttttggcaaaaattttgacttaacctttgatcgtgtggacgacttttttgacaaagcaattgctgcttttgttaaattacacaaagacatcaaacacgcagaaccactagaattattttgtaatgctgccgagttgaaaaaaaactattag

SEQ ID NO: 25568 - protein, 116 aa, Unknown
  Obtained from environmental sample
  misc_feature (1)..(116): Xaa is any amino acid
MFSFSHDEPYRIEFFGDEVDSIRTFDVETQLSTEQIKKISIIPNVANKLMDESRQSFLKYIAQKTVVFGKNFDLTFDRVDDFFDKAIAAFVKLHKDIKHAEPLELFCNAAELKKNY

SEQ ID NO: 25569 - DNA, 459 bp, Unknown
  Obtained from environmental sample
  misc_feature (1)..(459): n is a, c, g, or t
ttgtcaacgttattcagagtacagttttacgagaacaataatggacaacctggagatgttttaacctacgaaaaagtcatttttattcccacacaagacaccaaacctgtttttgaatttgatgtgtctggatttgatgtttttattccaaaagatggtatttacatttccatacaagttttaggctttacagacaaaaacggaaaattacttccaaataaaaaatatcaagaagttaaaactagacgtggtattgtaaaagtatcgacaacgtttagacctttattaccttttacagaccaaatttctgaaaaaaccacttttgtaaaacgtgtttttcaaaacaatggacaatgggttctttttgataaaaaaaacattgataactcaaatcttttaaacgctggtttaaacaattatggtatgggtttaaaaatggaagtttataaagagcaatag

SEQ ID NO: 25570 - protein, 152 aa, Unknown
  Obtained from environmental sample
  misc_feature (1)..(152): Xaa is any amino acid
MSTLFRVQFYENNNGQPGDVLTYEKVIFIPTQDTKPVFEFDVSGFDVFIPKDGIYISIQVLGFTDKNGKLLPNKKYQEVKTRRGIVKVSTTFRPLLPFTDQISEKTTFVKRVFQNNGQWVLFDKKNIDNSNLLNAGLNNYGMGLKMEVYKEQ

SEQ ID NO: 25571 - DNA, 573 bp, Unknown
  Obtained from environmental sample
  misc_feature (1)..(573): n is a, c, g, or t
atgcactctagatatttcattattttacttttagtactatttacaattaatagttttagtcaaactacaattattgatagtattacaaaaaatggcgtctcgtttgcaacagtttcatttggaaacggaaatggaatatttgctgatgacgatggtaaatttttcttcactaaaaagctatattcagatatcgattcgcttttcgtttcagcattaggatacaaagacgttaagctggcttcaaaaacactaaaagacaccctttatttaacaccacaatctgaccttttagacgaggttatcgttactgctaaaccttcaggaaaacacaaagaaattacactaaaaccaacatcacatgacgactattataaatgttggttaccaactattgaaagtgaaattgctgtatttttccctaacacagacaacaaaccaaagcatgtcactaaagtgttaattcctattaaaaccgaagctaaagattgggaccaaagaggtaaaagtaataaagcaaaacgtcctttttcaccgttattcagagtacagttttacgagaaccataatnnnnna

SEQ ID NO: 25572 - protein, 191 aa, Unknown
  Obtained from environmental sample
  SIGNAL (1)...(20)
  misc_feature (1)..(191): Xaa is any amino acid
MHSRYFIILLLVLFTINSFSQTTIIDSITKNGVSFATVSFGNGNGIFADDDGKFFFTKKLYSDIDSLFVSALGYKDVKLASKTLKDTLYLTPQSDLLDEVIVTAKPSGKHKEITLKPTSHDDYYKCWLPTIESEIAVFFPNTDNKPKHVTKVLIPIKTEAKDWDQRGKSNKAKRPFSPLFRVQFYENHNXX

SEQ ID NO: 25573 - DNA, 648 bp, Unknown
  Obtained from environmental sample
  misc_feature (1)..(648): n is a, c, g, or t
atggctatacaagaatcagaattaattttaaatcctgatggtagtgtttaccatcttaatttaaaaccagaacatattgcagatacaattattactgtaggtgatcctgatcgtgtttctggagtaacaaaatactttgattcggttgagtttacaacccgtaaaagagagtttcatactcaaacaggaatgtacaaaggtaaacgtataaccgttatatcaactggaattggaactgataatatcgatattgtgtttaatgaattagatgctttggttaatatagatttaaaaaccagaaccataaataaaacgcacaagtctttagatataattcgtattggtacctctggttctattcaaaaagacattgctattgatacctttataataagcgaaaaagcttgtggatttgatagtctacttcatttttataatagtaaacacatacaacaaactgatgtagcagatgctttagttgcgcatacaaattgggcttcggaaaaatcaaaaccctatatcgtagcagtagataaagacttagctgcaaaattagaatctgatctaaccactaaaggctttacagccacaaatgttggtttttatggaccacaaggtcgtgtattaagattattcatttcaggataa

SEQ ID NO: 25574 - protein, 215 aa, Unknown
  Obtained from environmental sample
  DOMAIN (28)...(213): Phosphorylase family
  misc_feature (1)..(215): Xaa is any amino acid
MAIQESELILNPDGSVYHLNLKPEHIADTIITVGDPDRVSGVTKYFDSVEFTTRKREFHTQTGMYKGKRITVISTGIGTDNIDIVFNELDALVNIDLKTRTINKTHKSLDIIRIGTSGSIQKDIAIDTFIISEKACGFDSLLHFYNSKHIQQTDVADALVAHTNWASEKSKPYIVAVDKDLAAKLESDLTTKGFTATNVGFYGPQGRVLRLFISG

SEQ ID NO: 25575 - DNA, 354 bp, Unknown
  Obtained from environmental sample
  misc_feature (1)..(354): n is a, c, g, or t
atgttacaatcagttaatcaaaatattaaaaacattgctgccttctttttagtagcaatgtttttttcttgtggtaacaacctaaaagaagttcaggacttcttagcagataaaaatttacccattggtatagccaaaaatgttgatttaattcatactgattccggtcgggtaaaaacaaagctcactacacctttattacacgattatagtaacaggaatgaacatccttatcaagaatttccggaaggcataaaaatcattactttcgataaatatggtgattctattaccttaacagctaatataccaaaacttatagtaaacaggtattctgaagtaccaacaatgtag

SEQ ID NO: 25576 - protein, 117 aa, Unknown
  Obtained from environmental sample
  misc_feature (1)..(117): Xaa is any amino acid
MLQSVNQNIKNIAAFFLVAMFFSCGNNLKEVQDFLADKNLPIGIAKNVDLIHTDSGRVKTKLTTPLLHDYSNRNEHPYQEFPEGIKIITFDKYGDSITLTANIPKLIVNRYSEVPTM

SEQ ID NO: 25577 - DNA, 396 bp, Unknown
  Obtained from environmental sample
  misc_feature (1)..(396): n is a, c, g, or t
atgctaaattacactgattctattaactcgcaaaagccattccttaagtctaatcaaccgactgttgaaacagtaaatgtgctcttagcgttagatgatttcttttctgacatgtcaaaaaaggtgggttctaatgagttagatgatttgaccaagcgtcatgactttatatatgaaaaagagcttcgtgactgcaatcttgattattcaataaatagtctcaagcgaattgatgagtggttgctaacggttaaaaaaagactatctgacttcacagagtatcgaattttttcttcagaatacccgctgcacaatagctcgactattgagatattgagctattatttaggtgaaatcattgacgagctcgtagagaagccccagtttgtagcctga

SEQ ID NO: 25578 - protein, 131 aa, Unknown
  Obtained from environmental sample
  misc_feature (1)..(131): Xaa is any amino acid
MLNYTDSINSQKPFLKSNQPTVETVNVLLALDDFFSDMSKKVGSNELDDLTKRHDFIYEKELRDCNLDYSINSLKRIDEWLLTVKKRLSDFTEYRIFSSEYPLHNSSTIEILSYYLGEIIDELVEKPQFVA

SEQ ID NO: 25579 - DNA, 711 bp, Unknown
  Obtained from environmental sample
  misc_feature (1)..(711): n is a, c, g, or t
atgaataagttaaaatcatttgtggtagatgatattccagaagcattagaaatgttatgtaatgatattgaaaggtatcatccatccatagaaatcataggaaaagctgccagtgttgtagaagcttccaaactattacaaaagcaacaaccagatattttatttctagacattatgttaggagatggtactggatttgatattttagaaattgtaccaaacttaaattctaaaataatatttgtgactgcaagtgatgaatatgccattaaagcttttaaattcgcagcaatagattatatcttaaaaccttattctatagaggatttatcgaatgctatagagaaagctaagattcaaattcaaccaaagaaagaacaactaaatgtattaaaacaattagtttcagaaccaaatcacaaaccaagaaaagtatcattgcatacttcagaaaaaattattgtggtaaatatcgaagatataattcgttgtaaagccgacaataattatactactttctatttaaatgatacatccaaaatattagtatcgaaaactttaaaatattatgcagatattttaaaagaggtcaattttttaagagttcatcaaagtcatttagtaaataaaaactatataaaagaatttataaagtctgatggaggttatttaattttaaatgatgcatcaaatatcccacgtatcacgtaa

SEQ ID NO: 25580 - protein, 236 aa, Unknown
  Obtained from environmental sample
  DOMAIN (151)...(236): LytTr DNA-binding domain
  misc_feature (1)..(236): Xaa is any amino acid
MNKLKSFVVDDIPEALEMLCNDIERYHPSIEIIGKAASVVEASKLLQKQQPDILFLDIMLGDGTGFDILEIVPNLNSKIIFVTASDEYAIKAFKFAAIDYILKPYSIEDLSNAIEKAKIQIQPKKEQLNVLKQLVSEPNHKPRKVSLHTSEKIIVVNIEDIIRCKADNNYTTFYLNDTSKILVSKTLKYYADILKEVNFLRVHQSHLVNKNYIKEFIKSDGGYLILNDASNIPRIT

SEQ ID NO: 25581 - DNA, 381 bp, Unknown
  Obtained from environmental sample
  misc_feature (1)..(381): n is a, c, g, or t
ttggattattatttaaagaacatcaataaaaaacacaaggaaagactagattctttaaaattgaaaaatcgtttactgtctttagagcaaaaagctttgcagttgcaaatgaatcctcattttatatttaatgttttaaacggaataaaagcattaggaaatgccaataaagttgatgagttaaatgcaactatttctaaattttcaatacttttaagaggaattttaaataattctagaacagaagaaattacgctacaagaagaaattacgcttttaaaaaattatattgagttagaacaaagaatgagttcaaagaactttacatatacaattacatcaaatttaaataatatagatccagaagaaatattgattcca

SEQ ID NO: 25582 - protein, 127 aa, Unknown
  Obtained from environmental sample
  DOMAIN (29)...(113): Histidine kinase
  misc_feature (1)..(127): Xaa is any amino acid
MDYYLKNINKKHKERLDSLKLKNRLLSLEQKALQLQMNPHFIFNVLNGIKALGNANKVDELNATISKFSILLRGILNNSRTEEITLQEEITLLKNYIELEQRMSSKNFTYTITSNLNNIDPEEILIP

SEQ ID NO: 25583 - DNA, 876 bp, Unknown
  Obtained from environmental sample
  misc_feature (1)..(876): n is a, c, g, or t
gtgaatttctcaaattcagaaaataatatatccatcacttttaaaagcgttgatatttcaaatcctaaaaaagttaactatcgatataaattaaataacgaattttctccttggtctaccaatagtactatccagtttccgaacttaaatgctggtagatatcgctttgaagtacagtctaaaatagaaaataatgaaagtgatattatatcttattcttttaaaattgatgctcctttttataagcaagtctggtttatttttgcggttgttatttccttcttattaataggttatttttatttggattattatttaaagaacatcaataaaaaacacaaggaaagactagattctttaaaattgaaaaatcgtttactgtctttagagcaaaaagctttgcagttgcaaatgaatcctcattttatatttaatgttttaaacggaataaaagcattaggaaatgccaataaagttgatgagttaaatgcaactatttctaaattttcaatacttttaagaggaattttaaataattctagaacagaagaaattacgctacaagaagaaattacgcttttaaaaaattatattgagttagaacaaagaatgagttcaaagaactttacatatacaattacatcaaatttaaataatatagatccagaagaaatattgattccaacaatgttactacaaccttttgtagaaaattgtgtgcagcatgcttttcaaaaaaacgatttaggtacaattgacattaattttaatataaaacatggttttttaccatgtgctattattgataatggcctaggccttcatcaatctaaaaaaagaaaaccagnaacaaaactaaatctgtggcttaagnga

SEQ ID NO: 25584 - protein, 292 aa, Unknown
  Obtained from environmental sample
  DOMAIN (130)...(214): Histidine kinase
  misc_feature (1)..(292): Xaa is any amino acid
MNFSNSENNISITFKSVDISNPKKVNYRYKLNNEFSPWSTNSTIQFPNLNAGRYRFEVQSKIENNESDIISYSFKIDAPFYKQVWFIFAVVISFLLIGYFYLDYYLKNINKKHKERLDSLKLKNRLLSLEQKALQLQMNPHFIFNVLNGIKALGNANKVDELNATISKFSILLRGILNNSRTEEITLQEEITLLKNYIELEQRMSSKNFTYTITSNLNNIDPEEILIPTMLLQPFVENCVQHAFQKNDLGTIDINFNIKHGFLPCAIIDNGLGLHQSKKRKPXTKLNLWLKX

SEQ ID NO: 25585 - DNA, 372 bp, Unknown
  Obtained from environmental sample
  misc_feature (1)..(372): n is a, c, g, or t
gtgatacaagaattcctcttgcaacagaaaccagtagtcacttttcggcaccacattccgaaatcatttttgatcaatgttgagaacgcttcggaaattgaaaaagcattggaacatgcactgacctatccaagcgaaaaattgacattgataaaaaaatataccgaacagatacatccctattttgatggaaaatcaagtgggagagtgatagacgcgaccatagaattcttgcatcgcgacaaatcctatctaaagcgaaaaccatggaatctcgtcagaaaatggggaattcgaaacaaacttaagcactatacccttaaaacttttggcaaaccgctgacccttggtgcgaaaagcggtgagcgatag

SEQ ID NO: 25586 - protein, 123 aa, Unknown
  Obtained from environmental sample
  misc_feature (1)..(123): Xaa is any amino acid
MIQEFLLQQKPVVTFRHHIPKSFLINVENASEIEKALEHALTYPSEKLTLIKKYTEQIHPYFDGKSSGRVIDATIEFLHRDKSYLKRKPWNLVRKWGIRNKLKHYTLKTFGKPLTLGAKSGER

SEQ ID NO: 25587 - DNA, 552 bp, Unknown
  Obtained from environmental sample
  misc_feature (1)..(552): n is a, c, g, or t
ttggaaaatatagcaataaaacacggtattcatttactcaatgcacgagagttatacaaaaacgcaagtggcttaaataataacgacaagctcatcactcaagttaaaggtcaaactgctcaagccattattaccacggcattggataacgcttataacctgtccgtacagaaacctgatcaattacgagagtttgtcagtatttataagcaaaagcacattacctctagatcttacttaaaatttggcattaaaaaatctcaacatgagttattgggtgacttcttgaagatagggtgtcaaattattgctcctcaccattggcaactgacttctagtagcgcaaaagaggttagagatttcaagaaaaagtataaactagatagcgccattagggtggaagccaaccaaaattgtgtaggctttgaagttagaattgtcagaaaaatgaaatccaaatctgaaaaacaagctacttatgagtcgtccggcgtcttgaaatttttgggtgagatgttagtaatactgcttgaacaggatagtgaagaataa

SEQ ID NO: 25588 - protein, 183 aa, Unknown
  Obtained from environmental sample
  misc_feature (1)..(183): Xaa is any amino acid
MENIAIKHGIHLLNARELYKNASGLNNNDKLITQVKGQTAQAIITTALDNAYNLSVQKPDQLREFVSIYKQKHITSRSYLKFGIKKSQHELLGDFLKIGCQIIAPHHWQLTSSSAKEVRDFKKKYKLDSAIRVEANQNCVGFEVRIVRKMKSKSEKQATYESSGVLKFLGEMLVILLEQDSEE

SEQ ID NO: 25589 - DNA, 381 bp, Unknown
  Obtained from environmental sample
  misc_feature (1)..(381): n is a, c, g, or t
atggtgagaaagctgaactcacagaagtattgtaataaaatcttgctcgtgatccctttagagatcagagatgacaanatatggttgcagaagttgatggcaacgaatgatgcattaactncgctatatatcttatgttcnctgatgaccgtaagtcttatgtttctatacgctttaggtgatactgatataaataagcgtaaaatacagcagtttgagacgattatcaaaggattgaacaatacgtttgaacttacttgccgagatccaaaaaaaatccatttatcacatcttatcaaatacgctaattttcattggcggcagtggcctggtagtgctatcgatggcgctggcagtctagtcatgncaaggacaacttaa

SEQ ID NO: 25590 - protein, 126 aa, Unknown
  Obtained from environmental sample
  misc_feature (1)..(126): Xaa is any amino acid
MVRKLNSQKYCNKILLVIPLEIRDDXIWLQKLMATNDALTXLYILCSLMTVSLMFLYALGDTDINKRKIQQFETIIKGLNNTFELTCRDPKKIHLSHLIKYANFHWRQWPGSAIDGAGSLVMXRTT

SEQ ID NO: 25591 - DNA, 798 bp, Unknown
  Obtained from environmental sample
  misc_feature (1)..(798): n is a, c, g, or t
atgattcgcgttggtgcagaagttaaacctggtgatattttgattggaaaaattactcctaagggagagtcagatccaacaccagaagaaaaacttttacgtgcaatttttggtgataaagctggagatgtaaaagatgcttcattaaaagcttcaccttcattacatggtgtagttattaataaaaaattattttctagagcagttaaagataaaagaaagagagctcaagataaagaagatatagctaaattagaaaatctttactttacgaagtttgatcaattacaagatgtattagttgaaaaacttttcactattgttaacggaaaaacatctcaaggtatatttaatgatttaggagaagaggttttaccaaaaggtaaaaaattcactctaaaaatgttaaatgctgttgacgattatactcacttaactggtggtacttggacaactgatgatcatactaataagcttgtagctgatttaattcacaattacaagattaaagaaaatgacttacaagggtctttaagacgcgagaagtttactatatctgtaggagatgaattaccagcaggaataatcaagttagcaaaagtttacatcgctaaaaaacgtaagttaaaagttggtgataaaatggcaggacgacatggtaacaaaggtattgttgcgcgtattgtacgtcaagaggatatgccattcttagaagatggaactccagttgatattgtattacatccattaggtgtaccatctcgaatgaacatcggacaaatttatgaaactgtctaa

SEQ ID NO: 25592 - protein, 265 aa, Unknown
  Obtained from environmental sample
  DOMAIN (57)...(265): RNA polymerase Rpb2, domain 6
  misc_feature (1)..(265): Xaa is any amino acid
MIRVGAEVKPGDILIGKITPKGESDPTPEEKLLRAIFGDKAGDVKDASLKASPSLHGVVINKKLFSRAVKDKRKRAQDKEDIAKLENLYFTKFDQLQDVLVEKLFTIVNGKTSQGIFNDLGEEVLPKGKKFTLKMLNAVDDYTHLTGGTWTTDDHTNKLVADLIHNYKIKENDLQGSLRREKFTISVGDELPAGIIKLAKVYIAKKRKLKVGDKMAGRHGNKGIVARIVRQEDMPFLEDGTPVDIVLHPLGVPSRMNIGQIYETV

SEQ ID NO: 25593 - DNA, 474 bp, Unknown
  Obtained from environmental sample
  misc_feature (1)..(474): n is a, c, g, or t
gtgaaaaaacaggattataaaatacatataattggtgctggaattagtggtttaattgctgcaacggttttagaaaaaaatggattatctcctgttattattgaaacgactgatagggttggaggccgagtaaaaacagatattgtagaaggttaccaattagatcatggttttcaggtattattaactgcttatcctgctgcacaaaaatatcttaatcttgaagccttgcaattacaaacgtttattccaggagcttcaatttttaaaaatggaaaacaaaatagtattggagatcctctcagagataagtctttattattatcgactgtatttgctagggtaggaaccctttctgatacatctcacatttcgaaactttatactcacttcacgaaaaatcccttcagaaatatctcaggcaagagcaaaccacaaaatctatttagtaaatcgggctttcttcacaaatga

SEQ ID NO: 25594 - protein, 157 aa, Unknown
  Obtained from environmental sample
  misc_feature (1)..(157): Xaa is any amino acid
MKKQDYKIHIIGAGISGLIAATVLEKNGLSPVIIETTDRVGGRVKTDIVEGYQLDHGFQVLLTAYPAAQKYLNLEALQLQTFIPGASIFKNGKQNSIGDPLRDKSLLLSTVFARVGTLSDTSHISKLYTHFTKNPFRNISGKSKPQNLFSKSGFLHK

SEQ ID NO: 25595 - DNA, 489 bp, Unknown
  Obtained from environmental sample
  misc_feature (1)..(489): n is a, c, g, or t
gtgaaaaaacaggattataaaatacatataattggtgctggaattagtggtttaattgctgcaacggttttagaaaaaaatggattatctcctgttattattgaaacgactgatagggttggaggccgagtaaaaacagatattgtagaaggttaccaattagatcatggttttcaggtattattaactgcttatcctgctgcacaaaaatatcttaatcttgaagccttgcaattacaaacgtttattccaggagcttcaatttttaaaaatggaaaacaaaatagtattggagatcctctcagagataagtctttattattatcgactgtatttgctagggtaggaaccctttctgataaatttacaattttgaaacttcataataaattacagaaaaaatcactttcagaaatatcttcaagcaaagagcaaaccaccaaatcctatttagtagattttggtttttcttccaacaatgatacttga

SEQ ID NO: 25596 - protein, 162 aa, Unknown
  Obtained from environmental sample
  misc_feature (1)..(162): Xaa is any amino acid
MKKQDYKIHIIGAGISGLIAATVLEKNGLSPVIIETTDRVGGRVKTDIVEGYQLDHGFQVLLTAYPAAQKYLNLEALQLQTFIPGASIFKNGKQNSIGDPLRDKSLLLSTVFARVGTLSDKFTILKLHNKLQKKSLSEISSSKEQTTKSYLVDFGFSSNNDT

SEQ ID NO: 25597 - DNA, 840 bp, Unknown
  Obtained from environmental sample
  misc_feature (1)..(840): n is a, c, g, or t
ttggaatccagagccattataaaagtagaagaatctaaggaagcggttttattaaattttaattggcgtcggcatgataaatctccagatatcagaagatttttaatcataaatgctaaaacaaaagatactgtacaaaatatacttagaattgaagtcaataatgaaaaatgtgaattggtgtttggaccagtagaaaagggggaatacaatttttattatttgccttttaaacccgatcctaaatggggctattatcgttatgaatacttgaagccagaagaaaaaccgaattcagattggattgctaccaataaattagataaacctaaaaaggtaagtaagcttcctttagccaattgtacgcagatccaggcaagatcggagtttgattctttttacccaatggaggtatcggctacaagtagcgaattaagtaaccttataaaaagtatacatacagattatattgcatttcctgaggaccgaaaaaacccagttaaaatgcgtgatcacattccatctaaatggattaaaagtggcgtttccaaacagttcgaaggaaaagtaaaaaagaatgaatattatgcatttcaaatagccatttttgcagcaaagaagtctttaaagaatgtacaattagcttttaacgatttgaaatcttcggatggaaatattatttcttcagaggcctttacatgttttaatacatcgggcgtagatccatacggagaggcatttactaaacaagttaatgtagagaaaggcaagttcaaacgttatggattggaacagatgttacgaaacatattcaaccaggtgaatatacgtctactgtag

SEQ ID NO: 25598 - protein, 279 aa, Unknown
  Obtained from environmental sample
  misc_feature (1)..(279): Xaa is any amino acid
MESRAIIKVEESKEAVLLNFNWRRHDKSPDIRRFLIINAKTKDTVQNILRIEVNNEKCELVFGPVEKGEYNFYYLPFKPDPKWGYYRYEYLKPEEKPNSDWIATNKLDKPKKVSKLPLANCTQIQARSEFDSFYPMEVSATSSELSNLIKSIHTDYIAFPEDRKNPVKMRDHIPSKWIKSGVSKQFEGKVKKNEYYAFQIAIFAAKKSLKNVQLAFNDLKSSDGNIISSEAFTCFNTSGVDPYGEAFTKQVNVEKGKFKRYGLEQMLRNIFNQVNIRLL

SEQ ID NO: 25599 - DNA, 750 bp, Unknown
  Obtained from environmental sample
  misc_feature (1)..(750): n is a, c, g, or t
ttgaattacgaaaattttaatgaacatttaattgataaagaagaaaccagtattggttatacaagtaaagattcagtgaatcaagaatctttttattatagttataatttgttaaatgataaaattcaaaaaatctctaaaagggataaagatgataatcctttagcttttaatgctaaagtaaatgcttttattgttgaatacaataaagaatcagatgacctctataaaccaaattcaaaactaaaaattgttactaaagagaacagttttgttatcgattcaactttaagtcaaaatgacaaagttaaattctcgaattctggaacgtatatctgcttgatgaaaggtaaagctataaaaatcatagattggaaaaaaaagaaagaactcttaagctataattttacttcatatgataataaaaatatatttcaaatcaataacaataactttattgtttctgggacaaatgaggaaactcaaagcaatgtttctttttttataacagaaataaatggggagtttaaaattaaggagttaaaagatggtttggttttatcagccgattataaaaacaatcaattagcaatattatttgaagatgggttggtttttaatggtaagagttacaagataaatagtcttgatggctttgcaacatcaatttctttaaattcagatgcatcaaaaatgtttgtgaatttttctaatgggaaatcaagattattagaaaccaaaaacttttaa

SEQ ID NO: 25600 - protein, 249 aa, Unknown
  Obtained from environmental sample
  misc_feature (1)..(249): Xaa is any amino acid
MNYENFNEHLIDKEETSIGYTSKDSVNQESFYYSYNLLNDKIQKISKRDKDDNPLAFNAKVNAFIVEYNKESDDLYKPNSKLKIVTKENSFVIDSTLSQNDKVKFSNSGTYICLMKGKAIKIIDWKKKKELLSYNFTSYDNKNIFQINNNNFIVSGTNEETQSNVSFFITEINGEFKIKELKDGLVLSADYKNNQLAILFEDGLVFNGKSYKINSLDGFATSISLNSDASKMFVNFSNGKSRLLETKNF

SEQ ID NO: 25601 - DNA, 429 bp, Unknown
  Obtained from environmental sample
  misc_feature (1)..(429): n is a, c, g, or t
gtgaccgataaaaaacgaaaacttgtagataaaaataaaataaacttctataaaaaatggaaaaacgttttagataaccctccttaccaaaaaacgcgattaaaacaaaaataccttaataaaaattatgtaagagataagttattggtgctcgaagatgccataacgcctcaattattagaggaaataaatgatacagattgtactacctataaagttgctattgttctaaaagataaagaaaatttaaaaaatattgaaaaatggcagcgtcacggcgtcgaaattgtttatccttacgtatctaaagatagtaaaatgataagctatttaaatattataaaatttatggcccctggttttgatactattctaactaaaagcataaaatataaattttattttcatttgaaatcatttaataaataa

SEQ ID NO: 25602 - protein, 142 aa, Unknown
  Obtained from environmental sample
  misc_feature (1)..(142): Xaa is any amino acid
MTDKKRKLVDKNKINFYKKWKNVLDNPPYQKTRLKQKYLNKNYVRDKLLVLEDAITPQLLEEINDTDCTTYKVAIVLKDKENLKNIEKWQRHGVEIVYPYVSKDSKMISYLNIIKFMAPGFDTILTKSIKYKFYFHLKSFNK

SEQ ID NO: 25603 - DNA, 759 bp, Unknown
  Obtained from environmental sample
  misc_feature (1)..(759): n is a, c, g, or t
gtgaatccagtagattatactttcctaaaacattntcttatgaataaatatagtgaaacttttggaattgacatcagtaaagatgtctttgattgttatggtagtacacaaggtcatttacaattcaaaaatgatgaattaggctttaaaaagtttcataaaagactaccccaaaactgtttagtggttatggaagctaccggttattatcattataggtttgctcagtttttatataagaaaggtgtttttgtatctgttgtcaatcctttatcaataaagcgatttatccagatgaagttagccaaaataaagacagataaaagtgatgcaaaagccatctgtgattatggtttaacacaagaagtacctttatataatgcccttacagatgttcaaagtgagtgcttacaattgtttcgattaatggataatttattaaaaattagaaccgccacaaaaaacaaaatacatggagaggaagttttaggtgtaccctcaaaatttgtttatcgatctttaattaaaaccaaaaaatatgtagacaaagagttgaaagagattgatgagaaattattgagtctagtaaagaaagatcaacaaaaacagcttacattattacaaagtattcctggaattggactcaaaacagccttgtttttaatagtagttacagatggatttaataaatttgaaacagcctcaaaattgtgcagttatgcaggaataacaccaacaataaagagagtctggaagtaa

SEQ ID NO: 25604 - protein, 252 aa, Unknown
  Obtained from environmental sample
  DOMAIN (78)...(176): Transposase
  misc_feature (1)..(252): Xaa is any amino acid
MNPVDYTFLKHXLMNKYSETFGIDISKDVFDCYGSTQGHLQFKNDELGFKKFHKRLPQNCLVVMEATGYYHYRFAQFLYKKGVFVSVVNPLSIKRFIQMKLAKIKTDKSDAKAICDYGLTQEVPLYNALTDVQSECLQLFRLMDNLLKIRTATKNKIHGEEVLGVPSKFVYRSLIKTKKYVDKELKEIDEKLLSLVKKDQQKQLTLLQSIPGIGLKTALFLIVVTDGFNKFETASKLCSYAGITPTIKRVWK

SEQ ID NO: 25605 - DNA, 414 bp, Unknown
  Obtained from environmental sample
  misc_feature (1)..(414): n is a, c, g, or t
atggaatcttatagtttaggtaaattaactcgtgcgctaggtattcctatgagcgatagacacagggcaaatggtgatgcaatggcaactgtaaagttgtttaaaatgttactgaataaagatttagataaggttattgttaaagatgctattaagattgaaaagaaatctaatattgcaccaaaccttaatactataattgacaacctaccttctgaaactggtgtttattacattcataatgctaaaagtgaaattatatatattggaaagagtaataatattagaaaacgtatcattcagcattttacgggtaccaactctaagtctaagaaaattcaaaaattagttagcactgtaacctttgaaaaaacaggtagtgaattagccgcattattaaaagagagttgctga

SEQ ID NO: 25606 - protein, 137 aa, Unknown
  Obtained from environmental sample
  misc_feature (1)..(137): Xaa is any amino acid
MESYSLGKLTRALGIPMSDRHRANGDAMATVKLFKMLLNKDLDKVIVKDAIKIEKKSNIAPNLNTIIDNLPSETGVYYIHNAKSEIIYIGKSNNIRKRIIQHFTGTNSKSKKIQKLVSTVTFEKTGSELAALLKESC

SEQ ID NO: 25607 - DNA, 819 bp, Unknown
  Obtained from environmental sample
  misc_feature (1)..(819): n is a, c, g, or t
atgctaaaaacagaatttaaacgcttaggctttccttttaagagaaaaacgctttgtactgttgagctatctcaacagcttattccagatatggaatcttatagtttaggtaaattaactcgtgcgctaggtattcctatgagcgatagacacagggcaaatggtgatgcaatggcaactgtaaagttgtttaaaatgttactgaataaagatttagataaggttattgttaaagatgctattaagattgaaaagaaatctaatattgcaccaaaccttaatactataattgacaacctaccttctgaaactggtgtttattacattcataatgctaaaagtgaaattatatatattggaaagagtaataatattagaaaacgtatcattcagcattttacgggtaccaactctaagtctaagaaaattcaaaaattagttagcactgtaacctttgaaaaaacaggtagtgaattagccgcattattaaaagagagtgctgaaataaaaaagaacaagcctattttcaatagagcgctaagacgtacaacttttacgcatgcactatatagttttacggataaaaatggttatataaatttgcatattgacaaagcagctggagaaaccactccgattactacgtttagcactagagtaagtggaaaaaactttatgtttaaagccgtagaagattataacttgtgccaaaagctaaccgatttatatgccacaaaaacaagttgctttaaatacgacgttaaagaatgccaaggagcttgtattaatgaagaatctaaagaagactataatannnnn

SEQ ID NO: 25608 - protein, 273 aa, Unknown
  Obtained from environmental sample
  DOMAIN (103)...(183): GIY-YIG catalytic domain
  misc_feature (1)..(273): Xaa is any amino acid
MLKTEFKRLGFPFKRKTLCTVELSQQLIPDMESYSLGKLTRALGIPMSDRHRANGDAMATVKLFKMLLNKDLDKVIVKDAIKIEKKSNIAPNLNTIIDNLPSETGVYYIHNAKSEIIYIGKSNNIRKRIIQHFTGTNSKSKKIQKLVSTVTFEKTGSELAALLKESAEIKKNKPIFNRALRRTTFTHALYSFTDKNGYINLHIDKAAGETTPITTFSTRVSGKNFMFKAVEDYNLCQKLTDLYATKTSCFKYDVKECQGACINEESKEDYNXX

SEQ ID NO: 25609 - DNA, 672 bp, Unknown
  Obtained from environmental sample
  misc_feature (1)..(672): n is a, c, g, or t
ttgctaattaatgctgcttcaaataataaagaaaatccaaccattgtaattttaactccaggaccacacaatgaaacgtattttgaacatgcgtatttatcttcgtttttaggatatcctttagtaaaaggaagtgacttggttgtaagagatgaaaaagtttggcttaaaactttaaaagggttaattcaaattgatgtaatttacagacgagttgacgatgcttttgttgatcctttagaattaaaaggcgattcttttttaggagttgctggcttgttagaagttgttaggaagcaaaatgtagccataatgaatcctattggaagtggtgtattagaaaaccctgggttaattccttttatgaattctatttgtaaatactttttaaaagaagatttactattaccacaaattgcttcttggtggtgtggaccagaaaaagagcgaaaacacgttttagaaaacctcaaagattttgttgtaaaacctattgatattaccaacagagaaaatatttatttctgcgaaattttaaatgatgctgaaatagccgatttaaaaaagcagatcttagcgaaaccatatcgttttgtagcacacgacaaaatttcttttcaacaggaccaatcttaccaagaccttataactaaaaagtgttgtaaacttttn

SEQ ID NO: 25610 - protein, 224 aa, Unknown
  Obtained from environmental sample
  DOMAIN (125)...(222): Domain of unknown function (DUF407)
  misc_feature (1)..(224): Xaa is any amino acid
MLINAASNNKENPTIVILTPGPHNETYFEHAYLSSFLGYPLVKGSDLVVRDEKVWLKTLKGLIQIDVIYRRVDDAFVDPLELKGDSFLGVAGLLEVVRKQNVAIMNPIGSGVLENPGLIPFMNSICKYFLKEDLLLPQIASWWCGPEKERKHVLENLKDFVVKPIDITNRENIYFCEILNDAEIADLKKQILAKPYRFVAHDKISFQQDQSYQDLITKKCCKLX

SEQ ID NO: 25611 - DNA, 636 bp, Unknown
  Obtained from environmental sample
  misc_feature (1)..(636): n is a, c, g, or t
ttgctaattaatgctgcttcaaataataaagaaaatccaaccattgtaattttaactccaggaccacacaatgaaacgtattttgaacatgcgtatttatcttcgtttttaggatatcctttagtaaaaggaagtgacttggttgtaagagatgaaaaagtttggcttaaaactttaaaagggttaattcaaattgatgtaatttacagacgagttgacgatgcttttgttgatcctttagaattaaaaggcgattcttttttaggagttgctggcttgttagaagttgttaggaagcaaaatgtagccataatgaatcctattggaagtggtgttttagaaaaccctgggttaattccttttatgaattctatttgtaaatactttttaaaagaagatttactattaccacaaattgcttcttggtggtgtggacaagaaaaagagcgaaaacacgttttagaaaacatcaaagattttgttgtaaaacctattgatattaccaacagagaaaatatttatttctgcgaatttttaaatgatgctgaaatagccgatttaaaaaagcagattttagcaaaaccatatcgttttgtagcacaagaaaaaatatctttttcaacaggaccaannngg

SEQ ID NO: 25612 - protein, 212 aa, Unknown
  Obtained from environmental sample
  DOMAIN (125)...(212): Domain of unknown function (DUF407)
  misc_feature (1)..(212): Xaa is any amino acid
MLINAASNNKENPTIVILTPGPHNETYFEHAYLSSFLGYPLVKGSDLVVRDEKVWLKTLKGLIQIDVIYRRVDDAFVDPLELKGDSFLGVAGLLEVVRKQNVAIMNPIGSGVLENPGLIPFMNSICKYFLKEDLLLPQIASWWCGQEKERKHVLENIKDFVVKPIDITNRENIYFCEFLNDAEIADLKKQILAKPYRFVAQEKISFSTGPXX

SEQ ID NO: 25613 - DNA, 741 bp, Unknown
  Obtained from environmental sample
  misc_feature (1)..(741): n is a, c, g, or t
ttgaatttttcgctctacatagccaagcggtatttattttctaaaagtagtaacaatgccatcaatattattactggtattgcggcagttggtgttgtagtaggcgcgatgtctttatttatagtgctttcagggttttctggcttgaaagatttcagtcttcaatttactgatgaatttgacagcgacctaaaaatccttcccgaaagtggaaaaacgattactttttcagaagcacagagagcgcaactaaaaaatattgaagggcttgaaaacttttcagaaataatcgaggaacgtgtttttcttcactacaaaggaaaaaaccatatagcctacataaaaggagtggattccctctacggaaaagtgacccaactggacagtattatgtattttggagaatggttcacccctgatgagcatcaagtagtagttggactttccaccattgcaaaactttctttgggcgtgaatgattacggtgccccattggaaatttacgttccaaaagcgggaacgggacagctaaatgcgcttgacccatccgatgctttccgtaaagaaagtgtagtggtttctggagtctatcaagtaaatgaagatttggatacgaagtatgttttttccgatttggattttgcccgtaacctactttcgttggatagtacaaaaatttcttccattgaaatgaaattgttgccaaacggctttccgaagaaaatgtgcgcagccaaataa

SEQ ID NO: 25614 - protein, 246 aa, Unknown
  Obtained from environmental sample
  misc_feature (1)..(246): Xaa is any amino acid
MNFSLYIAKRYLFSKSSNNAINIITGIAAVGVVVGAMSLFIVLSGFSGLKDFSLQFTDEFDSDLKILPESGKTITFSEAQRAQLKNIEGLENFSEIIEERVFLHYKGKNHIAYIKGVDSLYGKVTQLDSIMYFGEWFTPDEHQVVVGLSTIAKLSLGVNDYGAPLEIYVPKAGTGQLNALDPSDAFRKESVVVSGVYQVNEDLDTKYVFSDLDFARNLLSLDSTKISSIEMKLLPNGFPKKMCAAK

SEQ ID NO: 25615 - DNA, 627 bp, Unknown
  Obtained from environmental sample
  misc_feature (1)..(627): n is a, c, g, or t
ttgatgagtgttgtgctattgggactcattgcttctgtaataacgcaatatgtagctagcggtgaattatttgaaaaacttacatttaaaaaagtgcaaaagaaaattgaaaaactcaagaatcatacgattgtatgtggttatggcagaaacggtaaacaagcgataattaaactaaaaaaatataataaaccagtggttataattgagagcgatgaaagattaattagtgagattgaaaacggaaacttacttttgataaatggagatgcaactaatgatgagatattagagaaagctggtattaaagaggcatcaaatttaattactacatggccttctgatgctgataatttattggtggtcctttcagcaagacagctcaatacagaattgacaattgtaagtagggcttccgatgacccatcagatagtaaattacgaatagcgggtgcaaataatgttattatgcctgataagttaggtggtgatcatatggcttccttattagttacaccagatattgtcgaatttgtagatatgttggccatagattcggataatgctactcatttagacgaccttatcgtgaataaattgccaacagaattttatcaaagtctataa

SEQ ID NO: 25616 - protein, 208 aa, Unknown
  Obtained from environmental sample
  SIGNAL (1)...(20)
  DOMAIN (42)...(158): TrkA-N domain
  misc_feature (1)..(208): Xaa is any amino acid
MMSVVLLGLIASVITQYVASGELFEKLTFKKVQKKIEKLKNHTIVCGYGRNGKQAIIKLKKYNKPVVIIESDERLISEIENGNLLLINGDATNDEILEKAGIKEASNLITTWPSDADNLLVVLSARQLNTELTIVSRASDDPSDSKLRIAGANNVIMPDKLGGDHMASLLVTPDIVEFVDMLAIDSDNATHLDDLIVNKLPTEFYQSL

SEQ ID NO: 25617 - DNA, 915 bp, Unknown
  Obtained from environmental sample
  misc_feature (1)..(915): n is a, c, g, or t
ttgggaagtggggctgacatagtgatcaagatcggctcgagaaccaatgaaaaacctcgtgtngtgtacaacacaagttcatgccggtatggtgcgcgatttattaatcagtacgcagtaaaaaaaggctggaccaccaacactaactattgtgttcgtgttaccgctaacgatggtgtagcgggtgaaaacgatttaaaaaccttttgtgataacgaaaaaaccattccaacaattttaaccacatcacgcaagctttctacaggcgtagatgcgcgtaacgtccgtaacattgtgctcatgcgtccttgtaataatatgattgagtttaagcagatcataggccgaggcacccgcacttacgatggcaaagactattttaccatttacgactttgtaaaagcgcaccataactttgctgatcctgcttgggatggtgaaccaatacccagcgaagtatgcccagagtgcggcacaaccccgtgccaatgtgaagacactggcggcgatggtgccggtgaaaagaaaccgtgtaaagtgtgtgaacaaaaaccatgtgtttgtgaaaagccagagcctgaaggctgtgaaaaatgtggcgaaagaccatgtgtatgcgaaaagctcgaaataaagctctcagacggccgtacacgacaaataaagcatatatcctcagcaatgtactggagtgctgaaggcaagcccattacagctaaagagtttgttgaacgtatgttcgatgacctaccgtgcttttttgaaaacgaagaccaactacgagaaatctggagcgacccaaccagtcgcgaaaagctattagaagatttaaccgaagcgggttacgatagcgaaaaactcgatagcatgaaggcagtaattgatgctcaagacagggatgtatacgatgtntaa

SEQ ID NO: 25618 - protein, 304 aa, Unknown
  Obtained from environmental sample
  misc_feature (1)..(304): Xaa is any amino acid
MGSGADIVIKIGSRTNEKPRVVYNTSSCRYGARFINQYAVKKGWTTNTNYCVRVTANDGVAGENDLKTFCDNEKTIPTILTTSRKLSTGVDARNVRNIVLMRPCNNMIEFKQIIGRGTRTYDGKDYFTIYDFVKAHHNFADPAWDGEPIPSEVCPECGTTPCQCEDTGGDGAGEKKPCKVCEQKPCVCEKPEPEGCEKCGERPCVCEKLEIKLSDGRTRQIKHISSAMYWSAEGKPITAKEFVERMFDDLPCFFENEDQLREIWSDPTSREKLLEDLTEAGYDSEKLDSMKAVIDAQDRDVYDV

SEQ ID NO: 25619 - DNA, 321 bp, Unknown
  Obtained from environmental sample
  misc_feature (1)..(321): n is a, c, g, or t
ttgctaaactactcaacatatttacattctcattctaatgaatgggtcacttttgttcatggagcaggaggaagcagctctatatggtataagcaaatacgagattttaaagccgaatttaatgtacttattatggatttacgaggtcatggtaatagtaaacctaagttaaaagatgcatttaatactaaatatacttttgattctattactaatgatattgtcgaagttatagattttttaaaaattgaaagctcgcatttggtcggtatatctttaggtacaatatcgattagaaacttagccaaaagcatcttctag

SEQ ID NO: 25620 - protein, 106 aa, Unknown
  Obtained from environmental sample
  misc_feature (1)..(106): Xaa is any amino acid
MLNYSTYLHSHSNEWVTFVHGAGGSSSIWYKQIRDFKAEFNVLIMDLRGHGNSKPKLKDAFNTKYTFDSITNDIVEVIDFLKIESSHLVGISLGTISIRNLAKSIF

SEQ ID NO: 25621 - DNA, 906 bp, Unknown
  Obtained from environmental sample
  misc_feature (1)..(906): n is a, c, g, or t
gtgatcaagaatcggccgaggaaaacgtatactattttatcactactagtcgctagttacagtccagctcaggatataaacacacattactatacatttaatttagaaaaagaaataactaaagacgaatttgaaaaaagatattctaactatgacacctctcaaaatgttgttgaaataaaaaaaaatgatactagtattattaaaatgttacaccccagaaaacaatttgatgtattagatcctatagttttagattccttaaaagggtatttaaactatctaactaataaaaaaaacgtctttaaagattatattgttattaactacttttctgggaacgaaccttatgaatcgtttaattctgacactaaaagttatgtcgtagataaagggtatatcaaaaaaatcaaaaaacttttaaattgtaatcagttttctatttataaggaaaaaaaagatattaaatattatgaagataaaaaactctggataaaagatgatttaggtgttattaaaaacttgtttttttattaccaaattccctacggaagttttgtgattatcaaatcggatggaacttttatatcattacatggagagcataataaagatatggtttatgaaatcgctgaagaaataaaaaaagacatcaaaaaagtagaacattacacgtatgactttaaacagaaaatagaaccatcaaaatttgatagtctattatataattcaattaaaggaaacaggaatcttgaattaaattttgaaagcgatagtattttttataagatgatacatcctgcaagacgttatggtatattaaaaaaacaccaaatagactcggttaaaaactatattaacaaaatctcaaaaacccaaaatactttaaagattctcttgttttaa

SEQ ID NO: 25622 - protein, 301 aa, Unknown
  Obtained from environmental sample
  SIGNAL (1)...(21)
  misc_feature (1)..(301): Xaa is any amino acid
MIKNRPRKTYTILSLLVASYSPAQDINTHYYTFNLEKEITKDEFEKRYSNYDTSQNVVEIKKNDTSIIKMLHPRKQFDVLDPIVLDSLKGYLNYLTNKKNVFKDYIVINYFSGNEPYESFNSDTKSYVVDKGYIKKIKKLLNCNQFSIYKEKKDIKYYEDKKLWIKDDLGVIKNLFFYYQIPYGSFVIIKSDGTFISLHGEHNKDMVYEIAEEIKKDIKKVEHYTYDFKQKIEPSKFDSLLYNSIKGNRNLELNFESDSIFYKMIHPARRYGILKKHQIDSVKNYINKISKTQNTLKILLF

SEQ ID NO: 25623 - DNA, 549 bp, Unknown
  Obtained from environmental sample
  misc_feature (1)..(549): n is a, c, g, or t
atgttacaccccagaaaacaatttgatgtattagatcctatagttttagattccttaaaagggtatttaaactatctaactaataaaaaaaacgtctttaaagattatattgttattaactacttttctgggaacgaaccttatgaatcgtttaattctgacactaaaagttatgtcgtagataaagggtatatcaaaaaaatcaaaaaacttttaaattgtaatcagttttctatttataaggaaaaaaaagatattaaatattatgaagataaaaaactctggataaaagatgatttaggtgttattaaaaacttgtttttttattaccaaattccctacggaagttttgtgattatcaaatcggatggaacttttatatcattacatggagagcataataaagatatggtttatgaaatcgctgaagaaataaaaaaagacatcaaaaaagtagaacattacacgtatgactttaaacagaaaatagaaccatcaaaatttgatagtctattatataattcaattaaaggaaaccaggaattttga

SEQ ID NO: 25624 - protein, 182 aa, Unknown
  Obtained from environmental sample
  misc_feature (1)..(182): Xaa is any amino acid
MLHPRKQFDVLDPIVLDSLKGYLNYLTNKKNVFKDYIVINYFSGNEPYESFNSDTKSYVVDKGYIKKIKKLLNCNQFSIYKEKKDIKYYEDKKLWIKDDLGVIKNLFFYYQIPYGSFVIIKSDGTFISLHGEHNKDMVYEIAEEIKKDIKKVEHYTYDFKQKIEPSKFDSLLYNSIKGNQEF

SEQ ID NO: 25625 - DNA, 336 bp, Unknown
  Obtained from environmental sample
  misc_feature (1)..(336): n is a, c, g, or t
ttgaactatttaactgccactaagaataagaaatatttaatgtatatttctcaaaattattcctacgctattttaagacctttgcaagcagaaatatttgctcaaggaggggaagttaaatggtttttagaaggtgatgaagtagaccctaagtttttaaaaccaactgaacatcgccttgaatcagtcaaaagtataaaagattgggagccagatgctgtgttcataccaggcaatactattccaagctttattccaggaaaaaaagtagctgtatttcatggtttttattctggaaaactaaatagaaaaggtaaagaagaccatttcnnnnng

SEQ ID NO: 25626 - protein, 112 aa, Unknown
  Obtained from environmental sample
  misc_feature (1)..(112): Xaa is any amino acid
MNYLTATKNKKYLMYISQNYSYAILRPLQAEIFAQGGEVKWFLEGDEVDPKFLKPTEHRLESVKSIKDWEPDAVFIPGNTIPSFIPGKKVAVFHGFYSGKLNRKGKEDHFXX

SEQ ID NO: 25627 - DNA, 780 bp, Unknown
  Obtained from environmental sample
  misc_feature (1)..(780): n is a, c, g, or t
atggatcgtgaggattggtttggtatgtatgtgaatactattgtagaagagtttgatccacacacctcttacttagcaccaacagataaagatagatttgatcagcaaatgtctggtaaactggaaggtattggagcacgtttacagaaaaaaatggactacatcaaaattgtagaacttatttctggtggaccagcttggagagatggagagatagaagttggtgatgttataatgaaagtacgtcaggacaaagaaaaagaagcaataagcgtagttggaatgcgtatcgatgatgctattaaattaattaaaggacctaaagggactaaggttattttaaccatgaaaaaagtggatggtactatccaagatattgcggtgactagagatttagtagagctggaagagacttatgctaagtcttcaatagtgaaaaaagaccataaaaattacggaataataaatctgcctaaattttatgtagattttgaagattacaataatcgtaatgctgcaacagatattaaactggaaattgagcgtttaaaagaagcaggtattgaaggtcttgttttagacctacgtaataatggtggaggatctttaagaaccgttgtagatatggctggtttatttattaaagaaggaccaattgtacaagttagatcaaccgacgagccaaaagaggtcttacgtgatactgacaaatccattgtttgggatggaccattagtaattatggttaacgagttatctgcatctgcatcagaattttag

SEQ ID NO: 25628 - protein, 259 aa, Unknown
  Obtained from environmental sample
  DOMAIN (151)...(259): Peptidase family S41
  misc_feature (1)..(259): Xaa is any amino acid
MDREDWFGMYVNTIVEEFDPHTSYLAPTDKDRFDQQMSGKLEGIGARLQKKMDYIKIVELISGGPAWRDGEIEVGDVIMKVRQDKEKEAISVVGMRIDDAIKLIKGPKGTKVILTMKKVDGTIQDIAVTRDLVELEETYAKSSIVKKDHKNYGIINLPKFYVDFEDYNNRNAATDIKLEIERLKEAGIEGLVLDLRNNGGGSLRTVVDMAGLFIKEGPIVQVRSTDEPKEVLRDTDKSIVWDGPLVIMVNELSASASEF

SEQ ID NO: 25629 - DNA, 339 bp, Unknown
  Obtained from environmental sample
  misc_feature (1)..(339): n is a, c, g, or t
ttggaggnggaacaccgcaattggaatgtgagaaacaataccgaatacatcaaggccttagaaaataatacactgcctttagaaaccgaaacactttctactaccgacgaatacaacgaatatgtgatgacagggctgcgtactatttggggtgtttctctcgataaagtggaaaaagatttcggatcagactataaaaactaccttttggagcactcacaaaaacatattattgaacaattattgtatcttgaggatggcaaattgctggtcaccaaaaagggtaaatttttgagtgatggtattgcgtctgatctttttaaaatcaatatatcttga

SEQ ID NO: 25630 - protein, 112 aa, Unknown
  Obtained from environmental sample
  DOMAIN (1)...(97): HemN C-terminal region
  misc_feature (1)..(112): Xaa is any amino acid
MEXEHRNWNVRNNTEYIKALENNTLPLETETLSTTDEYNEYVMTGLRTIWGVSLDKVEKDFGSDYKNYLLEHSQKHIIEQLLYLEDGKLLVTKKGKFLSDGIASDLFKINIS

SEQ ID NO: 25631 - DNA, 366 bp, Unknown
  Obtained from environmental sample
  misc_feature (1)..(366): n is a, c, g, or t
ttgggaatagggccgtcagcccattcttttgacggcgaacaccgcagttggaatgtgagaaacaataccaaatacatcaaggccttagaaaataatacactgcctttagaaaccgaaacactttctactaccgacaaatacaacgaatatgtgatgacagggctgcgtactatttggggtgtttctctcgataaagtggaaaaagatttcggatcagactataaaaactaccttttggagcactcacaaaaacatattattgaacaattattgtatcttgaggatggcaaattgctggtcaccaaaaagggtaaatttttgagtgatggtattgcgtctgatctttttaaaatcaatatatcttga

SEQ ID NO: 25632 - protein, 121 aa, Unknown
  Obtained from environmental sample
  DOMAIN (1)...(106): HemN C-terminal region
  misc_feature (1)..(121): Xaa is any amino acid
MGIGPSAHSFDGEHRSWNVRNNTKYIKALENNTLPLETETLSTTDKYNEYVMTGLRTIWGVSLDKVEKDFGSDYKNYLLEHSQKHIIEQLLYLEDGKLLVTKKGKFLSDGIASDLFKINIS

SEQ ID NO: 25633 - DNA, 429 bp, Unknown
  Obtained from environmental sample
  misc_feature (1)..(429): n is a, c, g, or t
gtggatggtattattgtacaaaataataatgatgttgttttttataaccctaaaaaaataaaatctatagcagttgtgcaaggtcaatacatttatggctcaaaactttttcaaggtattatagatataaaaacctttcttcaagattttaaaacgagtttaaaaggagatttctttatagaaaaacaattaaaaaaaccagaacctaaaaaaatatattttcaacccaattactcagatgctgcacaattaaacaatcgtattccagactatagaagacaattattatggataccagaaattaatgaaactgtaaataagtatgaagcatacgcctcagatgtaaaaggcatctttgaaattacactcgagggaatcaataattcaggtgtttttattagcgcttccacttatattgaagtgaactaa

SEQ ID NO: 25634 - protein, 142 aa, Unknown
  Obtained from environmental sample
  misc_feature (1)..(142): Xaa is any amino acid
MDGIIVQNNNDVVFYNPKKIKSIAVVQGQYIYGSKLFQGIIDIKTFLQDFKTSLKGDFFIEKQLKKPEPKKIYFQPNYSDAAQLNNRIPDYRRQLLWIPEINETVNKYEAYASDVKGIFEITLEGINNSGVFISASTYIEVN

SEQ ID NO: 25635 - DNA, 846 bp, Unknown
  Obtained from environmental sample
  misc_feature (1)..(846): n is a, c, g, or t
atggaaatcacattaaaaggagataaagttatagaaagtgttccttcattaaaagataaagcattacgcattaacttaaatgaaaacatatatggcacgttctccgaaattggtgccggacaagaaaccgttcgtcatttttttagagctggtggaggatcgggaacgattgcgaaggcaatgtctgcctacgataaagattttagtgatgccatttacggaattgaaaatgacagacgttatgttaccgaagcgcgtttacgtaaaatgctagatcacgaaattaatttgatggaacagcgtattacacgcgataagcatccgcataaaatgttctttagttatgccaatacggtggcaaccatagattttgctaaaaaatttaaagggcacggttggattggtataaaatatcaaattgatgcagatcaggcgtataacgaaattgtattacatgtgcgttttaaagaaaacgatgcacgtttacaacaagaaaccttaggtaagttaggaactaacttaatttatggcgcgtattacaaatataacgagcctaaaaaattattgcgttatttatacgatcatttagatcaagatcaattagaaatagataccataaacttctcggggcctatttttgaaaatgtagataaccgtttaatgagtttacaactggttaaaaacggaatgaccgatgccattatgtttgcgccagacggtaataatgtactgcctgcaaaagttctttacaaaaaaaatattttaacgctacgcggaagttttagaccggtaacgaaagtaaatatggatatgtataagaaatcttacactcgagccgattcttga

SEQ ID NO: 25636 - protein, 281 aa, Unknown
  Obtained from environmental sample
  misc_feature (1)..(281): Xaa is any amino acid
MEITLKGDKVIESVPSLKDKALRINLNENIYGTFSEIGAGQETVRHFFRAGGGSGTIAKAMSAYDKDFSDAIYGIENDRRYVTEARLRKMLDHEINLMEQRITRDKHPHKMFFSYANTVATIDFAKKFKGHGWIGIKYQIDADQAYNEIVLHVRFKENDARLQQETLGKLGTNLIYGAYYKYNEPKKLLRYLYDHLDQDQLEIDTINFSGPIFENVDNRLMSLQLVKNGMTDAIMFAPDGNNVLPAKVLYKKNILTLRGSFRPVTKVNMDMYKKSYTRADS

SEQ ID NO: 25637 - DNA, 411 bp, Unknown
  Obtained from environmental sample
  misc_feature (1)..(411): n is a, c, g, or t
ttgaaatttgatggggaacagcgtattacacgcgataagcatccgcataaaatgttctttagttatgccaatacggtggcaaccatagattttgctaaaaaatttaaagggcacggttggattggtataaaatatcaaattgatgcagatcaggcgtataacgaaattgtattacatgtgcgttttaaagaaaacgatgcacgtttacaacaagaaaccttaggtaagttaggaactaacttaatttatggcgcgtattacaaatataacgagcctaaaaaattattgcgttatttatacgatcatttagatcaagatcaattagaaatagataccataaacttctcggggcctatttttgaaaatgtagataaccgtttaatgagtttacaactggttaaaacggaatga

SEQ ID NO: 25638 - protein, 136 aa, Unknown
  Obtained from environmental sample
  misc_feature (1)..(136): Xaa is any amino acid
MKFDGEQRITRDKHPHKMFFSYANTVATIDFAKKFKGHGWIGIKYQIDADQAYNEIVLHVRFKENDARLQQETLGKLGTNLIYGAYYKYNEPKKLLRYLYDHLDQDQLEIDTINFSGPIFENVDNRLMSLQLVKTE

SEQ ID NO: 25639 - DNA, 885 bp, Unknown
  Obtained from environmental sample
  misc_feature (1)..(885): n is a, c, g, or t
gtggcaaagcttggaaaggcggtttaccaccggataaacgggaatacctggccacgagctaaagggggcagtacccagagggatcacatcatcgtctctatatacggcatctttgtcatcgaaaccaaaaactataaagcctggatatatggtagcgagaaccaaagacagtggacgcaagccttcccaaatggaagtaaattcaaattccaaaacccattgcgccaaaactacttgcacattaagacgctcgcagatttattaggcttggagttgagctactttcattcgatgattgcttttatcggtgagtgcgaattaaaaacccgcgatgagttgcccgagtatgtattgacgagtggtatggtgtcttatgtgaaggaaaagcaaaataagatactcactgaagatgaggttgcatctatcgttgcgcagattaatagcaatagatttagtaagtcttggcgcaccaatcgagagcataaagcctatctaaaagacaagcatagcaattcaagcaaaaatacaaataagcagcctagcgataatactaatgataaaccagttgctaaagtggctcatgagtctataccagagccgatagtaaaagagaccgctaaacgagctattctaaaaagtagggaagtgcatcgatggtcgggtcagactgacattgaatctagcgatttaccaattgatagtatggacactcagcaggcagatattcagcatacaattacatcgcacgatattgctgataaggtttttcttacgccgtttgagatcgtagaatctgagccaaaagttaatgaacctgcgacaattgaggtgatagaccatacagctgatttaattcaaacgccaacctgcccgagattaacgtga

SEQ ID NO: 25640 - protein, 294 aa, Unknown
  Obtained from environmental sample
  misc_feature (1)..(294): Xaa is any amino acid
MAKLGKAVYHRINGNTWPRAKGGSTQRDHIIVSIYGIFVIETKNYKAWIYGSENQRQWTQAFPNGSKFKFQNPLRQNYLHIKTLADLLGLELSYFHSMIAFIGECELKTRDELPEYVLTSGMVSYVKEKQNKILTEDEVASIVAQINSNRFSKSWRTNREHKAYLKDKHSNSSKNTNKQPSDNTNDKPVAKVAHESIPEPIVKETAKRAILKSREVHRWSGQTDIESSDLPIDSMDTQQADIQHTITSHDIADKVFLTPFEIVESEPKVNEPATIEVIDHTADLIQTPTCPRLT

SEQ ID NO: 25641 - DNA, 570 bp, Unknown
  Obtained from environmental sample
  misc_feature (1)..(570): n is a, c, g, or t
ttgttgagcttaagaagacaattttcaggngttggagaggcgacttcgaatccatattatggtatttcagtccaaaaaatgatggaggatatgcgtattatccaaccattaattgaatcattaagaaatgaaacacccgaggagttttggaaaatgttgtttccatcattaaaacaaaatatgtttgctttgtgtgcattagatatggcttatcatgatctgtatgctcgaaaaaaaggcaaaaaattatatgagctttggggatataatatcaataataatccgttgactgattatacaattggtatcgcttcagttgcagaaatgattgctaaaatggaggagtttccttggccgatctataagatcaaattaggcacaaaagatgatatcaatattattaaagaactccgtaaaaacactgatgcagtttttagagtggatgcaaattgcggttggaatgttgatgaaaccataaataatgcaattgtgttaaaaaaattaggggtagaatttattgaacaaccattaaaagctgatcattgggacggtcatagaaaggttttttaa

SEQ ID NO: 25642 - protein, 189 aa, Unknown
  Obtained from environmental sample
  misc_feature (1)..(189): Xaa is any amino acid
MLSLRRQFSGVGEATSNPYYGISVQKMMEDMRIIQPLIESLRNETPEEFWKMLFPSLKQNMFALCALDMAYHDLYARKKGKKLYELWGYNINNNPLTDYTIGIASVAEMIAKMEEFPWPIYKIKLGTKDDINIIKELRKNTDAVFRVDANCGWNVDETINNAIVLKKLGVEFIEQPLKADHWDGHRKVF

SEQ ID NO: 25643 - DNA, 327 bp, Unknown
  Obtained from environmental sample
  misc_feature (1)..(327): n is a, c, g, or t
ttggtcgccgtacccaattataaaagttacgatgcaacttattacaaagagtattgggcggcgtatgatgtgcctagacacttatggcatttttccagattatcaataaataatttgtttcaatcggtaaatatgaaagtcatcaaaaccttacccatgaaatttgattccttttatgtaagcttactttccgaaaagtataaaacaggtaattctaatttcattaaagctttttttattggattacggtctaatttaaaagcaagaacctctaaagagtattcttcgcttatttatataataaaaacaagtaaaaacctattttaa

SEQ ID NO: 25644 - protein, 108 aa, Unknown
  Obtained from environmental sample
  misc_feature (1)..(108): Xaa is any amino acid
MVAVPNYKSYDATYYKEYWAAYDVPRHLWHFSRLSINNLFQSVNMKVIKTLPMKFDSFYVSLLSEKYKTGNSNFIKAFFIGLRSNLKARTSKEYSSLIYIIKTSKNLF

SEQ ID NO: 25645 - DNA, 534 bp, Unknown
  Obtained from environmental sample
  misc_feature (1)..(534): n is a, c, g, or t
atgaacgacgataaaagttacaaagaatacttagcaaatattaccacatttatttttgatgttgatggagtacttaccgatggtactattacggttacaacagatggagaaatgctaagaaccatgaatattaaagacggattcgccttaaaaacagctatcgatgctggttttaatctctgtattatttctggaggttctaatgaaggggttcgtaagcgtttagccgccttagggattaaagacatttttttaggtacacataataaaattgaacaactcaattcttatttaaatcagcataatatttcaaaatctcaagtgttatatatgggagatgatattccagattttcctgtgatggaattggttggtttaccatgttgcccgcaagatgcagtaccagagattaaagccatttcaaaatacatctcgcataaaaatggtggcaaaggagctgttagagatgtaattgaacaagtattgaaagtgcaaggtaaatggaatgggaattttaatgctaaatacgactaa

SEQ ID NO: 25646 - protein, 177 aa, Unknown
  Obtained from environmental sample
  misc_feature (1)..(177): Xaa is any amino acid
MNDDKSYKEYLANITTFIFDVDGVLTDGTITVTTDGEMLRTMNIKDGFALKTAIDAGFNLCIISGGSNEGVRKRLAALGIKDIFLGTHNKIEQLNSYLNQHNISKSQVLYMGDDIPDFPVMELVGLPCCPQDAVPEIKAISKYISHKNGGKGAVRDVIEQVLKVQGKWNGNFNAKYD

SEQ ID NO: 25647 - DNA, 351 bp, Unknown
  Obtained from environmental sample
  misc_feature (1)..(351): n is a, c, g, or t
ttgttaacagctttattaaaaatcaaactgcctggctgcaaaaatagaatcgtgaggttttggggtaccttcaggaacatctttcttcatctcttcccaatttacaggtcgttctacaattgttatataatctgttgcatccacaaacgttttaaattgtttgttggtaacctctataatatcgataaaaaaaccatcaacggtcacttgatgtgctggcttttcgcgatccatagcgtatttatcctcctttttagctccttgagtaaaggtctttccaataacccagaccataccctcgggagtcttgacctcatttggttgagttatcaaaaaagctttatttactga

SEQ ID NO: 25648 - protein, 116 aa, Unknown
  Obtained from environmental sample
  misc_feature (1)..(116): Xaa is any amino acid
MLTALLKIKLPGCKNRIVRFWGTFRNIFLHLFPIYRSFYNCYIICCIHKRFKLFVGNLYNIDKKTINGHLMCWLFAIHSVFILLFSSLSKGLSNNPDHTLGSLDLIWLSYQKSFIY

SEQ ID NO: 25649 - DNA, 495 bp, Unknown
  Obtained from environmental sample
  misc_feature (1)..(495): n is a, c, g, or t
atgaagaatgaagaaaagaactactatttacaaataaacctggtattaatcacaacaaatacatatgtcaatctcctgatactgttatttgttgtatccaattttacgaattgcaaaaataatgctaatgaaaaatctaatgttaacacagagagtagttcagtaaataaagcttttttgataactcaaccaaatgaggtcaagactcccgagggtatggtctgggttattggaaagacctttactcaaggagctaaaaaggaggataaatacgctatggatcgcgaaaagccagcacatcaagtgaccgttgatggtttttttatcgatattatagaggttaccaacaaacaatttaaaacgtttgtggatgcaacagattatataacaattgtagaacgacctgtaaattgggaagagatgaagaaagatgttcctgaaggtaccccaaaacctcacgattctatttttgcagccaggcagtttgatttttaa

SEQ ID NO: 25650 - protein, 164 aa, Unknown
  Obtained from environmental sample
  misc_feature (1)..(164): Xaa is any amino acid
MKNEEKNYYLQINLVLITTNTYVNLLILLFVVSNFTNCKNNANEKSNVNTESSSVNKAFLITQPNEVKTPEGMVWVIGKTFTQGAKKEDKYAMDREKPAHQVTVDGFFIDIIEVTNKQFKTFVDATDYITIVERPVNWEEMKKDVPEGTPKPHDSIFAARQFDF

SEQ ID NO: 25651 - DNA, 372 bp, Unknown
  Obtained from environmental sample
  misc_feature (1)..(372): n is a, c, g, or t
gtggatcaagatcggtcgagttatatgaatcatgaatacacagtatatacattaactggagagcagatttgtggtaaaagaagaaaagctaatgattttgctcgagaatatttattcaataaacaaaggtctaaatacattaaaccttttatcaatgaagatgttctggttagggagtacgcagataaagcacaaattcacccaagtattatttataacttttatatgtatgatagtaatagttgggggaaatttaaaaatcaaatgccagatgttagtttagctattaacactctaaatgtaaacatatgggaaagcgaatcagttgaggaaacaacacaaagattaaaaaaagaaatattcaatatttaa

SEQ ID NO: 25652 - protein, 123 aa, Unknown
  Obtained from environmental sample
  misc_feature (1)..(123): Xaa is any amino acid
MDQDRSSYMNHEYTVYTLTGEQICGKRRKANDFAREYLFNKQRSKYIKPFINEDVLVREYADKAQIHPSIIYNFYMYDSNSWGKFKNQMPDVSLAINTLNVNIWESESVEETTQRLKKEIFNI

SEQ ID NO: 25653 - DNA, 300 bp, Unknown
  Obtained from environmental sample
  misc_feature (1)..(300): n is a, c, g, or t
gtggttaaagaagaaaagctaatgatttgctcgagaatattattcaataaacaaaggtctaaatacattaaacctttgatcagtgaagatgntctggttagggagtacgcagataaagcacaaattcacccaagtattatttataacttttatatgtatgatagtaatagttgggggaaatctaaaaatcaaatgccagatgttagtttagctattaacactctaaatgtaaacatatgggaaagcgaatcagttgaggaaacaacacaaagattaaaaaaagaaatattcaatatttaa

SEQ ID NO: 25654 - protein, 99 aa, Unknown
  Obtained from environmental sample
  misc_feature (1)..(99): Xaa is any amino acid
MVKEEKLMICSRILFNKQRSKYIKPLISEDXLVREYADKAQIHPSIIYNFYMYDSNSWGKSKNQMPDVSLAINTLNVNIWESESVEETTQRLKKEIFNI

SEQ ID NO: 25655 - DNA, 636 bp, Unknown
  Obtained from environmental sample
  misc_feature (1)..(636): n is a, c, g, or t
atgccacttctatccctaactcaaaacaaaacagttatgataattctaattgctccagaacaagacattcctaatgaaattgaaatattaaatcaattatttaaagaaggtttaaaattttatcattttagaaaaccagataaaaattacgcagagcacgttgcgtatttaaataaaattgataaaaaatatcacaatagaattgtagtgcatttttatcacgaattgattaatgatttcaatttaaaaggcattcattttcaggaacaaaaaagaaaggattctttagaaaaaggaattggatattttaatggtttaaaaatgaatggaaaaacaatgagcagttcttttcacgaaccagaagagttaacagcttgtaatttagagttcgattatcatttattgagtcctgttttttcttctatttctaaaaaaggatatgaaggtagaggttttgatgtaaatcatataaataaaacaattgttggtatgggaggaattaattcagaaaccatccaagaaaccatacaattaggttttaaaggaattggtgttttaggtggcgtttggaatgctgaaaaccctgtagagagttttaaagagattgaacagatatacaaaattcataattcataa

SEQ ID NO: 25656 - protein, 211 aa, Unknown
  Obtained from environmental sample
  DOMAIN (11)...(203): Thiamine monophosphate synthase/TENI
  misc_feature (1)..(211): Xaa is any amino acid
MPLLSLTQNKTVMIILIAPEQDIPNEIEILNQLFKEGLKFYHFRKPDKNYAEHVAYLNKIDKKYHNRIVVHFYHELINDFNLKGIHFQEQKRKDSLEKGIGYFNGLKMNGKTMSSSFHEPEELTACNLEFDYHLLSPVFSSISKKGYEGRGFDVNHINKTIVGMGGINSETIQETIQLGFKGIGVLGGVWNAENPVESFKEIEQIYKIHNS

SEQ ID NO: 25657 - DNA, 465 bp, Unknown
  Obtained from environmental sample
  misc_feature (1)..(465): n is a, c, g, or t
atgattagcaaattacactacatcactcaaggaaaaactccagaagcacatttaagcaatttagaaaaagcgtgtatggcaggtgcagattgggtacaattacgtttaaaaaacatggatcttgatgttgttttaaaaactgccaaaaaagcgagagaaataacatcaaaatatcaaacaaaattaataataaacgatcattacaaaattgcaaaagcggtaaatgcagatggagttcatttgggcaaaaacgatgaatgtccgttaataactcgcaattttttaggcacttcatttataattggaggaactgcaaatactgttgaagattgtaaagttttgctaaataaaaaagtagattatataggtttaggtccttatcaatttacagaaacaaaaaagaatgtaagtcctattttaggagttgctggttatcagaaaataatagaacaccttcaaacgtaa

SEQ ID NO: 25658 - protein, 154 aa, Unknown
  Obtained from environmental sample
  DOMAIN (2)...(153): Thiamine monophosphate synthase/TENI
  misc_feature (1)..(154): Xaa is any amino acid
MISKLHYITQGKTPEAHLSNLEKACMAGADWVQLRLKNMDLDVVLKTAKKAREITSKYQTKLIINDHYKIAKAVNADGVHLGKNDECPLITRNFLGTSFIIGGTANTVEDCKVLLNKKVDYIGLGPYQFTETKKNVSPILGVAGYQKIIEHLQT

SEQ ID NO: 25659 - DNA, 360 bp, Unknown
  Obtained from environmental sample
  misc_feature (1)..(360): n is a, c, g, or t
ttgatcacaccaaactacaatgaaatcaaagattggtttcctgataaatccatagaagaaactattgaatttatatcagaaaaaacaaatatttatctaaaaggaggccacagaaaagaaaaaattggttgggatgaagtgtattatagtaaaattgtaaaactgaatatttctccaataaccacaaaacctattttcgaaaaacacggaagtggttgtgttttgtcatctgctttggctgcgaatttaacaaaagatattcctttagaagatgcttgtaaaaatgcaaaattatatacagaacaatttttaagttctaacaaaactttattaggaacacataattatcagaataaatga

SEQ ID NO: 25660 - protein, 119 aa, Unknown
  Obtained from environmental sample
  misc_feature (1)..(119): Xaa is any amino acid
MITPNYNEIKDWFPDKSIEETIEFISEKTNIYLKGGHRKEKIGWDEVYYSKIVKLNISPITTKPIFEKHGSGCVLSSALAANLTKDIPLEDACKNAKLYTEQFLSSNKTLLGTHNYQNK

SEQ ID NO: 25661 - DNA, 630 bp, Unknown
  Obtained from environmental sample
  misc_feature (1)..(630): n is a, c, g, or t
ttggtgctggataggaccaattggaagttcggcaccaagaatatcaatattttaatgctgggaatcagctataaaaacgttgcgtttctcttgatgtttaaaatgttggataagcgtgggaattctgatacccaagaacgaattgatctggtcaaacaatttatagaatggtttggaaaagaacgcatagattgtttgctggccgatagagaatttattggagacaaatggttggaattcttgaatgagaacaatattagatatttcattaggatcaggaataatttcaaaatttattcctatcaaaaacaaaaagagatcaaagcattttggttgttcaacaatttaaaaattggtgagttttataactatccaaaaatagtatcactccatggtcaaaaatgttatctatccggcagcaaaactttcagcagagatggtaaaatggagttcctgatcattgtttcgttcaacaggcccgagcaggcaatggtttattacagaccaaggtgggaaatagaaaccctttttagaggattgaaaagtagtggtttcaatattgaagatactcatgtaaccgatttggaaaggttggaaaaactctttctgttaacaatgattgcttnnnnn

SEQ ID NO: 25662 - protein, 210 aa, Unknown
  Obtained from environmental sample
  DOMAIN (1)...(208): Transposase DDE domain
  misc_feature (1)..(210): Xaa is any amino acid
MVLDRTNWKFGTKNINILMLGISYKNVAFLLMFKMLDKRGNSDTQERIDLVKQFIEWFGKERIDCLLADREFIGDKWLEFLNENNIRYFIRIRNNFKIYSYQKQKEIKAFWLFNNLKIGEFYNYPKIVSLHGQKCYLSGSKTFSRDGKMEFLIIVSFNRPEQAMVYYRPRWEIETLFRGLKSSGFNIEDTHVTDLERLEKLFLLTMIAXX

SEQ ID NO: 25663 - DNA, 474 bp, Unknown
  Obtained from environmental sample
  misc_feature (1)..(474): n is a, c, g, or t
atgtctaaaataaaaatcctctataccattcccaattttgatactgctggtagtggcaaagttgtatatgaccttgttaaaggcttggataggaaaatatttgaagtggaggtagcctgttcaagcaatcgcggcgctttttttagtgagatggaaggattgggcgttccaatccatattgtggaaacaacaacaaagtatcgcccttatagtggcttgtttattcgaattaaaaccatcaagaatttttttagaaataataagtatgacatagttcattcctggcattggagcagtgattggacagaggtgattgcggnccgatgggctggcgcaaaatggatctataccaaaaaggcgatgagttgggggaacaaacattggaaaattcgcagttatcttgcaagttttattattacaattaatgatgaaatgcgaagctattttccatctaaaaaagaaccaaaaggttaa

SEQ ID NO: 25664 - protein, 157 aa, Unknown
  Obtained from environmental sample
  misc_feature (1)..(157): Xaa is any amino acid
MSKIKILYTIPNFDTAGSGKVVYDLVKGLDRKIFEVEVACSSNRGAFFSEMEGLGVPIHIVETTTKYRPYSGLFIRIKTIKNFFRNNKYDIVHSWHWSSDWTEVIAXRWAGAKWIYTKKAMSWGNKHWKIRSYLASFIITINDEMRSYFPSKKEPKG

SEQ ID NO: 25665 - DNA, 480 bp, Unknown
  Obtained from environmental sample
  misc_feature (1)..(480): n is a, c, g, or t
ttgaaatatatttctattgatggtgatgatgtaggtagaaagattacatcatattatttgagtaatgactgcaacgggcttgaggagttaagcagctctattagggcttctacaaaggcaatatcagttaagcttcaggaacatggatttgacatcattttttgcgctgccgatggagtcgcggcgtctacgaaacaagatattgacatgaaatctatattctccgaaataaggaaaatatctccaaatggagttactttttccgcagggtctgggtcaagtattcgtgaatcctatattgctttaatttcagctaagagcaatgggaaaaattgccttcatgagtatccaccattagatgatcccgccaagattgccaattgttcggatcgtaagtttgactactttaaggacattgtctgctacggtgtcacagatggtattaagcccttgtcacatatggtactgaaatcgaaataa

SEQ ID NO: 25666 - protein, 159 aa, Unknown
  Obtained from environmental sample
  misc_feature (1)..(159): Xaa is any amino acid
MKYISIDGDDVGRKITSYYLSNDCNGLEELSSSIRASTKAISVKLQEHGFDIIFCAADGVAASTKQDIDMKSIFSEIRKISPNGVTFSAGSGSSIRESYIALISAKSNGKNCLHEYPPLDDPAKIANCSDRKFDYFKDIVCYGVTDGIKPLSHMVLKSK

SEQ ID NO: 25667 - DNA, 621 bp, Unknown
  Obtained from environmental sample
  misc_feature (1)..(621): n is a, c, g, or t
atgagtgatgcaacttcaagcctgacccattactgcgagttaaccatcatccctgaccctgatattgcgccctactttatctggagtaagctatttacccagctacacattgcgctagctgaaatgaagaataaacatgacatcgaatccatcggtgtcagcttccctgattatcattatgatgataaaaaggagaagtcatctaagctgggagtaaagcttcgcgtctttgcctctaaccaaaaagatttagaaacgctaaatcttgataactggctatcgcggcttactgactacgtgcatatcaaaggcatcaaagacgtgcctatagataaaataacgggctacgtgagtgtacaccgctatcgttttaaaccgatagaggtacaagtagaatctctagccaaaaaaatggagattagcaatgacgaggcaatggcgatagttgttaaacgcaaagctgaattaaagctgccttttatcagaatgtttagtgaaagcaataaagcccattatccattgcaaattttacaacaacctagtaaacaggacgtaactggtggttttaatgtatacggtatgaatggcatgcgcgataacgttactgtgccgcagtggtag

SEQ ID NO: 25668 - protein, 206 aa, Unknown
  Obtained from environmental sample
  misc_feature (1)..(206): Xaa is any amino acid
MSDATSSLTHYCELTIIPDPDIAPYFIWSKLFTQLHIALAEMKNKHDIESIGVSFPDYHYDDKKEKSSKLGVKLRVFASNQKDLETLNLDNWLSRLTDYVHIKGIKDVPIDKITGYVSVHRYRFKPIEVQVESLAKKMEISNDEAMAIVVKRKAELKLPFIRMFSESNKAHYPLQILQQPSKQDVTGGFNVYGMNGMRDNVTVPQW

SEQ ID NO: 25669 - DNA, 609 bp, Unknown
  Obtained from environmental sample
  misc_feature (1)..(609): n is a, c, g, or t
gtggataaaaaattaatttccaagaaaaaacctgcttttcccataacgcctttattgtcggattatctgactgcgcaaggaagaaatattaagatccctattttttatgacgatttactacgttttcaaggggctgtagaaatcttagatgaaaatgataacgatacgttatggattagcacctattttgcagaacacgagcgcgacgaaatagaatacagtttaaagcaaatgtattctatactccattctgatggaagcgacagtattatcccttatttaaatatcgacagtatagatttttgcaccttcggaaacaccaaaccgtttcgtattaaggttcggaatatattaaacgataattacctctatctgtatgtaaaaaaagcagatgcttcccgagtttatgggttggaattggaacatttattatcgcccaatcatattacttttttggtacataaggatacgttaatagaagaacacatctcaggagttgcaggcgatacttttattagcaagcatttagagaaactttcagatcaagataaacgtgctttagccaaagagtttgtaaatttaacgagcgttgttttgtgcgccttttag

SEQ ID NO: 25670 - protein, 202 aa, Unknown
  Obtained from environmental sample
  misc_feature (1)..(202): Xaa is any amino acid
MDKKLISKKKPAFPITPLLSDYLTAQGRNIKIPIFYDDLLRFQGAVEILDENDNDTLWISTYFAEHERDEIEYSLKQMYSILHSDGSDSIIPYLNIDSIDFCTFGNTKPFRIKVRNILNDNYLYLYVKKADASRVYGLELEHLLSPNHITFLVHKDTLIEEHISGVAGDTFISKHLEKLSDQDKRALAKEFVNLTSVVLCAF

SEQ ID NO: 25671 - DNA, 462 bp, Unknown
  Obtained from environmental sample
  misc_feature (1)..(462): n is a, c, g, or t
ttgaatactgccaaattgattaacttagagtgtacgggtgttaataaatataggaacgattataaatttagaaccaaagaatatgatttttttaagttaaacgataccgtgattaattcgaaaacttacagcctatttaaactcgcatcaataaaacctagaaaggaaaaaagactacaattagccactaaattctatatattagataaggacactgcttttcacttacccctactcgatttttctacagcctatgaagaatggaagttaaatcgaatactccctaatggtctattttatcagaaatacactattaattatggagggcgaataagtggaaaagaaacgttattaaattatacgaaaattaataaaaaaataatcattagtgaagattgtgattacacgaaaaagttagcttcacctgctttaaaaacaaataatctaatgaagaatcagtaa

SEQ ID NO: 25672 - protein, 153 aa, Unknown
  Obtained from environmental sample
  misc_feature (1)..(153): Xaa is any amino acid
MNTAKLINLECTGVNKYRNDYKFRTKEYDFFKLNDTVINSKTYSLFKLASIKPRKEKRLQLATKFYILDKDTAFHLPLLDFSTAYEEWKLNRILPNGLFYQKYTINYGGRISGKETLLNYTKINKKIIISEDCDYTKKLASPALKTNNLMKNQ

SEQ ID NO: 25673 - DNA, 681 bp, Unknown
  Obtained from environmental sample
  misc_feature (1)..(681): n is a, c, g, or t
atgataaaaccaattaaaaaaaatgacaatcggagtgttgatttaacatttagctggttatctaaagctattggcactaaatggctttcgtgggagaagttggctgccgaatggatgaagatgcaaacaacttctattgacgtcaaaagagtagctcttacttttttattagaaaaatattttttaatacatgctccctatgcatctaatatcgatactttttttagtggttcaaatggtcatataagtaattcagatgaatttattgaagtaatgaaaatatcaggtgtcaacgaccttaacgagcaggcaaggagaccaaattatatagttgatttcattgactttgtcatcgagaagcattttacagttcgtgatcaaaataatgtctccataaaaacggttgttaacccatttacaaaggttaaatttaaaagtgttcctcttgagactgttcgccaaccactcccttataaatatatactctcgctaagagatataatttcaccgagtaacgataaaacaactaagcatgataatacatcccactgtccatcattcaaagattggctttgggcacaagctcaaacaggcgtacgttcaggaacaaggggtggtgattggttcgaggtacctgaaagtctaattaacaaagatgatcctgactgcgtttggcgcctc

SEQ ID NO: 25674 - protein, 227 aa, Unknown
  Obtained from environmental sample
  misc_feature (1)..(227): Xaa is any amino acid
MIKPIKKNDNRSVDLTFSWLSKAIGTKWLSWEKLAAEWMKMQTTSIDVKRVALTFLLEKYFLIHAPYASNIDTFFSGSNGHISNSDEFIEVMKISGVNDLNEQARRPNYIVDFIDFVIEKHFTVRDQNNVSIKTVVNPFTKVKFKSVPLETVRQPLPYKYILSLRDIISPSNDKTTKHDNTSHCPSFKDWLWAQAQTGVRSGTRGGDWFEVPESLINKDDPDCVWRL

SEQ ID NO: 25675 - DNA, 792 bp, Unknown
  Obtained from environmental sample
  misc_feature (1)..(792): n is a, c, g, or t
ttgatcgaagaaaaaaataaagaatacgatttatttttagggacatctacaggtagcttgatggttacccatttggcattaggaaaactatatgagctcaaagctatatatactacggtaagccagcgaaaaatatttagcaataatccgtttgtggtaaaaactgttcatggtgaaaaagttgttagcataaattatcttaataccctatggaattttataaatggccgccgaacttttggtgaaagtaagaatttgcgaaaatttataagaaaatatgtcactgaagaatattttcaaaaagtaaaggattctgataaaaatgtaataattacagtatctaaccttacagaaaataaggtggaatataaatctattaaagattgtagttatcttgatttttgtgattggatatgggcatcttgtaattatgttccttttatgagcttattaagaaagaatggatatgaatatgctgatggcggatttgggtgtttagtaccgatccgtgaggccatattaaggggagctactgaagtcgatgctattattttagaaacagaaatgacacaattgaacagattgccttcaaaaaaccctttttcattgttaactaatgtatctgaattcatgctagatcatgtagaaaggcataatgtcaccattggtaaattacaggctaagcatagtgatgttaagctcaatttatattatactccaacagttttaactacaaattcgttatttttaccagaaaataatggtaaatggtggcagatggatatcgacttn

SEQ ID NO: 25676 - protein, 264 aa, Unknown
  Obtained from environmental sample
  misc_feature (1)..(264): Xaa is any amino acid
MIEEKNKEYDLFLGTSTGSLMVTHLALGKLYELKAIYTTVSQRKIFSNNPFVVKTVHGEKVVSINYLNTLWNFINGRRTFGESKNLRKFIRKYVTEEYFQKVKDSDKNVIITVSNLTENKVEYKSIKDCSYLDFCDWIWASCNYVPFMSLLRKNGYEYADGGFGCLVPIREAILRGATEVDAIILETEMTQLNRLPSKNPFSLLTNVSEFMLDHVERHNVTIGKLQAKHSDVKLNLYYTPTVLTTNSLFLPENNGKWWQMDIDX

SEQ ID NO: 25677 - DNA, 726 bp, Unknown
  Obtained from environmental sample
  misc_feature (1)..(726): n is a, c, g, or t
gtgaaaanacaggattatgaaatacatataattggtgctggaattagtggtttaattgctgcaacggttttagaaaaaaatggattatctcctgttattattgaaacgactgatagggttggaggccgagtaaaaacagatattttagaaggttaccaattagatcatggttttcaggtattattaactgcttatcctgctgcacaaaaatatcttaatcttgaagccttgcaattacaaacgtttattccaggagcttcaatttttaaaaatggaaaacaaaatagtattggagatcctctcagagataagtctttattattatcgactgtatttgctagggtaggaaccctttctgataaatttaaaattttgaaacttaataataaattaaagaaaaaatcactttcagaaatattttcaagcaaagagcaaaccacaaaatcctatttagtagattttggtttttcttcaaaaatgatacatgacttttttaatcctttttttagcggaatctttctagaaaacaaattagaaacctctagcagaatgtttgaatttgtatataaaatgtttggtcaaggtgacgcagcgttgccaaaaggaggaatgcaagccataccaaaacaattatcaaataatttaaggcgtaccacgtttaaatttaatacaaaagtggcaactgttaatgatagcgaaaaattcttgaagatggcaaaagattaa

SEQ ID NO: 25678 - protein, 241 aa, Unknown
  Obtained from environmental sample
  misc_feature (1)..(241): Xaa is any amino acid
MKXQDYEIHIIGAGISGLIAATVLEKNGLSPVIIETTDRVGGRVKTDILEGYQLDHGFQVLLTAYPAAQKYLNLEALQLQTFIPGASIFKNGKQNSIGDPLRDKSLLLSTVFARVGTLSDKFKILKLNNKLKKKSLSEIFSSKEQTTKSYLVDFGFSSKMIHDFFNPFFSGIFLENKLETSSRMFEFVYKMFGQGDAALPKGGMQAIPKQLSNNLRRTTFKFNTKVATVNDSEKFLKMAKD

SEQ ID NO: 25679 - DNA, 669 bp, Unknown
  Obtained from environmental sample
  misc_feature (1)..(669): n is a, c, g, or t
ttgtggcgaaaaaaatgggacaaggtgctcagctggaattttaatacgccagaaattaaatggtttgaaggtgccaagctgaatattacggaaaactgtttggacagacatttgctcaatcgtggcaataaaacagccattatttttgaaccgaataaccctgatgaagaagcgcagcacatcacctataaacagctttatgagcgtgtttgtaaaatggcgaatgttctaaaagatcaaggcgtaaaaaaaggagatcggatatgcgtgtatttgcctatgattcctgaactggccgtaaccttattggcttgtgccaggattggtgccatacacaacgttgtgtttgcaggattttcatctaaagcactttcaacccgtatcattgatagtgattgtaaactggtcatcaccgcagatggatcttacagaggcaacaaaagcatcgatttaaaaggcattgtagatgaggcacttcaagagtgtgaggtcgataaagtattggtggtaaaacgtacggattctgagattaccatggttgaaaatcgcgatatttggttgcaacccttaatggatgaagcatctgctgtttttgaagcagaagttatggatgcggaagatccgtatttatttatatactcagttctctcgaccgatcttgatccgtag

SEQ ID NO: 25680 - protein, 222 aa, Unknown
  Obtained from environmental sample
  misc_feature (1)..(222): Xaa is any amino acid
MWRKKWDKVLSWNFNTPEIKWFEGAKLNITENCLDRHLLNRGNKTAIIFEPNNPDEEAQHITYKQLYERVCKMANVLKDQGVKKGDRICVYLPMIPELAVTLLACARIGAIHNVVFAGFSSKALSTRIIDSDCKLVITADGSYRGNKSIDLKGIVDEALQECEVDKVLVVKRTDSEITMVENRDIWLQPLMDEASAVFEAEVMDAEDPYLFIYSVLSTDLDP

SEQ ID NO: 25681 - DNA, 354 bp, Unknown
  Obtained from environmental sample
  misc_feature (1)..(354): n is a, c, g, or t
gtgaaaaagatggaagatgcagggataattaaaggatcgtcattaacgcttgattatcgtaaattagggtattcatttatagcttacgtaggtgtgtttttacaaaatacttctaaaacgtcttttgttttggagcgtataaacgaaattccttttgtgactgtagcgcatgttactacagggaaatttaatatcttttgtaaaattagagctagaaacactgagcatgcaaaggatgtaatctttatgttagatgacatagaaggtgtttacagaacagaaacaatgatatctttagaagaaagcattaacgataaaaaacgtttaatgcacagtatttttaacgaattataa

SEQ ID NO: 25682 - protein, 117 aa, Unknown
  Obtained from environmental sample
  DOMAIN (2)...(85): AsnC family
  misc_feature (1)..(117): Xaa is any amino acid
MKKMEDAGIIKGSSLTLDYRKLGYSFIAYVGVFLQNTSKTSFVLERINEIPFVTVAHVTTGKFNIFCKIRARNTEHAKDVIFMLDDIEGVYRTETMISLEESINDKKRLMHSIFNEL

SEQ ID NO: 25683 - DNA, 402 bp, Unknown
  Obtained from environmental sample
  misc_feature (1)..(402): n is a, c, g, or t
ttgacaactaagagttgtggagctgttaagcctgaaaatggattgcagtctgttattgctaaatctcatccaacgcctgcagtgtgcggtttacctaaagaaaacgctaaacagtttatattaaaaaacgaaggctataatcgtgaatattataccggttttttaggcgaaataaatattaaacaagccaaaacaagaaataccaatcgcagaaacgtagagaataacgcttacggatctgttaaaacaatatcacatttgtttgttaatttaagatgtcttcaaattaagaacaaccaagcattaatatatgtaggtggcggaattacaaaagattctgtacctgaaaacgaatgggaagaaaccgttgcaaaatctaagactgttaaaaacctcttataa

SEQ ID NO: 25684 - protein, 133 aa, Unknown
  Obtained from environmental sample
  misc_feature (1)..(133): Xaa is any amino acid
MTTKSCGAVKPENGLQSVIAKSHPTPAVCGLPKENAKQFILKNEGYNREYYTGFLGEINIKQAKTRNTNRRNVENNAYGSVKTISHLFVNLRCLQIKNNQALIYVGGGITKDSVPENEWEETVAKSKTVKNLL

SEQ ID NO: 25685 - DNA, 474 bp, Unknown
  Obtained from environmental sample
  misc_feature (1)..(474): n is a, c, g, or t
ttggctccaaacagtgtggagcaacactttattgacgttttagcagaagatgaaagtgtattgatattaaccgaaagtacctctaacttacatcacaataatatttgtccgagtattgataaattaattggtgcgttaacggaacaggagttacaaggcttgcaaccagaaatactattaacctttggaggtttaatagtatctaaaaaaataaagaaatttttacgtacccataaacccacacaacattggcatgtggccgaaaatggggcaaatgacaccttttttgtgcttaataaagtgttcaagcaatcaataaactcattttttcaatcttttataccattaactaaagctttaaaaagtgattataatccattttggaaaaaccaaatggatattagacgcgaaaagcatgtgcaatacatggggttaatcctttttctgactttaaagcatttgatgtgttactaa

SEQ ID NO: 25686 - protein, 157 aa, Unknown
  Obtained from environmental sample
  misc_feature (1)..(157): Xaa is any amino acid
MAPNSVEQHFIDVLAEDESVLILTESTSNLHHNNICPSIDKLIGALTEQELQGLQPEILLTFGGLIVSKKIKKFLRTHKPTQHWHVAENGANDTFFVLNKVFKQSINSFFQSFIPLTKALKSDYNPFWKNQMDIRREKHVQYMGLILFLTLKHLMCY

SEQ ID NO: 25687 - DNA, 747 bp, Unknown
  Obtained from environmental sample
  misc_feature (1)..(747): n is a, c, g, or t
gtgactaaattagtgcaagctaatcctatcgcttataatttagatgaaagcaataattggctacctaatttagacgagattaaaactttagatttaagtaaagttaaactaatgtggatcagttatccacatatgccaacaggagcaaaggctaaaaaagcagatttaaaaaagttagtagattttgctaaaaagcatgatatattgctaataaatgacaacccttatagctttattttaaacgataatccgataagtattttaaacatagaaggcgcaaaagaggtgtgtttagagttaaactcacttagcaaaacttttaatatggctggttggagagtaggtatggtgttaggaagtcaagaccatattaatgcagttttaaaagtgaaaagcaatatggattctggtatgttttatggcattcaaaaaggcgcaatagcagcactagagagctcacaagattggtttgataatttaaacaaagtgtatacaacacgtcgtaaattagtatggcaattggcagataaattaaactgtacgtatgataaaaatgcctcaggtttatttgtttgggcaaaaacaccagaaggttataaatcagaaacatttatagatacattgttacacgataaaagcctatttataacaccaggaacggtttttggaacacaaggcgaaggatatgtaagattttcgttatgtgcaacgactgaccaaatagaagaagcaatagcaagagtatga

SEQ ID NO: 25688 - protein, 248 aa, Unknown
  Obtained from environmental sample
  DOMAIN (3)...(248): Aminotransferase class I and II
  misc_feature (1)..(248): Xaa is any amino acid
MTKLVQANPIAYNLDESNNWLPNLDEIKTLDLSKVKLMWISYPHMPTGAKAKKADLKKLVDFAKKHDILLINDNPYSFILNDNPISILNIEGAKEVCLELNSLSKTFNMAGWRVGMVLGSQDHINAVLKVKSNMDSGMFYGIQKGAIAALESSQDWFDNLNKVYTTRRKLVWQLADKLNCTYDKNASGLFVWAKTPEGYKSETFIDTLLHDKSLFITPGTVFGTQGEGYVRFSLCATTDQIEEAIARV

SEQ ID NO: 25689 - DNA, 300 bp, Unknown; identical to SEQ ID NO: 23301
  Obtained from environmental sample
  misc_feature (1)..(300): n is a, c, g, or t

SEQ ID NO: 25690 - protein, 99 aa, Unknown; identical to SEQ ID NO: 23302
  Obtained from environmental sample
  misc_feature (1)..(99): Xaa is any amino acid

SEQ ID NO: 25691 - DNA, 648 bp, Unknown
  Obtained from environmental sample
  misc_feature (1)..(648): n is a, c, g, or t
gtgccaaatatcataggattaataaacatattaaaaacgaatattatgaaaaaagcaaactattctaaaatataccgcaccctgcattgggcaatagctatttcatttctgctactattaattacgatttttttgcgattaacctggatgaacaagtataatgtagcagcaattatccaagattatttgagtggcaccgaccaggttttaacgcaagatcaacttattcttttggcaaaaaagataagacaacccatgtggaattggcatatttacattggttatgtatcggttggattatttagtattcgtttcatacttccggcattcggacatatgaagttccaatctccttttcctaaaaatctatccgcaaaggagaaattccaaaaatggatatatattatttctcatgtctgtgtcatagtttcacttaccactggacttcttatagaattagggccaaaagaatgggaaaagacaatggaaggaatccatgtacttggtatttactatttgatcggacttatcgtgatacatataacaggcgtatcgattgccgaattcaccaatcaaacagcattatctccagatcgtaagtggctcgaaaaagtaaaaagcacaaagcacaacaagctaaggacttga

SEQ ID NO: 25692 - protein, 215 aa, Unknown
  Obtained from environmental sample
  misc_feature (1)..(215): Xaa is any amino acid
MPNIIGLINILKTNIMKKANYSKIYRTLHWAIAISFLLLLITIFLRLTWMNKYNVAAIIQDYLSGTDQVLTQDQLILLAKKIRQPMWNWHIYIGYVSVGLFSIRFILPAFGHMKFQSPFPKNLSAKEKFQKWIYIISHVCVIVSLTTGLLIELGPKEWEKTMEGIHVLGIYYLIGLIVIHITGVSIAEFTNQTALSPDRKWLEKVKSTKHNKLRT

SEQ ID NO: 25693 - DNA, 636 bp, Unknown
  Obtained from environmental sample
  misc_feature (1)..(636): n is a, c, g, or t
gtggagggcgctgaaaggaactttccagaagatgcacaaaaggaattcgacaaattggtcaatcaataccgtaatgatctgttaaccaaagcctatgtagaagccttagtaaagcggaatatagacacggcagtttctatgtctgaagctcaaaaggtctatggaaataacaaagagtcctttaaacttaatgaagaattgataaaattgagatatatcaatatgcttcaaaatgcacttaataaggaagagattgaaaaacgattcaaaagatttaatgaaaaggataggcgctatctcgattctttgcacattcaatttaaatcctattccttaaatgattccatctgggtcaaggctgcgcaggtggttcaaaaaattcctgtcgtcaacgctgataacaaaaaagaactgttaaaaaaatctaattttatacagctcaaagattcaataggcctatatttgatccaaattaatgaggtcctacagcaaaatgattatgcaccattagaatatgttaaaccgacagtaaatcaaatcataatcaatcgtcgaaaattagaactcatcaagcaatttgaaaaagatattacaagagatgccattaaaaacaaccaatttgaaatttacaactaa

SEQ ID NO: 25694 - protein, 211 aa, Unknown
  Obtained from environmental sample
  misc_feature (1)..(211): Xaa is any amino acid
MEGAERNFPEDAQKEFDKLVNQYRNDLLTKAYVEALVKRNIDTAVSMSEAQKVYGNNKESFKLNEELIKLRYINMLQNALNKEEIEKRFKRFNEKDRRYLDSLHIQFKSYSLNDSIWVKAAQVVQKIPVVNADNKKELLKKSNFIQLKDSIGLYLIQINEVLQQNDYAPLEYVKPTVNQIIINRRKLELIKQFEKDITRDAIKNNQFEIYN

SEQ ID NO: 25695 - DNA, 837 bp, Unknown
  Obtained from environmental sample
  misc_feature (1)..(837): n is a, c, g, or t
ttgtttggtcaaaaattagggttagctcctgttattttagtaaatcacgcattgactggaaatagcgatgttgctggtgaaaatggttggtggaaagatattattggtgttgataaaacaatcgatacaaatgtgtatacgatattatcttttaacattccaggaaatggttttgatggttttttaattgaagattataaaagttttattgctagagatgttgcaaatatttttttaattggattaaaacaattaaaaatcgataagctttttgcgttaattggtggttctttaggtggtggaattgcttgggaaatgatggttttaaaaaacaaacttacccaacattttttaccaattgccacagattggaaatctacagattggctcattgcaaattgtcaaattcaagagcagtttttaataaattctagtaatcctgtgcacgatgcaagaatgcatgcgatgttgtgttacagaactccagcttcttttaaagaacgttttcatcgctctaaaaaagaaaattctacagtttttaatgtggaaagttggttgttgcatcatggaaaaaagttgcaagaacgttatcaattgtcttcttataaattgatgaatcagttacttaggtctattgatgtgacaaataatgatgaattaaaaattgatattttagataaaattgaagcagatattcatattgttggtgtagattctgatttgttttttactgctgaagaaaataagcaaactcacaaaaaagtagcattaacaaaagcaaatgttacttataatgaaataaattcggtgcatgggcatgatgctttttttaattga

SEQ ID NO: 25696 - protein, 278 aa, Unknown
  Obtained from environmental sample
  misc_feature (1)..(278): Xaa is any amino acid
MFGQKLGLAPVILVNHALTGNSDVAGENGWWKDIIGVDKTIDTNVYTILSFNIPGNGFDGFLIEDYKSFIARDVANIFLIGLKQLKIDKLFALIGGSLGGGIAWEMMVLKNKLTQHFLPIATDWKSTDWLIANCQIQEQFLINSSNPVHDARMHAMLCYRTPASFKERFHRSKKENSTVFNVESWLLHHGKKLQERYQLSSYKLMNQLLRSIDVTNNDELKIDILDKIEADIHIVGVDSDLFFTAEENKQTHKKVALTKANVTYNEINSVHGHDAFFN

SEQ ID NO: 25697 - DNA, 744 bp, Unknown
  Obtained from environmental sample
  misc_feature (1)..(744): n is a, c, g, or t
atggaaaaccaacctgtagatcataaaaaagaaaatcgatttgaactactaaaagaacttttattaaccgaagacaggaaggaatttgaatctttaagaaatgagtttttaaagaaagatgattttaaaaatgaagtaaaacctgttttagacgataaaattgacgatctaaaaaataattttcctctttattttggcgatcaagtaacacaatcaataaaagttcagattagagaatctcaagacgaagtcgtagaagctctttacccaattatgggtaaattgattcagaaatttattgtcgcagaaataacaaagctttcagctaccattaataaaacgattaacgataaattctctttaacacatattgtaaaaagattatttaaaggaaaaaaaacagatgcagaagatgttttgcaaaccgtttttgcatcaaccatagaagaagtttttgtaattgaagagaactcaggtttgtcaattggtagttattctagaggtaatattgcagataaagatatgatttctggaatgttaaccgcaattaaatcttttgccgaagatgcctttcctaaacaaggtccccattcagacgatataacgttcgaaacctttcaattatccatgtataattttaaatcgattttccttgcaattgcaactcctggtgttatcacctccgaatttaaagaagagctaccaacacttaaacccttagtcgaaaaaattccaaaaacagag

SEQ ID NO: 25698 - protein, 248 aa, Unknown
  Obtained from environmental sample
  misc_feature (1)..(248): Xaa is any amino acid
MENQPVDHKKENRFELLKELLLTEDRKEFESLRNEFLKKDDFKNEVKPVLDDKIDDLKNNFPLYFGDQVTQSIKVQIRESQDEVVEALYPIMGKLIQKFIVAEITKLSATINKTINDKFSLTHIVKRLFKGKKTDAEDVLQTVFASTIEEVFVIEENSGLSIGSYSRGNIADKDMISGMLTAIKSFAEDAFPKQGPHSDDITFETFQLSMYNFKSIFLAIATPGVITSEFKEELPTLKPLVEKIPKTE

SEQ ID NO: 25699 - DNA, 339 bp, Unknown
  Obtained from environmental sample
  misc_feature (1)..(339): n is a, c, g, or t
atgaagaaaagcactttactaaagaagatatccgagacatccacattttcagagtttttaaatacacttaaagagaatcaagagttatatgtaagagaaagtgtaggctcacttagttcattcgcaatcaatgaactggggaaatcgtatcaaaatattctagtaattgctgacaccgaagaaaatgaacgcttcttaaaagctgatttaaaagttattcctggctcaaaactcatcagcttcccttctaccaaacataaaccatatgatacggatcaacttattgatcccagttccttaatattacgatctgaagccctggaaggaataaataagcnc

SEQ ID NO: 25700 - protein, 113 aa, Unknown
  Obtained from environmental sample
  misc_feature (1)..(113): Xaa is any amino acid
MKKSTLLKKISETSTFSEFLNTLKENQELYVRESVGSLSSFAINELGKSYQNILVIADTEENERFLKADLKVIPGSKLISFPSTKHKPYDTDQLIDPSSLILRSEALEGINKX

SEQ ID NO: 25701 - DNA, 813 bp, Unknown
  Obtained from environmental sample
  misc_feature (1)..(813): n is a, c, g, or t
atgcgcgatgcagattcttctcattttcatataaagaatttcatggcgactaccgaactactgagagaagaactttcgttattaggtattcaaagcaatacccctgtagattggcgagaagaaaacattaaacttttacgcaccaaacataggttttatactgactatgcaattcgtacctggcaaaagggaaaggataagaatattaaaaggcttattaaggctaaaaagaaaaataatgaactagtcaaaaaagagaatttaaaagctcattttaaaggggaattgcccgatagaggaatacaaacattgtacagggttacgttacagagccatttaaagcttagtgatattgccgatacaaaagcgaacatcctactctctgtaaatgcaattatcgtttctatggcattggcaaatttagttccaaaattggataacccttcaaacgattatctattttacccaacatttctttttatagttttcagtgtagtttctatggtgatgtcaattattgccactagacctaatgtaacatctggacagtttacagaagaagaagtaaccagcaaaaaggttaacctgttattcttcggaaattttcataaaatgaaattagagcagtataactgggcaatgactgagctaattaaagataaggactatatctacagttcattaacaaaagatctttattttcttgggattgtcctggaaaggaagtaccgaattttacggtggacatataccgctttttatgaccggtatgattatttcagtaatcgtattcggtattgccctaagtttttn

SEQ ID NO: 25702 - protein, 271 aa, Unknown
  Obtained from environmental sample
  misc_feature (1)..(271): Xaa is any amino acid
MRDADSSHFHIKNFMATTELLREELSLLGIQSNTPVDWREENIKLLRTKHRFYTDYAIRTWQKGKDKNIKRLIKAKKKNNELVKKENLKAHFKGELPDRGIQTLYRVTLQSHLKLSDIADTKANILLSVNAIIVSMALANLVPKLDNPSNDYLFYPTFLFIVFSVVSMVMSIIATRPNVTSGQFTEEEVTSKKVNLLFFGNFHKMKLEQYNWAMTELIKDKDYIYSSLTKDLYFLGIVLERKYRILRWTYTAFYDRYDYFSNRIRYCPKFX

SEQ ID NO: 25703 - DNA, 759 bp, Unknown
  Obtained from environmental sample
  misc_feature (1)..(759): n is a, c, g, or t
ttggaaaaagatatgaaaaagggaaggaaacgttttatcaccgttgagaacagtatggcaagggtgagacagtttaccggattacttaaacccgcctctgaaaatataaaagtggaacctgaacttatcgctgcattggccgatacttattttgaaggaaaacactccgtgaactggaaagcgatgggtgaggattacgaattaatcagacaacaaatagataaagtcataaaagggtttgaaaacacaagtgaaaattccaaagggtctggttattacttgcccaataatgtaagggatctcgattttagtatgttgcccaatggaaaagctcaattgacattgaataaattacccgatcatagattgaaagaaaatgaatttatgttgatgaccattcgttcccacgatcaattcaataccacgatctatggcttggatgatcggtacagaggtgtctacaatgaaagaagggttttgtttatgaataagcaggatatgttgacacaaggcttaaacaaaatggatgttgttgatatcactagcttttatgatgataccaagcgtaccgcttataaatttcttgtgattccgtataaaatccctaaaggcaatcttgctgcttattttccagaaaccaatgtgctggtaccctataaccactatgcagataggagtaatacacctattagtaaatcaataatagttaagctaattaaaaccaaaattggccaaactaaaaagagtctcatcagttaa

SEQ ID NO: 25704 - protein, 252 aa, Unknown
  Obtained from environmental sample
  misc_feature (1)..(252): Xaa is any amino acid
MEKDMKKGRKRFITVENSMARVRQFTGLLKPASENIKVEPELIAALADTYFEGKHSVNWKAMGEDYELIRQQIDKVIKGFENTSENSKGSGYYLPNNVRDLDFSMLPNGKAQLTLNKLPDHRLKENEFMLMTIRSHDQFNTTIYGLDDRYRGVYNERRVLFMNKQDMLTQGLNKMDVVDITSFYDDTKRTAYKFLVIPYKIPKGNLAAYFPETNVLVPYNHYADRSNTPISKSIIVKLIKTKIGQTKKSLIS

SEQ ID NO: 25705 - DNA, 459 bp, Unknown
  Obtained from environmental sample
  misc_feature (1)..(459): n is a, c, g, or t
natcctaattttcatttattagttaacgatgaaagagttacaatacaaggtaatcatcaggaagctcgagctgttaatccttttctgtataaagatgtaaaaatatccacttggacgaaagataaaaatagtagaatacaatatgatttttgcgatatttatgttggtcaatcagaagtatattatgacgaatttaagactttttttaacgagctgaagcataaaaaaggtacagaaccttttcattttataagcgagaaattagagaagtattacgatttaaaagactatgcgggtgctaagaagttcataagagtttttttaagtagttattcattaccagtttatttaagaactatacttgtaatttcaaaaggttttaaacatcataaagatttatcagaaattttgggtaaagtcgaacagaaattaaaacttaaaattagaaaagtatactaa

SEQ ID NO: 25706 - protein, 152 aa, Unknown
  Obtained from environmental sample
  misc_feature (1)..(152): Xaa is any amino acid
MPNFHLLVNDERVTIQGNHQEARAVNPFLYKDVKISTWTKDKNSRIQYDFCDIYVGQSEVYYDEFKTFFNELKHKKGTEPFHFISEKLEKYYDLKDYAGAKKFIRVFLSSYSLPVYLRTILVISKGFKHHKDLSEILGKVEQKLKLKIRKVY

SEQ ID NO: 25707 - DNA, 483 bp, Unknown
  Obtained from environmental sample
  misc_feature (1)..(483): n is a, c, g, or t
atgaagaaattaaataaatttatttttattagatgctttatttttagcgtgattctatttctgatatggaatttttctctgtctcaaacttttgatttaatgagacaacataatgaacttaaacaacaatctaaaataactaaaaatttacctcagaaaaaatcacgtcttattttaaaaaacacctacttagactcaattttaaaaacttttaaggtagatggctattcaatccaaaataatttactaaaatttattaatgacttcagtgaaaaaaataatttacaaattgtttcttttttagaaccacatagaattatagaaaacaataatacaaccacaacttacaatttttctgtttctggtgattataattccattaacaatcttatttacaaccttgaaaaatcctataagtacggtagcattattcatgttaatttttctaaaaaattaaattaccgcaagaatttaactttttag

SEQ ID NO: 25708 - protein, 160 aa, Unknown
  Obtained from environmental sample
  misc_feature (1)..(160): Xaa is any amino acid
MKKLNKFIFIRCFIFSVILFLIWNFSLSQTFDLMRQHNELKQQSKITKNLPQKKSRLILKNTYLDSILKTFKVDGYSIQNNLLKFINDFSEKNNLQIVSFLEPHRIIENNNTTTTYNFSVSGDYNSINNLIYNLEKSYKYGSIIHVNFSKKLNYRKNLTF

SEQ ID NO: 25709 - DNA, 327 bp, Unknown
  Obtained from environmental sample
  misc_feature (1)..(327): n is a, c, g, or t
ttgaccacggtatatgatctagggcagcaattttatgaaatgattgaatttgattcccaatttgaattagctgtaaagcccatgtcgaatattgtttgcttccgatatgttgaagactccctcaataattcggaattgaaccaactcaacaagcttataagaccacaaatattagaagaaggtgaattctatatcgttcaaaccaagttaagaggcatacattatttacgcaccacgataatgaatccgtttactactaaagagcatctaaagcaattgttagggaaggttaaagagatagcgaaaagtattaaaactataacctaa

SEQ ID NO: 25710 - protein, 108 aa, Unknown
  Obtained from environmental sample
  misc_feature (1)..(108): Xaa is any amino acid
MTTVYDLGQQFYEMIEFDSQFELAVKPMSNIVCFRYVEDSLNNSELNQLNKLIRPQILEEGEFYIVQTKLRGIHYLRTTIMNPFTTKEHLKQLLGKVKEIAKSIKTIT

SEQ ID NO: 25711 - DNA, 432 bp, Unknown
  Obtained from environmental sample
  misc_feature (1)..(432): n is a, c, g, or t
gtgaaaaagctggttattaaaagacaatatttaatcggtaaaaatgatataactaaacgaacctttaaaaaatatgatgctaaagaactattgaaaagtacttatacaccaattgagtatcgatttcaatattggtttcctgatttaaaagccacgcaagattttattgaaatgcaaaaacttcccaattttggttactattatcaatcaaataataaagttgcgttttacaaccagaatggagatgtgctatatgacgatatggatgtgaaattacagggaatgaaaaaaatacataaagggaatgtaaaaacagaaatgattaccgaatttattttagacgaagatgtttatatcaaattattaccatcactgaatttatataaaataacttctgtccaaattgaccaacataacaaaggaaaaatataa

SEQ ID NO: 25712 - protein, 143 aa, Unknown
  Obtained from environmental sample
  misc_feature (1)..(143): Xaa is any amino acid
MKKLVIKRQYLIGKNDITKRTFKKYDAKELLKSTYTPIEYRFQYWFPDLKATQDFIEMQKLPNFGYYYQSNNKVAFYNQNGDVLYDDMDVKLQGMKKIHKGNVKTEMITEFILDEDVYIKLLPSLNLYKITSVQIDQHNKGKI

SEQ ID NO: 25713 - DNA, 321 bp, Unknown
  Obtained from environmental sample
  misc_feature (1)..(321): n is a, c, g, or t
ttgggntttgaattatatccattttttgataaatcggaccgaaaaagaataagtcggacttgtaatcatatcggacttgaaacagnaaacgctcgcgaatgggatggatttccgaaaagtggaatcgcaattggtgcggacggattcgggaatcaactaatcctaactcacaacggaaatggaaatggaaatttaagtgacgaattatatttctggaatcacgagacaagacaggtagaaaaaattgctgaatcgattaataaacttcatatcgacaaaagctcattatgggacaaaataaaatcaaaatttaacgcataa

SEQ ID NO: 25714 - protein, 106 aa, Unknown
  Obtained from environmental sample
  misc_feature (1)..(106): Xaa is any amino acid
MGFELYPFFDKSDRKRISRTCNHIGLETXNAREWDGFPKSGIAIGADGFGNQLILTHNGNGNGNLSDELYFWNHETRQVEKIAESINKLHIDKSSLWDKIKSKFNA

SEQ ID NO: 25715 - DNA, 459 bp, Unknown
  Obtained from environmental sample
  misc_feature (1)..(459): n is a, c, g, or t
gtgaaaacgttctcacttcggtacaatttaagggaggtttttatttatatacttgataacaattttacaaaaactgaaattatgggattactaaataaaatattagggaacgctagccaagcttcagtagaacaattaagtgaaaagtatgggcgcttgttaacggatgacgaacaaatcgaactcggttttaaactgtttagagacgtgtttatgtttactaataaacgtctaatactaatagatgtacaaggtattacaggcagtaaggtagaatataattctatgccatataaaagcatctctagattctctttggaaacttctgggacttttgatttagatgcagaattaaaaatatggatatcaagcgaaaacacaccttcagtaagtaaaaagtttaataaaagtataaatgtttatgaggttcaaaaatatttggcttctaaagtgatgtaa

SEQ ID NO: 25716 - protein, 152 aa, Unknown
  Obtained from environmental sample
  misc_feature (1)..(152): Xaa is any amino acid
MKTFSLRYNLREVFIYILDNNFTKTEIMGLLNKILGNASQASVEQLSEKYGRLLTDDEQIELGFKLFRDVFMFTNKRLILIDVQGITGSKVEYNSMPYKSISRFSLETSGTFDLDAELKIWISSENTPSVSKKFNKSINVYEVQKYLASKVM

SEQ ID NO: 25717 - DNA, 324 bp, Unknown
  Obtained from environmental sample
  misc_feature (1)..(324): n is a, c, g, or t
gtgttaatggtgtcaaacgcatcacgaatcattttgggactgtaccgccgacnatttaaggttaccgaacctaaaaaagagtgtgttaaaataaccgaaagctctaggatgcgtgctaaacactctggtatgtttaaagtcactataacagttggtatagaggttaccataggtgatgatctaggaaacataacagatccttatggtaaatttaatccctttgttaaagtcaaatcctctggttatataattaatattaatccatcatctattgtttatccaggtgacgccttgttttctatctctatcgaagtcttaaaatag

SEQ ID NO: 25718 - protein, 107 aa, Unknown
  Obtained from environmental sample
  misc_feature (1)..(107): Xaa is any amino acid
MLMVSNASRIILGLYRRXFKVTEPKKECVKITESSRMRAKHSGMFKVTITVGIEVTIGDDLGNITDPYGKFNPFVKVKSSGYIININPSSIVYPGDALFSISIEVLK

SEQ ID NO: 25719 - DNA, 756 bp, Unknown
  Obtained from environmental sample
  misc_feature (1)..(756): n is a, c, g, or t
gtgaactgcgcagcatttacgccaagcttattagagnnnnnnnnnnnnnnnnnnnnnnnnnnnnnnnnnnnnnnnnnnnnnnnnnnnnnnnnnnnnnnnnnnnnnnnnnnnnncaaaggtaccttatttttagatgaaatagcagagctgccgcttgaagcgcaaagtaagttgcttagagtgttgcaagagcaagaatttgaacgtgttggggcaagcaatacattaaaggtagatattcgcgttattgcagcaactaaccgcgatctatgggaaatggtgcaaaaaggcagttttagaatcgatttatactatcgcttaaatgtatttcctataaaagtgccagcgctgaaagagcgcaaggaagatattccttatttatgtagtaatttaatagtgcagttaaataaacgtttaactaagcagcttaagggattaagtaataaggcaatttctcaactacaagcttatgactggccaggcaatattagagagttacaaaatgtactagagcgcgaggccattttgtctaagcaagccgttttacaattaagtcagccattacaagcaatatcacaaagtactataaacccagcattaacgctcaatgaaatgcaaaaacagcatattattactgtgcttaagctgtcggcttggcaaatatcggggagtaaaggggccgctgcaaaacttggtatgccagagagtaccttacgctctaaaatgcacaagttagggattagcaagatctcgtga

SEQ ID NO: 25720 - protein, 251 aa, Unknown
  Obtained from environmental sample
  DOMAIN (202)...(245): Bacterial regulatory protein, Fis family
  misc_feature (1)..(251): Xaa is any amino acid
MNCAAFTPSLLEXXXXXXXXXXXXXXXXXXXXXXXXXXKGTLFLDEIAELPLEAQSKLLRVLQEQEFERVGASNTLKVDIRVIAATNRDLWEMVQKGSFRIDLYYRLNVFPIKVPALKERKEDIPYLCSNLIVQLNKRLTKQLKGLSNKAISQLQAYDWPGNIRELQNVLEREAILSKQAVLQLSQPLQAISQSTINPALTLNEMQKQHIITVLKLSAWQISGSKGAAAKLGMPESTLRSKMHKLGISKIS

SEQ ID NO: 25721 - DNA, 537 bp, Unknown
  Obtained from environmental sample
  misc_feature (1)..(537): n is a, c, g, or t
gtggaaggagatacttattttttaaggaccattcttgaggattataggtacaagggggattccatttaccatgcggtaagaaaggatttaaaaaataactccaaaatatattccgaaatctctaaacacattggaacttcggattccataattcatctttcaaacgaatacgggcaactggattttctattatctttaaatgctgttgatcgcaaaattttcacctatcttaagaatgtagaggtaagacctattgtaaaaaacagttttattgctcagcaaatagccaaattaaccttggtagaatcaattgatgaggccgtggaacatccagcggatataatgattattgatttagaaataaaagatctaaaaacgcttgaacatataataaaaaacaatattcgattacttattttaataaaggacggtgtaaaattgcccttaaaaattattaaggcaactagttttaaaaatattttggaatatgaaaaccttattatctttgaaagaataaaggcccaacataacgcttag

SEQ ID NO: 25722 - protein, 178 aa, Unknown
  Obtained from environmental sample
  misc_feature (1)..(178): Xaa is any amino acid
MEGDTYFLRTILEDYRYKGDSIYHAVRKDLKNNSKIYSEISKHIGTSDSIIHLSNEYGQLDFLLSLNAVDRKIFTYLKNVEVRPIVKNSFIAQQIAKLTLVESIDEAVEHPADIMIIDLEIKDLKTLEHIIKNNIRLLILIKDGVKLPLKIIKATSFKNILEYENLIIFERIKAQHNA

SEQ ID NO: 25723 - DNA, 423 bp, Unknown
  Obtained from environmental sample
  misc_feature (1)..(423): n is a, c, g, or t
atggaggaaataaaacagaagctgaaactgaaaccctatcaagaaatttacttttctaaaattggatatagttctgaaataaaaaacgaaacagaatcgaaatccctttcgtttttaaaaaatcaagaattccttttggttacaggcattgccaacccaaaacctttggttgattttttaaggaacgaaggattgaattttgaagaaaagtcttttccagaccatcataatttcacgacttctgagattgaaaaattaaaaaaacacctcttaatcttgacaaccgaaaaggattttatgcgattgcaaccaatagcaaacgcaactgaaatctattatttaccaataaagactgtaattctaaacgaagcagaaaccagtttcaaaaaaagaatagaacgggaagttaaattgaaagaataa

SEQ ID NO: 25724 - protein, 140 aa, Unknown
  Obtained from environmental sample
  misc_feature (1)..(140): Xaa is any amino acid
MEEIKQKLKLKPYQEIYFSKIGYSSEIKNETESKSLSFLKNQEFLLVTGIANPKPLVDFLRNEGLNFEEKSFPDHHNFTTSEIEKLKKHLLILTTEKDFMRLQPIANATEIYYLPIKTVILNEAETSFKKRIEREVKLKE

SEQ ID NO: 25725 - DNA, 345 bp, Unknown
  Obtained from environmental sample
  misc_feature (1)..(345): n is a, c, g, or t
atgattgttaaagccaacgatttacctgttattgataaacaatttacagcgaccatttcttggatggattctcaaaatttagcctcaggtaataagtatgttatacaacatggtgtcaacaaagtattagcaaaagtggataccattaatcataaaataaatcctgattattctgggattgatcagtctgcacaggtgttaaacatgaatgatattgcatcagtgacttttaaattaaataagcctatattttatgatgcctttaaagaccataggacaaatggttcttttattattatagatagtaaatctaataatacggtaggtgcaggatttatacaatag

SEQ ID NO: 25726 - protein, 114 aa, Unknown
  Obtained from environmental sample
  misc_feature (1)..(114): Xaa is any amino acid
MIVKANDLPVIDKQFTATISWMDSQNLASGNKYVIQHGVNKVLAKVDTINHKINPDYSGIDQSAQVLNMNDIASVTFKLNKPIFYDAFKDHRTNGSFIIIDSKSNNTVGAGFIQ

SEQ ID NO: 25727 - DNA, 456 bp, Unknown
  Obtained from environmental sample
  misc_feature (1)..(456): n is a, c, g, or t
atgactaaaaaacggcaatccactaaaatcaacaacatattaggcgaattaagaaaaaaagagatcaatacatggtttgacctcggattgtttatagatcgatttaaagaacaaccgtcaaaagctccttttaaaggcaacgctaaggcctttgatagccatctagaaaaaggaggtatagcttttattactttctattttgctattgacggaattactgttgaaaccgaaaagtatgccaaaacctttaaaagaatatatccgaacattcctattcattatatcgccggagagatcaaacctgaggcagatgaattaattcataaagatgcctttaaaaaagtgatcaaggaaatggatggtttcgataactggccattatataatgacttctttaaaattaaaatggaaaggggcagtaccgaatataatgcccttattggtnattctggatga

SEQ ID NO: 25728 - protein, 151 aa, Unknown
  Obtained from environmental sample
  misc_feature (1)..(151): Xaa is any amino acid
MTKKRQSTKINNILGELRKKEINTWFDLGLFIDRFKEQPSKAPFKGNAKAFDSHLEKGGIAFITFYFAIDGITVETEKYAKTFKRIYPNIPIHYIAGEIKPEADELIHKDAFKKVIKEMDGFDNWPLYNDFFKIKMERGSTEYNALIGXSG

SEQ ID NO: 25729 - DNA, 585 bp, Unknown
  Obtained from environmental sample
  misc_feature (1)..(585): n is a, c, g, or t
atgctgttatttgaagtgaaaacaataaaactgaattccaataggaataaaataaaccataataacatgcgagcattagtgatatccggaggaggaagtaaaggagcatttgcaggaggtgttgcgcaatacttaatagagcgcgaaaaacataattacgatatgtttttaggaacttcaaccggaagtctcttaattccgcatttagccgttaacgaaattggtaaactttacgacatttttaccaatgttcagcagcataatatttttagtattagtccatttgtgcagcataaaaaaggagacagagagtatgtgtctattgattttgtaaattcattatggcagtttattagacgtaagcgcacttttggagaaagtaaagccttgcgcaagcatattcggaaaaatgtaacttatgaagagtatttaaaaattagaaaggaaaagcatgacgtggtagttacggtatctaatttgtctatgaatcgtgtggaatataaatcgatacaagagtgttcttatgaggaattttgtaactggatatggatttcgtgtaaatacatttccgtttatggcctttaa

SEQ ID NO: 25730 - protein, 194 aa, Unknown
  Obtained from environmental sample
  misc_feature (1)..(194): Xaa is any amino acid
MLLFEVKTIKLNSNRNKINHNNMRALVISGGGSKGAFAGGVAQYLIEREKHNYDMFLGTSTGSLLIPHLAVNEIGKLYDIFTNVQQHNIFSISPFVQHKKGDREYVSIDFVNSLWQFIRRKRTFGESKALRKHIRKNVTYEEYLKIRKEKHDVVVTVSNLSMNRVEYKSIQECSYEEFCNWIWISCKYISVYGL

SEQ ID NO: 25731 - DNA, 312 bp, Unknown
  Obtained from environmental sample
  misc_feature (1)..(312): n is a, c, g, or t
gtgactcgagaattttactcaaaccaattgggttttaaggaatttggtagcactgattatgaaggttatttaatgatggaaaaagatcgcgttcaaattcatttctttgaatttaaagaaattgacccaaaagaaaattatggacaagtttatattagaacgaaccatattgacgcattttataaatcattattggaaaaacggacaaaaattcaccctaatggaacattggaaattaaaccttggggacaaaaagaattttctattcttgatcccgacagtaatttattgacatttggccaagctatctaa

SEQ ID NO: 25732 - protein, 103 aa, Unknown
  Obtained from environmental sample
  misc_feature (1)..(103): Xaa is any amino acid
MTREFYSNQLGFKEFGSTDYEGYLMMEKDRVQIHFFEFKEIDPKENYGQVYIRTNHIDAFYKSLLEKRTKIHPNGTLEIKPWGQKEFSILDPDSNLLTFGQAI

SEQ ID NO: 25733 - DNA, 348 bp, Unknown
  Obtained from environmental sample
  misc_feature (1)..(348): n is a, c, g, or t
atgcttaaagaccttaacacgccattccaagaccttaaaaatgaactggaaggccaattttttacagacaatttaatgaaagcgctctatgctacagacgcgtctgtttatagaaaattacccattgccgttgcatatccaaagactataaaggacataaaattgctgattaagtttgcgaaaatccataaaacctctttaattccacgcacggnaggaacctctttagcgggacaatgtgtaggcgaaggtatcgtggtagatgtttctaaacattttacaaaattcctcgacatcaatgaaaaggcccaaacggttaccgtgcaaccaggtgttgttccgggatga

SEQ ID NO: 25734 - protein, 115 aa, Unknown
  Obtained from environmental sample
  misc_feature (1)..(115): Xaa is any amino acid
MLKDLNTPFQDLKNELEGQFFTDNLMKALYATDASVYRKLPIAVAYPKTIKDIKLLIKFAKIHKTSLIPRTXGTSLAGQCVGEGIVVDVSKHFTKFLDINEKAQTVTVQPGVVPG

SEQ ID NO: 25735 - DNA, 372 bp, Unknown
  Obtained from environmental sample
  misc_feature (1)..(372): n is a, c, g, or t
ttggtttcattttctttgctgataacctcttgttttaaaacctcaatttccgaatttattttcgcaatttctggtgtaaattgttgggctatttgcgttttattctccaaagtcatttgntttttttgcgtcaataaaacttggttgatttctttttcaaacaactttaattccaaaggtttagaaattacaacagcaataataattgccaacacaattctaggagttgcttggaataattctttcaacttagaatctgattttttaatggtagagacaataaatctgtctagattaaagattaaaagtccccaaattaatccaaagaaaatagcagtaactaaattatcaaacacagtaaacaaagcataa

SEQ ID NO: 25736 - protein, 123 aa, Unknown
  Obtained from environmental sample
  misc_feature (1)..(123): Xaa is any amino acid
MVSFSLLITSCFKTSISEFIFAISGVNCWAICVLFSKVIXFFCVNKTWLISFSNNFNSKGLEITTAIIIANTILGVAWNNSFNLESDFLMVETINLSRLKIKSPQINPKKIAVTKLSNTVNKA

SEQ ID NO: 25737 - DNA, 474 bp, Unknown
  Obtained from environmental sample
  misc_feature (1)..(474): n is a, c, g, or t
ttgaaagatgacaaagagatcccctcaaaagaagaaaacaaaaaagaaattgaggtcgaaattatcgagtctgcaaatgaatatatttattgccttaacggtaaacaaatagaagcaagcgaggtagcaaacatcccagctgaaaaaataaaaacgattacagtttacacatctcaagaagcaaaggacaaactaaatattaattcaaacggaaaaaaattaatgaattttcaattatttgaagagggagaagaaatcaatactacctcttctagagaattgataaagcatcaaatttctcttcaaaataaaaactcacttattatccttaacggaaaagaaatcacacgaaaagatctcgaagaaatagaccctaaacagataaaaagtatattccctataaaaggtaaaaaagctagtgaaaaatatggaaaaaaagctaaagatggagcaattgtcatcacaaccaagtaa

SEQ ID NO: 25738 - protein, 157 aa, Unknown
  Obtained from environmental sample
  misc_feature (1)..(157): Xaa is any amino acid
MKDDKEIPSKEENKKEIEVEIIESANEYIYCLNGKQIEASEVANIPAEKIKTITVYTSQEAKDKLNINSNGKKLMNFQLFEEGEEINTTSSRELIKHQISLQNKNSLIILNGKEITRKDLEEIDPKQIKSIFPIKGKKASEKYGKKAKDGAIVITTK

SEQ ID NO: 25739 - DNA, 483 bp, Unknown
  Obtained from environmental sample
  misc_feature (1)..(483): n is a, c, g, or t
atgccgaaagaattaaaaatagaaattgagcctcacaatttcaacacatttattctaaaatcaattttatcaattttattgattctctttttagcatttatactctttgtgtatataacaccaaatttgaatgataattacactctacctttaaagatagttggaattttatttatcctgattttagtaacacaatttatttttagtccaacaatatatctctattcaataacaatatcacaaactataacagaactaaaatggcaaaaaaacggaaaacataattcccaaagatttgatagcgcggaaattaaaacggaattagttccaagcggaaaaaataatccttacctaaaattggaaattaaggacaaaaactatcaatttatattaaaacaacgccgaattggagagtggacttttgacaaactcaagaaaactgaaaatgatatagaaaaatactatgcacaacaacgtgtataa

SEQ ID NO: 25740 - protein, 160 aa, Unknown
  Obtained from environmental sample
  misc_feature (1)..(160): Xaa is any amino acid
MPKELKIEIEPHNFNTFILKSILSILLILFLAFILFVYITPNLNDNYTLPLKIVGILFILILVTQFIFSPTIYLYSITISQTITELKWQKNGKHNSQRFDSAEIKTELVPSGKNNPYLKLEIKDKNYQFILKQRRIGEWTFDKLKKTENDIEKYYAQQRV

SEQ ID NO: 25741 - DNA, 504 bp, Unknown
  Obtained from environmental sample
  misc_feature (1)..(504): n is a, c, g, or t
ttgncgccgggttcttggagtggaaaacttgctaaaaaactgaatttaaaactatcattgcaaggaggtaaaggctatagcataaatgtagcacgcgaaacaggtatttcagtaccagcaatattaatggaatctaaaatagcggtaacgcctatgaacggatttacgagatttgcaggtactatggagttttcaggtaacaatgatttcgttagaaaagaaagggtacatgctattgtcaatggtgcacgttcgttttatcctgatatagaaataaacgatactgaaataaaggaagttaagacaggtttacgacccgtgtcaccagacggtttgccgtatataggtaaatctacaaagtttacgaaccttacaattgccacaggtcatgctatgatggggtggagtttaggacctgcaactggtaagctagttacggagttattatctgatactaagccatctatgaaccttgttgcttttagtccagaaagagcattttaa

SEQ ID NO: 25742 - protein, 167 aa, Unknown
  Obtained from environmental sample
  misc_feature (1)..(167): Xaa is any amino acid
MXPGSWSGKLAKKLNLKLSLQGGKGYSINVARETGISVPAILMESKIAVTPMNGFTRFAGTMEFSGNNDFVRKERVHAIVNGARSFYPDIEINDTEIKEVKTGLRPVSPDGLPYIGKSTKFTNLTIATGHAMMGWSLGPATGKLVTELLSDTKPSMNLVAFSPERAF

SEQ ID NO: 25743 - DNA, 381 bp, Unknown
  Obtained from environmental sample
  misc_feature (1)..(381): n is a, c, g, or t
atgaataatgaaacggctattttaaacggtgagtttgcttcgagcttgctagataagagtaaatacgatgcacaaattaatgatattattaaaattagcatcgataatatttaccaatctacagaagttgttgacaaagaaatagcaggttacgaaattattaaaacacttttagacacttacattaatgcggttaacaactgctataataacacggcgtctaactacgataaattaattcttaaaggatttcctgaaaccataaaaatggatcaaaactgtttgtacgatcgactcattagcgtatcacattatgtgtctttactttcggatagtcaagcgattttaagctataaaaagataaaaggatttagtctttag

SEQ ID NO: 25744 - protein, 126 aa, Unknown
  Obtained from environmental sample
  misc_feature (1)..(126): Xaa is any amino acid
MNNETAILNGEFASSLLDKSKYDAQINDIIKISIDNIYQSTEVVDKEIAGYEIIKTLLDTYINAVNNCYNNTASNYDKLILKGFPETIKMDQNCLYDRLISVSHYVSLLSDSQAILSYKKIKGFSL

SEQ ID NO: 25745 - DNA, 531 bp, Unknown
  Obtained from environmental sample
  misc_feature (1)..(531): n is a, c, g, or t
atggctcgagtagttatcaaaacagttttcaaacaactaaatggttttgaaggcaatacaaatattgccagtggtgatgatatttttttaatggaaaaagttttaaaaactgataatcaaagcattctgtatttaaaaaacaatcaagctatagttaccacaaaaccacaaagcaatcttaaaaacttaatatcacaacgtgtacgttgggctagcaaaactagcaattataagaataattttgccaaaactgttgggctactagtattactaatgaatgctagtcttgtaattggattactactagtgactttaggactatttgcattaaaaccttttgcttatctgttttttataaaagtagctatagactttatactaatttataaagcttgccaattatttaataaagaagaattgcttaagcattatttgtggagctgttttatttacccattttttagtgtttatattgcctttatatctatgtttacaacctataaatggaaaaaccgaacatttaagaaatag

SEQ ID NO: 25746 - protein, 176 aa, Unknown
  Obtained from environmental sample
  misc_feature (1)..(176): Xaa is any amino acid
MARVVIKTVFKQLNGFEGNTNIASGDDIFLMEKVLKTDNQSILYLKNNQAIVTTKPQSNLKNLISQRVRWASKTSNYKNNFAKTVGLLVLLMNASLVIGLLLVTLGLFALKPFAYLFFIKVAIDFILIYKACQLFNKEELLKHYLWSCFIYPFFSVYIAFISMFTTYKWKNRTFKK

SEQ ID NO: 25747 - DNA, 390 bp, Unknown
  Obtained from environmental sample
  misc_feature (1)..(390): n is a, c, g, or t
atgaaaggtagttatatagagtcacttaaaactggtcatagatttaaggttttaaatccagtaaacctcgaagaagattttacagattcttggacccaaaatcattattccagcttttataactttatatctgcttttcataaaaaatggcagagtctaaaaaattcatttgaaactagcaacacagactacatcgaattgtttggagaaggcatatataaaaaatcactaactgaacagataagaatgttttcaaaaaattcagaagatgattttacacgttcaagcggtttaattattggaaataatgctatgaccgattctaaaggaaatatcaatgtaaacaaaggaataaagaatgaacctcatcacagctttggaggcaaatag

SEQ ID NO: 25748 - protein, 129 aa, Unknown
  Obtained from environmental sample
  misc_feature (1)..(129): Xaa is any amino acid
MKGSYIESLKTGHRFKVLNPVNLEEDFTDSWTQNHYSSFYNFISAFHKKWQSLKNSFETSNTDYIELFGEGIYKKSLTEQIRMFSKNSEDDFTRSSGLIIGNNAMTDSKGNINVNKGIKNEPHHSFGGK

SEQ ID NO: 25749 - DNA, 327 bp, Unknown
  Obtained from environmental sample
  misc_feature (1)..(327): n is a, c, g, or t
ttggatagcattttatttaattttatatccaatgccctaaaatacagacatcaggataggacacctaaaataaatttaagcgcagagcaaacaaaacactatattaaaattgacattgaagataatggacttggcattgatttaaatttacataaagataaagtttttggcttatataaaacctttcataatcacaaagacgctaaaggtttaggtttatatattactaaaaaccaaattgaagctatggagggaaaagtaaaagttaaaagcattataaacaatggaagcgttttttctatatatttaaagtatgaaacaaattga

SEQ ID NO: 25750 - protein, 108 aa, Unknown
  Obtained from environmental sample
  DOMAIN (1)...(106): Histidine kinase-, DNA gyrase B-, and HSP90-like ATPase
  misc_feature (1)..(108): Xaa is any amino acid
MDSILFNFISNALKYRHQDRTPKINLSAEQTKHYIKIDIEDNGLGIDLNLHKDKVFGLYKTFHNHKDAKGLGLYITKNQIEAMEGKVKVKSIINNGSVFSIYLKYETN

SEQ ID NO: 25751 - DNA, 510 bp, Unknown
  Obtained from environmental sample
  misc_feature (1)..(510): n is a, c, g, or t
ngtgaagaattagatgaaaatgagtggaacatcattgaccgacatatagatgaagctctgaaggatattatacgatatagagttgatgaagctgcatccttagaaatagattttagagagcgaattaccaacattagacaatatttagaagaagttaaaagttttgatgctgatagagttgaaaacgtaaaaactcgtttacaaaaagctattgatgatttaaaagttgatacagatcaaaacaggtttgagcaggagcttatttattatctagaaaaattagatattaatgaagagaaagtacgcttggaaaatcatttaaactacttcttagaaaccctagaaacagaagattctaatggaaaaaaattaggttttattgtgcaagaaatgggtagagaaatcaatacaacaggttctaaagctaattttgcacctatgcaaaaagccgtaattcaaatgaaaaacgaattagaacaaattaaagagcacattttatatgtgctttaa

SEQ ID NO: 25752 - protein, 169 aa, Unknown
  Obtained from environmental sample
  misc_feature (1)..(169): Xaa is any amino acid
MEELDENEWNIIDRHIDEALKDIIRYRVDEAASLEIDFRERITNIRQYLEEVKSFDADRVENVKTRLQKAIDDLKVDTDQNRFEQELIYYLEKLDINEEKVRLENHLNYFLETLETEDSNGKKLGFIVQEMGREINTTGSKANFAPMQKAVIQMKNELEQIKEHILYVL

SEQ ID NO: 25753 - DNA, 510 bp, Unknown
  Obtained from environmental sample
  misc_feature (1)..(510): n is a, c, g, or t
ttggtcaaggcttacttggaaaatcctgcggattttcctctggcaagtacctgttgggaatcgtccgtaacaaatccacgccacaggcccatatgcgagacgttaacttgcaacctgaaaaacgaaatgaacaaaccaatcaaaatcttattaataattttcggcatatttttgaccattattataggattttttatttttctacatatagcgtttgacggtatttttactggaccttcctataataaacaagacttaattgacaatttcgaaaagaaaaaaaccgaaattatagaagtcaaaaagtttatagattcaaaaattccttctgaaacatacatttcgattgaatttgaaaatggagaacttggaatttttcacgttaagaaaaatgggaattatgaaagcaactggaatttggaaattgattcaaagaaaaccgattcgcttttaacagcaattaattggactaaaactgaccttaaaaatctggaaagacaaactaaataa

SEQ ID NO: 25754 - protein, 169 aa, Unknown
  Obtained from environmental sample
  misc_feature (1)..(169): Xaa is any amino acid
MVKAYLENPADFPLASTCWESSVTNPRHRPICETLTCNLKNEMNKPIKILLIIFGIFLTIIIGFFIFLHIAFDGIFTGPSYNKQDLIDNFEKKKTEIIEVKKFIDSKIPSETYISIEFENGELGIFHVKKNGNYESNWNLEIDSKKTDSLLTAINWTKTDLKNLERQTK

SEQ ID NO: 25755 - DNA, 402 bp, Unknown
  Obtained from environmental sample
  misc_feature (1)..(402): n is a, c, g, or t
ttgctaagtttggtgtattatgaagatgatattgaagtaacgtattcaggattattaagggacgttaaagaagcacgagttaatgctttggagtttctagataacgtaatacaaagcgaattaaaacgccgattattcccattaatagagcattttattattgacgaagaaacctttgatgcttccgttttaaacttaaaacgcattccagaaaaagcgtatattaatatgttactgaagagtagaggcaagaaaataaaattagaagtgttaaatctaatcaagcaactggaagatgcgagttaccttccagtagttcttccgtataaaaaacacagaaataaagagattaaattttttgcttacgataccattcaaactttagaacacgctacggattaa

SEQ ID NO: 25756 - protein, 133 aa, Unknown
  Obtained from environmental sample
  misc_feature (1)..(133): Xaa is any amino acid
MLSLVYYEDDIEVTYSGLLRDVKEARVNALEFLDNVIQSELKRRLFPLIEHFIIDEETFDASVLNLKRIPEKAYINMLLKSRGKKIKLEVLNLIKQLEDASYLPVVLPYKKHRNKEIKFFAYDTIQTLEHATD

SEQ ID NO: 25757 - DNA, 519 bp, Unknown
  Obtained from environmental sample
  misc_feature (1)..(519): n is a, c, g, or t
gtggtgaattaccctatagaagttcaagatttagaagatgaaattgaaggtttaaacacgagactttctaattttaatagtgatatagaaaatttagaaactagtataaaaaatagaaaaataacgattgatgaggcaaaagtagccatcaaaaaatatacaactcagcaaaaaaatgttagaaataacagagaatttgattctttgtctaaagagatcgaatatcaagaacttgaggtacaattagctgaaaaacacatcaaagaattttctgttaaaattgaacaaaaaaatgaaattattgatgcagccaaagaaaaactcaaagaaagaaatgagcatcttaaacataaaaaaaatgaattagacgctattcttgccgaaactgagaaagaagaaaaaatgttgcttaaaaaatcagcagaatttagcaaattaattgatgaacgattattaaatgcctataatcgtatccgtaataaagttaataatggattagcggtggttcctattgaacnn

SEQ ID NO: 25758 - protein, 173 aa, Unknown
  Obtained from environmental sample
  misc_feature (1)..(173): Xaa is any amino acid
MVNYPIEVQDLEDEIEGLNTRLSNFNSDIENLETSIKNRKITIDEAKVAIKKYTTQQKNVRNNREFDSLSKEIEYQELEVQLAEKHIKEFSVKIEQKNEIIDAAKEKLKERNEHLKHKKNELDAILAETEKEEKMLLKKSAEFSKLIDERLLNAYNRIRNKVNNGLAVVPIEX

SEQ ID NO: 25759 - DNA, 426 bp, Unknown
  Obtained from environmental sample
  misc_feature (1)..(426): n is a, c, g, or t
atgaagaaaaaagcaattatagtttcaggatattgtaatccaattcacaaaggtcatttagagtattttaatagcgcaaaagcattggcagatgaattatttgtcattgtgaatagcgatttacaacgaggtttaaagggatctaaagaatttcaagatcaagatgagcgtttatttattgttcaaaatataaaaggagtagataaagctatcatatctatagatacagatagaactgtttgtgaatcgattcgaagtcttgttgaaaactacaaaaatgaatatgattttggctttgcaaatggtggagatcaaaataacaattctatcccagaagctccaatttgtaaggagttgaatattgaattgattgatgggttaggagataaaatacaatcatcatcttggttattaggaaaaaaataa

SEQ ID NO: 25760 - protein, 141 aa, Unknown
  Obtained from environmental sample
  DOMAIN (7)...(140): Cytidylyltransferase
  misc_feature (1)..(141): Xaa is any amino acid
MKKKAIIVSGYCNPIHKGHLEYFNSAKALADELFVIVNSDLQRGLKGSKEFQDQDERLFIVQNIKGVDKAIISIDTDRTVCESIRSLVENYKNEYDFGFANGGDQNNNSIPEAPICKELNIELIDGLGDKIQSSSWLLGKK

SEQ ID NO: 25761 - DNA, 336 bp, Unknown
  Obtained from environmental sample
  misc_feature (1)..(336): n is a, c, g, or t
atgaataagcgtcacatatccatcctaatgcttgccatgacggcactattatcaggctgtgatcaatcgtcgcaagacccgaatgtcatgctgtcagaagggcaaaaagacccaatcaaacagctggagatcacctcaaaaattgatcatagtaaacttggctatcagcaaaccttttatgtgccgatttactctgacatttataccgatagagacaatcgtaagttcttgctgtctgcgactttgagtgtgcgtaataccaccttaaaaaaatcactttatatcaataaatcgatactacgataccctggctttctgaccgatcttgatccatag

SEQ ID NO: 25762 - protein, 111 aa, Unknown
  Obtained from environmental sample
  SIGNAL (1)...(19)
  misc_feature (1)..(111): Xaa is any amino acid
MNKRHISILMLAMTALLSGCDQSSQDPNVMLSEGQKDPIKQLEITSKIDHSKLGYQQTFYVPIYSDIYTDRDNRKFLLSATLSVRNTTLKKSLYINKSILRYPGFLTDLDP

SEQ ID NO: 25763 - DNA, 720 bp, Unknown
  Obtained from environmental sample
  misc_feature (1)..(720): n is a, c, g, or t
ttgtgcaaacctattaagatgtacaaatcccttctaagacctttattttttagtttcgatcctgaaaaaattcatcatttcacattttcattagtaaaagttacgtctaagattccaggtatggcgtcattgtatagacgtttgtatactattgaagatcctaaattagaacgtaaacttttcggtttaacctttaaaaacccagtgggattagcagcaggttttgataaaaatgcggtgttatataatgaattggcaaactttggtttcggttttatagaggttggtactgttacgccaaaaggtcaggttggtaatccaaaaaaacgtctgtttaggctaaaagacgatcaagggattattaacagaatgggctttaataacgaaggtttagaacaagccattattcaacttaaaaaaaacaaagggaaacttattattggtggtaatattggaaaaaacacacaaactaagcctgaggattataccaaggattacttggcgtgttttaatgggttacatccatatgtagattattttgtacttaatgtaagttgcccaaatgtgggtagtcatgctaaattaaacgataaagactatttgttagagcttattagtactgtgccaaaagggaataacacgtttgaaaaacaaaagacaatcttacttaaaattgccccagatttaaatactatccaattagatgaattatcgagctaa

SEQ ID NO: 25764 - protein, 239 aa, Unknown
  Obtained from environmental sample
  DOMAIN (55)...(239): Dihydroorotate dehydrogenase
  misc_feature (1)..(239): Xaa is any amino acid
MCKPIKMYKSLLRPLFFSFDPEKIHHFTFSLVKVTSKIPGMASLYRRLYTIEDPKLERKLFGLTFKNPVGLAAGFDKNAVLYNELANFGFGFIEVGTVTPKGQVGNPKKRLFRLKDDQGIINRMGFNNEGLEQAIIQLKKNKGKLIIGGNIGKNTQTKPEDYTKDYLACFNGLHPYVDYFVLNVSCPNVGSHAKLNDKDYLLELISTVPKGNNTFEKQKTILLKIAPDLNTIQLDELSS

SEQ ID NO: 25765 - DNA, 309 bp, Unknown
  Obtained from environmental sample
  misc_feature (1)..(309): n is a, c, g, or t
atgtccataaaaacagagctcggggaacaaatcagaaatcagagaattctaaacagttatttagatgaaacttacaatcatctgtttaaatgttatcgcgatttaatgaatgagcataaattgattaccgcacaggtcgttaaggctcgatatttcggtaatgacgaaaataatcgttccattacagatattatcaattaccataatgaagatatggtaaacaaattaaagtggggaacacaaaaaaattattacactacacagagttatatctccaaattttatcctcgaccgattcttgatcactag

SEQ ID NO: 25766 - protein, 102 aa, Unknown
  Obtained from environmental sample
  misc_feature (1)..(102): Xaa is any amino acid
MSIKTELGEQIRNQRILNSYLDETYNHLFKCYRDLMNEHKLITAQVVKARYFGNDENNRSITDIINYHNEDMVNKLKWGTQKNYYTTQSYISKFYPRPILDH

SEQ ID NO: 25767 - DNA, 315 bp, Unknown
  Obtained from environmental sample
  misc_feature (1)..(315): n is a, c, g, or t
atgggtttatttgacatgtttaaaagaaaagatatgagtttagatattaaagaatatttagaaaatgatgctgttattttagatgtaagaacgcaagaagagtggaatgaagggcatattgaaaacgcaaaacatattgttttaaatttaattcctttaaaagtagaggaaataaaagcttgggaaaagccagtaattgctgtttgtagaagtggaggtagaagtggacaagctgcacaatttttaaagcaaaatggcgtagatgttattaatggtggtccttggcaaaatgtagatcagtatatagaaaagtaa

SEQ ID NO: 25768 - protein, 104 aa, Unknown
  Obtained from environmental sample
  DOMAIN (13)...(104): Rhodanese-like domain
  misc_feature (1)..(104): Xaa is any amino acid
MGLFDMFKRKDMSLDIKEYLENDAVILDVRTQEEWNEGHIENAKHIVLNLIPLKVEEIKAWEKPVIAVCRSGGRSGQAAQFLKQNGVDVINGGPWQNVDQYIEK

SEQ ID NO: 25769 - DNA, 600 bp, Unknown
  Obtained from environmental sample
  misc_feature (1)..(600): n is a, c, g, or t
atgggcaaactcgtcccacaaaacccaaacgacgaacccgccgccaaactcctagagcgtatagcagcagaaaaagcacaactgattaaagacaaaaaaatcaaaaagcaaaaaccactgccagaaattaccgacgaagaaaaaccgtttgaattacccgaagggtgggagtggtgtcggtttgaagatatagttgagatcaatggcggaattactaagggtcgaaaattagctgggcgtgagctcattactgtgccttatttgagcgtggcgaatgttcagagaagctatctcaatttggagcacttaaaagagattgatatcccagttgaggaaaaagaaaaatatcgtgtgaaaaaaagagatctacttataactgaaggtggtgattgggataaggttggtcgaacagctatttggtcagatgaacttgattatgtaggtcatcaaaaccatgtatttaaagctcgtatttttcttgaagaacaatgcgaagtttggctcgagaaatatcttaatggaccatatgcccgtgattactttgcaggctcaagtaaacaaacaacgaaccttgcttctattaataaaacacagctaagn

SEQ ID NO: 25770 - protein, 200 aa, Unknown
  Obtained from environmental sample
  misc_feature (1)..(200): Xaa is any amino acid
MGKLVPQNPNDEPAAKLLERIAAEKAQLIKDKKIKKQKPLPEITDEEKPFELPEGWEWCRFEDIVEINGGITKGRKLAGRELITVPYLSVANVQRSYLNLEHLKEIDIPVEEKEKYRVKKRDLLITEGGDWDKVGRTAIWSDELDYVGHQNHVFKARIFLEEQCEVWLEKYLNGPYARDYFAGSSKQTTNLASINKTQLX

SEQ ID NO: 25771 - DNA, 306 bp, Unknown
  Obtained from environmental sample
  misc_feature (1)..(306): n is a, c, g, or t
gtggaatttgtagattgtacacttgaaggtggtggtggtgaaatggaatatcgaatttttccaaaccctagctctgaaactttaacaattcaaaaaaaatcaaatttagaaaactcaagagaaattgaaagttcatattcgattgaactttacgattttaattcaaatttaatttttaacagttttgaacgcaaccaaaagagtattactatatctaaatatcacaagggcaaatacattttaaaaattaataacaatcataaactgaaactcancactatatattcactacacaacataatatga

SEQ ID NO: 25772 - protein, 101 aa, Unknown
  Obtained from environmental sample
  misc_feature (1)..(101): Xaa is any amino acid
MEFVDCTLEGGGGEMEYRIFPNPSSETLTIQKKSNLENSREIESSYSIELYDFNSNLIFNSFERNQKSITISKYHKGKYILKINNNHKLKLXTIYSLHNII

SEQ ID NO: 25773 - DNA, 843 bp, Unknown
  Obtained from environmental sample
  misc_feature (1)..(843): n is a, c, g, or t
atgttttcattgttgatgcatggacgcatacattctgttgatgtattaaatgctgtttatgtgcatatcaccactaaaaagcagttacataaattggctgatgacatggtctatattccattagatatcgtgtctaaaacttatggcaatcagatagtcgatatcgacggttctgatgaaaaaattatctcttattcaaagtgggtattcatagacgatatcagtcgcttgtggttagttaaggttaatcagctattggaagatgagacatcgaagataccaagctttcatagctgtgttaggcagcttggtaatttgactggacaaaaatttaaagcggataatttggagaaaacagattttcttagctatttgaatatttactggcaaacattggcgaatgtacatatagatcagcagctagtggaactgcttgttcaacatgatacccatactgccattagtttaaacgactggcaagcttacttaggggctcttcaggaatcagataccactactgtcaaaaatgagtacatcacggttaatagactcaataaaactactcaaaatttgcaggatgaagttgtcggcatagaggatagtgtcagtaaaaataaggctcataaaaacgtattaaaagatattcgncgcgcccttatgggcagtaggaaaaaaattaaagagcagctcgaggcgttgactgaaattcacgaaggttatagtgagcgaggtttaattctctggatggttgatttaaatgctattaataaagcgattctaccttatcaagattcctgccgagtgggtgacgcattttatatgccctccctaatgaacacttgt

SEQ ID NO: 25774 - protein, 281 aa, Unknown
  Obtained from environmental sample
  misc_feature (1)..(281): Xaa is any amino acid
MFSLLMHGRIHSVDVLNAVYVHITTKKQLHKLADDMVYIPLDIVSKTYGNQIVDIDGSDEKIISYSKWVFIDDISRLWLVKVNQLLEDETSKIPSFHSCVRQLGNLTGQKFKADNLEKTDFLSYLNIYWQTLANVHIDQQLVELLVQHDTHTAISLNDWQAYLGALQESDTTTVKNEYITVNRLNKTTQNLQDEVVGIEDSVSKNKAHKNVLKDIRRALMGSRKKIKEQLEALTEIHEGYSERGLILWMVDLNAINKAILPYQDSCRVGDAFYMPSLMNTC

SEQ ID NO: 25775 - DNA, 669 bp, Unknown
  Obtained from environmental sample
  misc_feature (1)..(669): n is a, c, g, or t
ttggtaaaaaagattttagcttctttaaatttaatgccaatttatagaattagagatggtagaaaacaactttctaataacgaagaagtttttgaaaagtgtttcaacattttaaaaaacgaagaaaccttaatgatttttccacaaggtggccattgcagagacagaaccattcaacctttaagcaaagggtttacaagaattgtttttggtgcattagaaagtaatcctaatttagaaattgctgtgattcctgttggaattacctatcagaattcttctaaatacccctctaaagtttgtgtgaattttggaaatgtaattaattctagagagatttttaatgccaatgaaaaaccaaaagcaatcaacattttaaaaaataaagttagcaatcaactaaaaaaattgacggttcatattcctaatgatgagcattatactactaggctagccaaattaaatgctgccaatgtagattttactgatgttgacaccgtaaataaaatgattgctaaaaataactttccaaatcctgtaaaaaagcaacccaattatttaaaacctctcttttatgtaattcttttaaaccagtatttttccctttttctgatttgcgaaaaaaatgctcaaaaaacattcaagaaattgaatctattgacaccatga

SEQ ID NO: 25776 - protein, 222 aa, Unknown
  Obtained from environmental sample
  misc_feature (1)..(222): Xaa is any amino acid
MVKKILASLNLMPIYRIRDGRKQLSNNEEVFEKCFNILKNEETLMIFPQGGHCRDRTIQPLSKGFTRIVFGALESNPNLEIAVIPVGITYQNSSKYPSKVCVNFGNVINSREIFNANEKPKAINILKNKVSNQLKKLTVHIPNDEHYTTRLAKLNAANVDFTDVDTVNKMIAKNNFPNPVKKQPNYLKPLFYVILLNQYFSLFLICEKNAQKTFKKLNLLTP

SEQ ID NO: 25777 - DNA, 501 bp, Unknown
  Obtained from environmental sample
  misc_feature (1)..(501): n is a, c, g, or t
atggaaagtttaatctcagatattttaagatactcaagtttagactcagtttcagaagaaattaaaaaagtaaacttagatactttggttaaagatttaactcaaattttatttataccagagaatattaccattaatattttaaataaattaccagttgtacaaggagataaaattaaatatcaacaagtatttcaaaacttaattagtaatgctattaaatttaatgataaagaaaatggtgtaattaatattgatgttgaagatctttattcttattacaaattttctgtaagtgataatggcattggtatcgaaaaaaagtattttgataaaatttttaaaatatttcagtctttaaaagtggcaaaaaactcaacaggaattggattgtctattgtaaaaaaaattgtagatatttataaaggagaaatatggttagaatctgaaatacataaaggaaccaccttttattttacgattaaaaaggatcttttataa

SEQ ID NO: 25778 - protein, 166 aa, Unknown
  Obtained from environmental sample
  DOMAIN (56)...(164): Histidine kinase-, DNA gyrase B-, and HSP90-like ATPase
  misc_feature (1)..(166): Xaa is any amino acid
MESLISDILRYSSLDSVSEEIKKVNLDTLVKDLTQILFIPENITINILNKLPVVQGDKIKYQQVFQNLISNAIKFNDKENGVINIDVEDLYSYYKFSVSDNGIGIEKKYFDKIFKIFQSLKVAKNSTGIGLSIVKKIVDIYKGEIWLESEIHKGTTFYFTIKKDLL

SEQ ID NO: 25779 - DNA, 354 bp, Unknown
  Obtained from environmental sample
  misc_feature (1)..(354): n is a, c, g, or t
atgagccaaaataaagttgacatattagaaagagctttagagcgtcaaaaaaatgctcgaaaagaagcagagaaaatacttgaaaataagtctttagagttatataatacctctcaagaattaaaacaagttaatgaaaagctagaaattcttttaaaagaaaaaacttccatactaaaaggtatttttaggaatataaatgatgcttatcttatcatagatttgaaaggtaacgtcttaaaaatgaataacaaatctcaagatttatttggttacaatttaaaaaacgaaagttttaatacttcaaagcttttttttaaagaagattataatcatgcttattcatccttttaa

SEQ ID NO: 25780 - protein, 117 aa, Unknown
  Obtained from environmental sample
  misc_feature (1)..(117): Xaa is any amino acid
MSQNKVDILERALERQKNARKEAEKILENKSLELYNTSQELKQVNEKLEILLKEKTSILKGIFRNINDAYLIIDLKGNVLKMNNKSQDLFGYNLKNESFNTSKLFFKEDYNHAYSSF

SEQ ID NO: 25781 - DNA, 600 bp, Unknown
  Obtained from environmental sample
  misc_feature (1)..(600): n is a, c, g, or t
atgcagactaggtattatcaaattatagatgagtattataaaaatttcatcatctattatgccaatacttttatgcctttggcgttatttattgctgttattttatttacttcaaaattatctaacaacacagaaattattgccattaataatgcaaaagtttcatttacaagatttttatatccgtattttgttggtgctagtttaattacaattttatctttagtaatgaatcattttgtagttccaaacagcagtactacaagaaaaaagttcgaaaaagaatattttaataatagaagacaacaacaagaatttaaatatataagcgattttagccttcaattaacagatagcacttatatttttattaaaaattttaatacagaaaccaatgcaggttacgattttacgtcagaattatatgatggtttagaattgaaaacaaaattggtagcagataatattagatacaataaaaaagattcgacttttcttgttcaaaattggcgattacgtaaaatttataaagatagagatagcatcttttcaggaaataaaattgatactgtttttaattttacccctaaagatttaatt

SEQ ID NO: 25782 - protein, 200 aa, Unknown
  Obtained from environmental sample
  misc_feature (1)..(200): Xaa is any amino acid
MQTRYYQIIDEYYKNFIIYYANTFMPLALFIAVILFTSKLSNNTEIIAINNAKVSFTRFLYPYFVGASLITILSLVMNHFVVPNSSTTRKKFEKEYFNNRRQQQEFKYISDFSLQLTDSTYIFIKNFNTETNAGYDFTSELYDGLELKTKLVADNIRYNKKDSTFLVQNWRLRKIYKDRDSIFSGNKIDTVFNFTPKDLI

SEQ ID NO: 25783 - DNA, 318 bp, Unknown
  Obtained from environmental sample
  misc_feature (1)..(318): n is a, c, g, or t
ttgtatttgctttcccatattttagaaaatactggtgcaaataatataatgaataatgaatttaatacagagaaccatgatgctgcaacttcagtagcttcagaagtaaactctctatataacatccaaataacaatcacccaaataattaaaaaactaaatcctaagaaaaaatttgataaggcatactttttaaaagtttgcttaaatagcattcctaaaacccatgttaacacaaataaagggactaatgtaataattgaattaactatattaaaaaccgttgcagactctccacttaaagcacgatctgtataa

SEQ ID NO: 25784 - protein, 105 aa, Unknown
  Obtained from environmental sample
  misc_feature (1)..(105): Xaa is any amino acid
MYLLSHILENTGANNIMNNEFNTENHDAATSVASEVNSLYNIQITITQIIKKLNPKKKFDKAYFLKVCLNSIPKTHVNTNKGTNVIIELTILKTVADSPLKARSV

SEQ ID NO: 25785 - DNA, 612 bp, Unknown
  Obtained from environmental sample
  misc_feature (1)..(612): n is a, c, g, or t
atgtttttatgtgaattcaaaaaaacaatggtattaattgttgtctttttttatgctattaacgctcactcgcaatcatataacacgcaagttgaggcaaagctgatagttacccaagacaatgatattattaatataaagggcgttgctattaataaaatgcaattgtctaaaagtatatcctataaattatctgtttttaaaacagataaaaatcaaaataaatctaaaaacgagcaaagcggacaattagatttaaatgcagatcaacaaaaagatttgtcaacaacatccattaattttgatcaagatacaaaagtgataattctacttttaatttttgattccacagataatattattggtatggatagaatcgtttataacgataatgaagacaataatcttaatgttcaacaaaatattgcacaaaaaattgataatattagtgtcaaaatttctgcgcaattagtacataatgaagttgaggctaaaatagaaagcgctcaacaaatgactttacagcataaaagtaaagtttcaataaaccgaaattaccaaagttactctttaactaacggtttcgataagaaaaagtgtgatacctcctga

SEQ ID NO: 25786 - protein, 203 aa, Unknown
  Obtained from environmental sample
  misc_feature (1)..(203): Xaa is any amino acid
MFLCEFKKTMVLIVVFFYAINAHSQSYNTQVEAKLIVTQDNDIINIKGVAINKMQLSKSISYKLSVFKTDKNQNKSKNEQSGQLDLNADQQKDLSTTSINFDQDTKVIILLLIFDSTDNIIGMDRIVYNDNEDNNLNVQQNIAQKIDNISVKISAQLVHNEVEAKIESAQQMTLQHKSKVSINRNYQSYSLTNGFDKKKCDTS

SEQ ID NO: 25787 - DNA, 312 bp, Unknown
  Obtained from environmental sample
  misc_feature (1)..(312): n is a, c, g, or t
ttgcaaatagcttccaaagtagaaaaacgtatagctttagctttacctgtttttagtatggatagattagctgtggttataccaacaatttcagccaactcgttacttttcatgtttcgcttttctagcattatgtcaagatttactattatggacataagctatatggttaagtcattttcttgttttgcaaacttagcgaccttaaacacttcgcttaggaccataaaaaataacccaaaacaaagcattattaaaaaagaactaaaaccaatttcaagctctattttctgtttgtacaaaattttataa

SEQ ID NO: 25788 - protein, 103 aa, Unknown
  Obtained from environmental sample
  misc_feature (1)..(103): Xaa is any amino acid
MQIASKVEKRIALALPVFSMDRLAVVIPTISANSLLFMFRFSSIMSRFTIMDISYMVKSFSCFANLATLNTSLRTIKNNPKQSIIKKELKPISSSIFCLYKIL

SEQ ID NO: 25789 - DNA, 732 bp, Unknown
  Obtained from environmental sample
  misc_feature (1)..(732): n is a, c, g, or t
gtgatgtttatggatgatggcagtacagacaattcatggcaggtcattgaagatttagccaaacagaatgcttctgtaaaaggcatcagatttcaaaaaaactatggtaaatcacaagccttaaatgcaggttttcttgaggcgaagggcgatgtagtgatcactatggatgcagacttacaggatagtcctgatgaaattcctgaattacacgatctgattgccaacgataatttcgacctcatttcaggttggaagaaaaagcgattcgattcgaccatcagaaagaatttaccatcaaaattatttaacgccgttgcacgcaaaacttcaggtttacatctgcatgatttcaattgcggtttaaaagcgtacaaaaatgatgtgataaaaaatattgatgtgtacggtgagatgcatcgttatataccagtcttagctaagaacgaagggtacctgaaaattgatgaaaaagtggttgtgcaccaggcccgtaaatacggaaaaaccaaatttggcatgagtagatttgtcaacgggtttttggacctgattactatttggttcttatcaaaatttggtaaacgcccaatgcatttattcggtttattgggaagcctcatgttttttatagtnttttgttttgccttatacttaggtatagataaaatattgattaatcctacaggtagattattgacggacagaccccaattttacatctcttgttaa

SEQ ID NO: 25790 - protein, 243 aa, Unknown
  Obtained from environmental sample
  misc_feature (1)..(243): Xaa is any amino acid
MMFMDDGSTDNSWQVIEDLAKQNASVKGIRFQKNYGKSQALNAGFLEAKGDVVITMDADLQDSPDEIPELHDLIANDNFDLISGWKKKRFDSTIRKNLPSKLFNAVARKTSGLHLHDFNCGLKAYKNDVIKNIDVYGEMHRYIPVLAKNEGYLKIDEKVVVHQARKYGKTKFGMSRFVNGFLDLITIWFLSKFGKRPMHLFGLLGSLMFFIVFCFALYLGIDKILINPTGRLLTDRPQFYISC

SEQ ID NO: 25791 - DNA, 339 bp, Unknown
  Obtained from environmental sample
  misc_feature (1)..(339): n is a, c, g, or t
atgaaaaaaaatgacattaatgtttcctttcgaaacaaatttcttttacgaatcatgaaaatttacgtactcttatttttcacaaccatggcaaatctttttgcaaccaatactatggggcaaaatatttcagttaacgtgaaagatgtcgagttgaaaactgtttttacagaaattgaaaacaaaactaattttaactttttctacaataatacattagtagaagtaaccaaaaaaatttctttacctgttgacaacaaagaattggctacagtcctaaatcaattatctagtaaacctaagatagattatagatctttacaaattcaaatagtttaa

SEQ ID NO: 25792 - protein, 112 aa, Unknown
  Obtained from environmental sample
  misc_feature (1)..(112): Xaa is any amino acid
MKKNDINVSFRNKFLLRIMKIYVLLFFTTMANLFATNTMGQNISVNVKDVELKTVFTEIENKTNFNFFYNNTLVEVTKKISLPVDNKELATVLNQLSSKPKIDYRSLQIQIV

SEQ ID NO: 25793 - DNA, 456 bp, Unknown
  Obtained from environmental sample
  misc_feature (1)..(456): n is a, c, g, or t
atgatgnatttaactatgaagttaaaatttttgaatatgcttaggctcttcctattatttaatatcatgctaatatctgttatcggatattcccagaaaaattgtactctttcaatagaatttgaaggtttaaaatccgagaaaggcaaattgtttgttgcactttataattctgaagaagattttttaaaaaatcaaataaagggatcaatagtagatatatccaatggtaaggcttcggctagttttgataatttagaaagtggaatatatgccatttcatctttctatgataaaaataataatggtaaaatggatacaaatttcttgggaatacccaaagaacccgttgcgtgtagtaataatgccaagggaaagtttgggcctccaaaatttaaggatgcaaaattcatgatttcaacagatcatactcaaattaaaattaaatttaattag

SEQ ID NO: 25794 - protein, 151 aa, Unknown
  Obtained from environmental sample
  misc_feature (1)..(151): Xaa is any amino acid
MMXLTMKLKFLNMLRLFLLFNIMLISVIGYSQKNCTLSIEFEGLKSEKGKLFVALYNSEEDFLKNQIKGSIVDISNGKASASFDNLESGIYAISSFYDKNNNGKMDTNFLGIPKEPVACSNNAKGKFGPPKFKDAKFMISTDHTQIKIKFN

SEQ ID NO: 25795 - DNA, 441 bp, Unknown
  Obtained from environmental sample
  misc_feature (1)..(441): n is a, c, g, or t
atgaatgtaattattatagaagacgaaaaaccgtccgcgaggaggctagataggatgttacaaagccatgacattaaggtaaatgttatgctacattcagttgaagaatcgttagcatggtttcaaaaaaatgaacatcctgaccttatatttttagatatacaattatcagatgggctttcttttgaaatttttgaaaacatagaggtaaaaagtgctattatttttacaacagcttatgatgaatatgctttacaggcctttaagttgaacagtattgattatttgttaaaacctattgattcagaagaacttgagcatgctgtgattaaatacaaagaacgaatcccggaaaggaaaaatgtatcattggattttgaggatattaaaaaattattgataatccgcttgagcgtagcatataaaaacgatttaccgtga

SEQ ID NO: 25796 - protein, 146 aa, Unknown
  Obtained from environmental sample
  DOMAIN (1)...(117): Response regulator receiver domain
  misc_feature (1)..(146): Xaa is any amino acid
MNVIIIEDEKPSARRLDRMLQSHDIKVNVMLHSVEESLAWFQKNEHPDLIFLDIQLSDGLSFEIFENIEVKSAIIFTTAYDEYALQAFKLNSIDYLLKPIDSEELEHAVIKYKERIPERKNVSLDFEDIKKLLIIRLSVAYKNDLP

SEQ ID NO: 25797 - DNA, 435 bp, Unknown
  Obtained from environmental sample
  misc_feature (1)..(435): n is a, c, g, or t
atgaaaaacttaattttaattttagcattatccattggtttcaatgcattctctcaaatttacgaccccgttaaatgggaaacatcagttaagaaaatctctgatactgaatatattttagtgaccaatgcaaaaatagaaaaaggatggcatttatattctcaaaacgttcctgaagacggnccgattccaacaacgtttatttttgaaacaaaagagtctgtagaattaatagacgctgttttagaagaagaaggcgttactatagacgaccctgtttttaatatgcgtataaaattttttgagagtaaagcagcctttaaacaacgcataaaaatattaaataaagagttgtctctagttaaaggagacagtaaattatggtttgggacgaccagagatgttgccaccagcctatgtagaattagagtttga

SEQ ID NO: 25798 - protein, 144 aa, Unknown
  Obtained from environmental sample
  SIGNAL (1)...(18)
  misc_feature (1)..(144): Xaa is any amino acid
MKNLILILALSIGFNAFSQIYDPVKWETSVKKISDTEYILVTNAKIEKGWHLYSQNVPEDGPIPTTFIFETKESVELIDAVLEEEGVTIDDPVFNMRIKFFESKAAFKQRIKILNKELSLVKGDSKLWFGTTRDVATSLCRIRV

SEQ ID NO: 25799 - DNA, 417 bp, Unknown
  Obtained from environmental sample
  misc_feature (1)..(417): n is a, c, g, or t
gtgaatctgcaaaaatctaaacccgaaaccacaaatgtaacttttgatcggcgtcaaaaatttaggggagctcaagttattggtggagccatatttgaagctaacattgatagaagtcatcccattaattttggatataataaaaatgaaatagcattattcagaaatactaccatttttgtaaaaccggatagcagcagttatataaatccgattcagtatacaaaaaagccattgttaagtggatatatttctaaagaaaacctaaaagtattaggtgaaactattcccgttgaaactgctaatatgggtaaaggtaaagtcattgtatttacagataataccaacttcagagcattttggtacggtactaacaagttaatgatgaatgccattttctttgggaagatgatgtga

SEQ ID NO: 25800 - protein, 138 aa, Unknown
  Obtained from environmental sample
  misc_feature (1)..(138): Xaa is any amino acid
MNLQKSKPETTNVTFDRRQKFRGAQVIGGAIFEANIDRSHPINFGYNKNEIALFRNTTIFVKPDSSSYINPIQYTKKPLLSGYISKENLKVLGETIPVETANMGKGKVIVFTDNTNFRAFWYGTNKLMMNAIFFGKMM

SEQ ID NO: 25801 - DNA, 378 bp, Unknown
  Obtained from environmental sample
  misc_feature (1)..(378): n is a, c, g, or t
ttgatgtttttatttttgctaattagttttaaacagttatatttgattcaaagaatattaataggacataatatgagtttaactaaaagtatatcggccgatgcagctacgttaacaatacatataaagggtaagtttgactttaatttagtgcaatcttttcgccaagcgtatgcgcaaatagataaaagcattactaaagtaattatcgacctaagggaaaccgattacatggacagctcagcattaggtatgctgctaaatatgcaaaaaagcatagatacacaggtcaataaatttgagatcagcaactgccaaccacaattaaaaaaaatattacaaatatctcggtttgataagaagtttgatattaactag

SEQ ID NO: 25802 - protein, 125 aa, Unknown
  Obtained from environmental sample
  DOMAIN (26)...(124): STAS domain
  misc_feature (1)..(125): Xaa is any amino acid
MMFLFLLISFKQLYLIQRILIGHNMSLTKSISADAATLTIHIKGKFDFNLVQSFRQAYAQIDKSITKVIIDLRETDYMDSSALGMLLNMQKSIDTQVNKFEISNCQPQLKKILQISRFDKKFDIN

SEQ ID NO: 25803 - DNA, 666 bp, Unknown
  Obtained from environmental sample
  misc_feature (1)..(666): n is a, c, g, or t
atgcagaactatggtgagaatttttatgccaaaaggcaaatctggataggtgagtccttaggcgaaacagcggatattggtaacaaatccgatatcctcatattccctgagggaggcaccctattaagtgggcatgaaaacagggtaatggtcaaaatgcaccataacaaggaagcaaaggaaggaaaagttggaagaatattggatgaccaaaacaatgaggtagccattgtaaacaattattcgacatgtatgggtaccgccatttataaaccgattaaagacagggagtaccgtctagagttagagaatggatccatttaccctattcccagagcgctagatcaaggatacctcttgcacgtcaataaccttgatgcaactagtgtcaagatccgggttacggcatcttcagaagttactgggacagctgtaaaattggtagggatatcaggtgggataagatattttgaaaaacaattggactttaaggatagtaccattgcagatgttgaattttccaaaaaaggtattcctaacggaacattgttcctaaaactaatggatgaggttggaaacgagtatgcttcaaggacaatcttggtaaatgctgagcgaatcatatcgatattatcctatagttcaaaactgaagatcagtatatag

SEQ ID NO: 25804 - protein, 221 aa, Unknown
  Obtained from environmental sample
  misc_feature (1)..(221): Xaa is any amino acid
MQNYGENFYAKRQIWIGESLGETADIGNKSDILIFPEGGTLLSGHENRVMVKMHHNKEAKEGKVGRILDDQNNEVAIVNNYSTCMGTAIYKPIKDREYRLELENGSIYPIPRALDQGYLLHVNNLDATSVKIRVTASSEVTGTAVKLVGISGGIRYFEKQLDFKDSTIADVEFSKKGIPNGTLFLKLMDEVGNEYASRTILVNAERIISILSYSSKLKISI

SEQ ID NO: 25805 - DNA, 531 bp, Unknown
  Obtained from environmental sample
  misc_feature (1)..(531): n is a, c, g, or t
atgaatgcagatctggttattatgggaaccaaagttgctactaatgcaacagaacgtttttttggaagcaatacagtaaatattattaaaaagataaaaaattgtcctgtattggctattccagataattacaagtttattaaacctgaaaccattgcttttccaacagattttaatcgtttttatggtagcgagttagaacctttaaaagaattagctaaactatacgattctgaaattaaaattattcaccttaataaaacggatgatattacagaagctcaagactataacttagatcaacttaaagacgctttaaaaaattatacttacagtttgcacagggttccagagtacaatgctaaagatgaggctataaaacaatttattgaggataaaaaagcagatattttggtgatgattaattatgaacaaggctttattgaaaaacttattaaagaacctgtaattaaaaatataggcattcatcctactattccttttttagtgatacccagtcaagggaaatag

SEQ ID NO: 25806 - protein, 176 aa, Unknown
  Obtained from environmental sample
  misc_feature (1)..(176): Xaa is any amino acid
MNADLVIMGTKVATNATERFFGSNTVNIIKKIKNCPVLAIPDNYKFIKPETIAFPTDFNRFYGSELEPLKELAKLYDSEIKIIHLNKTDDITEAQDYNLDQLKDALKNYTYSLHRVPEYNAKDEAIKQFIEDKKADILVMINYEQGFIEKLIKEPVIKNIGIHPTIPFLVIPSQGK

SEQ ID NO: 25807 - DNA, 336 bp, Unknown
  Obtained from environmental sample
  misc_feature (1)..(336): n is a, c, g, or t
atgcaacagctaaggcttgaatctgaatcagataagctgaagcttaaaaaaagtaaacaatattttcttcccaccttttcatttgtagctaactataccacacagtatcaaggtgagaattttaaatacaatgaaaacatatggtcaccatttaattatttaggattgaaattttctttgccaataaggggtaatttaaaaaatgagaataccataaaggaatatcaactaaagattgaacaggataatttaaaattacttcaaaatgaaagtgatataagctatgaaatagaaaagaccagaacagagctgctgaatgctcaaagcttaatttag

SEQ ID NO: 25808 - protein, 111 aa, Unknown
  Obtained from environmental sample
  misc_feature (1)..(111): Xaa is any amino acid
MQQLRLESESDKLKLKKSKQYFLPTFSFVANYTTQYQGENFKYNENIWSPFNYLGLKFSLPIRGNLKNENTIKEYQLKIEQDNLKLLQNESDISYEIEKTRTELLNAQSLI

SEQ ID NO: 25809 - DNA, 468 bp, Unknown
  Obtained from environmental sample
  misc_feature (1)..(468): n is a, c, g, or t
ttgtatttttgcggcatgatatcggtagtaatagtaggaacaggtaatgtagcccaaaatctttttcaggcttttgataaagaagccgatgtggagataaaacaggtactaggcagaaacgaaaatcacaaagcatttgccaagtataaaatatcaattaacacagattttaatcagataccctcagcagacatctatattttagcagtatcagatgattctatcagtttagtagctgaaaaatttaaagatatcaaaggattaattgtccatacgtcaggtgcaacctctttagaggtgttaaatgaatgtaaacgatctggaattttttatcctttacagacattcacaacgggtaaaatcattttatttgatgatattcctatatgtattgaagcgaaatatgaaaaggatcttgaacttttgcggaaattaggaaaaacgctaagcnatacagttactgagtag

SEQ ID NO: 25810 - protein, 155 aa, Unknown
  Obtained from environmental sample
  misc_feature (1)..(155): Xaa is any amino acid
MYFCGMISVVIVGTGNVAQNLFQAFDKEADVEIKQVLGRNENHKAFAKYKISINTDFNQIPSADIYILAVSDDSISLVAEKFKDIKGLIVHTSGATSLEVLNECKRSGIFYPLQTFTTGKIILFDDIPICIEAKYEKDLELLRKLGKTLSXTVTE

SEQ ID NO: 25811 - DNA, 738 bp, Unknown
  Obtained from environmental sample
  misc_feature (1)..(738): n is a, c, g, or t
atgagtataagattgagattttataatttcattattcccaaaagaacaatagataaaaaatataaaggaggactaaactcttttaaaataaattgtcctaatagaactttcgaagaagataacgacttggttagtctagggtttatgaacccaatggatgtaaagtggttctgtcatgtattaaaaaaaaatggtttgcagtacaatgggaaaacttctgttgattttgtcgtaacaaattctatgtttggcaatttatgggatgtaaaatggcttgaccgagacataaattattgttggctgaaaggaaaattccccacacacaccaatacgtttattcctaagtttaaaaaacataaagtttttgaagaaaaatccgaaatagcaatgtggtggaataatttgaatgatgcttggaaaaatatactttattacaatcatatcataacaggtgaggataaaataaaaaatcttcataacaaattttccttcgggtataccattgaatatattggaaacataactttagacgacattcagaaaatatttgacattgaagaaatttgggctaatgcgagtaattgcgacgatttagctaggcttggagacttgtatcccataaaaaatttacaaagattacaatcacttacattgcgaagtaacgatctaacatctttaaaaggcctagaatatttagaaaaattaaattccttgaatacgaggacatttctgatatga

SEQ ID NO: 25812 - protein, 245 aa, Unknown
  Obtained from environmental sample
  misc_feature (1)..(245): Xaa is any amino acid
MSIRLRFYNFIIPKRTIDKKYKGGLNSFKINCPNRTFEEDNDLVSLGFMNPMDVKWFCHVLKKNGLQYNGKTSVDFVVTNSMFGNLWDVKWLDRDINYCWLKGKFPTHTNTFIPKFKKHKVFEEKSEIAMWWNNLNDAWKNILYYNHIITGEDKIKNLHNKFSFGYTIEYIGNITLDDIQKIFDIEEIWANASNCDDLARLGDLYPIKNLQRLQSLTLRSNDLTSLKGLEYLEKLNSLNTRTFLI

SEQ ID NO: 25813 - DNA, 810 bp, Unknown
  Obtained from environmental sample
  misc_feature (1)..(810): n is a, c, g, or t
atgaaatacctcagatactttttacttacaaccattttccttatttcgtgtaaagataaaacaacctctattcttccaaaaacaaagactgaaagtagtataaaatacgccaccggtttcgacatcattatacacgaaggcaaaaagaaattgattattaagaaaccttatcaaaatgcaaaaaaaccatttacttactttcttacagacacaacagatgtgcctaaaaacagtattaaagttcctttaaaaaacgtagtagttacaagtactacccatattgcaatgctagaactacttcatgtagaacacttgttagttggctttccacaaacaaggtttatttcatcaaaaaaaaccagacaacgcgttaacagtggtgctattgtagagttgggaagtgaacaaacaatgaatacagaaaaacttatagaattagcacctaaacttatagtaggcttcggattaaacggaaatagtaaggtctataaaacagctaanagaaacgggataccggtactttataatggtgattggttagaagaaacacctttgggccgtgcagaatggattaaattttttggagtattatttggtaaaagaaaagaagcagatagtatctttaagtctattgaaactaattattttaaaagtaaaagaattagcgctacaaacaaaagaaatacttactggtgctctctgggcaatttatttaaagattgtttggtacatgccctgcggggagaaaggttttattgcctaattatttttagggatgccaaacccccaaattattttatgggcaggaca

SEQ ID NO: 25814 - protein, 270 aa, Unknown
  Obtained from environmental sample
  misc_feature (1)..(270): Xaa is any amino acid
MKYLRYFLLTTIFLISCKDKTTSILPKTKTESSIKYATGFDIIIHEGKKKLIIKKPYQNAKKPFTYFLTDTTDVPKNSIKVPLKNVVVTSTTHIAMLELLHVEHLLVGFPQTRFISSKKTRQRVNSGAIVELGSEQTMNTEKLIELAPKLIVGFGLNGNSKVYKTAXRNGIPVLYNGDWLEETPLGRAEWIKFFGVLFGKRKEADSIFKSIETNYFKSKRISATNKRNTYWCSLGNLFKDCLVHALRGERFYCLIIFRDAKPPNYFMGRT

SEQ ID NO: 25815 - DNA, 636 bp, Unknown
  Obtained from environmental sample
  misc_feature (1)..(636): n is a, c, g, or t
ttggatggaaccataacggttagtgatttttctgtccttatttcgaataaggaaaatagtttagtgcatacaaaagtaacggttgataagctcattgttgaaaatgtaagctattgggattatttagtaaattctaaaatccatattgaggatattaaaattaaatcaccctccattttttattacacgcacaaacaaattaaaaatgaggattccacgtcatcttcgggtccagtaaaactctataagcccctttttgtcgatgcattaagtataaataatgctatgcttcatatatatgatgaggaaaaagattctttggttttatatgttgaaaacagcacgataaatatcagtgatataatgatggataaagacattattaaccgccgattaccagttgagtttaaaaagtataaagcgagtgcagattctatatttgtaaaaacaaatgcttatgaaaatctaacggtaagcgattttaatttagaagatgatagagcagttttcaacactattaaattgaaaacaaagtattcaagaactgaattatctcaaataattttaaccgaaagagatcattttgatttagaagtgaaaaaattcactatagatgacattaaattttggctttaa

SEQ ID NO: 25816 - protein, 211 aa, Unknown
  Obtained from environmental sample
  misc_feature (1)..(211): Xaa is any amino acid
MDGTITVSDFSVLISNKENSLVHTKVTVDKLIVENVSYWDYLVNSKIHIEDIKIKSPSIFYYTHKQIKNEDSTSSSGPVKLYKPLFVDALSINNAMLHIYDEEKDSLVLYVENSTINISDIMMDKDIINRRLPVEFKKYKASADSIFVKTNAYENLTVSDFNLEDDRAVFNTIKLKTKYSRTELSQIILTERDHFDLEVKKFTIDDIKFWL

SEQ ID NO: 25817 - DNA, 792 bp, Unknown
  Obtained from environmental sample
  misc_feature (1)..(792): n is a, c, g, or t
atgagtgaaccaaaattatctgaaaggataactaatgatgacggatccattaaatgggttaataaaaaagccgacaccatagtaaatcttccaaataactcaataataattggtgaaccaggatgtggtaaatctactttatttaaaactctatcaaatgagattattactcaaaattctttaagaaacaaccaagatttttatccaatcattctaacgtttaaggaaattgaattatcaaagttcaatcttgaaaacacaattgaagattttttcaacagagattggaatgaagatttaaacattgattctcaagaaatattaaagactgaaaattgtgcgatttttattgatgctcttgatgaattagcaaaaaaagaatccaaagaaagtgcattaaatgcagtttctgaattcaatattaaatacccaaatgttaaggttatttgctcttctagaccttctgattacctttttcataattgcgagacaattgggtttagatatatggaaataagtgcattgaatagacagcaaatagaaatatttttaaataattattttagtgacaacttaacaaaatctaaatcattaatcaaatcattaaaagattcagaaattttagaaaaacttccaaaaactccattaacgattgcattaataacaatgttatttgatgaaaaggaaatagagattcctgcaaccataacagatttatatgaacttttcgtaaaccttctaattggaaaactacatcaaccgaaactaccgaacttatcgaggttggattaa

SEQ ID NO: 25818 - protein, 263 aa, Unknown
  Obtained from environmental sample
  DOMAIN (32)...(191): NACHT domain
  misc_feature (1)..(263): Xaa is any amino acid
MSEPKLSERITNDDGSIKWVNKKADTIVNLPNNSIIIGEPGCGKSTLFKTLSNEIITQNSLRNNQDFYPIILTFKEIELSKFNLENTIEDFFNRDWNEDLNIDSQEILKTENCAIFIDALDELAKKESKESALNAVSEFNIKYPNVKVICSSRPSDYLFHNCETIGFRYMEISALNRQQIEIFLNNYFSDNLTKSKSLIKSLKDSEILEKLPKTPLTIALITMLFDEKEIEIPATITDLYELFVNLLIGKLHQPKLPNLSRLD

SEQ ID NO: 25819 - DNA, 366 bp, Unknown
  Obtained from environmental sample
  misc_feature (1)..(366): n is a, c, g, or t
atgttattaaaaggtagagaagaacagtttttaaatgctgataaaagaaaagaacaaattgttttttttgatagaggaattcctgatgtacatgcttatatgaactattttaagacagcttatcctgatttatatttagaaaaaagcaaagcatataaatacaccaaaatttttcatttttctccttgggaagagattcacacaactgataatgagcgttatgaaacttttgaagaatcgttaactatcgataaattcttgttacaagcttattcagaattgggatacacaattataaatgttccttttggcactattgaagaacgtactaactttattctaaattcgctttcttgcgatttatga

SEQ ID NO: 25820 - protein, 121 aa, Unknown
  Obtained from environmental sample
  misc_feature (1)..(121): Xaa is any amino acid
MLLKGREEQFLNADKRKEQIVFFDRGIPDVHAYMNYFKTAYPDLYLEKSKAYKYTKIFHFSPWEEIHTTDNERYETFEESLTIDKFLLQAYSELGYTIINVPFGTIEERTNFILNSLSCDL

SEQ ID NO: 25821 - DNA, 444 bp, Unknown
  Obtained from environmental sample
  misc_feature (1)..(444): n is a, c, g, or t
ttgtttacgattaatgatttagaaataaaacaagaggcatttgtagcttatattataaatagaaataattctcctgtgtacgaactttttaatgagtttaaagacaaagagattttaagttattacaaagaaaacttagaaaaaactgaaccagaatttgcttatactttacaagaatatagagatggcttgttgttatttgaattgatgcaacaaaaaatatgggaaaaatcatctaaagatactttaggattaaaaaaccattatgatgccaatttatctaaatttcaaaataaagaatttaataaaataaaaggtgaggtaatgaacgattaccaaaatgttttagaagaaaagtggattgcagatttaagaagtaaaagtactattgacgttaataatagagaacttaaaaaattaattaaattttatagaaaagagtaa

SEQ ID NO: 25822 - protein, 147 aa, Unknown
  Obtained from environmental sample
  misc_feature (1)..(147): Xaa is any amino acid
MFTINDLEIKQEAFVAYIINRNNSPVYELFNEFKDKEILSYYKENLEKTEPEFAYTLQEYRDGLLLFELMQQKIWEKSSKDTLGLKNHYDANLSKFQNKEFNKIKGEVMNDYQNVLEEKWIADLRSKSTIDVNNRELKKLIKFYRKE

SEQ ID NO: 25823 - DNA, 645 bp, Unknown
  Obtained from environmental sample
  misc_feature (1)..(645): n is a, c, g, or t
ttgtctaaaagaaaactgaacaattggtatttaaacgaggagtatattaagattatatataaggagataatggaaagcgatgtatatgctacctatatgtccactgccactagtacatacgatgaggataaaaagctggttttagatctgtttcgagagatcattgctcctaacgaaaagatttatgattattttgaagatgataaattaacctgggtagatgatattcccatcgtaaatacttatctcttaaagcagtttaaaaaagtaaaggaaagtagtgttccatcttattttttaccacccctttttaaggatgaggatgatatggtgtatgccaatagacttttgacgaaaacgctactgaacaatgcgaaattggaaaatgagatcgaaggtaaaaccccgaattgggataaagataggattgccgatattgatgccatattattaaaaatggcaatttgtgagttacttaactttccatcgataccggagagagttaccataaacgagtttttagaaattgccaaggaatattcaacacctaaaagtagcatattcatcaatggaatattggataagttggtaagggagtataaggaggccggcaaactaaaaaaagtgggtagaggtttattgtaa

SEQ ID NO: 25824 - protein, 214 aa, Unknown
  Obtained from environmental sample
  DOMAIN (41)...(200): NusB family
  misc_feature (1)..(214): Xaa is any amino acid
MSKRKLNNWYLNEEYIKIIYKEIMESDVYATYMSTATSTYDEDKKLVLDLFREIIAPNEKIYDYFEDDKLTWVDDIPIVNTYLLKQFKKVKESSVPSYFLPPLFKDEDDMVYANRLLTKTLLNNAKLENEIEGKTPNWDKDRIADIDAILLKMAICELLNFPSIPERVTINEFLEIAKEYSTPKSSIFINGILDKLVREYKEAGKLKKVGRGLL

SEQ ID NO: 25825 - DNA, 495 bp, Unknown
  Obtained from environmental sample
  misc_feature (1)..(495): n is a, c, g, or t
ttgcaagtgaatgaatcaataagtgcggtgaatcagagggctcttgtgagattgctattaattgaaggtttagtaaacttaatattggctttagaggtagtactacatgaaaccgaaaatgatacctccataatttgtaaaggtaaccttaaagtttttgaaattaatgcgattagagaattgtctgaatacataaacactaacccagatttaaacttatctgtaaaagagtggagtgctaaaataggggtaagatcttcaaaagtacaagaagggttcaaattaatgcacggtaaaacccttaatgaatatgtgcgttatgtaagagttaaaaagtctgaagaactcattaaaactacagatcttaatatttctgaaatagtatacagtttgggtttatccagtagaagttacttttcgtatatatttaagaatatgtataactgttctccaagtgagtatatgaagaaaaataggttagctgcaacagcttag

SEQ ID NO: 25826 - protein, 164 aa, Unknown
  Obtained from environmental sample
  DOMAIN (114)...(156): Bacterial regulatory helix-turn-helix proteins, AraC family
  misc_feature (1)..(164): Xaa is any amino acid
MQVNESISAVNQRALVRLLLIEGLVNLILALEVVLHETENDTSIICKGNLKVFEINAIRELSEYINTNPDLNLSVKEWSAKIGVRSSKVQEGFKLMHGKTLNEYVRYVRVKKSEELIKTTDLNISEIVYSLGLSSRSYFSYIFKNMYNCSPSEYMKKNRLAATA

SEQ ID NO: 25827 - DNA, 399 bp, Unknown
  Obtained from environmental sample
  misc_feature (1)..(399): n is a, c, g, or t
atgaaaacgatagaaattaaagcgtcaaatacagaagtattatttaattctttacagaaggaaattggtggtgaattaaaagtaatacttaaagaatatgtattattatttaataatgaattgggaattggaacagtaagaggtatggggcttccaaatggaatcgcatttatacaatttgatgcagaattcaaagaaaatattaaaataagtattaatagtcctaaaaattctataattaattttatgtattgtaaccaaggagagttagcacattcctttgggttaaatgagaaaaatgtgggtttagaaacctaccaaaatggtatctctgcaaatataagaacctatgaaaatattctgtatttccaaaaagctattagagtagatgcggtttaa

SEQ ID NO: 25828 - protein, 132 aa, Unknown
  Obtained from environmental sample
  misc_feature (1)..(132): Xaa is any amino acid
MKTIEIKASNTEVLFNSLQKEIGGELKVILKEYVLLFNNELGIGTVRGMGLPNGIAFIQFDAEFKENIKISINSPKNSIINFMYCNQGELAHSFGLNEKNVGLETYQNGISANIRTYENILYFQKAIRVDAV

SEQ ID NO: 25829 - DNA, 462 bp, Unknown
  Obtained from environmental sample
  misc_feature (1)..(462): n is a, c, g, or t
ttgattcctttatttattcataacataaaaaatattgaatctttacctgtttatggagatggtccgtataccagagattggctttttgtagaagaccatgccaaagcaattgatctaattttccataatggaaaaaataacgaaacctataatatcggagggtttaatgaatggacaaatctcaacttaattcatttgctgtgtgagcaaatggatgagaagttaaatcggtctaaagggacttcagctaaattgataacatacgttaaagacagagctggacatgataggcgttatgccatagatgcaacaaaattgaacaaagatcttggctggaaaccatctgttacttttgaagagggcctttcaaaaacgattgattggtatttagaaaatgaaacatggctaaataatgtaacgtcaggtgcgtataaggagtattacgagaaaatgtatggataa

SEQ ID NO: 25830 - protein, 153 aa, Unknown
  Obtained from environmental sample
  DOMAIN (1)...(133): NAD dependent epimerase/dehydratase family
  misc_feature (1)..(153): Xaa is any amino acid
MIPLFIHNIKNIESLPVYGDGPYTRDWLFVEDHAKAIDLIFHNGKNNETYNIGGFNEWTNLNLIHLLCEQMDEKLNRSKGTSAKLITYVKDRAGHDRRYAIDATKLNKDLGWKPSVTFEEGLSKTIDWYLENETWLNNVTSGAYKEYYEKMYG

SEQ ID NO: 25831 - DNA, 309 bp, Unknown
  Obtained from environmental sample
  misc_feature (1)..(309): n is a, c, g, or t
ttgccaatcaaaatcactttctacttgtttataaaacaggtcaagacgtgtatccaaaaaatcatcattcaacaagacgtcatcaatacctcctttagaagaatgataattaaaaaatcctccgaaatcattatatcttgtactatttgtatgcacaaaagcctcaatttgtggggtagaaaaattcccaaatccggcagtaataaaattatcataaaccggtgcactgggtctactctcaatactttagccttccctttagctggagtgaacgtgagctaccgaatctcgaccgatcttgatccatag

SEQ ID NO: 25832 - protein, 102 aa, Unknown
  Obtained from environmental sample
  misc_feature (1)..(102): Xaa is any amino acid
MPIKITFYLFIKQVKTCIQKIIIQQDVINTSFRRMIIKKSSEIIISCTICMHKSLNLWGRKIPKSGSNKIIINRCTGSTLNTLAFPLAGVNVSYRISTDLDP

SEQ ID NO: 25833 - DNA, 609 bp, Unknown
  Obtained from environmental sample
  misc_feature (1)..(609): n is a, c, g, or t
atgaaaaaaataaccacacttctaatccttttcacctcaataatttcattttcacaagaaattacaggagatgaattattacaaaaagcaattcaatttcatgatccaaatggaaattgggaaacctttaaaggcgaactttttgtaactatggaaactcctaaaaatggagatagagttagtataattaatattgatttaccaaagcaatacttttctgtttctgcaaaaagagatactgttatcactgaatatattgttgataaaaatgaggttcgtttttcttttaatggtgataaaaatccatcagaagcaattaaaaagaaatataatttaactgatgatcgtgcaaatatgtataaaaattactatacatatttatatggtttgccaatgaaattaaaagatgaaggcacagtaattcatcaaaaagtagaaagaaaaacgtttaaaggacaagaatatttggttttaaaaagcacctataatcaagaagttggtaaagatacttggtacttttattttgatccaaaaacgtttggcatggaaatttaccacttctttaaagaagcaaaagatagtggagaatatatttattatcagaattga

SEQ ID NO: 25834 - protein, 202 aa, Unknown
  Obtained from environmental sample
  SIGNAL (1)...(18)
  misc_feature (1)..(202): Xaa is any amino acid
MKKITTLLILFTSIISFSQEITGDELLQKAIQFHDPNGNWETFKGELFVTMETPKNGDRVSIINIDLPKQYFSVSAKRDTVITEYIVDKNEVRFSFNGDKNPSEAIKKKYNLTDDRANMYKNYYTYLYGLPMKLKDEGTVIHQKVERKTFKGQEYLVLKSTYNQEVGKDTWYFYFDPKTFGMEIYHFFKEAKDSGEYIYYQN

SEQ ID NO: 25835 - DNA, 312 bp, Unknown
  Obtained from environmental sample
  misc_feature (1)..(312): n is a, c, g, or t
atgaacaaatacattgttgtcaatcaaccagaaaaatggcatttttcgattgagaatattacggtaatttcatcgcaagattatcttaccaatcctaaattttcgcttttaaaaaaagcaagaatatttaatctttgcaaagattatagttaccaatccaaaggttactacgtctcgcttttagccgaagctagaggtcatttagccattccaacagtaagaaacattgtagatttaaaaacacttaaactagtcaaaatagtttccgacgagtttgacgatgttatacaagcaaagcctaaaaagcattaa

SEQ ID NO: 25836 - protein, 103 aa, Unknown
  Obtained from environmental sample
  misc_feature (1)..(103): Xaa is any amino acid
MNKYIVVNQPEKWHFSIENITVISSQDYLTNPKFSLLKKARIFNLCKDYSYQSKGYYVSLLAEARGHLAIPTVRNIVDLKTLKLVKIVSDEFDDVIQAKPKKH

SEQ ID NO: 25837 - DNA, 303 bp, Unknown
  Obtained from environmental sample
  misc_feature (1)..(303): n is a, c, g, or t
ttgacgatgttatacaagcaaagcctaaaaagcattaagtctagagagtttactttaagtatatactttggtcaaaatgtggcacaaaaatataaagagctaagtagtttgttttacaaacattttcaagttccttttttacgcgtaaaatttcatcataataataagtggaatatacaaagtattaaagctatttcagaatcagaaatccctagtgatcatcttgaaagtgtcaacctttttgctaatcagtattttgctcaaaaacgttacgacacacctaaaataacaaatcagatttga

SEQ ID NO: 25838 - protein, 100 aa, Unknown
  Obtained from environmental sample
  misc_feature (1)..(100): Xaa is any amino acid
MTMLYKQSLKSIKSREFTLSIYFGQNVAQKYKELSSLFYKHFQVPFLRVKFHHNNKWNIQSIKAISESEIPSDHLESVNLFANQYFAQKRYDTPKITNQI

SEQ ID NO: 25839 - DNA, 867 bp, Unknown
  Obtained from environmental sample
  misc_feature (1)..(867): n is a, c, g, or t
gtggatatattacttactaaaaaaatggtaaataactttctgatatcgagaacggattctatcgcttggagcaatgaattggttggacatgttgttgaaattaaaacgaatggaccaactaacgatttaaataatcttgcagaagcatttcatcaaaacatcatagaaataaatggtttattaaaacctttaaatacaaaactactacctacagcgtctcatcctacaatgaatcccttaaaggacacacaactatggaaacacagttatagtgaagtttacgagttgtacaacaggatttttgattgtaaaggtcatggttggagtaatgtgcaaagtacacacattaacttacccttttatgatgataaagagtttgaaaaattacatgctgccatcaggataatattacccttaattcctggtctatgtgcaagttcgccaattttagatggtaaaattacaggatttaaagacactagattagaatattataaaaccaatcaaaaagaaattccagaaatgactggattggttataccagagcgtgtttttacaaaagcggattactacgctaccatttttaaacccataaaacaagtcattaaaaagtatgacacaaataatattttagatcatcattttttaaatagtcgtggtgcaattgcaaggtttgatcgaaatgctatagaaattagactagtcgacattcaagagtgtccaaaagctgacattgctatttgcgcattaataattgaagtcttaaagcttttagctaatgaagatacaacaagtcttaaaaagcaaaaaaaatggttaaagcaggatnttgttttctatttaaaccagtctcgaccgaattcttga

SEQ ID NO: 25840 - protein, 288 aa, Unknown
  Obtained from environmental sample
  DOMAIN (1)...(271): Glutamate-cysteine ligase family 2(GCS2)
  misc_feature (1)..(288): Xaa is any amino acid
MDILLTKKMVNNFLISRTDSIAWSNELVGHVVEIKTNGPTNDLNNLAEAFHQNIIEINGLLKPLNTKLLPTASHPTMNPLKDTQLWKHSYSEVYELYNRIFDCKGHGWSNVQSTHINLPFYDDKEFEKLHAAIRIILPLIPGLCASSPILDGKITGFKDTRLEYYKTNQKEIPEMTGLVIPERVFTKADYYATIFKPIKQVIKKYDTNNILDHHFLNSRGAIARFDRNAIEIRLVDIQECPKADIAICALIIEVLKLLANEDTTSLKKQKKWLKQDXVFYLNQSRPNS

SEQ ID NO: 25841 - DNA, 750 bp, Unknown
  Obtained from environmental sample
  misc_feature (1)..(750): n is a, c, g, or t
atgctgcagcatacaaacatgtaccatgtttggaaaaacacccatcgngaagctatttttgctaacataatgggatcaaaaaatgtagcggatttatcttataaatttaaatcagaaaaatttgtcatggtctctacagataaggctgttaacccaagtaacgtaatgggagcctcaaaacgtattgccgagatttatgtccaagccttacaggttaaagctatggcagatcctaaaaacaaaactaactttgtaaccactagatttggaaatgttttgggtagtaatggctctgttgtaccattatttaaaagacaaattgaagaaggtggacctttaacaataacgcatccagatattattagatattttatgaccataccagaagcttgccaattagttttggaagcaggtgcaatgggtaatggtggagagatttttatctttgatatgggagaagctgttaaaataattgacttggctaaaaaaattattcgtttagcaggttttgtaccttataaagatatcgatattaaagttgttggattaagaccaggagaaaagttgtatgaagagttgttaagcgataaatctacaacattgcctacttacaatagcaaaatcatgattgccaaagtagataactgttctcatacagaaattaacaaagatgtaaatgagttatttattttagctaaagaaggcaataaaaatgaaatcgtaaaacaaatgaaggatattgtaacctga

SEQ ID NO: 25842 - protein, 249 aa, Unknown
  Obtained from environmental sample
  DOMAIN (1)...(246): Polysaccharide biosynthesis protein
  misc_feature (1)..(249): Xaa is any amino acid
MLQHTNMYHVWKNTHREAIFANIMGSKNVADLSYKFKSEKFVMVSTDKAVNPSNVMGASKRIAEIYVQALQVKAMADPKNKTNFVTTRFGNVLGSNGSVVPLFKRQIEEGGPLTITHPDIIRYFMTIPEACQLVLEAGAMGNGGEIFIFDMGEAVKIIDLAKKIIRLAGFVPYKDIDIKVVGLRPGEKLYEELLSDKSTTLPTYNSKIMIAKVDNCSHTEINKDVNELFILAKEGNKNEIVKQMKDIVT

SEQ ID NO: 25843 - DNA, 663 bp, Unknown
  Obtained from environmental sample
  misc_feature (1)..(663): n is a, c, g, or t
ttgcaatacagatcaaattactctgccgatttattgttaatgttagactatggtattttttacgagtttatcccaatggatacatttgggactaaggaccaaaaagtaataccattaagtgaggtacaacttaataaaaactatgcagttgtaattacaactaatgctgggctttggcgttatatgataggtgataccgtaaggtttgtgtctatcagtccatatcgtataaaagtgtcaggacgcacaaaacaccatattaatgtttttggcgaagagttgattattgaaaacgctgaagatgctttaaaaaaagtatgtaaaaagacgaagtcagaaattgtagattacacagcagctccaatatttatggatgggaaagaaaaaggtgcgcatgagtggttaatcgagtttaaaacgcctcctaaggatattaattattttaatgagctgtttgataatgcacttaaaagtctaaactcagactatgaagctaaacgttataataatatgacattaaataaaccaaaaatacacatagctagagagcagttgttttatgattggttaaagcaaaataataagcttggaggccaacacaaagtcccaagactatctaatacgcgtcaatatatggacgagctaatacttttaaatacatag

SEQ ID NO: 25844 - protein, 220 aa, Unknown
  Obtained from environmental sample
  misc_feature (1)..(220): Xaa is any amino acid
MQYRSNYSADLLLMLDYGIFYEFIPMDTFGTKDQKVIPLSEVQLNKNYAVVITTNAGLWRYMIGDTVRFVSISPYRIKVSGRTKHHINVFGEELIIENAEDALKKVCKKTKSEIVDYTAAPIFMDGKEKGAHEWLIEFKTPPKDINYFNELFDNALKSLNSDYEAKRYNNMTLNKPKIHIAREQLFYDWLKQNNKLGGQHKVPRLSNTRQYMDELILLNT

SEQ ID NO: 25845 - DNA, 510 bp, Unknown
  Obtained from environmental sample
  misc_feature (1)..(510): n is a, c, g, or t
atgagtcttcaaatttccaatcaagcgctgaaactttctatttggaataaaacctattaccatatttttcttcctatttcgacaaaaaaagaagtgaataccgattacatgatgcacattttacagggaaaggataaaagcatagtagtttcaaaagcagatttctcaacaggcgaaatgaagcattttttgttgcaggaaaatacagttttaaaaatttcaggatatggaattcccgaacctgtttcgggtattgaaatttcaccagaaatgctggaagtggtttttgttccattattggcttatgaccaaaacgggcatcgcattggctacggaaaaggtttttatgatcggtttttgaaaaaatgcagtacaaccgcattgtttgtaggactttctttttttgaaccagagccagaaatattttttgaggctaccgatgtgcccttaaatttttgcgtcacgccaaaaaaaattctggattttaaaaataactacttacctttatga

SEQ ID NO: 25846 - protein, 169 aa, Unknown
  Obtained from environmental sample
  DOMAIN (2)...(156): 5-formyltetrahydrofolate cyclo-ligase family
  misc_feature (1)..(169): Xaa is any amino acid
MSLQISNQALKLSIWNKTYYHIFLPISTKKEVNTDYMMHILQGKDKSIVVSKADFSTGEMKHFLLQENTVLKISGYGIPEPVSGIEISPEMLEVVFVPLLAYDQNGHRIGYGKGFYDRFLKKCSTTALFVGLSFFEPEPEIFFEATDVPLNFCVTPKKILDFKNNYLPL

SEQ ID NO: 25847 - DNA, 477 bp, Unknown
  Obtained from environmental sample
  misc_feature (1)..(477): n is a, c, g, or t
ttgccagttgtaccaaaaacaattggagagagaattatcgtgaaaaagcaaaaaagtccttttggcacgtatattattcacaaggaagcaaatgaactttttaaagatcaagaagttgtaacccttaaagaaaacttttacgattatctatattataattacgatactacaagtgccgattatggcaattatatttgcatcaaacatacagagtctaaacttactgaagatggtgtaacagacttgttatcttttgtatatgatggaaattcagcctttttatctttaaattattttagtgctgctctgatagaacagttagaaattaccaccaataatttagacaaagatgtctattcagttgatgatttaaaacccttaaaaggcgagttttatctagaagacaacagntttgacaaggatacctttaatttcgatagaaccatcagaagaccattatttcgtaacgtatactga

SEQ ID NO: 25848 - protein, 158 aa, Unknown
  Obtained from environmental sample
  misc_feature (1)..(158): Xaa is any amino acid
MPVVPKTIGERIIVKKQKSPFGTYIIHKEANELFKDQEVVTLKENFYDYLYYNYDTTSADYGNYICIKHTESKLTEDGVTDLLSFVYDGNSAFLSLNYFSAALIEQLEITTNNLDKDVYSVDDLKPLKGEFYLEDNXFDKDTFNFDRTIRRPLFRNVY

SEQ ID NO: 25849 - DNA, 561 bp, Unknown
  Obtained from environmental sample
  misc_feature (1)..(561): n is a, c, g, or t
atgcttattacttacccatgcattatactgagtacagctattatggtagtcatttttatgttgcagtttgttgtgccgatgtttgaggatatttttaaacagcaaaatgtagaattaccagcaattacgatttttgtagtcaatacttctgcttttattaaaaattatggatggttacttcttgtttttttcgtggctataattttatctagagcattattaaataaaaagcaatggtacaaaaagtctaaagatcttataatttctagaattccgtttgttggtagttttgtggaaacggtctacttatcgcaatttacacaagctattgcattgttagcggcttcaaaagtccctattgtgaatagtattaaattagtaaagaagatgattgatttttatccattgaccaatgctttagaaaccgttgaacaacaattattaaaaggagatacattgagtgatagtcttagtcggcacaaattgtttgatgctaatatgatagccttggtaaaagtancgacagaaactaatcagacagaatatatgttgagagattaa

SEQ ID NO: 25850 - protein, 186 aa, Unknown
  Obtained from environmental sample
  misc_feature (1)..(186): Xaa is any amino acid
MLITYPCIILSTAIMVVIFMLQFVVPMFEDIFKQQNVELPAITIFVVNTSAFIKNYGWLLLVFFVAIILSRALLNKKQWYKKSKDLIISRIPFVGSFVETVYLSQFTQAIALLAASKVPIVNSIKLVKKMIDFYPLTNALETVEQQLLKGDTLSDSLSRHKLFDANMIALVKVXTETNQTEYMLRD

SEQ ID NO: 25851 - DNA, 630 bp, Unknown
  Obtained from environmental sample
  misc_feature (1)..(630): n is a, c, g, or t
ttggttaataataaagcatccgaaatgtatgattggaaagacaccttttctaagcttacagcaaaagatggtgtgttttctgtattagggaatcatgattatggtgattacgtagattgggcaacagagcaagataaacatgataatttaaatgaattaaaatctatccagaaagagattggttttgatttattattaaatgaaagtcgttacattgaaaaagatggacaaaaaatagcattagtaggtgtagagaattggggaataggtggttttaaaaaagctggagacttggataaagcgtcaaataatattgcctcagatgattttaaggtattgctatcgcatgatccttcacattgggcagaacaggtaatagaccatagtaatcactatcacttaacgttaagtgggcatacacatggcatgcagtttggaatagaaattccgggttggattaaatggagtcctgttaaatggcgttataaacattgggcaggaatctatacagaaaaagggcaatacattaatgttaatagaggttttggttatttagcttatcctggacgtgtaggaatttggccagaaataacagtcatagaacttaaaaaagggacgcaaattgcttaa

SEQ ID NO: 25852 - protein, 209 aa, Unknown
  Obtained from environmental sample
  misc_feature (1)..(209): Xaa is any amino acid
MVNNKASEMYDWKDTFSKLTAKDGVFSVLGNHDYGDYVDWATEQDKHDNLNELKSIQKEIGFDLLLNESRYIEKDGQKIALVGVENWGIGGFKKAGDLDKASNNIASDDFKVLLSHDPSHWAEQVIDHSNHYHLTLSGHTHGMQFGIEIPGWIKWSPVKWRYKHWAGIYTEKGQYINVNRGFGYLAYPGRVGIWPEITVIELKKGTQIA

SEQ ID NO: 25853 - DNA, 810 bp, Unknown
  Obtained from environmental sample
  misc_feature (1)..(810): n is a, c, g, or t
atgattatggagatggaccgattacaaaagaaagttttaatcggttcaattccagaagaacaaattttaattggagataaaacaagaagattagttgaaaaggaaattggaaaatattccgattttcaattggcacttaagtttcctgaaagagtaaaagaagatattgaaagaaaggcaaaaaacttgggttcgattgctgttcaactacaatgggttgaaggagatgcagaagttgcagaggcttcattttttaaaataaaccagcaagcagcaaaaatagacccaacagagtttaaactaattaaatcacgtaaaaaaccaaatggaattgcttcaagagcaataataaaaggaggtaaaggtcaccaatattggtctaaatttggaaaagaaaaagttgagcaaatagaacaacttgcagaagaaataaacaaatcatttttccttcctaaactcaagaatcctgtaaaaactttagatttaccaattggaggaaaagggtattcaagtcaaagtccattattgatttttgaatacgtaaatatggtcaaccgaatccaagaaattgagaaaatagaagatgatttaatcggagaaaaaactatagaatatcttaaaaacagtaaaaaaatatctaacttaataaatagtactcatccttcttctttaggtttacatccagcagtttatttttactcaaaaggaggtaggcacaagactgcatctttatacgctgttacagatttattaatggatctagaaacacagaaacgcttcacaactttacagattgtagacacgatttga

SEQ ID NO: 25854 - protein, 269 aa, Unknown
  Obtained from environmental sample
  misc_feature (1)..(269): Xaa is any amino acid
MIMEMDRLQKKVLIGSIPEEQILIGDKTRRLVEKEIGKYSDFQLALKFPERVKEDIERKAKNLGSIAVQLQWVEGDAEVAEASFFKINQQAAKIDPTEFKLIKSRKKPNGIASRAIIKGGKGHQYWSKFGKEKVEQIEQLAEEINKSFFLPKLKNPVKTLDLPIGGKGYSSQSPLLIFEYVNMVNRIQEIEKIEDDLIGEKTIEYLKNSKKISNLINSTHPSSLGLHPAVYFYSKGGRHKTASLYAVTDLLMDLETQKRFTTLQIVDTI

SEQ ID NO: 25855 - DNA, 444 bp, Unknown
  Obtained from environmental sample
  misc_feature (1)..(444): n is a, c, g, or t
atgagcgaattagcacaagaatcacaaaccaaaattcttactactaagaattatgatttattcgaattgaccgacattaacagagaccctaagcattcagaaaatgtgaaagaatctattgaaattaaggatctgacagcatacataccaattttggttagacttaatcctaaaactggaaaatacataatctatgatggtcaaggaagatttttggcttgcaaaagtcttaaattacccatttactttgtcataggggaaggattagaagaaaccgacattcatctcttgaatatttcacaagaaaaatggaaaccggacgattatttacgtcactattctaatagaaattatgtagaatatcagaaaattgaaagacttttgtatgaatgtaagcatatgaaaatgggttatattcttcacatatgcaatatcgaattataa

SEQ ID NO: 25856 - protein, 147 aa, Unknown
  Obtained from environmental sample
  misc_feature (1)..(147): Xaa is any amino acid
MSELAQESQTKILTTKNYDLFELTDINRDPKHSENVKESIEIKDLTAYIPILVRLNPKTGKYIIYDGQGRFLACKSLKLPIYFVIGEGLEETDIHLLNISQEKWKPDDYLRHYSNRNYVEYQKIERLLYECKHMKMGYILHICNIEL

SEQ ID NO: 25857 - DNA, 492 bp, Unknown
  Obtained from environmental sample
  misc_feature (1)..(492): n is a, c, g, or t
ttgccgacttcaaaaaacaatattttgatgctctcgaaaaaacacgtcttatccaaagaaaaggcagatgcgtattctaaaaaaatcgcaatccaatgcggcatcaaggaacttgatcaaatagaattcaatgatcaaatctcactgccaaactgccaggtaaccacaccaaaaaaagagatcgatagcattctggaaacaggagcgggcggcaagttgcaggacttttatgattcaaagaacttattgctcttaatgaatatcatcgatttaggattttcaatacaaggcgcttccggtgttcaggtcacgatctcttccgacagncctgtgaaagcaaagtggacgccgtcaaaatctatggcacacttccacccgtnaaagcaggtgtctagggatattctaaaaatgcgcccaatgtgcgtaaagaataggcatacggggttagattgctgccatttatcttcgtattcaccttgggttacttattga

SEQ ID NO: 25858 - protein, 163 aa, Unknown
  Obtained from environmental sample
  misc_feature (1)..(163): Xaa is any amino acid
MPTSKNNILMLSKKHVLSKEKADAYSKKIAIQCGIKELDQIEFNDQISLPNCQVTTPKKEIDSILETGAGGKLQDFYDSKNLLLLMNIIDLGFSIQGASGVQVTISSDXPVKAKWTPSKSMAHFHPXKQVSRDILKMRPMCVKNRHTGLDCCHLSSYSPWVTY

SEQ ID NO: 25859 - DNA, 717 bp, Unknown
  Obtained from environmental sample
  misc_feature (1)..(717): n is a, c, g, or t
gtggcaacatcttattcaatccagaacactaaggttttaaataccgctgttttttttcaagcttcagcctgggctacttcaggaaaattatatattccgttttatagacaggcccatatacgatattactcgaaccttgaaaatggcgggaaagaagcattactgttggcttatgaagatataaaagaatcattcgaagtatatttaagaaagtataacaatggaagaccaatcattattgcaggtcatagccagggtatcacacattgtagattactgctaaaagattttttcgatgacaaaccgcttcaagaaaaacttattgcagcatatattccaggtattggtattcataaggatgagtttaaaacgattctaattatgacaaaaccagaagaaacaggtggatttgtttcatggaatactttcacaaaaaacagattacccaagaaatatgaaagttggtataaagataaagttacttcgaatccaattacatggaatgaaactaaaaacacaaaacgagaagatcataaaggatttttatacagcaatggtagaatatataataaagcgttgaaacttgaaataatgaatggaatggtttggaccactttaccaagatttccacacaggttgttcactgttttaacgaaaaggtatcatattggtgacgtaaatctatcttgggcagactttaacaaaattcagaactaa

SEQ ID NO: 25860 - protein, 238 aa, Unknown
  Obtained from environmental sample
  misc_feature (1)..(238): Xaa is any amino acid
MATSYSIQNTKVLNTAVFFQASAWATSGKLYIPFYRQAHIRYYSNLENGGKEALLLAYEDIKESFEVYLRKYNNGRPIIIAGHSQGITHCRLLLKDFFDDKPLQEKLIAAYIPGIGIHKDEFKTILIMTKPEETGGFVSWNTFTKNRLPKKYESWYKDKVTSNPITWNETKNTKREDHKGFLYSNGRIYNKALKLEIMNGMVWTTLPRFPHRLFTVLTKRYHIGDVNLSWADFNKIQN

SEQ ID NO: 25861 - DNA, 477 bp, Unknown
  Obtained from environmental sample
  misc_feature (1)..(477): n is a, c, g, or t
atggaaaataaaggtcaaataattgcgatggatatttacgaaagtaagcttcgtaaattaaaagtaagggcaaaaagaaataaagctcataatatagatatgcgtgtaattgattctaccaaaccaattaaaaaattacatggaaaagcagatagagttttaattgatgctccttgttctggtttaggtgtaattcgtagaaacccagattctaaatggaaattacaaccagaatttatagataatattaaaaaagttcaacaagatgtgttgcaacaatattctaaaatggtaaaaccaggaggtaaaatggtatatgcaacttgctctattttaccatcagaaaatcaagatcaagttaataatttcttaacatcagaagcaggaaaagactttacttttgtaagtgataaaaaagtgcttgctcatgtttctggttttgatggattttatatggcacttttagaaaaaaaataa

SEQ ID NO: 25862 - protein, 158 aa, Unknown
  Obtained from environmental sample
  DOMAIN (1)...(156): NOL1/NOP2/sun family
  misc_feature (1)..(158): Xaa is any amino acid
MENKGQIIAMDIYESKLRKLKVRAKRNKAHNIDMRVIDSTKPIKKLHGKADRVLIDAPCSGLGVIRRNPDSKWKLQPEFIDNIKKVQQDVLQQYSKMVKPGGKMVYATCSILPSENQDQVNNFLTSEAGKDFTFVSDKKVLAHVSGFDGFYMALLEKK

SEQ ID NO: 25863 - DNA, 597 bp, Unknown
  Obtained from environmental sample
  misc_feature (1)..(597): n is a, c, g, or t
atgaaagctgcaggtgaacacccagcaagtaaatctcaaaaaggtagaattgctggagattttttaatttcaatagcagattctattcgagttcataatggagacaccaattttggagcgccactaaattttaatggcgatgatccaattggtttatttaaaaataacgtcttaatagatattattggcacttacaatagtgggcaaatagagtttggaactgataaaaccttaagaagaaaaaaaaatattacagcaccaaacaccaattttgatttaacaaacgaatgggatatttttgacaaagacaatgcagatgattttggacaacataatgcaattgtgctatcaactaattctttttcaaaagatgatattcaattttacccaaatcctgtaggcgatattttaaacattactaataattcaaatagtaaaataaaaaatatagcaatttataatatgttaggtaaaaaagttttttacaaaccaaaccctaatcataatattaacgttaaaaaaatatcaaaaggaatctatatgcttacttttgaagtcgaaaataaaatgtataaatcaaaattaattaaatattag

SEQ ID NO: 25864 - protein, 198 aa, Unknown
  Obtained from environmental sample
  misc_feature (1)..(198): Xaa is any amino acid
MKAAGEHPASKSQKGRIAGDFLISIADSIRVHNGDTNFGAPLNFNGDDPIGLFKNNVLIDIIGTYNSGQIEFGTDKTLRRKKNITAPNTNFDLTNEWDIFDKDNADDFGQHNAIVLSTNSFSKDDIQFYPNPVGDILNITNNSNSKIKNIAIYNMLGKKVFYKPNPNHNINVKKISKGIYMLTFEVENKMYKSKLIKY

SEQ ID NO: 25865 - DNA, 516 bp, Unknown
  Obtained from environmental sample
  misc_feature (1)..(516): n is a, c, g, or t
atgaaaaaaattataatagcacttgcaacaactctagtctttggttgtaaaaaccccaaaacagataacggcaagcttaatatagtaaccacaaccacaatgataacagacctcgtacaaaacatcggtggcaattatgttaatattgaaggattgatgggtagtggtgtagacccgcatttatacaaagccagtgaaggcgatgttacaaagttagtgaatgctgatatcattttttataacggattacatttagaaggaaaactggttgaggttttcgaaaaaatggaaagtgcccataaaacaccaatcgctttgtccgatgctatagataaaagcacacttattggttcagattattttgcttcaaattacgatccgcacgtatggtttaatatcgcttattttaaattattttcacaaaaggtgactagcgtattatctgaaaaagatccagaaaacgccaatagttataaagaaaacgaaacaaagtatctagagcaattagaagtttag

SEQ ID NO: 25866 - protein, 171 aa, Unknown
  Obtained from environmental sample
  SIGNAL (1)...(15)
  DOMAIN (4)...(170): Periplasmic solute binding protein family
  misc_feature (1)..(171): Xaa is any amino acid
MKKIIIALATTLVFGCKNPKTDNGKLNIVTTTTMITDLVQNIGGNYVNIEGLMGSGVDPHLYKASEGDVTKLVNADIIFYNGLHLEGKLVEVFEKMESAHKTPIALSDAIDKSTLIGSDYFASNYDPHVWFNIAYFKLFSQKVTSVLSEKDPENANSYKENETKYLEQLEV

SEQ ID NO: 25867 - DNA, 588 bp, Unknown
  Obtained from environmental sample
  misc_feature (1)..(588): n is a, c, g, or t
ttgaaaaaaactatcgtaatattattaattttcataagttgttcttcgaccaaagaagtcaactcaataaaatctattattaaaaaagtagagaaaattgaaaagaacatacctgtattagaaaaggaaattataagcttagagaatctttattcttttgaatttgggaattatgcaacttcctttaaagataaatcagaaatacgaaaaattgaatataacctctcaagttggtcttatacatcctttaataaagataatattgctgaactttttcgtatgagatatagggaagatttaatttcaatagtcggagaaatatatttgtatgagaataagccaattttaataaaggaaaaaataactcgtgacccagcattattgatgagtccacctaaaaatatacaaactggcgaagttagaagttatacacaggttattaatcaggatgaggagtctattatttacattcagaactgggacaaaagcgaaataatcatagaaaatttattcgggtccttcactaaatgggactttaaaaaagatttttacaacgacattattgaggaagtgaaaaaaccgaagtga

SEQ ID NO: 25868 - protein, 195 aa, Unknown
  Obtained from environmental sample
  SIGNAL (1)...(18)
  misc_feature (1)..(195): Xaa is any amino acid
MKKTIVILLIFISCSSTKEVNSIKSIIKKVEKIEKNIPVLEKEIISLENLYSFEFGNYATSFKDKSEIRKIEYNLSSWSYTSFNKDNIAELFRMRYREDLISIVGEIYLYENKPILIKEKITRDPALLMSPPKNIQTGEVRSYTQVINQDEESIIYIQNWDKSEIIIENLFGSFTKWDFKKDFYNDIIEEVKKPK

SEQ ID NO: 25869 - DNA, 555 bp, Unknown
  Obtained from environmental sample
  misc_feature (1)..(555): n is a, c, g, or t
ttgtctggacacaaagcatatttatttagagaagagataaaagatcaagatatggatgcttttataacaaatagagaagatgattttaatgatatagaaatttccgattacgaaacaaaaaacattgatacttatgaaggtaatgtaagtgaatcttttaccttttatcaagaagatggagccgaaattttaaataataaaatttattttcatccattaatgtttattcgaatgaacgaaaacccgtttaagctagataaaagagagtatccaatcgattttggatttccatttaaagatatgtacattgtaaatgtggatattcctgaaggttatgagctagaatcacaacttgaacctttcatggctcgatctccagatggaaacgtagaatttaaatatagcgtttcagttatgaataataaattaagattatctgcaatatttgatattaaagaagccaaacatggtgctgaatcatatttaataattaaagaaatttttaaccaagtaatatctaaagaagcagaacaagtcgttctcaaaaaaatataa

SEQ ID NO: 25870 - protein, 184 aa, Unknown
  Obtained from environmental sample
  misc_feature (1)..(184): Xaa is any amino acid
MSGHKAYLFREEIKDQDMDAFITNREDDFNDIEISDYETKNIDTYEGNVSESFTFYQEDGAEILNNKIYFHPLMFIRMNENPFKLDKREYPIDFGFPFKDMYIVNVDIPEGYELESQLEPFMARSPDGNVEFKYSVSVMNNKLRLSAIFDIKEAKHGAESYLIIKEIFNQVISKEAEQVVLKKI

SEQ ID NO: 25871 - DNA, 732 bp, Unknown
  Obtained from environmental sample
  misc_feature (1)..(732): n is a, c, g, or t
atgcaacaagcggttgaagataaaaccgtaaccccacttttgtatgaagagcgtataccagagctaaacgttaacgacaaagccattgatgcgtggtttgaacgcagtaccagtaagctgagcgacaaacaaaaaaccgatttaaaaagaaagttttcgcaaaaaggtcagatttatcaaactgccgatcgcattatgttaattgcctatgatattgccgaccattttcaaaactttaagcatcaaggtttaaaaggtcaattagcctgtgactctaaagcctctgcaatacgttataaagaggctttagataaaattggcaccgtgacatcagttgttgcaatgtcggctcctgacacgcgtgaggggcatgatgtagttgatcaagaaagcaaagacattgtacaaaattggtggaaagccaatgttgataaaatggatgaaaaagcctacaccaaagccattattgaagactttggcagagatgacggccctgacatcatgatagtggttgataaactgctaacgggctttgatgagccaaagaacaccgtactgtatattgataaacctctaaaagaacataaccttattcaagccattgcccgtgtaaaccgtttacatagcaaaaagcagtttggttacttaattgattaccgaggcattttaaaagagcttgataccaccattgaaaagtaccaagacttgcggagcgtacccatgcggctttga

SEQ ID NO: 25872 - protein, 243 aa, Unknown
  Obtained from environmental sample
  misc_feature (1)..(243): Xaa is any amino acid
MQQAVEDKTVTPLLYEERIPELNVNDKAIDAWFERSTSKLSDKQKTDLKRKFSQKGQIYQTADRIMLIAYDIADHFQNFKHQGLKGQLACDSKASAIRYKEALDKIGTVTSVVAMSAPDTREGHDVVDQESKDIVQNWWKANVDKMDEKAYTKAIIEDFGRDDGPDIMIVVDKLLTGFDEPKNTVLYIDKPLKEHNLIQAIARVNRLHSKKQFGYLIDYRGILKELDTTIEKYQDLRSVPMRL

SEQ ID NO: 25873 - DNA, 696 bp, Unknown
  Obtained from environmental sample
  misc_feature (1)..(696): n is a, c, g, or t
atggttcgcggtgttggaaatccagagtttaaaaatgaaaatccctatgctaacatgccatatccagatgatggttttagattattatcggtttataaatactggaatatgattaattatttttttccttataaacatataatggataaagactggaatgaaagtttaaaagaaaatattccaccatttattaatgctaaaaacgaattagaatatgaattagcagctttaaagatgattgcagacattaaagacactcatgctaatctttggggaggaaaagataaaattaacgaaatacttggtgacaactatccaaatttccatgtttcatttattgaaaacaagctggttatagacaacttttataatgaagacagtcctagaaacggtttaaaaataggagatattattacgcgtattaacggaaaaaaagttgaagacatcgttacagataatcaagatttttatccagcgtcaaaccagccaactcgtttaagagatattagttttaatttattacgtactacaagcaatagcttagatattgaggtagaagataatggtatcaaattaattaaaacaatacctgtatacaacaaaaaagacattaaggacttttacaaatggtacacaaaagaagaaacattagtagttatagactacttaaaaattacttgcctatgttcactctaa

SEQ ID NO: 25874 - protein, 231 aa, Unknown
  Obtained from environmental sample
  misc_feature (1)..(231): Xaa is any amino acid
MVRGVGNPEFKNENPYANMPYPDDGFRLLSVYKYWNMINYFFPYKHIMDKDWNESLKENIPPFINAKNELEYELAALKMIADIKDTHANLWGGKDKINEILGDNYPNFHVSFIENKLVIDNFYNEDSPRNGLKIGDIITRINGKKVEDIVTDNQDFYPASNQPTRLRDISFNLLRTTSNSLDIEVEDNGIKLIKTIPVYNKKDIKDFYKWYTKEETLVVIDYLKITCLCSL

SEQ ID NO: 25875 - DNA, 426 bp, Unknown
  Obtained from environmental sample
  misc_feature (1)..(426): n is a, c, g, or t
atgtattttaaaggggcaaatatgctacatacattacgacaaatagtgaacgatgatgaaaaatggagagctattttaagagggctgaatacaactttctatcaccaaaccgtaactacagggcaagtggaaaattatttaaacgatcaaattagcacagatttaaagccattttttgatcaatatttaagaactgttcaaataccgaagctcgaatatagggtgaataaaaatcaactattctataggtggtctgatgttgtagataattataatattccagttaagattgctattaatgatcaatcacattggatagttccaactgcattatggaaaaaattacgaacaaaagaaaaaattgaagttgtgaccgttaatgaaaacttttacattgtaaatgaggatgttaacattaagaattaa

SEQ ID NO: 25876 - protein, 141 aa, Unknown
  Obtained from environmental sample
  misc_feature (1)..(141): Xaa is any amino acid
MYFKGANMLHTLRQIVNDDEKWRAILRGLNTTFYHQTVTTGQVENYLNDQISTDLKPFFDQYLRTVQIPKLEYRVNKNQLFYRWSDVVDNYNIPVKIAINDQSHWIVPTALWKKLRTKEKIEVVTVNENFYIVNEDVNIKN

SEQ ID NO: 25877 - DNA, 822 bp, Unknown
  Obtained from environmental sample
  misc_feature (1)..(822): n is a, c, g, or t
atgctctcttcctatattataacctacgctatacagttgaataaaatagatgctattcgcaaagattcacgagatctcattataaccaatacaacctatacaaatgcctctatagattttgaagagaccaacaaaaggatcaattcattttttaaagaaaacagatcaaaggttgttgtaattcctggtttcgtagctgctgcacgcaatggagacactacggttttaggaagagggggctcagattttacggcatccgtagtagcggcagaagtagatgcaaccatacttgaaatttggacagatgtaagtggtatgtatactgccaatcccaaactagtcagtcaggcgactccaatagaaataatttcttatgaggaagctatggaattgtcccattttggtgcaaaggttatttacccaccaaccattcacccagtattaaaaaaggaaatacctattcgtattaaaaacacactaaaaccaaataaaaaagggacattaattactactaagcatagtgatgaagaaactcctgttaaaggaatcagccatatagaaaatgtaaccttaataacactggaaggttcaggaatggttggtattccgggcttttcaaaaaaattatttgaaacactcgcttcggaaaaaattaatgtaaaattgatcactcaggcatcctctgaacattcaatttgtattggtatagatgacagcaatgcagataaggcaaaaactgcgatagatgaggtttttgagtttgagatcttaagagacagattaaaccacttatcgttctcgagccgattcttngatccttag

SEQ ID NO: 25878 - protein, 273 aa, Unknown
  Obtained from environmental sample
  DOMAIN (190)...(260): ACT domain
  misc_feature (1)..(273): Xaa is any amino acid
MLSSYIITYAIQLNKIDAIRKDSRDLIITNTTYTNASIDFEETNKRINSFFKENRSKVVVIPGFVAAARNGDTTVLGRGGSDFTASVVAAEVDATILEIWTDVSGMYTANPKLVSQATPIEIISYEEAMELSHFGAKVIYPPTIHPVLKKEIPIRIKNTLKPNKKGTLITTKHSDEETPVKGISHIENVTLITLEGSGMVGIPGFSKKLFETLASEKINVKLITQASSEHSICIGIDDSNADKAKTAIDEVFEFEILRDRLNHLSFSSRFXDP

SEQ ID NO: 25879 - DNA, 396 bp, Unknown
  Obtained from environmental sample
  misc_feature (1)..(396): n is a, c, g, or t
atggttagaaatcatatactataccgttgtgtgcaatgtgagaaagatgagaactctgaaagaaaaatatgtatttatcttgaccaatttgctgtaagtgatatggtcgaattggagatggaatctatttgggaagaaatcaggaaagttgtgattgatctaaaagaaaatgataaaatattttgtcctttatcacctgaacattatataaaaacctctcaaaaagacattaaaaaagcaagaatacacgatgaatttttatacaatttatcaaatggtttttctttcaaaccagagttgttcctaacatcacaattaatatcttcaaaaattagaaacaataatatcccgctacaaacctatttatacgagaatataaataatgtttcgaggtga

SEQ ID NO: 25880 - protein, 131 aa, Unknown
  Obtained from environmental sample
  misc_feature (1)..(131): Xaa is any amino acid
MVRNHILYRCVQCEKDENSERKICIYLDQFAVSDMVELEMESIWEEIRKVVIDLKENDKIFCPLSPEHYIKTSQKDIKKARIHDEFLYNLSNGFSFKPELFLTSQLISSKIRNNNIPLQTYLYENINNVSR

SEQ ID NO: 25881 - DNA, 732 bp, Unknown
  Obtained from environmental sample
  misc_feature (1)..(732): n is a, c, g, or t
gtggtttctgttttaaaaagagctgtacatacattagatcctattggagttggagctagagatttaagagaatgtttaattattcaattaaaagcaaaagaaagcaataagattagaagtttagcaattgaaattttagaggatgcttttgatcattttgtaaaaaaacattacaaaaagcttcaggaaaaattcaacatttctgaagatgaattaaaagaagtaaattcagaaatttctagattaaatcctaagcctgggagttcttatgctggtaataacaaaattgctgaacaaattgttccagatttttcaattaaaattatagatggcgaactagatttaacgctaaattctagaaatgctcctgaattacatgtttctagggaatataataacatgttaaaaggataccaagaagcgactacaaaaagtaagtctcaaaaagatgcagttttctttattaaacaaaaactagatgctgcaaaatggtttattgatgcaataaaacagcgtcagcaaacgcttttaattaccatgaatactattatgcattatcaatatgattattttttaacaggtgatgaacgcagattaaaacccatgattttaaaagatatagcagataaaataaatatggatgtttctactgtttctagagtggcaaacagcaaatatgtttctactccttatggaactaaattaattaaagaattttttctgaatctatga

SEQ ID NO: 25882 - protein, 243 aa, Unknown
  Obtained from environmental sample
  DOMAIN (1)...(132): Sigma-54 factor, core binding domain
  misc_feature (1)..(243): Xaa is any amino acid
MVSVLKRAVHTLDPIGVGARDLRECLIIQLKAKESNKIRSLAIEILEDAFDHFVKKHYKKLQEKFNISEDELKEVNSEISRLNPKPGSSYAGNNKIAEQIVPDFSIKIIDGELDLTLNSRNAPELHVSREYNNMLKGYQEATTKSKSQKDAVFFIKQKLDAAKWFIDAIKQRQQTLLITMNTIMHYQYDYFLTGDERRLKPMILKDIADKINMDVSTVSRVANSKYVSTPYGTKLIKEFFLNL

SEQ ID NO: 25883 - DNA, 756 bp, Unknown
  Obtained from environmental sample
  misc_feature (1)..(756): n is a, c, g, or t
gtggaccaagaatcggccgaggaaagtgattatattgaacaaatttcgcattctttatgttctttagagtttaaacctcacagagaattgtacgattggtttaaagataatgttttagaatatagtaaatctgaatatccaaatccgccaaaacaacgtgagttttctcgtttgaatttgagttatacaattatgagtaaacgtaaattgttaactttagttgaaaatggaattgtagctggttgggatgatccaagaatgccaacaatttctggtttaagaagacgtggttacactccagaatctataaaaagttttattgaaactgttggagtttctaaacgtgaaaatgtaattgatgtagctttattagaatttaaaatcagagaagatttaaacaaaactgctaaaagagtaatgggtgttttagatcctgtaaaagtggtaattaccaattatcctgaggataaagaagaaatgctagatgccaattataatgattatgaagatggtttcggtagtagaaaagttcctttttcaagagaaatttatattgaaaaagaggattttagagaagaagcaaacaagaagttttttaggttgaaattgggtagcgaagttcgtttaaaaaatgcttattttataaaagcaaatagttgcccaaaagatgctgatggaaatgtcattgagattcaatgtacttatgatccattaacaaaatctgcgatggatactgaagaaagcaacgtcaagtga

SEQ ID NO: 25884 - protein, 251 aa, Unknown
  Obtained from environmental sample
  DOMAIN (1)...(134): tRNA synthetases class I (E and Q), catalytic domain
  misc_feature (1)..(251): Xaa is any amino acid
MDQESAEESDYIEQISHSLCSLEFKPHRELYDWFKDNVLEYSKSEYPNPPKQREFSRLNLSYTIMSKRKLLTLVENGIVAGWDDPRMPTISGLRRRGYTPESIKSFIETVGVSKRENVIDVALLEFKIREDLNKTAKRVMGVLDPVKVVITNYPEDKEEMLDANYNDYEDGFGSRKVPFSREIYIEKEDFREEANKKFFRLKLGSEVRLKNAYFIKANSCPKDADGNVIEIQCTYDPLTKSAMDTEESNVK

SEQ ID NO: 25885 - DNA, 336 bp, Unknown
  Obtained from environmental sample
  misc_feature (1)..(336): n is a, c, g, or t
atgaatcaaaatctggaacaaatatttgaattagaatctgccgaaaaatataatgaagcatattctgaatatcgaaacctgatttcggaaaacaacgcggattttgaaacgtggaaatattatttcttctttttgtggtctatgattgaagatgtgaacggactttttaaaaaagacattgacttacgaaccgaattggaatccgaatnaaaaaacggactgaaaaaatactcggaattagatgaatttattttattgctgatatgcaattcaattttccttacgaattggcgactacgagagtgggattcaggaaagaatgctaaaagcgtctga

SEQ ID NO: 25886 - protein, 111 aa, Unknown
  Obtained from environmental sample
  misc_feature (1)..(111): Xaa is any amino acid
MNQNLEQIFELESAEKYNEAYSEYRNLISENNADFETWKYYFFFLWSMIEDVNGLFKKDIDLRTELESEXKNGLKKYSELDEFILLLICNSIFLTNWRLREWDSGKNAKSV

SEQ ID NO: 25887 - DNA, 537 bp, Unknown
  Obtained from environmental sample
  misc_feature (1)..(537): n is a, c, g, or t
ttgaaaaacggtaaagtaaaaaacatcaaaacagagttactatcagataactggtataccctaaataaaatcacttttgattaccaaaaagaagatggctcgtgggaaacccaaataagagaggcatacgataggggtaatggtgcggctattcttctctataattccaagaaagggaatgtggtgttaacacgacaattcagaatgcccacctatgttaacggtaatgaggacggaatgatgatcgaagtctgcgcaggacttttagatggcgaccacccagtagattgcataaaaaaggaagtcgaggaagaaataggttacaagattgaaaacgtgcaaaaggtatttgaatcttatatgtcaccaggatcagtcactgaaatcttgcatttgtttataggtgaatatgcagcggatatcaaactaagtgaaggtggcggagccgaggatgagagcgagaatattgaagtgttggacatggatcttagcgaagctttgaaaatgattcaaacggggggaaatccgagattctaa

SEQ ID NO: 25888 - protein, 178 aa, Unknown
  Obtained from environmental sample
  DOMAIN (45)...(177): NUDIX domain
  misc_feature (1)..(178): Xaa is any amino acid
MKNGKVKNIKTELLSDNWYTLNKITFDYQKEDGSWETQIREAYDRGNGAAILLYNSKKGNVVLTRQFRMPTYVNGNEDGMMIEVCAGLLDGDHPVDCIKKEVEEEIGYKIENVQKVFESYMSPGSVTEILHLFIGEYAADIKLSEGGGAEDESENIEVLDMDLSEALKMIQTGGNPRF

SEQ ID NO: 25889 - DNA, 510 bp, Unknown
  Obtained from environmental sample
  misc_feature (1)..(510): n is a, c, g, or t
gtgggaaaggaagcggaagaaatacagagatttttgaggtacgataaaactggatttttgaagcgtggatttaatcataaaatcatatattgtagtccaatgggatgcaccaaacttaaatatcaaaatttttcttttttagagataatacactctgaaaaaagggtgtccgcagaaaaaaaacgcataaactattatccttttggacttgaacacaaaggatacaataatgtcatcaatggtactgaatacaactacaaaacgttccaaggtcaggaaatctcgaaagagcttggtttaaactggttgtcgtttaagtatagaaattatgacccatcattagcaacgtttcataacatagaccctttggctcaagaatatgcttatcaatcggcatataacttctctgaaaatagagtcttgacggagttgattagaggagcggaagatatcagtaaatacacttggatgggctttgctacaatacaactacgattaccatccaactaa

SEQ ID NO: 25890 - protein, 169 aa, Unknown
  Obtained from environmental sample
  misc_feature (1)..(169): Xaa is any amino acid
MGKEAEEIQRFLRYDKTGFLKRGFNHKIIYCSPMGCTKLKYQNFSFLEIIHSEKRVSAEKKRINYYPFGLEHKGYNNVINGTEYNYKTFQGQEISKELGLNWLSFKYRNYDPSLATFHNIDPLAQEYAYQSAYNFSENRVLTELIRGAEDISKYTWMGFATIQLRLPSN

SEQ ID NO: 25891 - DNA, 726 bp, Unknown
  Obtained from environmental sample
  misc_feature (1)..(726): n is a, c, g, or t
atgcttcgatctttttatgaccgaactatagctaataatacgataatgaagcatatacaacgtctgagaaaaatgatgaccatggcctatcacatggagtggattgacagagatccttttgctaaatacaaggctaaactcgaaaaaattgagagaggctttctaacagaagctgaactatcaaaaatcgaagaactaccctactccattgaacgaattcaaacagtaaaagacttatttatttttagctgttatacaggtattgcttatggggatatcatgttactgacaaaagataatattgtatatggtttagatagacatcaatggatcatgaccaaaagacaaaaaaatggaaaccctgtcaagattcctttgttaccaaaagccttaagcctcattgaaagttataaagaacatccaaaatcaatacgggaaggtacattgtttccaaaaatatcaaatcaaaaaatgaatagttatttaaaggaaattgcagcattatgtggtatctcaaaaaatatcacttttcatatggcacgtcatacctttgcaacaacggtaactttaagtaatggtgtacctatagaaacggtgtcaaaaatattagggcatacaaaaatcacaactacacagatttatgcaaaagtcaccgaaagaaaggtaagtgatgatatgtttgtgcttcgagagaaacttgggaaaaacaaaattgcaaacgtgtaa

SEQ ID NO: 25892 - protein, 241 aa, Unknown
  Obtained from environmental sample
  DOMAIN (55)...(224): Phage integrase family
  misc_feature (1)..(241): Xaa is any amino acid
MLRSFYDRTIANNTIMKHIQRLRKMMTMAYHMEWIDRDPFAKYKAKLEKIERGFLTEAELSKIEELPYSIERIQTVKDLFIFSCYTGIAYGDIMLLTKDNIVYGLDRHQWIMTKRQKNGNPVKIPLLPKALSLIESYKEHPKSIREGTLFPKISNQKMNSYLKEIAALCGISKNITFHMARHTFATTVTLSNGVPIETVSKILGHTKITTTQIYAKVTERKVSDDMFVLREKLGKNKIANV

SEQ ID NO: 25893 - DNA, 579 bp, Unknown
  Obtained from environmental sample
  misc_feature (1)..(579): n is a, c, g, or t
atggaaagaaataatttatatccgattttgttaaaagtatctcaattaaatgtaatgttgattggtggtggaaatgtaggttttgagaaattgtcatttttattaaaatcgagtcctaatgcaaatgttgtagtggctgctgaagatttttctaaagaaattattgacttggcaaaagcacatgacattccgttaatgtggcgctcatacacaaaaaacttattacacaaacagcatatggtaattgcagcgaccaacgatgtagaagtaaataaagaaattcatcgagatgcaaaagcaaaacaattgttggtgaatgttgctgacactccgaccttatgtgatttttatttgggaggtatcgtaaccaaaggcaatgtgaaaattgccatttctaccaatggaaaatcgcccactatggcaaagagattacgtcaattttttgaggaagtgattccagaaaatgtagatgatttggtgttgaatttaaacaaataccgaaaatccatcaaagggaattttactgataaagttacacgattaaataaattgactgaagggtttgtgnttaaggggtag

SEQ ID NO: 25894 - protein, 192 aa, Unknown
  Obtained from environmental sample
  misc_feature (1)..(192): Xaa is any amino acid
MERNNLYPILLKVSQLNVMLIGGGNVGFEKLSFLLKSSPNANVVVAAEDFSKEIIDLAKAHDIPLMWRSYTKNLLHKQHMVIAATNDVEVNKEIHRDAKAKQLLVNVADTPTLCDFYLGGIVTKGNVKIAISTNGKSPTMAKRLRQFFEEVIPENVDDLVLNLNKYRKSIKGNFTDKVTRLNKLTEGFVXKG

SEQ ID NO: 25895 - DNA, 636 bp, Unknown
  Obtained from environmental sample
  misc_feature (1)..(636): n is a, c, g, or t
atgctcgctattactaaaagccattacgacataaaccaacagcacttaaaaaacaaaataataagaagctctgaatgggttgaaattactaaaagctattttgaagccaagctaaattttgaacatatgcaacatcaaatggcatttttaaacattgatgataatgaaaacgtgaccttagtgagtccaaaaacgggcattttaaaactcactaatgagtcgggaaaccgtgtgatgggtgacaccgcgtttgatattatcgatgcaagtagtattcgcgttaagattaatgtcccccttagttttaccaacacgttagcgcattttaagctgtcacaaaattgcagcttaaatattgagagctatgacagtattgtagataaataccatcaaatagtatgggcgtcgctaagctcgaatgagtgccagctgacactggggcaaaccatcaaagtcacaccggtaaataaattaacaggctttaaaatagcaaagtcagcggtgtttgaatttgaagatgttaattacattgctttaaaatctggcgataaccttgagttactgccgattgagctcaaaggtacacaaggcaaagactacgtgtttactgccaataaaaacctagatgatcagtag

SEQ ID NO: 25896 - protein, 211 aa, Unknown
  Obtained from environmental sample
  misc_feature (1)..(211): Xaa is any amino acid
MLAITKSHYDINQQHLKNKIIRSSEWVEITKSYFEAKLNFEHMQHQMAFLNIDDNENVTLVSPKTGILKLTNESGNRVMGDTAFDIIDASSIRVKINVPLSFTNTLAHFKLSQNCSLNIESYDSIVDKYHQIVWASLSSNECQLTLGQTIKVTPVNKLTGFKIAKSAVFEFEDVNYIALKSGDNLELLPIELKGTQGKDYVFTANKNLDDQ

SEQ ID NO: 25897 - DNA, 486 bp, Unknown
  Obtained from environmental sample
  misc_feature (1)..(486): n is a, c, g, or t
ttggacaggatagattttaaaaatggttatttaagttttggaaagatcaatcgagaagatataaaaacaagttttaatgcacaagcgaaggcattgaaaagtataagtttacatgatttatctaatcaaaaaataaagaaatttgagtttgacactaattatttcaactcgagtcatataaatgatatagacaaggaaaattatttaaggttaaagttaaacgggataactgaatttaataatcaatttacaacttctcttcctagccatgttttttcctacaatactaccgcattgccagctaaaaactcatattccattgattattgggggtattttaatggtgaaaagaatgattatataagttcatattatttctcgaaaatgggaagtgttgtgacaccaagctctctcagtgttagtaaattctggtccgtcggncacaactttgtcgaaatacctttattcagatccaaattgcaataa

SEQ ID NO: 25898 - protein, 161 aa, Unknown
  Obtained from environmental sample
  misc_feature (1)..(161): Xaa is any amino acid
MDRIDFKNGYLSFGKINREDIKTSFNAQAKALKSISLHDLSNQKIKKFEFDTNYFNSSHINDIDKENYLRLKLNGITEFNNQFTTSLPSHVFSYNTTALPAKNSYSIDYWGYFNGEKNDYISSYYFSKMGSVVTPSSLSVSKFWSVGHNFVEIPLFRSKLQ

SEQ ID NO: 25899 - DNA, 402 bp, Unknown
  Obtained from environmental sample
  misc_feature (1)..(402): n is a, c, g, or t
atgaagaaaattatcacattagttgctttggtctttttttcggtcagcaccttcgcacaaacgcaatggactgtagatccatatcattcctcattaaatttcaacatttcgcattctggaattagtatcgtgaatgggaaatttttagattataccggaagcttaattacaaaaggagatgcgcttaatgatgcaagtttcgattttagggttaaaattgaaagtattaatacccatgtagaagatagggataaccatttaagaagtgctgactttcttgaagttgaaaaatatcctgaaatgacttttaaaagcacgaaaatttcaattaccgaaaaaagtcatcaatacctcttaaaaggaccactaaatattaaaggtgtgagaaagacgtcgttttga

SEQ ID NO: 25900 - protein, 133 aa, Unknown
  Obtained from environmental sample
  SIGNAL (1)...(19)
  DOMAIN (20)...(132): YceI like family
  misc_feature (1)..(133): Xaa is any amino acid
MKKIITLVALVFFSVSTFAQTQWTVDPYHSSLNFNISHSGISIVNGKFLDYTGSLITKGDALNDASFDFRVKIESINTHVEDRDNHLRSADFLEVEKYPEMTFKSTKISITEKSHQYLLKGPLNIKGVRKTSF

SEQ ID NO: 25901 - DNA, 462 bp, Unknown
  Obtained from environmental sample
  misc_feature (1)..(462): n is a, c, g, or t
ttgaatacaactaaccagcactttccaaaatcaataaaaaagtatttattaatgctctctcttgttctaaccacttcaatggttttagcgcaagatcctgtagtagaacaagactctacaaaaacagggtttgtaatgggggatattgaaatgcctaatccgcaaagtatagaatctatttatacttacgatcctaaaacagatcgttacatttatacagaaacagtagggacttttactattaattaccctacaattttaacgccagaagaatatcaagacctcgtttttaaagagaatttaaaatcgtattacaaaaataaaattgatgcttttgaaggtaaaaaagacaatgctgatgcccagcaaaaaaacttattgccagagttttatgtcaattctggttttttcgaaagtatttttgggggtaatactatcgaagtgtctcgagccgattcttga

SEQ ID NO: 25902 - protein, 153 aa, Unknown
  Obtained from environmental sample
  misc_feature (1)..(153): Xaa is any amino acid
MNTTNQHFPKSIKKYLLMLSLVLTTSMVLAQDPVVEQDSTKTGFVMGDIEMPNPQSIESIYTYDPKTDRYIYTETVGTFTINYPTILTPEEYQDLVFKENLKSYYKNKIDAFEGKKDNADAQQKNLLPEFYVNSGFFESIFGGNTIEVSRADS

SEQ ID NO: 25903 - DNA, 693 bp, Unknown
  Obtained from environmental sample
  misc_feature (1)..(693): n is a, c, g, or t
atgccagaatggatgatgatcaattgtattgaaatcgatccttttactcagggaggtgcatacattgttggaaccaaatataagtctggcgattacaagccttatatttataaaacttctaattatggtaaatcttggaaactgattgtaaatggaattaacagtgaagattttacaagggctatccgaactgatcctaaacgaaaagggctattatacgcgggaacagaacgtggtatgtatattagttttgatgatggtaaccattgggaaaaatttcaattgaatttaccgattgttccaattacggatctggccataaaaaacaacaacttaatagcggctacccagggccgttctttttgggttattgacgatctaacaccattacatcagctcaatgcaaatcttgtaaatgaagatttttatttgttcaaaccgatggacagttatagattaaatggtggacgaggcgcaacttcaaaaactcagggccaaaaccactatggtggtgtaggtgtcaatttttatgtaaaagatacagttaaaagtgataccatttccctttcatttttagataaacataagaatccgataaaaaaattctctacacatcctgataaagaaaagaacgaaggacactcacaggtgcaacccggaagtaccaatttattcggatatgatgtaccctga

SEQ ID NO: 25904 - protein, 230 aa, Unknown
  Obtained from environmental sample
  misc_feature (1)..(230): Xaa is any amino acid
MPEWMMINCIEIDPFTQGGAYIVGTKYKSGDYKPYIYKTSNYGKSWKLIVNGINSEDFTRAIRTDPKRKGLLYAGTERGMYISFDDGNHWEKFQLNLPIVPITDLAIKNNNLIAATQGRSFWVIDDLTPLHQLNANLVNEDFYLFKPMDSYRLNGGRGATSKTQGQNHYGGVGVNFYVKDTVKSDTISLSFLDKHKNPIKKFSTHPDKEKNEGHSQVQPGSTNLFGYDVP

SEQ ID NO: 25905 - DNA, 693 bp, Unknown
  Obtained from environmental sample
  misc_feature (1)..(693): n is a, c, g, or t
ttggcaagactttcgttaagttttccaaatattaaaaatttaaatgaaaagttacttatagagttttacaatgtagagtgtatgaaaaacaatattataattattttaggattactttgttttgcatcatgcaagcaagttcaaaatttatctgataagtttacaaaatcttcaggaaaacaagttatagaacgtagttttaaagaggatgaagtttctttaaagaaatttgaagatgtttatgagcaagctaaaaacaataatttagagttggctttaccaaacgttatttatacaaaatcagattctttagatttttcaattctatcttataaaatatttttagaaaaaggagagagattaaaaattgaaacaaatattgaaacagattctttacaatttgctgtagatatttatagtattttaaatgataccttaatttcaaaaagaccattagtttctaatgaagcctctttaaacaatcttaattttgaagtttttaaaacgggctattacaaaattgtgatgttttcagaatctaataaaaaagtcgattttaatataggagtttacacagagccagtttttttgtttcctgttgctggaagaggaaataaagatattcaaagtttttggggagcagtaagaagtggaggaaaaagaaaacatgaaggcatagatatcttgctctga

SEQ ID NO: 25906 - protein, 230 aa, Unknown
  Obtained from environmental sample
  misc_feature (1)..(230): Xaa is any amino acid
MARLSLSFPNIKNLNEKLLIEFYNVECMKNNIIIILGLLCFASCKQVQNLSDKFTKSSGKQVIERSFKEDEVSLKKFEDVYEQAKNNNLELALPNVIYTKSDSLDFSILSYKIFLEKGERLKIETNIETDSLQFAVDIYSILNDTLISKRPLVSNEASLNNLNFEVFKTGYYKIVMFSESNKKVDFNIGVYTEPVFLFPVAGRGNKDIQSFWGAVRSGGKRKHEGIDILL

SEQ ID NO: 25907 - DNA, 447 bp, Unknown
  Obtained from environmental sample
  misc_feature (1)..(447): n is a, c, g, or t
atgcctaattttatattggaagctaatccccattttcctgaaataaatggacaatctggaggtgatagttttgtttcaaaacatatagttataagcaataattatgatgatctacgagaaaagaacttagctatatcaaattctagccgtgaaaggataagaatgataagcctttctaactatgaaataacaagtaattatgcaagtgtattcataagacaagctgggatagatgaagaattgctttctaataaatatgatataactgcctatcgaaaatctggattaagacatcatttatttaaaggaaaaataacagactcagcaatattaaatcttgaaaatcaaaaatcaacggctctactaaaattaattaaacaacgtaggaagattaaaaatgactctttaaattctaaatttaaaaggaactttatgaaaggcttgtaa

SEQ ID NO: 25908 - protein, 148 aa, Unknown
  Obtained from environmental sample
  misc_feature (1)..(148): Xaa is any amino acid
MPNFILEANPHFPEINGQSGGDSFVSKHIVISNNYDDLREKNLAISNSSRERIRMISLSNYEITSNYASVFIRQAGIDEELLSNKYDITAYRKSGLRHHLFKGKITDSAILNLENQKSTALLKLIKQRRKIKNDSLNSKFKRNFMKGL

SEQ ID NO: 25909 - DNA, 561 bp, Unknown
  Obtained from environmental sample
  misc_feature (1)..(561): n is a, c, g, or t
ttgtatcacttatatgaaaaattatcgctaaaattatttaatatattgattatgagtaacttaacaacaaaagaaaaagtaaaatttatagcagatttgtgtcgtaaaaatgacataacagcgtacgagattagcaaatcgaaaggtttaagtgcatctggaatccaaagaattttaaacaatgaggttaaaaaaccacgaaatgaaaccttagatgctattctggattatattgaaaataagctaactggctctaaatttgaagccacaaaagacacagataacaaagttgcagaaccaatacaacaatacatccatcgcgatgcaccaagcagtgtaccatattataacatagaattgtctggcgacacgtttacaagctttaaagcagcagaaaaaaacatcgacttttttgtggactataagccattaaataattgcacagcgtntttaccctattttggagatgctatgttgccatattataagtctggcaacacgttagctgtaaaagaaattgttaattttgacgtatcacttggcggagaaccacattggtaa

SEQ ID NO: 25910 - protein, 186 aa, Unknown
  Obtained from environmental sample
  misc_feature (1)..(186): Xaa is any amino acid
MYHLYEKLSLKLFNILIMSNLTTKEKVKFIADLCRKNDITAYEISKSKGLSASGIQRILNNEVKKPRNETLDAILDYIENKLTGSKFEATKDTDNKVAEPIQQYIHRDAPSSVPYYNIELSGDTFTSFKAAEKNIDFFVDYKPLNNCTAXLPYFGDAMLPYYKSGNTLAVKEIVNFDVSLGGEPHW

SEQ ID NO: 25911 - DNA, 717 bp, Unknown
  Obtained from environmental sample
  misc_feature (1)..(717): n is a, c, g, or t
gtgccggaattttcgatggatgtttacggcgataagttataccaaacacaaaccgtatttaaatatccaaaggcaggtgaggcaaatgctattgtgtcacttcatattcacaatttagaaagtaatacgacacatccggtaactttagataaagagtataacgatttttatattccaagaattaaatggacaaataatgctgatgtgttaagcgctcagtatatgaatcgtcatcaaaatgaactggatttatggatgattgatgccgaaaaaaacacaggttttatagctatttctgaaaaagacaaggcctatgttgatgttaccgataacttaacctttttaaaagatgatagttttatctggacgagtgaaaaagacggttacaaccatatttaccaccacgataaaaaaggaaaactgattaatcaaatcactaaaggaaattgggaagtcactaattattatggttttgatgctaaatctgatcaaatatattatcaatctgtagagaatgcttctattaacagagacgtgtattctataagtttaaaaggaacaaagaagcacgtttatcttgataagacccgaacaaatagtgcggacttagtgccgatttcacctattctatcaattcgttttctaatgtgtccacgccacctagttatactttacatattccaaaccgcggacctcgtcaacctattaagaccatag

SEQ ID NO: 25912 - protein, 238 aa, Unknown
  Obtained from environmental sample
  DOMAIN (1)...(237): Dipeptidyl peptidase IV (DPP IV) N-terminal region
  misc_feature (1)..(238): Xaa is any amino acid
MPEFSMDVYGDKLYQTQTVFKYPKAGEANAIVSLHIHNLESNTTHPVTLDKEYNDFYIPRIKWTNNADVLSAQYMNRHQNELDLWMIDAEKNTGFIAISEKDKAYVDVTDNLTFLKDDSFIWTSEKDGYNHIYHHDKKGKLINQITKGNWEVTNYYGFDAKSDQIYYQSVENASINRDVYSISLKGTKKHVYLDKTRTNSADLVPISPILSIRFLMCPRHLVILYIFQTADLVNLLRP

SEQ ID NO: 25913 - DNA, 441 bp, Unknown
  Obtained from environmental sample
  misc_feature (1)..(441): n is a, c, g, or t
atggataattttaactatctttactgttataaaatcaagtatatgaaagcttttagaaatgaaaaatggaagctatttgaaaaagaaaactacgattttaaacgagaaaaaatttatatttctaattatggtagggtaaaaagggagaatgatgataaacaatttgagttagtaactattggtaaaataaacaattttgaaacttttgcgtatccaaaaattggaacaaaaagaaaaagtaatttttatgtgcacagagcagttggtttactttttttagataaaagtgaagatgaaaaattcgtgattcataaaaatcatgatttaattgataattacgttgctaatttaaaatgggtaaatcaaaaagaactaacaagacatcaacatacaaatcctaaaagaaaagcaaaatatggaattaaaccaggtgcaaaataa

SEQ ID NO: 25914 - protein, 146 aa, Unknown
  Obtained from environmental sample
  misc_feature (1)..(146): Xaa is any amino acid
MDNFNYLYCYKIKYMKAFRNEKWKLFEKENYDFKREKIYISNYGRVKRENDDKQFELVTIGKINNFETFAYPKIGTKRKSNFYVHRAVGLLFLDKSEDEKFVIHKNHDLIDNYVANLKWVNQKELTRHQHTNPKRKAKYGIKPGAK

SEQ ID NO: 25915 - DNA, 381 bp, Unknown
  Obtained from environmental sample
  misc_feature (1)..(381): n is a, c, g, or t
atgcaagaacaattaaagatctttaaaatcatccatatagcattagtcgcaggtctaatattagcttacttttttttaggaaacctttctgatattacccaattaaagttacctaaggtagatagcgacaatacggtatatttagctattcctattgctgcttttatagttagcaattttctatttaaaatgttagtttctaaaattgacagcaacttaagcttaaaagaaaaattagtaccttatcaaaagtgcttctgttgtacgcctatgcccatattgaaaggctctgccttttcttatattaataatagcaacagacctttattaaaatttggtttggcttttaaattggataccttaaaatttaccaaagcccct

SEQ ID NO: 25916 - protein, 127 aa, Unknown
  Obtained from environmental sample
  misc_feature (1)..(127): Xaa is any amino acid
MQEQLKIFKIIHIALVAGLILAYFFLGNLSDITQLKLPKVDSDNTVYLAIPIAAFIVSNFLFKMLVSKIDSNLSLKEKLVPYQKCFCCTPMPILKGSAFSYINNSNRPLLKFGLAFKLDTLKFTKAP

SEQ ID NO: 25917 - DNA, 813 bp, Unknown
  Obtained from environmental sample
  misc_feature (1)..(813): n is a, c, g, or t
gtgcactcacagctctttcagtgctttcaacacttaaagtcaaacagtaaattaatcacaccagaattaatcaaggccgattatttaggggaaggtggaaataacaagtcactgcaaaatctaattgaataccataccaggaaaaccgaaaaaatattagcgcccggtactattagaaattttgaagtaacacagggatacatatataggtacatcacaaagaaactaaaaacctcagatatctacttgaaagaactcgactataagtttatttgtgattttgaggactttcttcatcgctattggccaaaaggtcatatgagggcaatgagccataatactgtgatgaaacatattcaaagatttcgaaaaatagcaaccctgggatatcatttggaatggatcgacagagacccctttgtgagatggaaacctacctatgaaaaaagggagcggccctatttaacggaaaatgaattatctaatatagaaacctatccttttcaaatagaacgactagatagagttagagacttattcgtttttagttgttatacaggaatttcttattcagatataatcaaactttcatactcaaatatttctaagggcatcgatggaaatgattggatctttacaagtcgtcaaaaaacaaaatctccggtaaaagttccaattcttgcaaaagcacaggaacttatccataaataccagaatcacccgatgactatgataacagaaactttgtttccggtaattacaaatgacaacgtaactctgtatctaccagaattcgtgaagcctgtggaataa

SEQ ID NO: 25918 - protein, 270 aa, Unknown
  Obtained from environmental sample
  misc_feature (1)..(270): Xaa is any amino acid
MHSQLFQCFQHLKSNSKLITPELIKADYLGEGGNNKSLQNLIEYHTRKTEKILAPGTIRNFEVTQGYIYRYITKKLKTSDIYLKELDYKFICDFEDFLHRYWPKGHMRAMSHNTVMKHIQRFRKIATLGYHLEWIDRDPFVRWKPTYEKRERPYLTENELSNIETYPFQIERLDRVRDLFVFSCYTGISYSDIIKLSYSNISKGIDGNDWIFTSRQKTKSPVKVPILAKAQELIHKYQNHPMTMITETLFPVITNDNVTLYLPEFVKPVE

SEQ ID NO: 25919 - DNA, 783 bp, Unknown
  Obtained from environmental sample
  misc_feature (1)..(783): n is a, c, g, or t
ttggcgattatgatgtactactcatcaatcaaaacggtagcacaggatcttctgcgcacgccagtaaagattttaaagatcaacgtcaagcgtgcaatgattgtgcatcagtttgaattggatattaatactgaagttcaaaaacgtggtcgtatcaatcgtactggtcaagtgaacttgccagagtactattatataaccagcgacattcctaccgaaaagcgtttaatgacaatgcttaaagcgaaattgaaatcgctggatgccaatactacaggttctcaaaaaaccaatgatgacaccttgaaaagcgccgacttcctaaataaatatggagatatcgctgcgtggaattgggtagatgagaatcaggaaatgatggaacagctcggttatccaacgtatcaaaagaaaacggataagcgaggctttatttcttatgagcgtaatggttttaaagaaggtgctattcgtcaattgacaggacgagctggattgcttaaagtggaagatcaagatgctttatatgatgatttattagagcgttatgaccatcaaatcaagttagaaaagcaacaaggcacgtatgatttggaaactgaattcttaccactcgatgccgaagtaaaaaagcgtttcctatttcaaaaaggtcaaggtggtcgcacaccatttggaaaagacacggttcgagatattactattgtcaataatctaaagcgcccctttaccaaacaagatattgatgaacgtattcaagagcactcctcgaccgattcttga

SEQ ID NO: 25920 - protein, 260 aa, Unknown
  Obtained from environmental sample
  misc_feature (1)..(260): Xaa is any amino acid
MAIMMYYSSIKTVAQDLLRTPVKILKINVKRAMIVHQFELDINTEVQKRGRINRTGQVNLPEYYYITSDIPTEKRLMTMLKAKLKSLDANTTGSQKTNDDTLKSADFLNKYGDIAAWNWVDENQEMMEQLGYPTYQKKTDKRGFISYERNGFKEGAIRQLTGRAGLLKVEDQDALYDDLLERYDHQIKLEKQQGTYDLETEFLPLDAEVKKRFLFQKGQGGRTPFGKDTVRDITIVNNLKRPFTKQDIDERIQEHSSTDS

SEQ ID NO: 25921 - DNA, 789 bp, Unknown
  Obtained from environmental sample
  misc_feature (1)..(789): n is a, c, g, or t
ttgattcggtcgagatctcaaatgatgtgtgattttgagcgatttcttaacgcatactatccaaagggtcacgatagggagatgggacataataccgtcatgaaacacattcagaggcttcgtaaaatggttacgctttcctatcatttggaatggttggacaaagatccattcatgcgttggaaaatgagctatgaaaagaaggaacgtgattttttgactgctaatgaactttctaatctcgaaacctatgactttccaattgggcgacttgaaagggtgcgtgatatttttcttttcagttgctataccggtatcagttatgctgatattaaaatccttaaaccaaaacatgttttagaaggtatggatggtaataattggattgttacgcatcgccaaaaaactaaaacaaaagtaaaagttcctttacttgataaggcgaaacttctcatagaaaaatatgacaatcatcctatggctgtcatctcagaaaccttatttcccgtggttagcaatgtgaaaatcaatctgtatctcaaagaaattgcttctgtggttggaattagaaagagcctcacctttcacatgactcgccacacctttgtcacaactgttacattaaacaatggcgtgcctatagagacggtttctaaattattgggtcacaaaaaaatatcaacaactcagatttatgcacgtgtattagaggatacattaagtaaggatatgattgatttacagaagatattgaatggtaaggatgaactgaagttaatcaacaaatag

SEQ ID NO: 25922 - protein, 262 aa, Unknown
  Obtained from environmental sample
  DOMAIN (73)...(242): Phage integrase family
  misc_feature (1)..(262): Xaa is any amino acid
MIRSRSQMMCDFERFLNAYYPKGHDREMGHNTVMKHIQRLRKMVTLSYHLEWLDKDPFMRWKMSYEKKERDFLTANELSNLETYDFPIGRLERVRDIFLFSCYTGISYADIKILKPKHVLEGMDGNNWIVTHRQKTKTKVKVPLLDKAKLLIEKYDNHPMAVISETLFPVVSNVKINLYLKEIASVVGIRKSLTFHMTRHTFVTTVTLNNGVPIETVSKLLGHKKISTTQIYARVLEDTLSKDMIDLQKILNGKDELKLINK

SEQ ID NO: 25923 - DNA, 375 bp, Unknown
  Obtained from environmental sample
  misc_feature (1)..(375): n is a, c, g, or t
ttggtattttttggaaatagtaatgaaattgataggatactttgcttctccgattggtttttattaccaagtaaaaccgaaagttttggattatcagctttagaancgatggcttcaggagtacctgtaatatctagtaatacaggaggtattccagaagtaaataaagaaggtttttctggttatttaagtaatgttggtgatgtagaaagtatgagtaaaaacgctataaaaatacttaaagacgattcagttttaaaacagtttaaagcaaatgctaaggagcaggctaaaacttttgatattcatcagattgtaccacaatatgaagctatctatcaaaaaacactaaacaggtgtaaggttttaaaataa

SEQ ID NO: 25924 - protein, 124 aa, Unknown
  Obtained from environmental sample
  DOMAIN (1)...(96): Glycosyl transferases group 1
  misc_feature (1)..(124): Xaa is any amino acid
MVFFGNSNEIDRILCFSDWFLLPSKTESFGLSALEXMASGVPVISSNTGGIPEVNKEGFSGYLSNVGDVESMSKNAIKILKDDSVLKQFKANAKEQAKTFDIHQIVPQYEAIYQKTLNRCKVLK

SEQ ID NO: 25925 - DNA, 852 bp, Unknown
  Obtained from environmental sample
  misc_feature (1)..(852): n is a, c, g, or t
ttggctaaaaaagccgagttagatgctaatttagtacttgtgttaacctcagattacggttataacagtttagtattgccaagtacagattttaatcactgtattgcaaaagttaaaattgatggaaaagatcagtttttagaattaacagataagtatttaccgtataaatctttaccaacatcgttaagaggtgctacagctttagagattccattggatagaaatgatactaaaacgtatgatttatttaaattaaataatttatcaagagagcaagcggtctctaaaaacatagttacattaaatatcgataattcaaaaattggtatggtaatagactcagaatatagtggtcatattaattcttattattctagtgtatttgcagagccaaatgcagaggttgttaaaaaatctgtttacgaagattatgataatagattatcagatgattttacattaaatagtgtgaataatatagaaagacttaatgatgatatgttgattaaatatacatcagatatgacattaaataaaaaaataaataaaataggatctactaatgtgttgcaattaccaatggtatctaatccttataccaatagtattgttagtttagaaaaacgtgagcatgtaattgattatacattatacgaaaacatggatgtttaccaagtagattatattgttaatatccaagccgatcagtcttttactgaaattcctgagaatgttagtctaacttttaaagaccattcctatagcataacttatagtaagttaaaggctaatccattnaagggtttgacttcactcaaagcccttcatgaaacgtattcaagatgctga

SEQ ID NO: 25926 - protein, 283 aa, Unknown
  Obtained from environmental sample
  misc_feature (1)..(283): Xaa is any amino acid
MAKKAELDANLVLVLTSDYGYNSLVLPSTDFNHCIAKVKIDGKDQFLELTDKYLPYKSLPTSLRGATALEIPLDRNDTKTYDLFKLNNLSREQAVSKNIVTLNIDNSKIGMVIDSEYSGHINSYYSSVFAEPNAEVVKKSVYEDYDNRLSDDFTLNSVNNIERLNDDMLIKYTSDMTLNKKINKIGSTNVLQLPMVSNPYTNSIVSLEKREHVIDYTLYENMDVYQVDYIVNIQADQSFTEIPENVSLTFKDHSYSITYSKLKANPXKGLTSLKALHETYSRC

SEQ ID NO: 25927 - DNA, 570 bp, Unknown
  Obtained from environmental sample
  misc_feature (1)..(570): n is a, c, g, or t
atgtcttttgaacgtattttagaaaaattgaaaattttagcagatgcagctaaatatgatgtttcttgttcatctagtggaagtaaaagaactaacacaaataaaggtttaggagattctacaggaatgggaatttgccattcgtatacagaagatggtagatgtgtttctttgctaaaaattttgctgacaaatcattgtatttttgattgtgcttattgtgtaactcgaaaaagtaacgatgttaaaagagcagcttttaaagtacaagaagtcgtagatttaaccatcaatttttatagaagaaattatattgaaggtttgtttttaagttctggtatatttaaaagtgcagattatactatggaacgtttggtggctgttgccaaaaaattacgtttagaagaaaattttaatggttatattcatttaaaatcaattcctggagcttcagatgaattgatgcgtgaagcaggtttgtatgcagatagattaagtgtaaatatagaaataccaaccaaatctggtttaaaattattagctcctgataaaatttcgaagattttataa

SEQ ID NO: 25928 - protein, 189 aa, Unknown
  Obtained from environmental sample
  misc_feature (1)..(189): Xaa is any amino acid
MSFERILEKLKILADAAKYDVSCSSSGSKRTNTNKGLGDSTGMGICHSYTEDGRCVSLLKILLTNHCIFDCAYCVTRKSNDVKRAAFKVQEVVDLTINFYRRNYIEGLFLSSGIFKSADYTMERLVAVAKKLRLEENFNGYIHLKSIPGASDELMREAGLYADRLSVNIEIPTKSGLKLLAPDKISKIL

SEQ ID NO: 25929 - DNA, 345 bp, Unknown
  Obtained from environmental sample
  misc_feature (1)..(345): n is a, c, g, or t
atggatgaaagcggctttgaggctgaaactattcgtccttatggctacgcgccgatcggtaagccttgtattgatcgctacaactggcaaggtaaaaagcgaactaatattattggcgctctgtatgacaagaggttgtttgcgcttgattactttgagaaaaacatcaatggcgatatattctatgactggtgcaaatacacgctcattccaagccttaaaactaaatgcgtgatcgtcatggataatgccagctttcataaacgagtgaaaagtcttctgaataggcatggtcacaggcttttatttctaccatcctatagtcctgacttaaatccttattga

SEQ ID NO: 25930 - protein, 114 aa, Unknown
  Obtained from environmental sample
  misc_feature (1)..(114): Xaa is any amino acid
MDESGFEAETIRPYGYAPIGKPCIDRYNWQGKKRTNIIGALYDKRLFALDYFEKNINGDIFYDWCKYTLIPSLKTKCVIVMDNASFHKRVKSLLNRHGHRLLFLPSYSPDLNPY

SEQ ID NO: 25931 - DNA, 618 bp, Unknown
  Obtained from environmental sample
  misc_feature (1)..(618): n is a, c, g, or t
ttgaaggcgacttatcggattaaagatcattttgncggctggctctgggtactcgatcgcggcaaaataatagaaaaagacaccaaccttagtcccttacgcatgacaggcacagtgcgcgacatttcacaattaaagctaaccgaagagcgcttaaaccttttggcaaaatgcgttgaatcgctaaccgacgccctggctatttacgataaaaactttaagttagtcgatattaaccccagctttttaaccttatttggtggcgtgcgcgagcagtaccttaaaaaagattttaatttgcccggctacgataaaagttacattaacaccattaaaaaaaccgtataccagcgagatagcctgcaacaagaagttaaattacgcaatagtgcacatgttttattacccatagaaatttcgattgatgaaattagaaatgatcaaaaccaaataactaactatgtcgttgtatactctgatttaaccgagcgtaaaaaagccgaatcgcaactgcataacctctccaatagagaccgcaccaccaacctgcctaaccgtaatttgttttttaccgacttacaaaaattagggcaactaaactcgcaccatgcttgttag

SEQ ID NO: 25932 - protein, 205 aa, Unknown
  Obtained from environmental sample
  misc_feature (1)..(205): Xaa is any amino acid
MKATYRIKDHFXGWLWVLDRGKIIEKDTNLSPLRMTGTVRDISQLKLTEERLNLLAKCVESLTDALAIYDKNFKLVDINPSFLTLFGGVREQYLKKDFNLPGYDKSYINTIKKTVYQRDSLQQEVKLRNSAHVLLPIEISIDEIRNDQNQITNYVVVYSDLTERKKAESQLHNLSNRDRTTNLPNRNLFFTDLQKLGQLNSHHAC

SEQ ID NO: 25933 - DNA, 570 bp, Unknown
  Obtained from environmental sample
  misc_feature (1)..(570): n is a, c, g, or t
gtgacaatttcagaattgaatgaaaatgaaaaaaccatgcttctaatgttgcattacgatgtttggcagaaagaagaaggtttcgattctttagaaaaaagtattctccaaattggaaataatcttgttctagtcgaagaaataaaggaaattctagaatttttaattgataatatagacttcaaagaattaccgattaaacttccatatgaacaaccattaaaattacatagtcgttatacaagagaccaaatattaactgctttccaatttagtagtttcacaaaaaaatcatctaatagagaaggaactgcattgaatatagatttgaataccgaattactttttatcaaccttattaagtccgaagaaaacttttcaccaaccacaatgtatgatgattatgctgtaaatgaattactatttcattggcaaactcaaaactctgcaagacctgataaaggaaaaggattgtcttacataaaacatcaagaggacaataaacgaattttactttttgttcgcgaaaaagcaaaagatgaattggaaatacaaaaggttattttatag

SEQ ID NO: 25934 - protein, 189 aa, Unknown
  Obtained from environmental sample
  misc_feature (1)..(189): Xaa is any amino acid
MTISELNENEKTMLLMLHYDVWQKEEGFDSLEKSILQIGNNLVLVEEIKEILEFLIDNIDFKELPIKLPYEQPLKLHSRYTRDQILTAFQFSSFTKKSSNREGTALNIDLNTELLFINLIKSEENFSPTTMYDDYAVNELLFHWQTQNSARPDKGKGLSYIKHQEDNKRILLFVREKAKDELEIQKVIL

SEQ ID NO: 25935 - DNA, 747 bp, Unknown
  Obtained from environmental sample
  misc_feature (1)..(747): n is a, c, g, or t
ttgaagaaagcgggtaaattgtgggaacaagctgctaaaccatattcggaacattggaataatgtgatgaatgaacttatagagctagattttacgatagttcccacctttaatatatatgaggctaatagagatttacatcgagcccgaagagctgaatggcatgaggagtatacactcccatctttgtggaaattttaccaacctagtaaaatttctcatgggtcatattggcataattggggcacagaacaagaagtttcatggaaaaaaaattaccaattatggatgacctttattaatgaatataagaataggggaggtagagttactactggatcagattcaggttttatttttcagctatacggttttgcttatatccgcgaattagaacttttaagagaagccggttttcatccattagaaattataaaatcagcaactttgaatggagctgaagccttgaaaatggagaataaaattggttcagtacaagttggaaaattggctgattttgtaattgttgatcaaaatccattagagaatttaaaagtattatatggtacaggagcaattaaactaactgacaaaaatgaaattattagagttggcgggataaaatacaccataaaagatggaattgtttacgacgctaaaaaattgcttgaggatgttaaacagatggtgactgaggctaaacaaaaagataattttgaaattttgcagccaggaataaaaaaataa

SEQ ID NO: 25936 - protein, 248 aa, Unknown
  Obtained from environmental sample
  misc_feature (1)..(248): Xaa is any amino acid
MKKAGKLWEQAAKPYSEHWNNVMNELIELDFTIVPTFNIYEANRDLHRARRAEWHEEYTLPSLWKFYQPSKISHGSYWHNWGTEQEVSWKKNYQLWMTFINEYKNRGGRVTTGSDSGFIFQLYGFAYIRELELLREAGFHPLEIIKSATLNGAEALKMENKIGSVQVGKLADFVIVDQNPLENLKVLYGTGAIKLTDKNEIIRVGGIKYTIKDGIVYDAKKLLEDVKQMVTEAKQKDNFEILQPGIKK

SEQ ID NO: 25937 - DNA, 471 bp, Unknown
  Obtained from environmental sample
  misc_feature (1)..(471): n is a, c, g, or t
atgcaatcacaagaacaattactcaatttctttaagaaaaccagggcacattctgaacttatatgctcttttttggaaaccgaagattatgtagtacaacccatagtagatgtttcccctccaaaatggcaccttggccataccacctggttttttgaagaatttgttctaaaaccaaatgcaaaaaactataaaattttcgataaaaattcggcttacgttttcaacagttattacgaaagcataggcgataaagtaattcgcactaaccgcggtaatttatcgcgcccaacagttgcctgggtgtatgagtatagaaattatgtttctaaagcgatgcagcaatttctgaaagatgaaaaaatttcagaagaactctgcggcgttatagaaattggctgtcaccatgaggaacaacaccaggaacttttattgacagatattaagtatatcnttggtaacaatccttga

SEQ ID NO: 25938 - protein, 156 aa, Unknown
  Obtained from environmental sample
  misc_feature (1)..(156): Xaa is any amino acid
MQSQEQLLNFFKKTRAHSELICSFLETEDYVVQPIVDVSPPKWHLGHTTWFFEEFVLKPNAKNYKIFDKNSAYVFNSYYESIGDKVIRTNRGNLSRPTVAWVYEYRNYVSKAMQQFLKDEKISEELCGVIEIGCHHEEQHQELLLTDIKYIXGNNP

SEQ ID NO: 25939 - DNA, 705 bp, Unknown
  Obtained from environmental sample
  misc_feature (1)..(705): n is a, c, g, or t
atggaagttcacgggttggattatttggtttataaaaagtttactaaagcattttcccgactaaaggcggaagattttgtttcagacattttagtaaaacaactgcgagctaaaaaagttattattggttacgaccaccattttggaaggaatagaacagccaatattgatgatttacgccaatttggtattgactatcaatttgaagttgaagaaatttcagcacaagatatcaatgatgtttctgttagttccacaaaaattagaacagcactattaaatggagacataaaaacagccaatagttatttaggttataactacatgttgaccggaaccgtaattcacggtaaaggattaggtaaagaaataggttttccaacggctaatctgcatattgaagaacactataaactaataccagcagatggcgtttatgtcattaaatctaaaataaacaatcacatctattttgggatgatgaatataggcacaaatcccacggtaaatccagataataatcagtccattgaaataaatttctttaatttagaagcatcgttatatggttctaaattaaaaatagatatgcttgaacgcatccgagacgagcagaaatttaattccgtgaccgaattacaggcacaattagaaaaggataaacaaaccgctttacagtatataaaaaatcatgcgactcactaa

SEQ ID NO: 25940 - protein, 234 aa, Unknown
  Obtained from environmental sample
  DOMAIN (1)...(87): Riboflavin kinase (Flavokinase)
  misc_feature (1)..(234): Xaa is any amino acid
MEVHGLDYLVYKKFTKAFSRLKAEDFVSDILVKQLRAKKVIIGYDHHFGRNRTANIDDLRQFGIDYQFEVEEISAQDINDVSVSSTKIRTALLNGDIKTANSYLGYNYMLTGTVIHGKGLGKEIGFPTANLHIEEHYKLIPADGVYVIKSKINNHIYFGMMNIGTNPTVNPDNNQSIEINFFNLEASLYGSKLKIDMLERIRDEQKFNSVTELQAQLEKDKQTALQYIKNHATH

SEQ ID NO: 25941 - DNA, 732 bp, Unknown
  Obtained from environmental sample
  misc_feature (1)..(732): n is a, c, g, or t
ttggattctttacaaggtaattttaaaaaagccaatttttggcaatctaaatattttacagctaaaagtcggttagacaaagaaagtgaagaaaaaaaacaacttgcaaacactttaatgactatcgatatcgaagacactatagttgccccattacaaataatagaaaaccccgttaccaaaccagaaccccaagccagtaaccaatttaaatttattttttactttctaattatagcttttgtggtggtaattatagtttttattatattttttataaaacgtaaacaccgcttaaaatacaccacaaaactcgaagaaaagaacaaagaaataaagcttcagaataaatcaatattggaacagaaaaaacatttagaaagtattaatgatgttaaagacaaattgttttctattgtttcccatgatttaagagattcgttaatctcgacaaaagaatttattgacttattaaaagacggttctctctctcaagatgaatttaagagtttgttacccgaattaagtgagaatgcaaataatgctacccttttattatttaatttattaaattggtctaagtcacaaatgcaatcattaaaatccaaaccttctctttttgatatccaagaggtaatccatcaaaaaataaatttaatcacttcaaaaanccaaagtaaaaacattaaagtaatagataataccctaaacgattttgtatatgcccgatag

SEQ ID NO: 25942 - protein, 243 aa, Unknown
  Obtained from environmental sample
  DOMAIN (132)...(198): His Kinase A (phosphoacceptor) domain
  misc_feature (1)..(243): Xaa is any amino acid
MDSLQGNFKKANFWQSKYFTAKSRLDKESEEKKQLANTLMTIDIEDTIVAPLQIIENPVTKPEPQASNQFKFIFYFLIIAFVVVIIVFIIFFIKRKHRLKYTTKLEEKNKEIKLQNKSILEQKKHLESINDVKDKLFSIVSHDLRDSLISTKEFIDLLKDGSLSQDEFKSLLPELSENANNATLLLFNLLNWSKSQMQSLKSKPSLFDIQEVIHQKINLITSKXQSKNIKVIDNTLNDFVYAR

SEQ ID NO: 25943 - DNA, 456 bp, Unknown
  Obtained from environmental sample
  misc_feature (1)..(456): n is a, c, g, or t
gtgaactgcacaagaaattatgcaatgactgatgttgtttgtaatatattaccaaaagacaaaccaagatatttaatgggagtaggtacccctataaatattttagaaaatatagcattgggtattgatatgtttgattgtgttatgcctacccgaaatggaagaaatggcatgctatttactgctcatggtacaattaatattaaaaataaaaaatgggccgatgatttctcacccattgatgatatgaatatcactatggtcgatacagaatattctaaagcatacctaagacatttatttatatcaaaagaatatttagggaaacaaattgcaacgattcataatcttggattttatttatggttggttcgtgaagctagaaagcatatattagcaggagattttacaagttggaaaaatactatggtaaaacaaatggataaacgcctgtaa

SEQ ID NO: 25944 - protein, 151 aa, Unknown
  Obtained from environmental sample
  DOMAIN (1)...(145): Queuine tRNA-ribosyltransferase
  misc_feature (1)..(151): Xaa is any amino acid
MNCTRNYAMTDVVCNILPKDKPRYLMGVGTPINILENIALGIDMFDCVMPTRNGRNGMLFTAHGTINIKNKKWADDFSPIDDMNITMVDTEYSKAYLRHLFISKEYLGKQIATIHNLGFYLWLVREARKHILAGDFTSWKNTMVKQMDKRL

SEQ ID NO: 25945 - DNA, 645 bp, Unknown
  Obtained from environmental sample
  misc_feature (1)..(645): n is a, c, g, or t
ttgtttcccattaagttaatgagtagtttgtataaagcgaataagatcattaaaaagtttaaaccaaatgtagtcatcggtacaggaggttttgcatcaggtccaaccttacatatggcagcaaaaaaaggaataccgacattagtgcaagaacaaaactcatatccgggtatcactaataaaattttaggtaaaaaagcgaatgttatttgtgtggcttatgacggcttagaacgtttttttccagtcgataaaattgttaaaacagggaatccggtacgtcaggatctattagaaatttctcaaaaaagaaaagaagcacaacaatcttttaaacttattacaactcaaaaaacattattggttttaggagggagcttgggagcaagaactattaataaactcatcgaacacaatatcgaatggctagtagaaaaccgtgtacaagttatatggcagacaggcaaactatactatgatgattacaagcattttaaagaattagaaggagttcaaacttttgagttcatcaatacaatggatctggcttatgctgcagcggatattatcatcagtagggcaggtgcaggctctattccagaattatgcatcgtggtaaacctgtcattttattccatcacctaa

SEQ ID NO: 25946 - protein, 214 aa, Unknown
  Obtained from environmental sample
  misc_feature (1)..(214): Xaa is any amino acid
MFPIKLMSSLYKANKIIKKFKPNVVIGTGGFASGPTLHMAAKKGIPTLVQEQNSYPGITNKILGKKANVICVAYDGLERFFPVDKIVKTGNPVRQDLLEISQKRKEAQQSFKLITTQKTLLVLGGSLGARTINKLIEHNIEWLVENRVQVIWQTGKLYYDDYKHFKELEGVQTFEFINTMDLAYAAADIIISRAGAGSIPELCIVVNLSFYSIT

SEQ ID NO: 25947 - DNA, 321 bp, Unknown
  Obtained from environmental sample
  misc_feature (1)..(321): n is a, c, g, or t
atgaaaagctattttgtttatatattaaaatgtaaagacgatttattatatattggaattacgaataatttaaatagaagactaatagagcataatcaaggtttaaataaaacatgctttacttttaaaaggagaccggttgaaattattttctatcaagattttaatgatgtaaatcaagtcatttattttgaaaagaaaattaaaaaatggagcggtaaaaagaagttggcattggcaaatggagattttgatatgttacaaatattggcggaatgtagaaatgctacacattcaaattataagcctgagaatgattga

SEQ ID NO: 25948 - protein, 106 aa, Unknown
  Obtained from environmental sample
  DOMAIN (3)...(84): GIY-YIG catalytic domain
  misc_feature (1)..(106): Xaa is any amino acid
MKSYFVYILKCKDDLLYIGITNNLNRRLIEHNQGLNKTCFTFKRRPVEIIFYQDFNDVNQVIYFEKKIKKWSGKKKLALANGDFDMLQILAECRNATHSNYKPEND

SEQ ID NO: 25949 - DNA, 615 bp, Unknown
  Obtained from environmental sample
  misc_feature (1)..(615): n is a, c, g, or t
atgcgaagcttctttttaggtaatggctttaaagatattgtagatacaaataactttaataaaatagactttaatggctcgtggggcgcatcagacgaagacttatacgaccaagctgatatcgaactcactaaacttaaaaaacaaaataaaccatttttaagtcttatattttccagctccaaccatagcccgtatgaatttcctgacgataaaataaccctgtacgacaaacaaaaacaaacccgcaataatgcggcaaaatacgctgactacgcgctaggtacatttattgaaaaagctaaaaagtcgagctactgggacgatacggtatttattgtaatagccgatcacgactcgcgtgtatcaggcgctagcttggtgccaattgatcactttagaattccagcggttatttttggtaaagacattgcccataaacgcgataatcaactagccagccaactcgatattcccgttactttactatctttaattggcgtaagtggcaaacaccctatgataggccatgatttatcaaaacctattagcgacaacaaacaaacgcgcaatgatgcaatacgacaaaaactttgcctatatgcacgacaataa

SEQ ID NO: 25950 - protein, 204 aa, Unknown
  Obtained from environmental sample
  DOMAIN (1)...(199): Sulfatase
  misc_feature (1)..(204): Xaa is any amino acid
MRSFFLGNGFKDIVDTNNFNKIDFNGSWGASDEDLYDQADIELTKLKKQNKPFLSLIFSSSNHSPYEFPDDKITLYDKQKQTRNNAAKYADYALGTFIEKAKKSSYWDDTVFIVIADHDSRVSGASLVPIDHFRIPAVIFGKDIAHKRDNQLASQLDIPVTLLSLIGVSGKHPMIGHDLSKPISDNKQTRNDAIRQKLCLYARQ

SEQ ID NO: 25951 - DNA, 612 bp, Unknown
  Obtained from environmental sample
  misc_feature (1)..(612): n is a, c, g, or t
gtggactcaagaatccggctcgagactcaagaaaacatagctaaaatgtttgaagatgctgaaaaaaatgcacctacaattatttttatcgatgaaattaatgaattactaccaaaccgggatagtgattcacatgaaatgtcaaaaagtgcagttaatgaaatgctagcgcaaatggatagaactggtgaaaaaggtatttttataattggtgcaacaaactatcctgataagatagaccctgcaatgcttaggtctggtcgattagaaaagaaattttatttacctccaccagattcaaaattgagaaaagctctttttgaaatgagcctaaacaaaaggaaaaaggtattagattttggtatcaattacgacaggctctccgaactaactaataattatgtaagctctgatattgaggctataattaatgaagctacttcaatcgcaatgtcagatgattctaaaatcaccatgtttttgttggagaaagtaataaaatcatttcaacctttttcattggacgaacttaagaaatatcaaatcttgaaggcaaaaattgatggaaatagtattgaacaaaaaagcgatagacccaaaatcggattttaa

SEQ ID NO: 25952 - protein, 203 aa, Unknown
  Obtained from environmental sample
  DOMAIN (1)...(152): ATPase family associated with various cellular activities (AAA)
  misc_feature (1)..(203): Xaa is any amino acid
MDSRIRLETQENIAKMFEDAEKNAPTIIFIDEINELLPNRDSDSHEMSKSAVNEMLAQMDRTGEKGIFIIGATNYPDKIDPAMLRSGRLEKKFYLPPPDSKLRKALFEMSLNKRKKVLDFGINYDRLSELTNNYVSSDIEAIINEATSIAMSDDSKITMFLLEKVIKSFQPFSLDELKKYQILKAKIDGNSIEQKSDRPKIGF

SEQ ID NO: 25953 - DNA, 792 bp, Unknown
  Obtained from environmental sample
  misc_feature (1)..(792): n is a, c, g, or t
gtgtacacgggactgaaaaaagtgaaagcagngaaagcgagcgctgtaatagataggcagtccatagccgcgttcgccttgaatttagaagaaaacttgaaacaactgcaaggtgaactgcaaagcaagcagtatcgcgcacagccagtcaaacggatagaaataccgaaagatgatggtggtgtgagactgctgggaattccaacagttcgcgaccgcatagtacaacaaacactattgaacattctccaaccgctcttcgacatcgactttcacccatcaagttatgggtacaggccgaaacgaagttgtcatgacgccatcagcaaagccacggtatttattcgtaaatatcaccgtgagtgggtggttgatatggatctgtcgaagtgttttgacctactcgatcacgacttgatcataagcagcgtcaaacgcaaagtgacagacggtagcatcttaaaactgctcaaacagtttttaaaaagcggagtaatgataggcaataattgggaagcgagtgagctaggaagtccacaaggtggtgttatcagtccattgttggcgaatatctacctagatgcatttgatcaagacatgaaaaagcgaaatcacagaatagtgaggtacgccgacgacatattgatcttatgctgcacagaaaaagcagccaagaatgcactcacagtagcgactcagatactcgaaaaaggcttacagttaacagtcaaccaaaagaaaacgcacatagcgcatactagtgaaggcgtacacttttgggagtgcagatag

SEQ ID NO: 25954 - protein, 263 aa, Unknown
  Obtained from environmental sample
  DOMAIN (46)...(259): Reverse transcriptase (RNA-dependent DNA polymerase)
  misc_feature (1)..(263): Xaa is any amino acid
MYTGLKKVKAXKASAVIDRQSIAAFALNLEENLKQLQGELQSKQYRAQPVKRIEIPKDDGGVRLLGIPTVRDRIVQQTLLNILQPLFDIDFHPSSYGYRPKRSCHDAISKATVFIRKYHREWVVDMDLSKCFDLLDHDLIISSVKRKVTDGSILKLLKQFLKSGVMIGNNWEASELGSPQGGVISPLLANIYLDAFDQDMKKRNHRIVRYADDILILCCTEKAAKNALTVATQILEKGLQLTVNQKKTHIAHTSEGVHFWECR

SEQ ID NO: 25955 - DNA, 309 bp, Unknown
  Obtained from environmental sample
  misc_feature (1)..(309): n is a, c, g, or t
ttggtatcacttattcgaagggcttgtggtattgacaaagaattgaagccttatgaccagacgatagagaaaaactttaatagctggttgtttaaacagcatgctggccaacacaaccgtttttcggcagagcaattggattggcttcgtatgatcaaagaccacgtggtaagtagctatcatattgaattggatgatctggactacacaccttttgatgcccaaggagggaagggtaaaatgtatcaattatttggaaaggaaatgaatggaattattgatgaacttaatgaagtattggcagcataa

SEQ ID NO: 25956 - protein, 102 aa, Unknown
  Obtained from environmental sample
  misc_feature (1)..(102): Xaa is any amino acid
MVSLIRRACGIDKELKPYDQTIEKNFNSWLFKQHAGQHNRFSAEQLDWLRMIKDHVVSSYHIELDDLDYTPFDAQGGKGKMYQLFGKEMNGIIDELNEVLAA

SEQ ID NO: 25957 - DNA, 495 bp, Unknown
  Obtained from environmental sample
  misc_feature (1)..(495): n is a, c, g, or t
atgagaaaagattgggaagaatgtttgctgggagatatttcatcaaaaattacaaagggaagtacacctaccacctacggttataaatatcaaaatgaaggaattaatttcattaaaattgaaaatgtagttaatggtagaattgaattaaaaagtatttatcaattcatttctgaagaagctcatatttctcaaaagcgttcacaattaaaagaaggagatgttttgttctctattgcaggtacaataggtgaaacttgtttaatatcaaaagatgttttaccagcgaataccaatcaggcttttgcaataattaatggttttaatgaagttttaattgccgattttttaagaaagcaacttgactctnttgtttcaagaaaattgaaagctaaagcaagaggaggtgctatgaataatgtatcgctaacagaatttgaaggaattaactttagtcattcccacattgggtcggacaaaaagcctttgtcataa

SEQ ID NO: 25958 - protein, 164 aa, Unknown
  Obtained from environmental sample
  DOMAIN (5)...(160): Type I restriction modification DNA specificity domain
  misc_feature (1)..(164): Xaa is any amino acid
MRKDWEECLLGDISSKITKGSTPTTYGYKYQNEGINFIKIENVVNGRIELKSIYQFISEEAHISQKRSQLKEGDVLFSIAGTIGETCLISKDVLPANTNQAFAIINGFNEVLIADFLRKQLDSXVSRKLKAKARGGAMNNVSLTEFEGINFSHSHIGSDKKPLS

SEQ ID NO: 25959 - DNA, 420 bp, Unknown
  Obtained from environmental sample
  misc_feature (1)..(420): n is a, c, g, or t
ttggtatcatattcttgtgcaataattaagaatatcacaaaagttatggatgaaaaatttacattatattnttcgttgtcacctgtaattaaaagagaaataaatagatatgttgtagaaactacgcaagccaatattggtattgcttcaatagaaagtttcgtttatcctttatgttcaaaacaagaacaacaccaaatcgttcgagaaatcgagtctcgtctatctgtttgtgataaaatagaagaaagtattaaggatagtttagaaaaagcaaatgcgttaaggcaaagtattttaaaaaaagcctttgagggtaaattgttgagttctgccgaaattaccagatgcaagcagtccaaagattatgagccagctggtgttttgttggagaggataaaaaatgggaaaaatggataa

SEQ ID NO: 25960 - protein, 139 aa, Unknown
  Obtained from environmental sample
  misc_feature (1)..(139): Xaa is any amino acid
MVSYSCAIIKNITKVMDEKFTLYXSLSPVIKREINRYVVETTQANIGIASIESFVYPLCSKQEQHQIVREIESRLSVCDKIEESIKDSLEKANALRQSILKKAFEGKLLSSAEITRCKQSKDYEPAGVLLERIKNGKNG

SEQ ID NO: 25961 - DNA, 621 bp, Unknown
  Obtained from environmental sample
  misc_feature (1)..(621): n is a, c, g, or t
atgaagtatatgcatcggtatgcgatcaatataaagctaagttatgaaagagaaagtgctcttgaattatatcctcaatactctgaagaagagttgaagtggtgggataactttgtgcagcaagctaccaacccaaaaagtaaaatatggaaacaaaatttttcagaagagaaaaatgctcttttttatgactccacgaagaaaaagtcttttaaagaaaaatacaacgcacttgagcagctttccacaaaagaaacagaaatatgccgagtgctaatgtcgtctccagatattcgtgaaatgtcaaattattatcatatcaaattagataaattttttattccaataaacattaaaacaccttttttaaaacgtcggatgtggataataaaaatacccgttagatatgctttgattagtagtaaggataaaacagtaaaaagttattttgatacgtcaatagaaagcgttatatataaaaaagcttctctatttaaaaaaatgtcaattctctctaaagcagaaaatgatcaagttaatatttatgtatccaaattcggagtacattatagaacctcgttttatacgatcgatagaagtgattatggcctaagcatgtga

SEQ ID NO: 25962 - protein, 206 aa, Unknown
  Obtained from environmental sample
  misc_feature (1)..(206): Xaa is any amino acid
MKYMHRYAINIKLSYERESALELYPQYSEEELKWWDNFVQQATNPKSKIWKQNFSEEKNALFYDSTKKKSFKEKYNALEQLSTKETEICRVLMSSPDIREMSNYYHIKLDKFFIPINIKTPFLKRRMWIIKIPVRYALISSKDKTVKSYFDTSIESVIYKKASLFKKMSILSKAENDQVNIYVSKFGVHYRTSFYTIDRSDYGLSM

SEQ ID NO: 25963 - DNA, 438 bp, Unknown
  Obtained from environmental sample
  misc_feature (1)..(438): n is a, c, g, or t
atggatgcagaattaccaaatgctattgataaatctaaattatcaattagaacagattccttaaaaaatgatatagatatggtattacaaaaaatggttcaggataacctagtctattactttgcttgtgcggatatgaatggcagattaaacgatacaaaaaaaaccaagagtatagaaagagatagcgccattaaactgtcaataaatccagaggacattacaaaagctacttttagattattactagaaaaagatgatatgatgcaagcaggaataatgagctatgattcatttttaattcctatttgtgaactaaccagcgataattttaatagtacaggcacaacaatagaacaaataggtgcagatggtacgatggagttagaaaatagtatttggaaagtaaaaaacaagttacccattaaagttatttaa

SEQ ID NO: 25964 - protein, 145 aa, Unknown
  Obtained from environmental sample
  misc_feature (1)..(145): Xaa is any amino acid
MDAELPNAIDKSKLSIRTDSLKNDIDMVLQKMVQDNLVYYFACADMNGRLNDTKKTKSIERDSAIKLSINPEDITKATFRLLLEKDDMMQAGIMSYDSFLIPICELTSDNFNSTGTTIEQIGADGTMELENSIWKVKNKLPIKVI

SEQ ID NO: 25965 - DNA, 435 bp, Unknown
  Obtained from environmental sample
  misc_feature (1)..(435): n is a, c, g, or t
atgatttatctcattattctcttactcatcacgcatattgcagcactttattttattaacaaattcattactgcctacaagcttaacaatcataattacattaacagagagcttaaaaaacttaacgaactttttttacaaggagttacttctattgaccatagtgtaaacacactaacagataaaacgtctcaatcttttgagaagttgaaatctgaaaacacagaatttattaaatcacacaagagtaattttaatgatgtgaccacctttataaaagaggactatacgtctcttacaaaaatactttctactaataatgaactcttgagtcagttactcgataaaacggacgagaatatcacaaaaaacgccgccctaaagcccattctcataaacagcaatcacgaattggacaaagttatagtcaaataa

SEQ ID NO: 25966 - protein, 144 aa, Unknown
  Obtained from environmental sample
  misc_feature (1)..(144): Xaa is any amino acid
MIYLIILLLITHIAALYFINKFITAYKLNNHNYINRELKKLNELFLQGVTSIDHSVNTLTDKTSQSFEKLKSENTEFIKSHKSNFNDVTTFIKEDYTSLTKILSTNNELLSQLLDKTDENITKNAALKPILINSNHELDKVIVK

SEQ ID NO: 25967 - DNA, 645 bp, Unknown
  Obtained from environmental sample
  misc_feature (1)..(645): n is a, c, g, or t
ttggcaagtcttaaagaaattagaagtttagaaaccaactttaggagttattcagaagtcatcaactttaataattcattttttaaacacactgcaaattttattgataatgagtcgtataaaaatttgtttttagatggaaatacgcaattagaaaatgctaaaaaaggtggctatgtttcactttcatttttggataaagaagaagaaaaggaagatgaaaaagtaaaatatccgaagaaagttttagaaaatatacacgaattaaaagaagatttttctttgggtgaaatatgtattttaacaagaaaaagagcagatggagttgcgattgctaattatctatcagaaaatggaattgatataatatcatcagaaactttattgttgcaaaacagtccaaaagtttgttttattgttgatgttctaaaagttttacaaaatccgaatgatgaggaaacccgatttgaaatgttatattttttacatcaacatttacaaattgaaaaaccaaaacatatttttttaaatgaatatgcaaaatctgataacaaaaccatttttgaggctttaaatagctgtggatttcttttgatatttcaacctttcatcanatctattttatgggaaatgaagaatatatga

SEQ ID NO: 25968 - protein, 214 aa, Unknown
  Obtained from environmental sample
  misc_feature (1)..(214): Xaa is any amino acid
MASLKEIRSLETNFRSYSEVINFNNSFFKHTANFIDNESYKNLFLDGNTQLENAKKGGYVSLSFLDKEEEKEDEKVKYPKKVLENIHELKEDFSLGEICILTRKRADGVAIANYLSENGIDIISSETLLLQNSPKVCFIVDVLKVLQNPNDEETRFEMLYFLHQHLQIEKPKHIFLNEYAKSDNKTIFEALNSCGFLLIFQPFIXSILWEMKNI

SEQ ID NO: 25969 - DNA, 654 bp, Unknown
  Obtained from environmental sample
  misc_feature (1)..(654): n is a, c, g, or t
atgcttcaagttttaccagaagtttttgatgtagatgatatctacagaaaatataaaggtgaggatgtaaaaactgaaatcacaattcttggtgcttatgacttacataatgaaaagactaaaaaattaattggtgtagattttaatgagttatcatggagtagatatattgaaagtaggaggaaagtagcaagttttatatctaaattttacaagaaaaatgatgtaaagctgaaagacctagatttaaaatttattacagatttagaatactactttaaaacagatttaaatttaagacatgctactgtttatagaagtttacagagaataaagaaaattatattatttgctatagcagaaaattatttacaaaaagatccatttacgttatttaaaaacaagaagtataaaactgagattgtatatctaacaggagatgaattaaataaactagaaaatcatttgtttgctcaagataaattacagaaagttaaagatatgtttgtttctcgttgttatacaggtttagcatatcaagaaatggctaatttaaaaacagagaatattataattaattttgatggtcataaatggataccgattaaacgccagaaaacttcaaaaaataatttctttaactctaataagtaa

SEQ ID NO: 25970 - protein, 217 aa, Unknown
  Obtained from environmental sample
  misc_feature (1)..(217): Xaa is any amino acid
MLQVLPEVFDVDDIYRKYKGEDVKTEITILGAYDLHNEKTKKLIGVDFNELSWSRYIESRRKVASFISKFYKKNDVKLKDLDLKFITDLEYYFKTDLNLRHATVYRSLQRIKKIILFAIAENYLQKDPFTLFKNKKYKTEIVYLTGDELNKLENHLFAQDKLQKVKDMFVSRCYTGLAYQEMANLKTENIIINFDGHKWIPIKRQKTSKNNFFNSNK

SEQ ID NO: 25971 - DNA, 654 bp, Unknown
  Obtained from environmental sample
  misc_feature (1)..(654): n is a, c, g, or t
atgatgaaaaaatttataggcttcataaaaaaggaattctatcatatttttagagatagacgctcgttatttatcctctttgggatgcctattgcccaaagtgtactttttggttttgccattactaacgaaattaataatgtagatattgctattcttgatcattcaaaggatgcaaccactaaagaaattataaacaaaataacggcttcaaagtacttcagcatcaaacaggttattaaaaaagaatcggatatggaagctattttccaaaaaggaaaagtaaaagccgttttaaattttgaaaaagatttcagtaaaaatctcattaaaaatcacaccgcaaccttacaaattattactgatgccacagaccccaatacagcaaacacaatacgtaattttattggtgccattcttcagaaataccaaaaagaattaaataatgacgtaacaatagtctatcaaatagtaccagaaactcgtatggtctataacccagaattaaaaagtgtatatatgtttgttcccggtgttatgacaattattttgatgctggtttcggcaatgatgacctctatttccattaccagagaaaaagaattaggaacaatggaaatacttttagtctctcccataaaccatctcaagtaa

SEQ ID NO: 25972 - protein, 217 aa, Unknown
  Obtained from environmental sample
  misc_feature (1)..(217): Xaa is any amino acid
MMKKFIGFIKKEFYHIFRDRRSLFILFGMPIAQSVLFGFAITNEINNVDIAILDHSKDATTKEIINKITASKYFSIKQVIKKESDMEAIFQKGKVKAVLNFEKDFSKNLIKNHTATLQIITDATDPNTANTIRNFIGAILQKYQKELNNDVTIVYQIVPETRMVYNPELKSVYMFVPGVMTIILMLVSAMMTSISITREKELGTMEILLVSPINHLK

SEQ ID NO: 25973 - DNA, 840 bp, Unknown
  Obtained from environmental sample
  misc_feature (1)..(840): n is a, c, g, or t
gtgcctcaattacggggagatacccgcaaagttctcaacaaagacaaacatcccttctatcaacattcagaagcagatttcttcctggctgaagataacaacagaatcttaggtagaattgcagcaattgccaattccagatcaaatagcgccaataaattaaacactgttttcttttactatttcgaatcaatcaatgatagcgaggtgtctggcgcattattcaatgaagttataaattggaccaaggaaagaggtcataccaaagtctacggccctaaaggattgcttcaaggagacggggtaggacttcttgttgacggctttgattttattcccgccgtcggcattccctataattttgattattatgaccatctagtgaaagaagcaggatttgaaaagaaattcgattatttttccgcctacgtggacacaaaagctggcctttctgacaaagttagacgtgtcgccgaaaaagtaaagaagcgaagtggattctgggttagaaaatttgaaaaaaaagaagagatcatggcaataactccagaattgcgaacggtttataacagtgcctttggaggatctgagggtttcagtccaataacagaagaagagattgtagttattgccgagcgcatgttatcagtcgctgacccacgcttgatcaaactggtgtataaggacgataaaatcattggatttctgttcagttatccaaatatctgncgaagtttgcagaaaaccaatggtcggttattcctttcggttggttccacatcatgcgagatttcaaacactaagtatatggatccaccggatgggttctaccgaatatag

SEQ ID NO: 25974 - protein, 279 aa, Unknown
  Obtained from environmental sample
  misc_feature (1)..(279): Xaa is any amino acid
MPQLRGDTRKVLNKDKHPFYQHSEADFFLAEDNNRILGRIAAIANSRSNSANKLNTVFFYYFESINDSEVSGALFNEVINWTKERGHTKVYGPKGLLQGDGVGLLVDGFDFIPAVGIPYNFDYYDHLVKEAGFEKKFDYFSAYVDTKAGLSDKVRRVAEKVKKRSGFWVRKFEKKEEIMAITPELRTVYNSAFGGSEGFSPITEEEIVVIAERMLSVADPRLIKLVYKDDKIIGFLFSYPNIXRSLQKTNGRLFLSVGSTSCEISNTKYMDPPDGFYRI

SEQ ID NO: 25975 - DNA, 582 bp, Unknown
  Obtained from environmental sample
  misc_feature (1)..(582): n is a, c, g, or t
ttgattaaacaagcttcagcatatgagtttatgtttttgccgaaatatattcatgctttctttgaaaccgcaaaaacaaatacgtctgaaagcttgattaaaaactcgaccgtattatatcaaaaaaaagaaacaaatacagcatcccctgttctattaagtccattggtgataattggcctattagccattatcattttatttataacgtataaagattataaaaataaggtacgaagtaagtggttagatactctactttttagtgttacaggaattattggtatcgttattttgttattatggtttgcgactgaccattctgcaacggctcaaaattataatgttttgtgggcattcccgcttaacatttttgtagtcgctcaattgctgaagccaaaagttaaaacatggtttaaaaagtatttaaaattcctaattattatgctttgtttactaacgtcgcattggataatcggagtgcaagtctttgcaatgggtttaattccattacttatagcactattagtaagatatatctatttggtaaattctttaatcagaattaagcttaaacactag

SEQ ID NO: 25976 - protein, 193 aa, Unknown
  Obtained from environmental sample
  misc_feature (1)..(193): Xaa is any amino acid
MIKQASAYEFMFLPKYIHAFFETAKTNTSESLIKNSTVLYQKKETNTASPVLLSPLVIIGLLAIIILFITYKDYKNKVRSKWLDTLLFSVTGIIGIVILLLWFATDHSATAQNYNVLWAFPLNIFVVAQLLKPKVKTWFKKYLKFLIIMLCLLTSHWIIGVQVFAMGLIPLLIALLVRYIYLVNSLIRIKLKH

SEQ ID NO: 25977 - DNA, 408 bp, Unknown
  Obtained from environmental sample
  misc_feature (1)..(408): n is a, c, g, or t
atgaaagttaataaattggcaaatcaaattcacgctacaaaaaacgatgtaagagttacaaaaattggagcatttttaagaaaaacaagtatggatgaattacctcagtttgtaaatgtcttgtctggagatatgagtgttgttggtccaagaccacatttagaaagcttatctttagagtatcagaaagatgtaaacgattatttgaaaagacatattgtaaaaccgggaattacaggactagcacaaattagtggttatagaggagaaattaagaaaaaaacagatattaaaaacagagtacgtttagatattttttacatcgaaaactggtcgtttttgttagatattacaattattattcaaactgttttaaacgtttttaaaggagaagaaaaagcgtactaa

SEQ ID NO: 25978 - protein, 135 aa, Unknown
  Obtained from environmental sample
  DOMAIN (1)...(135): Bacterial sugar transferase
  misc_feature (1)..(135): Xaa is any amino acid
MKVNKLANQIHATKNDVRVTKIGAFLRKTSMDELPQFVNVLSGDMSVVGPRPHLESLSLEYQKDVNDYLKRHIVKPGITGLAQISGYRGEIKKKTDIKNRVRLDIFYIENWSFLLDITIIIQTVLNVFKGEEKAY

SEQ ID NO: 25979 - DNA, 678 bp, Unknown
  Obtained from environmental sample
  misc_feature (1)..(678): n is a, c, g, or t
atgattcaatatataaatcagaaacaaattaaatcaaaacgtttaacttttataatcattttattaagctcttgtttctttgcgcaagcacaatattcagaagagtttagtcgtctaaaaaagaagtatcctgatgcttcatttgttaggctattagatgaagttaatatttcagtaaagctgaagaataatcaactagaaattaagcaacactttttagaagaagatttatttttagatgaatctgcaacttacggctccaagaaatccttagatttttcaacattttttgagttagaatctgttgaagccacatcttaccaatacaaaaatggcaaatacaaatcatttaaagttgaagattttgtagaaaaagatgagctcggtgattcttttcatgatgatactaaatcactcaatttcatctattccaatttagctgaaggaggtaaaactaaattagaatacactgaaattgttaagaatcccagatttttaagtccaatatactttggtaacttctaccctataaaaaacagaaaggtcactttagaagccgataaagaaatcaatctaaagtttaaagagtttaatacagaaggttatgatatcacttttaaaaagaagcaaacgcaattcaaacatctacacttgttcaatactcgagccgattcttga

SEQ ID NO: 25980 - protein, 225 aa, Unknown
  Obtained from environmental sample
  misc_feature (1)..(225): Xaa is any amino acid
MIQYINQKQIKSKRLTFIIILLSSCFFAQAQYSEEFSRLKKKYPDASFVRLLDEVNISVKLKNNQLEIKQHFLEEDLFLDESATYGSKKSLDFSTFFELESVEATSYQYKNGKYKSFKVEDFVEKDELGDSFHDDTKSLNFIYSNLAEGGKTKLEYTEIVKNPRFLSPIYFGNFYPIKNRKVTLEADKEINLKFKEFNTEGYDITFKKKQTQFKHLHLFNTRADS

SEQ ID NO: 25981 - DNA, 504 bp, Unknown
  Obtained from environmental sample
  misc_feature (1)..(504): n is a, c, g, or t
ttgggatatctgccaaccattaatgatgatgtattaaacgatcntttggataagattcgatatttaattggcgatttttcattagttgtttatagtgcaattcaagaatctttgagctgggttaaaacggntgaaggtcggtctagcattacatttgataattcatgtattaaagagaatgttgaattgacaaaagaaaattgtgttattatcatgaataataccataggcggcaatgctgaaaaagattcatttaagatgttggcattagatgtcgcattagggagcatggatgttttcaatggtggtatttcaaatgaattattaactttttgtagtattgaatccgacaagaaaactgaaaatgaccatgaagactcattttgttttaagttaatctataagaggatatcggcagcagaaaacgaattgattgttggatgttctaaagatagaggtaaaacctgggttccgtacttaaaaactctttacaagcgaaaatag

SEQ ID NO: 25982 - protein, 167 aa, Unknown
  Obtained from environmental sample
  misc_feature (1)..(167): Xaa is any amino acid
MGYLPTINDDVLNDXLDKIRYLIGDFSLVVYSAIQESLSWVKTXEGRSSITFDNSCIKENVELTKENCVIIMNNTIGGNAEKDSFKMLALDVALGSMDVFNGGISNELLTFCSIESDKKTENDHEDSFCFKLIYKRISAAENELIVGCSKDRGKTWVPYLKTLYKRK

SEQ ID NO: 25983 - DNA, 903 bp, Unknown
  Obtained from environmental sample
  misc_feature (1)..(903): n is a, c, g, or t
ttggtctgtattccagaaaagcaaaaaataactatagctaataaaggacaagaacaaacttttatatttactatcattccgcctaaaaaccaaagcgaaggtttaattagtccaatggttaccattggcgacaagacttacaccaaggaattagtagaaattaactacgagcatattccgtttcaaacggtattacttcctagcgaaagcaaaatagtacgattagatattaaaaaacgtggcgaaaacatagcctatattgaaggtgcaggagacgtagtaccagaaagtttaaaacaaattggctacaacgttatgattttgcaaccagaagaaattactccagaacgacttagtgcttttgatgcagttgtggttggtattagagcttataacattgtcgaatccctaaaatttaaacaagatattttatttaattttgttgaaaaaggaggaaacatgattgtgcaatacaataccaatcgtggtattaaagtagataatattgcaccttttaatttacaattatcacgagatagagttacagatgaaagtgcagaagtaaccttattagctccaaaccacgagttacttaattttcctaacaagataaccactaaagattttgaaggttggacgcaagaacgtggattgtattttcctgaccaatggtcatcagacttcactcctatcctatccatgcatgataaagacgaaactgctaaaacaggaagtcttttagtggctaaaaatggtaaaggacactatatatacactggattaagctttttaagagaattccctgtnggtgtatctggtgcttacagattatttgccaatatggtaagtataggaaaaccagaaattactaatgaatacgggattaaaaaattaattcttnnt

SEQ ID NO: 25984 - protein, 301 aa, Unknown
  Obtained from environmental sample
  misc_feature (1)..(301): Xaa is any amino acid
MVCIPEKQKITIANKGQEQTFIFTIIPPKNQSEGLISPMVTIGDKTYTKELVEINYEHIPFQTVLLPSESKIVRLDIKKRGENIAYIEGAGDVVPESLKQIGYNVMILQPEEITPERLSAFDAVVVGIRAYNIVESLKFKQDILFNFVEKGGNMIVQYNTNRGIKVDNIAPFNLQLSRDRVTDESAEVTLLAPNHELLNFPNKITTKDFEGWTQERGLYFPDQWSSDFTPILSMHDKDETAKTGSLLVAKNGKGHYIYTGLSFLREFPVGVSGAYRLFANMVSIGKPEITNEYGIKKLILX

SEQ ID NO: 25985 - DNA, 537 bp, Unknown
  Obtained from environmental sample
  misc_feature (1)..(537): n is a, c, g, or t
atgaattttaaagcgagtttattctttgttgtgacgatattttcaattggtttaatgtcatttcaattgcctgaaaaaatccaaaagaaagtagataaagaaataaagttaattttcaatattgatgttttcgtattagagccaattattgtgtctgaagaaattaatgccaaattgcgtactaagataaacgaaaatgatctttttaaaatttcattagatactgtttctttgggatatgcctatattggcaaagggtttggtaaagtagatgactttgattttttagtactatttgataccgatttaattattgttaagagcaagatactagtgtatcgggaagattatggaggagaaataggtagcaaacgctggcttaaacaatttaatggtaaaggcaaaaatgatactattgaatatgaaaaagatattattgcaatttctggagctactttgtcagcaaactctatgacagttgcagtcaacaatttgcttagaactataactattcttcataactataaagcaatttaa

SEQ ID NO: 25986 - protein, 178 aa, Unknown
  Obtained from environmental sample
  SIGNAL (1)...(20)
  DOMAIN (80)...(169): FMN-binding domain
  misc_feature (1)..(178): Xaa is any amino acid
MNFKASLFFVVTIFSIGLMSFQLPEKIQKKVDKEIKLIFNIDVFVLEPIIVSEEINAKLRTKINENDLFKISLDTVSLGYAYIGKGFGKVDDFDFLVLFDTDLIIVKSKILVYREDYGGEIGSKRWLKQFNGKGKNDTIEYEKDIIAISGATLSANSMTVAVNNLLRTITILHNYKAI

SEQ ID NO: 25987 - DNA, 495 bp, Unknown
  Obtained from environmental sample
  misc_feature (1)..(495): n is a, c, g, or t
gtgactgaacaagataaaggtatttatgccttatgcagtccaaatcgtttgctagatttagcctataaatacattgtctttgacggtccagacaaaaaagtatgtcgttatcagcaatatttcgcagttcaagacaccatacaacgtgtaaaatcgcgaactaaagaaggcaaccgtcaaggtggtgttatttggcacaccacaggtagcggaaagtccttaaccatggttatgttgtccaaagcactagcgttagatacaagtattgaatcgcctagaataattatcgtaacagatagaataagtttagataaacaaatctttaaaacttttgttaattgtggtaaacacgtcaagaaagccaaaagtggcaacgatttagtggagctattacaagataagggcaatgaaatcatcacgaccataatagataaatttgaaattgccaacaaacgtgcgtcatttagagatgaatcaaaaaatgtgtnggtctag

SEQ ID NO: 25988 - protein, 164 aa, Unknown
  Obtained from environmental sample
  DOMAIN (33)...(164): Type III restriction enzyme, res subunit
  misc_feature (1)..(164): Xaa is any amino acid
MTEQDKGIYALCSPNRLLDLAYKYIVFDGPDKKVCRYQQYFAVQDTIQRVKSRTKEGNRQGGVIWHTTGSGKSLTMVMLSKALALDTSIESPRIIIVTDRISLDKQIFKTFVNCGKHVKKAKSGNDLVELLQDKGNEIITTIIDKFEIANKRASFRDESKNVXV

SEQ ID NO: 25989 - DNA, 357 bp, Unknown
  Obtained from environmental sample
  misc_feature (1)..(357): n is a, c, g, or t
atgctagaagataaagaacaagaaaaaacctcattagagaaattaggtgaattcggactcatagaacaccttaccaaagattttaaaatcaaacaagaatctaccataaaagcaattggtgatgatgctgcagttttagattttcaaaataaaaaaacagtcataagtccagaccttttaatagagggtgtacattttgaccttgcttatatgccatttaaacatttgggctataaatctatcatggtaaatctatctgatatttatgccatgaatgctactgctactcaagtaaccatttcaattgctgttcccataaattcctttaaaagcactgaaaagttcatgcaggtgtag

SEQ ID NO: 25990 - protein, 118 aa, Unknown
  Obtained from environmental sample
  misc_feature (1)..(118): Xaa is any amino acid
MLEDKEQEKTSLEKLGEFGLIEHLTKDFKIKQESTIKAIGDDAAVLDFQNKKTVISPDLLIEGVHFDLAYMPFKHLGYKSIMVNLSDIYAMNATATQVTISIAVPINSFKSTEKFMQV

SEQ ID NO: 25991 - DNA, 774 bp, Unknown
  Obtained from environmental sample
  misc_feature (1)..(774): n is a, c, g, or t
gtgaaaaagaaaaagaatgatttttgggtttgggacttattaggagaagcatattcgaatgacgctgatgttcagattgcttgtttatgtaaagcattaacattaaacactaaagaaagttttttagtaaaggttcatcagaaactagctgatttgttggttgatagggaattgtataaagaagcttctgcagagatcataaattctatttccattaaacaaaagaataattggaaaattaataatgaattattaaaatatacacatcaagaatggttcgcaaaagatgtacataaaaatgagaacaaacgattctatattgatcaagctgttcttgcagaagagctattgtataataatcatgaagaaatagttattgttatagattttgtaaataccaataaaaaggtcgtaaactttataaaggataaaacaaccaatgggtttttcagctacaagcatttaaaaatgaacccgaaaataggagacatttataacgcaagattaaacccagttggtgtcgatggattttataaagtattaacttttaaaagaagtccaaatacaaatgctgaagtaataaaaaatgtttcagggaatttaagaatcgcagtaaatggagactttggatttataaatgatgatttagtgccatcatatttgattaaaaaaaataagttaaaaaatgatgataagtttaatggtaaagcaatactatctttcgataagaaaaaaggaaattggggatggagagtttttgaacttgataattaa

SEQ ID NO: 25992 - protein, 257 aa, Unknown
  Obtained from environmental sample
  misc_feature (1)..(257): Xaa is any amino acid
MKKKKNDFWVWDLLGEAYSNDADVQIACLCKALTLNTKESFLVKVHQKLADLLVDRELYKEASAEIINSISIKQKNNWKINNELLKYTHQEWFAKDVHKNENKRFYIDQAVLAEELLYNNHEEIVIVIDFVNTNKKVVNFIKDKTTNGFFSYKHLKMNPKIGDIYNARLNPVGVDGFYKVLTFKRSPNTNAEVIKNVSGNLRIAVNGDFGFINDDLVPSYLIKKNKLKNDDKFNGKAILSFDKKKGNWGWRVFELDN

SEQ ID NO: 25993 - DNA, 804 bp, Unknown
  Obtained from environmental sample
  misc_feature (1)..(804): n is a, c, g, or t
gtggtcaaagaaagtgatggaacacgcaaaattgaaaaagaaagagcccaattttattcgatgacagtcagcccatcaaagtatgaattacgacaacttcagaacaatagtcaagatttaaaaacttacactcgtgagctgatgaaagattatgttgccagtttcaatcgtgaaatcaatggacgacctatatcaatagacgacataaaatactacgccaaaattgagcatcaaagaactttcaaggggacggactttcagataaaagagaaccaacctttcgccacaaaaatacttcagctcaaaacggatatccgaaatgttcaagaaggacgagctgaagggaatatcaagaaaatggaaaaggaaattgccaaattagaacgacaagcaccacatcaacaaaacggaaaacgaattgtccagggaatggcgaaagatggaaaccaaagtcatatccatattatcgtgagcagaaaggatgcctcaaattctgtaagtctttcgccaggaagtaaacacaaagcttctgaagttgaaaggcacggaaaaaaagtaaaacgaggttttgatagagatgcatttttcgcgaaagcggaaaaaacttttgataagacgtttggatataagcgcaattacgcagagacctacaaagctaaaaagacctttgtaaagaatccaaacctatatttttccgctttgatgaaattacctgccaatgaaaaagcattggcttttaaaattataagcaaatcaggattgcccatagtgccgtgtattcctggaccgattcttggtccatag

SEQ ID NO: 25994 - protein, 267 aa, Unknown
  Obtained from environmental sample
  misc_feature (1)..(267): Xaa is any amino acid
MVKESDGTRKIEKERAQFYSMTVSPSKYELRQLQNNSQDLKTYTRELMKDYVASFNREINGRPISIDDIKYYAKIEHQRTFKGTDFQIKENQPFATKILQLKTDIRNVQEGRAEGNIKKMEKEIAKLERQAPHQQNGKRIVQGMAKDGNQSHIHIIVSRKDASNSVSLSPGSKHKASEVERHGKKVKRGFDRDAFFAKAEKTFDKTFGYKRNYAETYKAKKTFVKNPNLYFSALMKLPANEKALAFKIISKSGLPIVPCIPGPILGP

SEQ ID NO: 25995 - DNA, 537 bp, Unknown
  Obtained from environmental sample
  misc_feature (1)..(537): n is a, c, g, or t
atgacacataaagtgtttgaaaacgaagagataaaaaatatctttacggctttaggagttactatcggaacagaagaagatagtaaagccttaaatctttcaaaattaagataccataaagtggtgattatgtgtgatgccgatatcgatggtgcgcatattgaaactttaattttaacgttctttttccgttatatgaaagaattgattgaaaatggacatatttatattgccacgcctccattgtttttggtgaaaaaaggtgccaaaaagcaatatgcttggagtgatgatgagcgtaaagcgcttatgcaagaatttggtgatggttccaaaatacaacgttataaaggtcttggggaaatgaatgctgaacaactttgggataccacaatgaacccagaatttagaacgcttcgtcaagtgcaaatagataatggtgtagaagcagatcgtgtcttctctatgttaatgggagatgaggtgccaccgcgtcgcgaatctatcgagaaaaacgccgtatatgccaaaaattga

SEQ ID NO: 25996 - protein, 178 aa, Unknown
  Obtained from environmental sample
  DOMAIN (105)...(170): DNA gyrase B subunit, carboxyl terminus
  misc_feature (1)..(178): Xaa is any amino acid
MTHKVFENEEIKNIFTALGVTIGTEEDSKALNLSKLRYHKVVIMCDADIDGAHIETLILTFFFRYMKELIENGHIYIATPPLFLVKKGAKKQYAWSDDERKALMQEFGDGSKIQRYKGLGEMNAEQLWDTTMNPEFRTLRQVQIDNGVEADRVFSMLMGDEVPPRRESIEKNAVYAKN

SEQ ID NO: 25997 - DNA, 537 bp, Unknown
  Obtained from environmental sample
  misc_feature (1)..(537): n is a, c, g, or t
ttgatctgtatatgcaacattttaaactggcctctcgataaaaaggatcgggataaaactgaatttgccggaactttgcgcttaaaaggggttcgggtcaattccaccaacctgctctcgggactgttgaccctgttcggggttcgcggcaatgaaatggattttggggatctggatattgattttgtggcccgcaacggacggattgaaacctctccgatacgaattgtaatcgacggctatcccatagagctgcgcggctcggtgggctttgacaaaagccttgattatacggccaagctgccgattacccctaagctggttggagataaagcctaccagtaccttgaaggggtgacgattgatgtccccatccgcggtaactcatcaaagccggatattgacgaaagcagcatgcaaaaggccaccgcaagtctggccgaacaggctctccaaaaatcccttgaaaagggtccagaatattttcgaacagattttcaaaaaaaaataaagggtaaccccccatgccgaaattag

SEQ ID NO: 25998 - protein, 178 aa, Unknown
  Obtained from environmental sample
  misc_feature (1)..(178): Xaa is any amino acid
MICICNILNWPLDKKDRDKTEFAGTLRLKGVRVNSTNLLSGLLTLFGVRGNEMDFGDLDIDFVARNGRIETSPIRIVIDGYPIELRGSVGFDKSLDYTAKLPITPKLVGDKAYQYLEGVTIDVPIRGNSSKPDIDESSMQKATASLAEQALQKSLEKGPEYFRTDFQKKIKGNPPCRN

SEQ ID NO: 25999 - DNA, 429 bp, Unknown
  Obtained from environmental sample
  misc_feature (1)..(429): n is a, c, g, or t
gtgaatgatttatacgattttaaattatatacaaatcaaggcgttataaataaaaaaatatggttaaaaggagaggctatcgtcattaaggcaagtctaaaaccttctaccttaacattagataccgttattaattcaccattattttatgaagttcaagaaaactctaaaatattaaaatctttatatttagaaaatgatcaaaatccaaaaattgattctttcctactaaaaaaaatttcagaacacttaaatagccctatcagttttgttatggcagatacctatatgtataggaatagagaaaatcttactcgtttaattcgcttaagagatctatttaatcaacaatcttctaattttaaaaatcatcctctccaaattaatcagaaacttgatgaagctataaatcaattagaaaacaattaa

SEQ ID NO: 26000 - protein, 142 aa, Unknown
  Obtained from environmental sample
  misc_feature (1)..(142): Xaa is any amino acid
MNDLYDFKLYTNQGVINKKIWLKGEAIVIKASLKPSTLTLDTVINSPLFYEVQENSKILKSLYLENDQNPKIDSFLLKKISEHLNSPISFVMADTYMYRNRENLTRLIRLRDLFNQQSSNFKNHPLQINQKLDEAINQLENN

SEQ ID NO: 26001 - DNA, 702 bp, Unknown
  Obtained from environmental sample
  misc_feature (1)..(702): n is a, c, g, or t
atggacatcaaagtctgttgctttattgcaacggattttaaaacgtatttcgggcaaggatctttcaggaactgcgtaagttttaaaatgggattttatcaccattcacgaaagtgccccatgactggtttggaaacaagtatcaccgctgccgatattgccgatatgtggattcacgaatcctttacctcgtacgcagaatcggtttatgtagaatgccgttggggaaaagaagatgcgcttacttatgtatttggtctaagaagatctataggaaatcaatcccctatcattggtgattacggcgtgaacagtgaaggttctggagatatgtattacaaaggcgccaatatgttaaacacgattagaagtgtgattaacaatgataaaaaatggtgggcattattaaaagattttagtcttacctacaaacatcaaattattgacactcctacagtaattaacttttttgagcagcgtacccaagcacacctctcgccaatttttgatcaatatttaaaatacgcccgtttaccggaattacaactaaaagaggaaaacaacaaagtttatgcccgctggaaaaccgatgtcgataattttgatatgccattaagatttacggtggatggaaaggaaatccttgtaatcctactacagaatggaaaaatgccatttaaaagatctagagatgtcaaataa

SEQ ID NO: 26002 - protein, 233 aa, Unknown
  Obtained from environmental sample
  misc_feature (1)..(233): Xaa is any amino acid
MDIKVCCFIATDFKTYFGQGSFRNCVSFKMGFYHHSRKCPMTGLETSITAADIADMWIHESFTSYAESVYVECRWGKEDALTYVFGLRRSIGNQSPIIGDYGVNSEGSGDMYYKGANMLNTIRSVINNDKKWWALLKDFSLTYKHQIIDTPTVINFFEQRTQAHLSPIFDQYLKYARLPELQLKEENNKVYARWKTDVDNFDMPLRFTVDGKEILVILLQNGKMPFKRSRDVK

SEQ ID NO: 26003 - DNA, 402 bp, Unknown
  Obtained from environmental sample
  misc_feature (1)..(402): n is a, c, g, or t
atggataataaaaatatctcattattaaacattgatgaagaaaataaaataatcatcagaaaagattattatggtacttattcttttagtagctggaatgcttataatgtagctaatatacaagttcatcaagttgaaaatttagaatttaatagctctgtagatcgtatagagaatctacaaaaaaacatttctacattatcttcaacaattcctgattggttagaaactaatgaagttttaaaggaaatagaagatgtaaaagaagagtatgcaaccttacttaatgagaaagataaatctaccaaagatataagagaaaattgggaagagttaagtaacgaatttgatgatttacgtgcagaattaagtgaaactgtaaaagattacagaactgagtag

SEQ ID NO: 26004 - protein, 133 aa, Unknown
  Obtained from environmental sample
  misc_feature (1)..(133): Xaa is any amino acid
MDNKNISLLNIDEENKIIIRKDYYGTYSFSSWNAYNVANIQVHQVENLEFNSSVDRIENLQKNISTLSSTIPDWLETNEVLKEIEDVKEEYATLLNEKDKSTKDIRENWEELSNEFDDLRAELSETVKDYRTE

SEQ ID NO: 26005 - DNA, 723 bp, Unknown
  Obtained from environmental sample
  misc_feature (1)..(723): n is a, c, g, or t
ttgggccgcgacctagtggatcaagaatcggtcgagaaatgcagttgggcatatttagtgagagaaaaagtgtataaaactcaactagaaaaatctggaattatagttggagaaaaagatgtttgggatgaaatagtaaatcaaccttttgttcaaaacaatccacaatttaaaaatgaaatagggctatttgacgaagaaaaatttaaagaatacatctcaactttaaaagatgcagctactgaagacgaacaaggcgaagctacatggttaagctggctaaactatgaatcaaacattaagtctaatttacaaattaaaacttacaataatttaataacagccggattaggtgtgactttaaaagaaggtgagcattattattttgataataatactaaattagatttagagtatgtgtatataccatacacctttattgccgacagtttagttaccgttactgatgatgagattaagaaatatgtcaaaagtaatcctgaagattatagaacagaagcctcgcgcgatatcagtttcgtgaaatttgatattatagcgactcctcaagatgaattggctattaaaacacaattagaagaattaatcactgatcgagaagaatacagttcagctgcgaaaactgatgttcacatttcaggctttgccaatactgataacgttgtagcattttcagagataacagttctgatacaccattag

SEQ ID NO: 26006 - protein, 240 aa, Unknown
  Obtained from environmental sample
  misc_feature (1)..(240): Xaa is any amino acid
MGRDLVDQESVEKCSWAYLVREKVYKTQLEKSGIIVGEKDVWDEIVNQPFVQNNPQFKNEIGLFDEEKFKEYISTLKDAATEDEQGEATWLSWLNYESNIKSNLQIKTYNNLITAGLGVTLKEGEHYYFDNNTKLDLEYVYIPYTFIADSLVTVTDDEIKKYVKSNPEDYRTEASRDISFVKFDIIATPQDELAIKTQLEELITDREEYSSAAKTDVHISGFANTDNVVAFSEITVLIHH

SEQ ID NO: 26007 - DNA, 540 bp, Unknown
  Obtained from environmental sample
  misc_feature (1)..(540): n is a, c, g, or t
gtgatcttaaaaggaaaaaaaaagagaactatggaagttttaaaagtttttactagaaattttgggggagtgcccaaaccaagtcttcaattattactaaacttatctaagatcgtttccttaaaaaaaggagataatataagcaacgttggtaaagttgctaaaaacttttatattataaaaagtggtgttgtaagatcttattatgaagatgaaaaaggaaaacaatatacaagaacaattttcacaactcataaaacaacaggctgtttaagttctttaatttctagccaaccttgtaaacttacctatgaatgcttaacagattgcgagttttatcaatttaattttaaggaatttaaaaagttggtaaagaaagatatttatatttcaatgttttatagtaatatgctagaatcaatctttttagttatggaatctagaatttttgatttgtcgcttttaaatgctacagaaaggtatttaaaattaaaaaaggaaatttctaatatcgaagatttgttcctcaattacacatag

SEQ ID NO: 26008 - protein, 179 aa, Unknown
  Obtained from environmental sample
  DOMAIN (35)...(129): Cyclic nucleotide-binding domain
  misc_feature (1)..(179): Xaa is any amino acid
MILKGKKKRTMEVLKVFTRNFGGVPKPSLQLLLNLSKIVSLKKGDNISNVGKVAKNFYIIKSGVVRSYYEDEKGKQYTRTIFTTHKTTGCLSSLISSQPCKLTYECLTDCEFYQFNFKEFKKLVKKDIYISMFYSNMLESIFLVMESRIFDLSLLNATERYLKLKKEISNIEDLFLNYT

SEQ ID NO: 26009 - DNA, 558 bp, Unknown
  Obtained from environmental sample
  misc_feature (1)..(558): n is a, c, g, or t
ttgctctctgcacaatgtactgatgttcgcgtaaatcaaattacgcctatcttatttgaaaaagccgataatccgtacgatatgataaagctttcggtagaagaaattaaagaaatgagtcgtccgtgtggtttatcacctatgaaaagtaaaggtatttacgggctatctaaaattattatcgaaaaatataatggtcaagtcccacatacgtatgaaggtttagaagaattgcctgctgttggccataatacagcgagcgtagtaatgtctcaaggctttggttttcctgcttttcctgtagatacacatattcatcgcttaatgtatcgctggaatttaaccaatggtaaaaatgtattgcaaaccgaaaaagatgctaaacgcatatttcctaaggaaatttggaacgatttacatcttcaaattatatggtacggtagagaatattcaccagcgcgtggttggaatttagaaaaagatattataaccagaactattggaagagcaacggttcttaaagactattataaaaacaataaaaaagcctttaagtaa

SEQ ID NO: 26010 - protein, 185 aa, Unknown
  Obtained from environmental sample
  DOMAIN (1)...(133): HhH-GPD superfamily base excision DNA repair protein
  misc_feature (1)..(185): Xaa is any amino acid
MLSAQCTDVRVNQITPILFEKADNPYDMIKLSVEEIKEMSRPCGLSPMKSKGIYGLSKIIIEKYNGQVPHTYEGLEELPAVGHNTASVVMSQGFGFPAFPVDTHIHRLMYRWNLTNGKNVLQTEKDAKRIFPKEIWNDLHLQIIWYGREYSPARGWNLEKDIITRTIGRATVLKDYYKNNKKAFK

SEQ ID NO: 26011 - DNA, 609 bp, Unknown
  Obtained from environmental sample
  misc_feature (1)..(609): n is a, c, g, or t
gtgattggcgagcaaacctttggtaaaggcactgtacaacagcacaaaggcttagggcgagcgtacgacctgtacgacaacgagcttggcagtgtgcagtatacaattgctaagttttaccgcataaatggtggtagcacacaacacaaaggcgttattcctgatatttcgtttccatctgcaattgatcccgcagagtggggagaaagcaaacaagataatgcactgccgtgggatagcatagtacgcgctagataccaagaaatgggtgacttaaaaccgattattacgtatttagataagcaacatgcgcagcgtattcagtcagagccagagtttaattatgtatttgaagacattactcgctacaacgaagagaaagaccgcaaaactatttcgttagtagaagctcagcgtattaaagaaaaagatgaaaatgaagcacgcgctttagtgcgtactaatgagcgtttagcgcgtttaggtgaaaaaccaatcgaaaacctagatgatgtgccggaagtaattgaaaagctggatccatttttagaggaagcagccctgatcactcaagactatattaaatacgggcgtatagccaaaaagtaa

SEQ ID NO: 26012 - protein, 202 aa, Unknown
  Obtained from environmental sample
  misc_feature (1)..(202): Xaa is any amino acid
MIGEQTFGKGTVQQHKGLGRAYDLYDNELGSVQYTIAKFYRINGGSTQHKGVIPDISFPSAIDPAEWGESKQDNALPWDSIVRARYQEMGDLKPIITYLDKQHAQRIQSEPEFNYVFEDITRYNEEKDRKTISLVEAQRIKEKDENEARALVRTNERLARLGEKPIENLDDVPEVIEKLDPFLEEAALITQDYIKYGRIAKK

SEQ ID NO: 26013 - DNA, 375 bp, Unknown
  Obtained from environmental sample
  misc_feature (1)..(375): n is a, c, g, or t
ttgtttgtttttaaggttctattttggttgttaacagctctgctaacgcgttttcctgaaatcgagtttaaaagtggtgtgaagtcttcacgtaatgtaccagatagattaattgagctatttagttttccttgtaaagctttagttattggagctaatgcttgtaataaatttaagtcattaaatgattgtgcgatgtcaaagttttttgcaccaacattcatattaaaagtaggttttgctgttttggtgtctattagtccttctaggcttaaattaccattaaatatactagaggttacattgtttaattgtgcagtctcatctgcgattttaagacttcctttaacatcttttaatattaagttatcataa

SEQ ID NO: 26014 - protein, 124 aa, Unknown
  Obtained from environmental sample
  misc_feature (1)..(124): Xaa is any amino acid
MFVFKVLFWLLTALLTRFPEIEFKSGVKSSRNVPDRLIELFSFPCKALVIGANACNKFKSLNDCAMSKFFAPTFILKVGFAVLVSISPSRLKLPLNILEVTLFNCAVSSAILRLPLTSFNIKLS

SEQ ID NO: 26015 - DNA, 345 bp, Unknown
  Obtained from environmental sample
  misc_feature (1)..(345): n is a, c, g, or t
atgaaaagtggttataaaattctatggacggaacacgcaatttctgagttagaacaaaccattgtatatttggaaaataattggtctgaaaaagaattaaggaaattctctacaaaacttgatcacactattgagttaatctcaaaaacacctganatatttcctgattcctatgagaaaaaaggaattagaanagctgttgtcgaagaacataacaacttatattatcgcataattgaaaattcaattgaaaataatttcgatctttttcaaccgaaaaaatccaaggcagaaaaaaatataccaaccgttgttataaaccctgcaaaaataccagccccatag

SEQ ID NO: 26016 - protein, 114 aa, Unknown
  Obtained from environmental sample
  misc_feature (1)..(114): Xaa is any amino acid
MKSGYKILWTEHAISELEQTIVYLENNWSEKELRKFSTKLDHTIELISKTPXIFPDSYEKKGIRXAVVEEHNNLYYRIIENSIENNFDLFQPKKSKAEKNIPTVVINPAKIPAP

SEQ ID NO: 26017 - DNA, 504 bp, Unknown
  Obtained from environmental sample
  misc_feature (1)..(504): n is a, c, g, or t
atgactggaagcaataaaaacattctatttgtaattggggtttccggtacaggtaaatctaccatagcccagttattggcgaaagaactgaacctgccatttattgatggggacgattttcattcggaagccaatataacaaaaatgtccaataaaatccccttgaccgacgaggaccgatatgggtggctggttaccctaaataaattagcggtgaacaaccaagaaacaggagccgtcattgtctgctccgccttgaaggaatcctacagaaaaatacttgaaaataaaattgaagaaaaagtggtatggatttccttggaaagttctttcgaattgctattggaacgccttcaaaaacgcaagggccattttatgcctgccgagttattaaagtcccaactggacacttttgaacctcctaccaatgctataaaaatatctatagaacctagtccgcaagaaattgtggatcaaatactaaaggagtacgaaactaaatga

SEQ ID NO: 26018 - protein, 167 aa, Unknown
  Obtained from environmental sample
  DOMAIN (7)...(165): Shikimate kinase
  misc_feature (1)..(167): Xaa is any amino acid
MTGSNKNILFVIGVSGTGKSTIAQLLAKELNLPFIDGDDFHSEANITKMSNKIPLTDEDRYGWLVTLNKLAVNNQETGAVIVCSALKESYRKILENKIEEKVVWISLESSFELLLERLQKRKGHFMPAELLKSQLDTFEPPTNAIKISIEPSPQEIVDQILKEYETK

SEQ ID NO: 26019 - DNA, 801 bp, Unknown
  Obtained from environmental sample
  misc_feature (1)..(801): n is a, c, g, or t
ttgcgaaaattcgcagaatttgaatattctaaaatgaaaaaaatagtactatttattctaccttttattgtgcctctagttcatgcacaaaaatctgatataaaaaatgacacgataaaacttgacgaggttttactttctgcaattcgagctaaaaagaaaactcctgttgcctttacgaacattaccaaaggtgaattggaatccaaaaatttaggtcaagatttaccgtttttaattgaccaaatgccatctgtggttacaacaagcgatgctggaggaggagttggttatacaggaattcgtgttcgaggtagtgatgcaacacgtgttaatgtaactattaatggaattccttataatgatgctgaaagccaagggacattttgggttaatatgcccgactttgtgtcttctgttgaagatattcaattacaacgtggtgttggcacatcaaccaatggttctgggtcatttggagcaagtttaaatttaaaaacactcaatccatcaacaaaaggttatgcttctactacaaatgtaatagggtcttttggaactagaaaacataatgtaaatgttggttctggaattaataaaaacttctatgttgaagggcgtctttccaaaattttaagcgatggttatatagatagagcatcatcggatctatcttctttttatatagaaacaggatatttaaatgaaacaacttcagtaaaagcaattgtttctggtggaacagaaaaaaatatcaatcttggtatggcgctccaaaagcagttgttaatggagatctag

SEQ ID NO: 26020 - protein, 266 aa, Unknown
  Obtained from environmental sample
  misc_feature (1)..(266): Xaa is any amino acid
MRKFAEFEYSKMKKIVLFILPFIVPLVHAQKSDIKNDTIKLDEVLLSAIRAKKKTPVAFTNITKGELESKNLGQDLPFLIDQMPSVVTTSDAGGGVGYTGIRVRGSDATRVNVTINGIPYNDAESQGTFWVNMPDFVSSVEDIQLQRGVGTSTNGSGSFGASLNLKTLNPSTKGYASTTNVIGSFGTRKHNVNVGSGINKNFYVEGRLSKILSDGYIDRASSDLSSFYIETGYLNETTSVKAIVSGGTEKNINLGMALQKQLLMEI

SEQ ID NO: 26021 - DNA, 525 bp, Unknown
  Obtained from environmental sample
  misc_feature (1)..(525): n is a, c, g, or t
atgaagatggttttcctgcctcaaccttttccaatttggaagctagcaaaaatgaataaatctatcttgttccttatattgactattggagcttctttttgttattcccaagaatattcaaaacattatctaacaagaaaagcacaatttgaaagctcgcctgaaacagaaaatgaaattatttttttaggcaatagcattacggaaggtggggcatggaaagaaatgttcaaaaaacataacgtcctaaatagaggtattagtggtgatgttactttgggtattttaaatagactggatgaggtggtctcatcaaaaccttcaagtatattccttctaattggtataaatgatttggcaagaggaaaaagcactgaacatgtcactaataatattgaaaaaataataaaacacatacaatccgactctccaaataccatactgtatttacagaccatactacccgtcaatccttacgtcggaaaacgattcgctagtcataaaaacaagcaaaattccatatga

SEQ ID NO: 26022 - protein, 174 aa, Unknown
  Obtained from environmental sample
  DOMAIN (60)...(174): GDSL-like Lipase/Acylhydrolase
  misc_feature (1)..(174): Xaa is any amino acid
MKMVFLPQPFPIWKLAKMNKSILFLILTIGASFCYSQEYSKHYLTRKAQFESSPETENEIIFLGNSITEGGAWKEMFKKHNVLNRGISGDVTLGILNRLDEVVSSKPSSIFLLIGINDLARGKSTEHVTNNIEKIIKHIQSDSPNTILYLQTILPVNPYVGKRFASHKNKQNSI

SEQ ID NO: 26023 - DNA, 576 bp, Unknown
  Obtained from environmental sample
  misc_feature (1)..(576): n is a, c, g, or t
gtggaaaacgcaattttcgttcgagatttaccgcctttaaaaggacaacatatccaatctatttttgataatattgatcccttaatggcatttaatccgccttttattgatgtcacttaccatcgtgaggagtatcattacaaagatttgggtgacggattgcttaaaaaacaagtggttaaaaagcgtcctggaaccgttggaatttgtgctgcaatccaaaataaatataatgtggatgccattccgcatattttatgtggtggttttactaaagaggatacagagaattttttgattgatttagactttttaaatatcgataatgtaatggcattgcgtggagatgctgttaaaaccgaaacctattttactccagaaaaagaaggtcatgcgtatgctagtgatttggtaaaacaaataacagctttaaataaagctaattatttggatgatcaactgcttaattgtagtgcgacggatttttgtgttggtgttggtgcgtacccagaaaaacatatggaagcaccaagtttggaaagtgatattcattttttaaaaaagaagattaaaaat

SEQ ID NO: 26024 - protein, 192 aa, Unknown
  Obtained from environmental sample
  DOMAIN (6)...(192): Methylenetetrahydrofolate reductase
  misc_feature (1)..(192): Xaa is any amino acid
MENAIFVRDLPPLKGQHIQSIFDNIDPLMAFNPPFIDVTYHREEYHYKDLGDGLLKKQVVKKRPGTVGICAAIQNKYNVDAIPHILCGGFTKEDTENFLIDLDFLNIDNVMALRGDAVKTETYFTPEKEGHAYASDLVKQITALNKANYLDDQLLNCSATDFCVGVGAYPEKHMEAPSLESDIHFLKKKIKN

SEQ ID NO: 26025 - DNA, 426 bp, Unknown
  Obtained from environmental sample
  misc_feature (1)..(426): n is a, c, g, or t
atgtgctatttttgcgaaattaataaagtgcaaaaccaatatatgtcatcagaaaccgaaacaattcaacaaaatgctactgagaaaagtctctatgattatcagattcgagacctgaaccgcatttttgatgtgatgcgagatgaatctgatgattttaatctgttgtatcaactaccaacaggtggtggtaaaacagttatcttttctgaaattgtaagacgttatgtaaaacaacacaagaaaaaggttgtaatcttgacgcatcgtatagagctttgcaagcaaacgtctaatgtattatctggttttaatgttcagaataaagtactaaatagcaaagtaaaaaacttaccagaccaagatgaataccagtgctttgttgccatggtggaaacttttaaacaaccgnttatcggacaatga

SEQ ID NO: 26026 - protein, 141 aa, Unknown
  Obtained from environmental sample
  DOMAIN (29)...(136): Type III restriction enzyme, res subunit
  misc_feature (1)..(141): Xaa is any amino acid
MCYFCEINKVQNQYMSSETETIQQNATEKSLYDYQIRDLNRIFDVMRDESDDFNLLYQLPTGGGKTVIFSEIVRRYVKQHKKKVVILTHRIELCKQTSNVLSGFNVQNKVLNSKVKNLPDQDEYQCFVAMVETFKQPXIGQ

SEQ ID NO: 26027 - DNA, 324 bp, Unknown
  Obtained from environmental sample
  misc_feature (1)..(324): n is a, c, g, or t
atgccagagactttaaaagtaaaatttaagaagtcttatactgtagattttgatgtaaaagcagaatataaaaatgtcattagtgaaggtaaaaaatcgtttactgtaatagagcgctctattgagcagcattcaaaaatgtgtattgaaaacagtgaagatgtttatgatgccagagagttgactaaagctcttcaagatgaaattgcctatagaataaaacagtattgctattgtataatgaacagtactcaaaattataaagattggttatttgaagagtataatagaaagttaagaattagctttaatggcaagttttaa

SEQ ID NO: 26028 - protein, 107 aa, Unknown
  Obtained from environmental sample
  misc_feature (1)..(107): Xaa is any amino acid
MPETLKVKFKKSYTVDFDVKAEYKNVISEGKKSFTVIERSIEQHSKMCIENSEDVYDARELTKALQDEIAYRIKQYCYCIMNSTQNYKDWLFEEYNRKLRISFNGKF

SEQ ID NO: 26029 - DNA, 465 bp, Unknown
  Obtained from environmental sample
  misc_feature (1)..(465): n is a, c, g, or t
nggattaatccagaaagaagtgaattatttttcgctaaaaaagttatacttgtagaaggtccaacggaaagaactataattccaaaactaggagaaacagaaggtgtttttaaatatgattttacaataattgattgtggtggtaaaagtaatattccattatatataaatttattaaacaaatttaaaattaaatattgcgctatatatgataaggatcatcaaagtggaaaaacagcagaaaaaattgaaggagctgacgaggcgtcaaaaattattgaagattgtattgataccactttaggcgaaactattgtgtttattaatgatatagaagaagaattgggtttaacaatttctgggaaaggttcaaaaccatttaaagcattaaatcatataaatgctgaaggttttataatatcagattcgtttagaaaaaaggttttaaaaatatttaaagaataa

SEQ ID NO: 26030 - protein, 154 aa, Unknown
  Obtained from environmental sample
  misc_feature (1)..(154): Xaa is any amino acid
MINPERSELFFAKKVILVEGPTERTIIPKLGETEGVFKYDFTIIDCGGKSNIPLYINLLNKFKIKYCAIYDKDHQSGKTAEKIEGADEASKIIEDCIDTTLGETIVFINDIEEELGLTISGKGSKPFKALNHINAEGFIISDSFRKKVLKIFKE

SEQ ID NO: 26031 - DNA, 543 bp, Unknown
  Obtained from environmental sample
  misc_feature (1)..(543): n is a, c, g, or t
atgaagattaataaaatagaaattaaaaattggaggtccattattaatgaaaacattcaatttcaggatttaattattcttattggccaaaataatcatggaaaatctaatgttttaagttcactattatttttctttggagaaatcaaagctcaagaatttgattttaatggagaatcaaatgaactatcagttgagatagaatttgttgatttaaacgaaagtgaaaaagtaacgtttcaaaaatatgtgtctgctgaaagcactattaatgtaagaaaaactgcaaaaaaagatggtagttttagttacaatggatttattcaagatcctgatgaagattggttaaaagaatctaaaatcagtgattttttaagaagagatgaagccgaaaaattgccattagtaaaatatttacctgctactggaagaattttaaaagcagattttataaaagctcaagcagattatataaaagataatttagataaaataaagtttaactatttattagaagaaaacaaatttctaggagcagcaang

SEQ ID NO: 26032 - protein, 181 aa, Unknown
  Obtained from environmental sample
  misc_feature (1)..(181): Xaa is any amino acid
MKINKIEIKNWRSIINENIQFQDLIILIGQNNHGKSNVLSSLLFFFGEIKAQEFDFNGESNELSVEIEFVDLNESEKVTFQKYVSAESTINVRKTAKKDGSFSYNGFIQDPDEDWLKESKISDFLRRDEAEKLPLVKYLPATGRILKADFIKAQADYIKDNLDKIKFNYLLEENKFLGAAX

SEQ ID NO: 26033 - DNA, 534 bp, Unknown
  Obtained from environmental sample
  misc_feature (1)..(534): n is a, c, g, or t
atgggtgaatttgaacaaacccgcttagggaatttatgtgactttacacaaggtgtacaaatagctgataaagatactatcaaacagccgcaagatggatatgtcagatatatctatattagagatttattcacagacaagtttcccgtttatgtgaaggatgtatatccaaataagctattactcagtggtgatattgtaatggttaatactggaaacacatcgggtagcgtttatcaggcgaaggaaggtgtattgtgtaacaatgcatttaaaatagcagttaaaagctcaaaacttaataagttagacaaagggttcctttgggtatatctaaacagtgacgctcgtgagcgaatgcttaaaaggctattcaatccggcaggacaacctcacgttggacataagaatgttgctagattggatatatcacttccaccantcccagaacaacgccaaatcgccaaaatcctatctacgtgggataaagcgattagcaccactgagcgcctaatcgacaacagccaacagtag

SEQ ID NO: 26034 - protein, 177 aa, Unknown
  Obtained from environmental sample
  DOMAIN (4)...(163): Type I restriction modification DNA specificity domain
  misc_feature (1)..(177): Xaa is any amino acid
MGEFEQTRLGNLCDFTQGVQIADKDTIKQPQDGYVRYIYIRDLFTDKFPVYVKDVYPNKLLLSGDIVMVNTGNTSGSVYQAKEGVLCNNAFKIAVKSSKLNKLDKGFLWVYLNSDARERMLKRLFNPAGQPHVGHKNVARLDISLPPXPEQRQIAKILSTWDKAISTTERLIDNSQQ

SEQ ID NO: 26035 - DNA, 435 bp, Unknown
  Obtained from environmental sample
  misc_feature (1)..(435): n is a, c, g, or t
ttgaatgcatttcgtgctacattttcaataaatagaacaaaagccgactattcgtttttaatttttggactgcttattcctatattctttggagtttttattcataatacagatgcagaatggtcaaaaaatagatatgaaaatgaaatttcaaaagcaggaatttactcattttttgctgcctttagaaataatgagttaagctataccaatttttatttaactcaagatgtagaccgttctttccgtcatttaaaagaaaaactaaccactcaaaacgacactattttttccaatgataaatacagcattgaaagagtcataaaaagttataatccaaaaataaaaccgaatgtaatttttatatgtttagaaagctttgatgccgattttttaaaacattttggaaacaaagataacctaactcccaattag

SEQ ID NO: 26036 - protein, 144 aa, Unknown
  Obtained from environmental sample
  misc_feature (1)..(144): Xaa is any amino acid
MNAFRATFSINRTKADYSFLIFGLLIPIFFGVFIHNTDAEWSKNRYENEISKAGIYSFFAAFRNNELSYTNFYLTQDVDRSFRHLKEKLTTQNDTIFSNDKYSIERVIKSYNPKIKPNVIFICLESFDADFLKHFGNKDNLTPN

SEQ ID NO: 26037 - DNA, 726 bp, Unknown
  Obtained from environmental sample
  misc_feature (1)..(726): n is a, c, g, or t
ttgattggtgagatatgttcagtcgttaataaccaagaaacttttttagaaaaattttctttaaagttcactctttccacaaataaatcaatcaaactttttcttaatctaaaaaaaaatgaaatcatcgatgctctaagctacacaggggatctcacacaagtagagttgcagtgtttttccttcattagcagttacttaacaaacaaacctttaatcacagcaatcgaaattaacggacaacatattaaagaatactaccgaacagacactcttttcgaaagtttcatacaacaaaatcacgcaacggttttctttatcccactttggcttattaaaaatttggttcgctcttttatcgaaggagaagctcctatggttcaaaaagaaaatattatttgctttggtcataatattgcagaacaggacctcgccagttggcttaaagaaaaaaatgaagaagaatctacatatacttttataaaaaaaaatactttactagagagccattgtaaaacatgctctaaaccactgttacagtatcttaaaaaaaacttttccgattctcatgatcaactttataaaaaagagctgcaggaactttgcgacgaccacgctcaantcaaacattacaatattaaaatcaaagactttttcgataatctcattactttagaagaagagattccctttgaactgaccaggaccttagaagcaaattactaa

SEQ ID NO: 26038 - protein, 241 aa, Unknown
  Obtained from environmental sample
  misc_feature (1)..(241): Xaa is any amino acid
MIGEICSVVNNQETFLEKFSLKFTLSTNKSIKLFLNLKKNEIIDALSYTGDLTQVELQCFSFISSYLTNKPLITAIEINGQHIKEYYRTDTLFESFIQQNHATVFFIPLWLIKNLVRSFIEGEAPMVQKENIICFGHNIAEQDLASWLKEKNEEESTYTFIKKNTLLESHCKTCSKPLLQYLKKNFSDSHDQLYKKELQELCDDHAQXKHYNIKIKDFFDNLITLEEEIPFELTRTLEANY

SEQ ID NO: 26039 - DNA, 303 bp, Unknown
  Obtained from environmental sample
  misc_feature (1)..(303): n is a, c, g, or t
atgaaattaaaaattatttggactataaaagctgaaaatgaggtaaattctatttttgaaaaagttaaagaaatgactttatcagaaaatttagcacaaaatgctgtgaatgaaatttttgaaacttcaacaaacattcactttactgaacaatttcaagtcgatgaatttttaggtaaaccttatagaagaataattgtaagaaattataaagtaatctacatttcaacaaacgaaaaagaaatcctaatacttcatatttttaacacatctcaaagtccatcaaaacttttaagagaataa

SEQ ID NO: 26040 - protein, 100 aa, Unknown
  Obtained from environmental sample
  misc_feature (1)..(100): Xaa is any amino acid
MKLKIIWTIKAENEVNSIFEKVKEMTLSENLAQNAVNEIFETSTNIHFTEQFQVDEFLGKPYRRIIVRNYKVIYISTNEKEILILHIFNTSQSPSKLLRE

SEQ ID NO: 26041 - DNA, 534 bp, Unknown
  Obtained from environmental sample
  misc_feature (1)..(534): n is a, c, g, or t
gtgtcgtatttaaacaccacaaaacctttgtattacgacaatcactacaaatcgggtaaaaaagtaaatacctcaccattgtatgtgtttctaaataatgaccatttaaaatgggcgtattatataatgcttattggtgtgttattttatgttgttttcgaaggcaaacggaaacagcgtgctattcctgttatagaacccttgcctaatcaaactgtagattttacgcgaaccattgccaatatgtattacgaaaatggtaaaaatcacgctattgcaaaacataaaattcagcattttttagaatacattcgtacgcacttccatttagacaccaacactataaacgctacttttattactaatttggcagctagaagtaataacacaatacaagatactcaagcactttttaatactatagaagcggttgaaaatcaagaaaaaacaaatgttgaactgttacaaaaactaaacactacaatagaactatttaatccaaaaagaatggcaaatcaaacttcaaagttataa

SEQ ID NO: 26042 - protein, 177 aa, Unknown
  Obtained from environmental sample
  misc_feature (1)..(177): Xaa is any amino acid
MSYLNTTKPLYYDNHYKSGKKVNTSPLYVFLNNDHLKWAYYIMLIGVLFYVVFEGKRKQRAIPVIEPLPNQTVDFTRTIANMYYENGKNHAIAKHKIQHFLEYIRTHFHLDTNTINATFITNLAARSNNTIQDTQALFNTIEAVENQEKTNVELLQKLNTTIELFNPKRMANQTSKL

SEQ ID NO: 26043 - DNA, 699 bp, Unknown
  Obtained from environmental sample
  misc_feature (1)..(699): n is a, c, g, or t
gtggcaatgctagataaggatttacgttatatttcggtttctagagaatggattaaagtattnaaactggaaggcgaagaggttattggtaaattacattatgatgtatttccggagattagtgaagaatggcgagaaataaatagacgttgtcttaaaggtgaaaaaaaccgttgtgatgaagctcctttttttagaaaagatggttctgtacagtgggtatattgggacatcattccttggtataatactgaaggtgctattggtggtatcgtaataagtactggtgatattacggatttaaaaaacaatgaaactaaaaataagcgtataaaagatatattatataaaattaacgaggtggcaagaattggagcctgggaagttgatttagtaaataataaatcctttttaagcgatgcggtgcgagacatacatggtatatcaaaagattataaaataagtacagaaaaggggattcaattttataaagaaggaaaaagtagggacacacttattaaagcactgaatgctgctataaatgacggcacaccctatgatctagagttagaaatggttaataccaaaggagaggtgatatgggtacgctcaatttgccaaatagaaagcgttaatgggaaaagtgttagactatatgggttaatgcaagatattaataatagaaactctcacagctag

SEQ ID NO: 26044 - protein, 232 aa, Unknown
  Obtained from environmental sample
  DOMAIN (59)...(101): PAC motif
  misc_feature (1)..(232): Xaa is any amino acid
MAMLDKDLRYISVSREWIKVXKLEGEEVIGKLHYDVFPEISEEWREINRRCLKGEKNRCDEAPFFRKDGSVQWVYWDIIPWYNTEGAIGGIVISTGDITDLKNNETKNKRIKDILYKINEVARIGAWEVDLVNNKSFLSDAVRDIHGISKDYKISTEKGIQFYKEGKSRDTLIKALNAAINDGTPYDLELEMVNTKGEVIWVRSICQIESVNGKSVRLYGLMQDINNRNSHS

SEQ ID NO: 26045 - DNA, 801 bp, Unknown
  Obtained from environmental sample
  misc_feature (1)..(801): n is a, c, g, or t
atgattgcgtcctatacgcatactttagttgaagcctcaattgatcaatatagtaatcctgagattggtagaaatcttaattttattgaagtcaaaaaacatgttggttataacgatatgtttcgtttgtactttcaatatgattatttagatgaatttgttaatgtcttttctgatacacctggagatttaactaaaacacttagtcaaagtttagaatttagtggttttagttttgatttagaaaaaaacgctattgtagctaatggtattacaaatactaatgaccaagcttcaacgtatttaaaagcgcttcaaaaatcaggacaaggtaaacgtaccattaaaaacgtagttcctaataatactgcaatttacttaagcttcggttttaaaagttttgaagatttttattctaatttcgaaactattcaaaaagaaaatcctgaacagtttaaaagttatgctgaaggtacttctcaaatagaaagctttttaaaaataaatctcaaaacccattttatgagtcggattgatgacgagattgctttaattcaaattcactctaatgtatccgattcaaaaaaagatgtcgcattaatattaaaaacaaaagcgattgacgatgctaaagacaacttagattttatattagaacaaattcgaaaacgtacaccagtaaaattcaagaagtcattccaagggatcgccataattccatgtcatcaaaggttttccaaatcctttaagcaattatttccaatcttgaaaccttattcccatatggcaataagtacatag

SEQ ID NO: 26046 - protein, 266 aa, Unknown
  Obtained from environmental sample
  misc_feature (1)..(266): Xaa is any amino acid
MIASYTHTLVEASIDQYSNPEIGRNLNFIEVKKHVGYNDMFRLYFQYDYLDEFVNVFSDTPGDLTKTLSQSLEFSGFSFDLEKNAIVANGITNTNDQASTYLKALQKSGQGKRTIKNVVPNNTAIYLSFGFKSFEDFYSNFETIQKENPEQFKSYAEGTSQIESFLKINLKTHFMSRIDDEIALIQIHSNVSDSKKDVALILKTKAIDDAKDNLDFILEQIRKRTPVKFKKSFQGIAIIPCHQRFSKSFKQLFPILKPYSHMAIST

SEQ ID NO: 26047 - DNA, 540 bp, Unknown
  Obtained from environmental sample
  misc_feature (1)..(540): n is a, c, g, or t
gtggatcaagaatcggctccaggaatagattttgaaaacggtttgacttgtaatttgatcaaaaaaaagccaaacgttataaatacttgctccaaaattaaattggatgaaaaatttctagaaaaattagaaaggacaaatctagagttagtaatattaagtaaaaataaaaaatcaattcatctcactatattttggactagtattagtatatttttattaataattggaggatattatttttatgaatggacaatacatagcgtgtttatatggtcagtaaaacttggaattattggaatgggttttacttttttaggaatggcgtactctaaacttaaagcgtttaaaaaacaagaaactaaagcaaaattcgagaaattaaaaatcgataaaatattaaaaaaatacaaaatcgaatatcatcctacttttatttttgaaaataaaattcacggaattcaagaattaaaggttaatttagaatttaggaattggataaaaaaacgaacgacaacagcgtataaaattaatgtttaa

SEQ ID NO: 26048 - protein, 179 aa, Unknown
  Obtained from environmental sample
  misc_feature (1)..(179): Xaa is any amino acid
MDQESAPGIDFENGLTCNLIKKKPNVINTCSKIKLDEKFLEKLERTNLELVILSKNKKSIHLTIFWTSISIFLLIIGGYYFYEWTIHSVFIWSVKLGIIGMGFTFLGMAYSKLKAFKKQETKAKFEKLKIDKILKKYKIEYHPTFIFENKIHGIQELKVNLEFRNWIKKRTTTAYKINV

SEQ ID NO: 26049 - DNA, 345 bp, Unknown
  Obtained from environmental sample
  misc_feature (1)..(345): n is a, c, g, or t
atgaaagaatatcataatagttttgaatttcaaataaattataatgcagtcacaaaggacaagcttattaactattttgaaaataataatcttaaaattataaaggatgaaaccgatcttgtttttgagaaaaaatggtcactttttgatggctggaaactaaatgtcctaaattgggaatctaatattagagttacaagtgtcgataatcataaaatcgtatccctcatacagttaaaacctatggttttggagtcattcaccaatagcttttcatccatttttcgaacctcttcgaccattcaaacagttcccatcatcatgatcttcgacaccagcatctga

SEQ ID NO: 26050 - protein, 114 aa, Unknown
  Obtained from environmental sample
  misc_feature (1)..(114): Xaa is any amino acid
MKEYHNSFEFQINYNAVTKDKLINYFENNNLKIIKDETDLVFEKKWSLFDGWKLNVLNWESNIRVTSVDNHKIVSLIQLKPMVLESFTNSFSSIFRTSSTIQTVPIIMIFDTSI

SEQ ID NO: 26051 - DNA, 621 bp, Unknown
  Obtained from environmental sample
  misc_feature (1)..(621): n is a, c, g, or t
ttgcctgaaatgacagaaaaagacacgtatataaccatcactaaagcctctgaagaagtcttatttaaggacaaaaatagcaagttttttggctatgcttttccggtaacttcagaagaggcagttaaagttcatctcgaagatttaaagaaacagcaccattctgccagacattggtgttatgcctatcaatttggcaaggacgaaaatcagtaccaatttagagctaatgatgacggtgaacccaataatagtgccggtatgccaatttatggacaaattcaatcctttgacgttaccaatgtgctgattgtagtggttcggtattttggaggtgtcaaattaggtgttggcggacttatagccgcgtataaaaccgcggcacaaatggctttagaaaattccaaaattgtcactcgcaccataaatcaggacatcaaactcaaatttgagtacaaagacatgaataaagtgatgcgggtaattaaggaaaagaatttaaagataaaatctcagactctagaactcgactgtaccatcatcatttcagtgcgacttaaaaaatcaaaaactgttttggataccttcaaatctatttttggcgttcaggtagacctctga

SEQ ID NO: 26052 - protein, 206 aa, Unknown
  Obtained from environmental sample
  DOMAIN (24)...(133): Uncharacterized protein family UPF0029
  misc_feature (1)..(206): Xaa is any amino acid
MPEMTEKDTYITITKASEEVLFKDKNSKFFGYAFPVTSEEAVKVHLEDLKKQHHSARHWCYAYQFGKDENQYQFRANDDGEPNNSAGMPIYGQIQSFDVTNVLIVVVRYFGGVKLGVGGLIAAYKTAAQMALENSKIVTRTINQDIKLKFEYKDMNKVMRVIKEKNLKIKSQTLELDCTIIISVRLKKSKTVLDTFKSIFGVQVDL

SEQ ID NO: 26053 - DNA, 471 bp, Unknown
  Obtained from environmental sample
  misc_feature (1)..(471): n is a, c, g, or t
atggatgtagattatattatagtagggtttggtttagcgggactcacgtttgttgaacagcttgagcaaaataataaatcatacatagttttcgaggataattctcaaaactcgtctttagttgctggcggggtatataatcctgttattctaaagagatttactccagtttgggatgcccttgatcagctaaaaatagccgtgccattttataaggctttagaaaaaaagttacatattaaatttgatcaaactcttgatatctatagaatttttacttcaatagaagagcagaataattggtttaatgcttgtgataagacttttttttcggagtatatgattcctgaaattattcagaatacaaataaacatgtcaatgctgatttcggttttgggaagattattaatacgggtaaaatagaaacggaagtattaataaacgggtatagaaagtatcttgaaaattaa

SEQ ID NO: 26054 - protein, 156 aa, Unknown
  Obtained from environmental sample
  misc_feature (1)..(156): Xaa is any amino acid
MDVDYIIVGFGLAGLTFVEQLEQNNKSYIVFEDNSQNSSLVAGGVYNPVILKRFTPVWDALDQLKIAVPFYKALEKKLHIKFDQTLDIYRIFTSIEEQNNWFNACDKTFFSEYMIPEIIQNTNKHVNADFGFGKIINTGKIETEVLINGYRKYLEN

SEQ ID NO: 26055 - DNA, 579 bp, Unknown
  Obtained from environmental sample
  misc_feature (1)..(579): n is a, c, g, or t
gtggtttcacatgataggcactttttagatgctgtttgtacacacatttctgatattgattttagcaagatcaatagctattccgggaactatactttttggtatgaatcgagtcaattagccgctagacaaagagctcagcaaaataaaaaatctgaagaaaaaaagaaagaattagaagagtttataagacgattttctgctaacgtagccaaatctaaacaggcaaccagtaggaaaaagatgattgaaaaattaaacattgaagatataaaaccgtcaagcaggcgatatcctgccataatttttgagcaagaacgccaagcaggtgatcaggttttacatgtggaaggattaagcaaatctattgaaggagatgttttatttaatgatatacatataaatctaaccaaaggagataaagtagttatcttgtcaaaagactctagagctgtgactgctttttatgagatcgtacttggtaactcaaaggctgattcaggaaaatttaattggggcgtcactacttctcaagcatatttaccggttgaaaattcaagtttttttgaaatgagttaa

SEQ ID NO: 26056 - protein, 192 aa, Unknown
  Obtained from environmental sample
  misc_feature (1)..(192): Xaa is any amino acid
MVSHDRHFLDAVCTHISDIDFSKINSYSGNYTFWYESSQLAARQRAQQNKKSEEKKKELEEFIRRFSANVAKSKQATSRKKMIEKLNIEDIKPSSRRYPAIIFEQERQAGDQVLHVEGLSKSIEGDVLFNDIHINLTKGDKVVILSKDSRAVTAFYEIVLGNSKADSGKFNWGVTTSQAYLPVENSSFFEMS

SEQ ID NO: 26057 - DNA, 429 bp, Unknown
  Obtained from environmental sample
  misc_feature (1)..(429): n is a, c, g, or t
atggacgatattcaaaaatcggaatataaaaaagcatgtgctaattgcggtgccgagttaaagtttaaaccgggatcacatcagcttacatgtgattattgcggatatgaagaattcattgaacaatctaaaagtagttttgaggaattagaattagagcattatttaaaaattgttggggaaaaggcctatacggaaactattgagctgttacattgtaaaaattgtggcgccaatcaacatgtagaagaaaattataaatcgcttaattgtgtctattgtagcgaaccattaattcgtgaagatattgaaaaagaaggatggattttacctggggccttagtgccttttcaacttgactcaagaaaagctcaatgcattttcaaagattgggttagcaaaatatggtttgcccccgacaatcattaa

SEQ ID NO: 26058 - protein, 142 aa, Unknown
  Obtained from environmental sample
  misc_feature (1)..(142): Xaa is any amino acid
MDDIQKSEYKKACANCGAELKFKPGSHQLTCDYCGYEEFIEQSKSSFEELELEHYLKIVGEKAYTETIELLHCKNCGANQHVEENYKSLNCVYCSEPLIREDIEKEGWILPGALVPFQLDSRKAQCIFKDWVSKIWFAPDNH

SEQ ID NO: 26059 - DNA, 402 bp, Unknown
  Obtained from environmental sample
  misc_feature (1)..(402): n is a, c, g, or t
atgagtattgattattcacaaccagctaaatatcattatgaattggcaaaagaaattaaaagccttcgtcaaaaaggaatattggttataggaagtgggaatatagttcataatcttcgtatggtagaatggaaaaaattaaacgaagaatatgcctatgattgggcaactgaagcaaacgaaaaaatgaaaaaacacattttaagtggagaccatcaaaaacttattgactttaaatctcaaggaaaagccttcgatttagctattcctacacctgaacattatcttcctttactttatacattgtcattaaaagaagaaaatgaaaaaataacattatttaacgacaaggcagttggaggctcgctatcaatgacatccttaaaaatagaaacaatttga

SEQ ID NO: 26060 - protein, 133 aa, Unknown
  Obtained from environmental sample
  misc_feature (1)..(133): Xaa is any amino acid
MSIDYSQPAKYHYELAKEIKSLRQKGILVIGSGNIVHNLRMVEWKKLNEEYAYDWATEANEKMKKHILSGDHQKLIDFKSQGKAFDLAIPTPEHYLPLLYTLSLKEENEKITLFNDKAVGGSLSMTSLKIETI

SEQ ID NO: 26061 - DNA, 510 bp, Unknown
  Obtained from environmental sample
  misc_feature (1)..(510): n is a, c, g, or t
ttgtctttttatccagatttaaaagacactgcaattaattttgaattcaaaaaaaacattaaaaaatcgactatgcaagcacaaccaactgctagtagttttttaaaaagaaaaggacaacgatcttataatatttttataagtgaaactgtaaaaatttctggtgaagttttatatacagtagatatgccacaagaggtattaatagggtggattggtcatgagctaggtcatgttatggattacaaaaaccgaagcaacctcaacctgatgtggtttggtgtaaagtatctattatccgacaatcatattgcaactgcagagcgtgctgcagatacttatgctgtacaatcaggaatggaacaatacattttaaaaacaaaggactttatattaagtcaagcaaatttagagcaatcttatattgcacgaattaaaaaatattatttatctccagaagaaatcatggaaattataaatcaaagagatgccaatctttccgagtcttaa

SEQ ID NO: 26062 - protein, 169 aa, Unknown
  Obtained from environmental sample
  misc_feature (1)..(169): Xaa is any amino acid
MSFYPDLKDTAINFEFKKNIKKSTMQAQPTASSFLKRKGQRSYNIFISETVKISGEVLYTVDMPQEVLIGWIGHELGHVMDYKNRSNLNLMWFGVKYLLSDNHIATAERAADTYAVQSGMEQYILKTKDFILSQANLEQSYIARIKKYYLSPEEIMEIINQRDANLSES

SEQ ID NO: 26063 - DNA, 849 bp, Unknown
  Obtained from environmental sample
  misc_feature (1)..(849): n is a, c, g, or t
atggaagaagttggtggtactttantttttcattataaagacaggncttttatgggctttttcgaagttataaaaaatcttcctaaagcattaacattaataagactttgtaaaaaagatattgccgaatttaatcctgatgttcttatttttattgataattctgggtttaatttacgaattgcaaaatgggcaaaatcgcaaggttttagaactaattattatatttctccacaagtttgggcaagtagagcaagcagagtaaaagacattaaaagagatgtggataaactgtttgtaatcttaccttttgaagaagaattttacaaaaaatacaattataaagttgagtttgttgggcatcctttaattgatgcaattgcaaacagagaacaagttagtattaaagattttagaaaaaaacacgacttaggtgaaaagccaattattgctttattacctggaagcagacagcaagaaataactaaaatgttggctgttatgttagcaatggtagatgtttttcctgactataaatttgtaattgctggtgctccaagtcaagatttttctttttatgatagtattattggaaacagaaaagttagttttatcaacaataaaacctacgatttattatcagttgctacagcagctatagttggttctggaacagcaactttagaaacagcactgtttaaagtgccacaagttgtgtgtcatacaggaggctcaatttcttatcaaattgctaaaagaattattacattaaaatacatttctttagtcaatttaattatggataaagaagttgttaccgaatctattccagatgatttaccagaataa

SEQ ID NO: 26064 - protein, 282 aa, Unknown
  Obtained from environmental sample
  DOMAIN (1)...(279): Lipid-A-disaccharide synthetase
  misc_feature (1)..(282): Xaa is any amino acid
MEEVGGTLXFHYKDRXFMGFFEVIKNLPKALTLIRLCKKDIAEFNPDVLIFIDNSGFNLRIAKWAKSQGFRTNYYISPQVWASRASRVKDIKRDVDKLFVILPFEEEFYKKYNYKVEFVGHPLIDAIANREQVSIKDFRKKHDLGEKPIIALLPGSRQQEITKMLAVMLAMVDVFPDYKFVIAGAPSQDFSFYDSIIGNRKVSFINNKTYDLLSVATAAIVGSGTATLETALFKVPQVVCHTGGSISYQIAKRIITLKYISLVNLIMDKEVVTESIPDDLPE

SEQ ID NO: 26065 - DNA, 315 bp, Unknown
  Obtained from environmental sample
  misc_feature (1)..(315): n is a, c, g, or t
atgtttacaatttttataaataataatcctatttatttaacagatagtttagcattcaccaacagaaagaattttgttaagtttgatgaagttgatttgcagacgtttattaaaaaattggaaagagaagaaatcaattatctttatctttatgatgataatattcaactgctttttgaaaaattttgtagcagttttagaattatagaggcagctggaggcgtagtaaagaattcaaaaggagaaatattattcatttttcgaaatggtatctgggatttaccaaagggaaaattgaaaagaatgaaagtataa

SEQ ID NO: 26066 - protein, 104 aa, Unknown
  Obtained from environmental sample
  misc_feature (1)..(104): Xaa is any amino acid
MFTIFINNNPIYLTDSLAFTNRKNFVKFDEVDLQTFIKKLEREEINYLYLYDDNIQLLFEKFCSSFRIIEAAGGVVKNSKGEILFIFRNGIWDLPKGKLKRMKV

SEQ ID NO: 26067 - DNA, 420 bp, Unknown
  Obtained from environmental sample
  misc_feature (1)..(420): n is a, c, g, or t
ttgaaaaaatgcgcatctatttacacattgacaacttgttttagaaacgttattagagatttcccatatgaaatgcagtcctcggcgtttggagatttgttcctttggtctttactgggggattatggtaaaggaaagtttttagaaaacataaaaccaagcagatatcgagttcatagtggaggcgtattttcacaacaatcaaaaaaaacaaaatttttgatgtcttcaaaaactaattcagcactatttctatattattcaagaataaaaaacgaagaattatctgattatttttttgaagaaaatatgatagcgaccattagagtatatggtttcttttcaatgctaaaaagattttcagaatattattttaatattattaaatctaaattgatgattttgaaaattgtaaaataa

SEQ ID NO: 26068 - protein, 139 aa, Unknown
  Obtained from environmental sample
  misc_feature (1)..(139): Xaa is any amino acid
MKKCASIYTLTTCFRNVIRDFPYEMQSSAFGDLFLWSLLGDYGKGKFLENIKPSRYRVHSGGVFSQQSKKTKFLMSSKTNSALFLYYSRIKNEELSDYFFEENMIATIRVYGFFSMLKRFSEYYFNIIKSKLMILKIVK

SEQ ID NO: 26069 - DNA, 636 bp, Unknown
  Obtained from environmental sample
  misc_feature (1)..(636): n is a, c, g, or t
atgaaaaaaaatatttacaggattttcctgacgatattatctattgcattagcaggttgcagtaatgcggagaataaaaataaatcagtgctacctcagactgataaagaagatttttttttagataaaccaaaaatacaatcactaaaaacatctgaacctcaattaaaatgcgaacagtttaatctagatgtagaagataatatagtctgcacctactggaacaactctaagaaatttgagaaagagataaaaattcaagaatatgaaatttatccttcgcttatagaagtccatgaattatctccaactgagtataatttttttacaactacaaatatctattataaaaacaagaattataaggccaatatttttccaaattctagagttcaactatcaaatggaaatgaagttatcaatctaatctgtaataaagatagttgctctaagccatttctatggggttttgctacagagtcaactataagagataatcctgaattagctgatgcaatgatgactaagatatcatctatatatacctataactacaacacctaccttaaaaaaacgagcagccaatcagtcaaagacaaactagcagtcaaagtctattttgaaacccaaatttag

SEQ ID NO: 26070 - protein, 211 aa, Unknown
  Obtained from environmental sample
  SIGNAL (1)...(18)
  misc_feature (1)..(211): Xaa is any amino acid
MKKNIYRIFLTILSIALAGCSNAENKNKSVLPQTDKEDFFLDKPKIQSLKTSEPQLKCEQFNLDVEDNIVCTYWNNSKKFEKEIKIQEYEIYPSLIEVHELSPTEYNFFTTTNIYYKNKNYKANIFPNSRVQLSNGNEVINLICNKDSCSKPFLWGFATESTIRDNPELADAMMTKISSIYTYNYNTYLKKTSSQSVKDKLAVKVYFETQI

SEQ ID NO: 26071 - DNA, 909 bp, Unknown
  Obtained from environmental sample
  misc_feature (1)..(909): n is a, c, g, or t
atgtttcgtaaaatggatgcagcagcttttgagaaaatagccactagagaaacttctaatgggagtagttacaatgtgcgtccattttattattactggagcttttttatacaatctggtatgtggacaattttagcttttgtcagtttactatatccgtacttaattaagaaagttgaagataaaaagttctatcgtttctcttttctatggacaattattgctgtggttttattgtcaattattcctgaaaagaaatcacgttatttagtccctgtattatttccattagcaatgactaccggaatctacattaactatctaattaaaagctttaagacacttacatctaaaaaagaaacgtatcctgtttattttaattttggattattcgccattttaggaattgccatacccattacattcttttttttgtttaaagataaactcgatggttactggcttcaatttagttttttgtctgctgcccttattgcaatcggggtattcatttttaaaaatatcaaacaaaaaaatatcaaaaatgctttttttggaatggtcttttttatgggtgctgcttttctttttggtctgccactttcaagctctttttacaacaatcaaaaattcttatctattgcaacattaacagaaacttatgaagatgaatataaaattcaatcttatgcttataaaggtttatctccagaattgatttggcattatggtaaaaatatcaatattattaactcaataaaaggaatgcaattagcacctgttgaaaaatttggattgttaatagaccaaaataatgaacaggaattagaaaagctacaacgaacacacacaacagaaaaggtagcgacttttgatatgaattatgattcaaaaaacaaaagtcgatga

SEQ ID NO: 26072 - protein, 302 aa, Unknown
  Obtained from environmental sample
  misc_feature (1)..(302): Xaa is any amino acid
MFRKMDAAAFEKIATRETSNGSSYNVRPFYYYWSFFIQSGMWTILAFVSLLYPYLIKKVEDKKFYRFSFLWTIIAVVLLSIIPEKKSRYLVPVLFPLAMTTGIYINYLIKSFKTLTSKKETYPVYFNFGLFAILGIAIPITFFFLFKDKLDGYWLQFSFLSAALIAIGVFIFKNIKQKNIKNAFFGMVFFMGAAFLFGLPLSSSFYNNQKFLSIATLTETYEDEYKIQSYAYKGLSPELIWHYGKNINIINSIKGMQLAPVEKFGLLIDQNNEQELEKLQRTHTTEKVATFDMNYDSKNKSR

SEQ ID NO: 26073 - DNA, 531 bp, Unknown
  Obtained from environmental sample
  misc_feature (1)..(531): n is a, c, g, or t
ttgattcggccgagtacgatgattctttacagatgtctcaaagatgaacgccgctataatttacccggaactgacggtctagacaactggtctttgcgctcaaagcgattacttaacaaaattaatttttctcaaattgctcaaattattaaaaattcagggcggttgtttcaaaattcaaatcaaactctaattactaccagtccgcaaaaatcagaaattcaaagaagacatgctggcgagttcttctttttggaaattgccctaggcaagcttcctcaaaaagtagaaatctttaccaatttacctacaactgaaaatttgggcggaggagtttggagcaattttatttacgacattgatgggataaatattaagaattttggtaaaactaaaattgcagagctgaaaattatagtgcccgagggggcaactaaaggtaaatttgaaatggcagctaatctttattttgaaaatgagcaaattaatctttgtcaaacaaacaataattacaaacttgaaatctggtag

SEQ ID NO: 26074 - protein, 176 aa, Unknown
  Obtained from environmental sample
  misc_feature (1)..(176): Xaa is any amino acid
MIRPSTMILYRCLKDERRYNLPGTDGLDNWSLRSKRLLNKINFSQIAQIIKNSGRLFQNSNQTLITTSPQKSEIQRRHAGEFFFLEIALGKLPQKVEIFTNLPTTENLGGGVWSNFIYDIDGINIKNFGKTKIAELKIIVPEGATKGKFEMAANLYFENEQINLCQTNNNYKLEIW

SEQ ID NO: 26075 - DNA, 576 bp, Unknown
  Obtained from environmental sample
  misc_feature (1)..(576): n is a, c, g, or t
ttgttttcagaaaaggacgattatgaatcgaatttgagtccagaagaaggggatgaagctatacaggaactaaaagacaaaggatattctgaagaagatttattgcgtttaggttatatcactaagcgtaaatcactaggcattttgaatgaaaaagaaggagatataatcacttctattaataaagaaagattactctttccgtttgagttttattcaatctacgaaatgcagagaataataaaggcggaattagctaaacacgaaaaacaaccatcgaatgaagaaagcaatacatcaagcaatgaccgactaaaagtaaatctttcagtaccgcaacttgcgttgctattcaagatgattaatgatttaaaaccttcggttttaatcgtttctacagaggctgaattattacgatttatctcttccaatttccaaacaaaaaattcaagtattgaaaatggtataagcgagaacaaactcagaatactattcaatcaaccagatgatagagcaattgatttttgggagaaacacctcaggacaatgttagccgaaatcaaaaaaatgaaataa

SEQ ID NO: 26076 - protein, 191 aa, Unknown
  Obtained from environmental sample
  misc_feature (1)..(191): Xaa is any amino acid
MFSEKDDYESNLSPEEGDEAIQELKDKGYSEEDLLRLGYITKRKSLGILNEKEGDIITSINKERLLFPFEFYSIYEMQRIIKAELAKHEKQPSNEESNTSSNDRLKVNLSVPQLALLFKMINDLKPSVLIVSTEAELLRFISSNFQTKNSSIENGISENKLRILFNQPDDRAIDFWEKHLRTMLAEIKKMK

SEQ ID NO: 26077 - DNA, 432 bp, Unknown
  Obtained from environmental sample
  misc_feature (1)..(432): n is a, c, g, or t
ttgagctttgactcggctcaggaacttcagataaatccggaggataaatattttgataaagagacagggaaaactttantttttttaaccaataatttcacctaccaagcaacgattattgctgagctatataaagaaagatggaaaatcgaattatttttcaaatggattaaacaacatctgagaatcaagagtttttttggcaccagcttgaatgcggtttatacccaaatatggatagcagtaagtgcctatctaataattgcaattatgaagaaaagactgaaaatagagcttgaactttacactattttacaaattttgagtattagcctctttgaaaaagtaactgtaaatcagatacttaacaataaagagtacagaaacaatattaatgacgattataaccaactgaaaatgtttgatttataa

SEQ ID NO: 26078 - protein, 143 aa, Unknown
  Obtained from environmental sample
  misc_feature (1)..(143): Xaa is any amino acid
MSFDSAQELQINPEDKYFDKETGKTLXFLTNNFTYQATIIAELYKERWKIELFFKWIKQHLRIKSFFGTSLNAVYTQIWIAVSAYLIIAIMKKRLKIELELYTILQILSISLFEKVTVNQILNNKEYRNNINDDYNQLKMFDL

SEQ ID NO: 26079 - DNA, 441 bp, Unknown
  Obtained from environmental sample
  misc_feature (1)..(441): n is a, c, g, or t
atgtttggtgaaaagtttggtaatcctggagaactttatgaagagcgctttaaaaagcaagaaaaaaatttcgataacatatttgaggaaaaagttgtaggttctaaaacggatcaatatttaggtgattttaaaactaaatcatcacaggttcgcgtcctttatcgtgattatggttctattgatggtgacgtaattcgtgtttttgttgataaagatattatgatgccatatgctgttttaacgggtgactacaaaggttttgtcttgcagttaaaaacaggctttaatgttattgattttttagctttatctcaaggtgatgttgctccaaataccgcacaagtggttataatggatgaaaatgaggagattattgcttcctctgggtggggactagccaatggtgttaaagcaacactcatcgttgttaaagaatag

SEQ ID NO: 26080 - protein, 146 aa, Unknown
  Obtained from environmental sample
  misc_feature (1)..(146): Xaa is any amino acid
MFGEKFGNPGELYEERFKKQEKNFDNIFEEKVVGSKTDQYLGDFKTKSSQVRVLYRDYGSIDGDVIRVFVDKDIMMPYAVLTGDYKGFVLQLKTGFNVIDFLALSQGDVAPNTAQVVIMDENEEIIASSGWGLANGVKATLIVVKE

SEQ ID NO: 26081 - DNA, 534 bp, Unknown
  Obtained from environmental sample
  misc_feature (1)..(534): n is a, c, g, or t
atgaaaaatttattttttactgctatttttttgttttgtttacctgcattagctcaggatattaaagcaactacagttgatggaaaaacagtaattctaaaagctaataacacttggtcttattctaatcaggatagctcaaagagcaagatttgtgatctaggacctgattttaaagaaggtgaagttaataagcgattacgagagtatgtagccgttgaaaatgactgtaaggaagaggacgtgatttttataaattcatacgaagatatgggtagtggtatattttcattatgcgttaaaggtaaacctatgaaatataaaaaagtaggaactatatttttcaaatctgataacacttggtctaatagttcaaagaacaacacttgtaatctaggagctgattttaaagaaggtgaagttaataagagattacgagagtatgtagccgttgaaattactgtaacgaacaaaatgtgttttattaattctacgaaaataggggtatggatgtttcattatgtgttaaggtaa

SEQ ID NO: 26082 - protein, 177 aa, Unknown
  Obtained from environmental sample
  SIGNAL (1)...(18)
  misc_feature (1)..(177): Xaa is any amino acid
MKNLFFTAIFLFCLPALAQDIKATTVDGKTVILKANNTWSYSNQDSSKSKICDLGPDFKEGEVNKRLREYVAVENDCKEEDVIFINSYEDMGSGIFSLCVKGKPMKYKKVGTIFFKSDNTWSNSSKNNTCNLGADFKEGEVNKRLREYVAVEITVTNKMCFINSTKIGVWMFHYVLR

SEQ ID NO: 26083 - DNA, 351 bp, Unknown
  Obtained from environmental sample
  misc_feature (1)..(351): n is a, c, g, or t
gtgtatgtaatgatgaaaaatgaagtggaaaaagaaatctttgagctgcaaatacaatttactgagttaatgcgcctatttgatgacaaagaaataaatttggatgttatctcagtcaaatattccaaattaaaacaacaagtaaatggtcgtgtaaacgatttagaaaaagctaaaaagaataatcggctcaatgaatatgaaggctatttcttacttccatgcatgaagaagataagcctcagctgtaatgctagagtaggttcaaaagataaatccgcactaagctcatctatatatgatggtgaggattattgctcatattggctgacagaaataagaagctgttga

SEQ ID NO: 26084 - protein, 116 aa, Unknown
  Obtained from environmental sample
  misc_feature (1)..(116): Xaa is any amino acid
MYVMMKNEVEKEIFELQIQFTELMRLFDDKEINLDVISVKYSKLKQQVNGRVNDLEKAKKNNRLNEYEGYFLLPCMKKISLSCNARVGSKDKSALSSSIYDGEDYCSYWLTEIRSC

SEQ ID NO: 26085 - DNA, 747 bp, Unknown
  Obtained from environmental sample
  misc_feature (1)..(747): n is a, c, g, or t
atgaaatggagtttcttaatcctatttgttttatcatttccatcaagtgcaataataatgagacatgatgtagatgagtctaaatatttagaatttgccaaggataataaatcgatagttaccttttacggaaattataaagataaagaaattgtcgaaggaacagggactctaattgccgaagattgggtaattaccgctgctcatgttgccaattatttgttaattgatggaaaagtcagattcaaagattcttactacaaaataaagaaagttgttaaacatccagactggaaagataagcaatttccaaatgatatcgctcttgtccagttacaatcgactatccctaatagtgaaactgtcgctttatatgacaaagaggatgaacttcataaaactttgacgtttatcggtcgcggggactttggtactggtgaagtaggagttgtcggtgctgatgatcgtttaagggctgcacaaaatgttgtcacggaaacttctgggcagtgggttcggtttaagtttgatagtgaaaaaggctctttggcattagaggggattagtggtccgggggattctggtggaccagcactacttaaaatgaataatcgactctatattgtgggcgttagttcatggcaaaattcagagccaacagaatggcaagaagctaaatatggggtaattgaaaaatactctcgcatttcatacttcaaaaaatggatagaaaaatctatggagtag

SEQ ID NO: 26086 - protein, 248 aa, Unknown
  Obtained from environmental sample
  SIGNAL (1)...(17)
  DOMAIN (42)...(243): Trypsin
  misc_feature (1)..(248): Xaa is any amino acid
MKWSFLILFVLSFPSSAIIMRHDVDESKYLEFAKDNKSIVTFYGNYKDKEIVEGTGTLIAEDWVITAAHVANYLLIDGKVRFKDSYYKIKKVVKHPDWKDKQFPNDIALVQLQSTIPNSETVALYDKEDELHKTLTFIGRGDFGTGEVGVVGADDRLRAAQNVVTETSGQWVRFKFDSEKGSLALEGISGPGDSGGPALLKMNNRLYIVGVSSWQNSEPTEWQEAKYGVIEKYSRISYFKKWIEKSME

SEQ ID NO: 26087 - DNA, 333 bp, Unknown
  Obtained from environmental sample
  misc_feature (1)..(333): n is a, c, g, or t
atgagccacataaatatgggtcgaatatttattattatgggtgtatcaagcaccggaaagtcgagtattggttatgcgcttgcgaaaaaaatggacgctaaatttattgatggcgatgatttacatcccaaagcaaatattttaaaaatgtcatcagggcaaccgcttaatgatgatgatagggtgccgtggttagaaagaattcgtgacgctgcgtttagtattgagcagaaaaatgaagtggccgttattgtttgttcagccttaaagaaaaaataccgagagcaaatatgcgaaggaaataagaatctcgagccgattcttgatcactag

SEQ ID NO: 26088 - protein, 110 aa, Unknown
  Obtained from environmental sample
  misc_feature (1)..(110): Xaa is any amino acid
MSHINMGRIFIIMGVSSTGKSSIGYALAKKMDAKFIDGDDLHPKANILKMSSGQPLNDDDRVPWLERIRDAAFSIEQKNEVAVIVCSALKKKYREQICEGNKNLEPILDH

SEQ ID NO: 26089 - DNA, 357 bp, Unknown
  Obtained from environmental sample
  misc_feature (1)..(357): n is a, c, g, or t
ttgctgtccgaagatcatttggattctttagaaattgaaattgaaaacttatttaaaaataataaaaaaattgatggtgtttttgctgtaaacgagctgtatgctattacaacaatgaaggttgctagaaagttaggcttaaccattccagacgatttgcaaattgttggttttacagatggtgtattgtctaaacacgctgttcctgctttaactacagtcagtcaacatggtaagaaaataggcgaaaaagcagccgaattattgataaataatttagaaagagaagacgaagaagacatctacgaaaccgtagttattgaaaccgaattaattgaacgcgcatccacaaaataa

SEQ ID NO: 26090 - protein, 118 aa, Unknown
  Obtained from environmental sample
  misc_feature (1)..(118): Xaa is any amino acid
MLSEDHLDSLEIEIENLFKNNKKIDGVFAVNELYAITTMKVARKLGLTIPDDLQIVGFTDGVLSKHAVPALTTVSQHGKKIGEKAAELLINNLEREDEEDIYETVVIETELIERASTK

SEQ ID NO: 26091 - DNA, 792 bp, Unknown
  Obtained from environmental sample
  misc_feature (1)..(792): n is a, c, g, or t
gtgtgtgcggtacgggatcaactgagagtagataaaacctaccgtgaggatgcaaacatcaccattgttgaggccgattttttaaaaccggaaacccttcaaaacatcccgaaagatattgatgtggcgtactacttaatacattccatgtccaatacctctaaagatttcgagaaattggaagccacctgtgctgaaaattttgaagagtatttctctaccacacaagtcaagcaagttatttatctaagcggcattaccaatgataaaaatctctctaaacatttacaatcacgtaaaaatgttgaagatttattgttctcagaaagctatgcactaacgattttcaaagcaggcattattgtaggctctggaagttcgtcttttgaaattattagagatttggtcgaaaaattaccggtgatgattgctccaaaatggctgaacaccaaaacgcaacctttggcggttagagatgttttggcatttctatccaaggcaaaaggacgggaagaattatacaataaatcctttgatattttgggtcctgaaattctgacctacaaagaaatgttgttacagtttgcggagattagagaattgaatcgncacattctcactgtacccttaatgaccccaaaactgtcctcctattgggtctatgttgtaacatccacctcctataaacttgccacgtcctgggtagacagtatgggacttgaacttttgcgcataaaagtgacttcaagagacttcttgatttgcagcccatcacctatcccgaagcagtag

SEQ ID NO: 26092 - protein, 263 aa, Unknown
  Obtained from environmental sample
  misc_feature (1)..(263): Xaa is any amino acid
MCAVRDQLRVDKTYREDANITIVEADFLKPETLQNIPKDIDVAYYLIHSMSNTSKDFEKLEATCAENFEEYFSTTQVKQVIYLSGITNDKNLSKHLQSRKNVEDLLFSESYALTIFKAGIIVGSGSSSFEIIRDLVEKLPVMIAPKWLNTKTQPLAVRDVLAFLSKAKGREELYNKSFDILGPEILTYKEMLLQFAEIRELNRHILTVPLMTPKLSSYWVYVVTSTSYKLATSWVDSMGLELLRIKVTSRDFLICSPSPIPKQ

SEQ ID NO: 26093 - DNA, 324 bp, Unknown
  Obtained from environmental sample
  misc_feature (1)..(324): n is a, c, g, or t
ttgtcattggtaaaggaaggattggctaataactcaaggttagttgttagtatttttgttaaccctactcaatttgataatgctgacgatttagcaaaatatccacgaactttagaggacgatattgctcttttaaagaccgtttctgacaaaataattgtgtatgcaccaactgtagatgatatttatgatggtaatacaaaagcccaacaatttagttttgatggcttggagtttgaaatggaaggaaaatttagagctggacattttgatggtgtaggtactattgttaaacgattatttgaaattgtaacacctaaataa

SEQ ID NO: 26094 - protein, 107 aa, Unknown
  Obtained from environmental sample
  DOMAIN (1)...(107): Pantoate-beta-alanine ligase
  misc_feature (1)..(107): Xaa is any amino acid
MSLVKEGLANNSRLVVSIFVNPTQFDNADDLAKYPRTLEDDIALLKTVSDKIIVYAPTVDDIYDGNTKAQQFSFDGLEFEMEGKFRAGHFDGVGTIVKRLFEIVTPK

SEQ ID NO: 26095 - DNA, 951 bp, Unknown
  Obtained from environmental sample
  misc_feature (1)..(951): n is a, c, g, or t
atgagttggtgcattaattaccaagtaacacctataaacggagaagcaacaatcaagtttcaaccgtatttagattctggtattaccaatgaagataccaattgggacgaccaattttgggatactttaaatgtaactacagaaaacgaacaagcgtttattgaagcaaaaaccatgaaaactggttttcatacttgcacatttatgcagtcttcggtttttgtaaataatacaaaacaagagcaaagaccagaaacagataaacaagaaaatgctatttcatttacgtatacagtttctgtaaatgcaggcgaaactgctagcattcaaaagtttggtggttataccgtagatagaaaccacgataaaaatcagttagtttctgcagcaaaaaaagctttagatactgcttcaaatttagggtttcaagcacttttaaagaaccaaaaagaggcttggtcaaaaatttgggaaatgtcagatatcacaatcgatggtgacgtaaaagcacaacaaggtattcgttttaatattttccaattaaaccaaacctatttaggaaaagattctacattaaatattggtccaaaaggatttacaggagaaaagtatggtggaagtacctattgggatacagaagcatattgtataccgttttacatggctaccaaagatcaaaaagtagcacgaagtttacttaaataccgatataatcatttagaaaaagcgattgaaaatgctgaaaaattagggtttaataacggagcagcattatatccaatggtaaccctgaatggcgaagaatgccataacgaatgggaaattacttttaagaaaattcacaaaaatggagctatcgcatttgctatttttaactaccatcgttacacaggtgactattgctatttttccaaaaatgggaataaaaatttcttattgggtattggctaa

SEQ ID NO: 26096 - protein, 316 aa, Unknown
  Obtained from environmental sample
  DOMAIN (175)...(316): Glycosyl hydrolase family 65 central catalytic domain
  misc_feature (1)..(316): Xaa is any amino acid
MSWCINYQVTPINGEATIKFQPYLDSGITNEDTNWDDQFWDTLNVTTENEQAFIEAKTMKTGFHTCTFMQSSVFVNNTKQEQRPETDKQENAISFTYTVSVNAGETASIQKFGGYTVDRNHDKNQLVSAAKKALDTASNLGFQALLKNQKEAWSKIWEMSDITIDGDVKAQQGIRFNIFQLNQTYLGKDSTLNIGPKGFTGEKYGGSTYWDTEAYCIPFYMATKDQKVARSLLKYRYNHLEKAIENAEKLGFNNGAALYPMVTLNGEECHNEWEITFKKIHKNGAIAFAIFNYHRYTGDYCYFSKNGNKNFLLGIG

SEQ ID NO: 26097 - DNA, 561 bp, Unknown
  Obtained from environmental sample
  misc_feature (1)..(561): n is a, c, g, or t
ttggtttttaaaacgatatatttgataaactttgagcaatacattattatgaaaaaaattatactgcttaccttatgtgtcttaattttttcttgtaaaaataattctaacgatataatcacacctaacagcaataagaccactaacaataatgaaaaaaacaccaaacctaatacaacgctagcttttcttgtaaatgtaaaaaatttagaaaaggatgctgcaactaatccaatagaggcttttaaaaaatctgcaacaacagaagcaaaagaagttatatatataactagtgacaatcttaaaactagtttaaacttagctaaaaaacatgactatgcagttattactgtagaagatcatactataattaagttaaatttacaagattgtaaaccatcaaatgcttgggatgcttgtatgccaaaagcagaaggttatattaaaaaaggggacttaatttaccaaaatgactattgtaataatatcattggattaccagataatcaagagcgtatcttatacttgtttcaaatagtacaaatgtttaacttttattaa

SEQ ID NO: 26098 - protein, 186 aa, Unknown
  Obtained from environmental sample
  misc_feature (1)..(186): Xaa is any amino acid
MVFKTIYLINFEQYIIMKKIILLTLCVLIFSCKNNSNDIITPNSNKTTNNNEKNTKPNTTLAFLVNVKNLEKDAATNPIEAFKKSATTEAKEVIYITSDNLKTSLNLAKKHDYAVITVEDHTIIKLNLQDCKPSNAWDACMPKAEGYIKKGDLIYQNDYCNNIIGLPDNQERILYLFQIVQMFNFY

SEQ ID NO: 26099 - DNA, 726 bp, Unknown
  Obtained from environmental sample
  misc_feature (1)..(726): n is a, c, g, or t
ttgttgagatactccctacatctattgatgttggaaatggactcctctgacagcttaatttttttatcgaaaaaaagtatattgctgatctcagataattctaaagtctttgaagatatagtatgtactaaattcattattatcatttctagactcaaaaatcaacaatacattggcattatgcaacaaatgttaataattaataaaagattctattatgtcttgtcaaactcttatttttggcaacttaaattgataacaatgaaaaatatatttattctcttatgtgccttaactattgtttcttgtaaagaagaaccaaagaattatgtcactttctcaggaaaaatctcaaacaaaacaggtgattctcttatgttgagaaacagaacgatgatgaaaactatagctttggacgctgacgggaacttttctgacacccttactatagatcaaccggaagtgtttggtttttttaacggtgcaattgctgcgccaatcttcttaaagaacgggtttgacatgacgatgaatgccgatggagaaaactttgaagaaaccttggagtttccagggtctggagctgaacacaacaaattctttattgaacaaatgcgattagagaaagatttttcggatcacgattcattgagcagcttaagctcagaaggtcttaaaactgaatgcagacaaccgaaaaaattattgccatttatgagcttataa

SEQ ID NO: 26100 - protein, 241 aa, Unknown
  Obtained from environmental sample
  misc_feature (1)..(241): Xaa is any amino acid
MLRYSLHLLMLEMDSSDSLIFLSKKSILLISDNSKVFEDIVCTKFIIIISRLKNQQYIGIMQQMLIINKRFYYVLSNSYFWQLKLITMKNIFILLCALTIVSCKEEPKNYVTFSGKISNKTGDSLMLRNRTMMKTIALDADGNFSDTLTIDQPEVFGFFNGAIAAPIFLKNGFDMTMNADGENFEETLEFPGSGAEHNKFFIEQMRLEKDFSDHDSLSSLSSEGLKTECRQPKKLLPFMSL

SEQ ID NO: 26101 - DNA, 522 bp, Unknown
  Obtained from environmental sample
  misc_feature (1)..(522): n is a, c, g, or t
ttggtaatacccttgaacaacctttatgctttaaccattaaaaactcagagaaagcacctgaagtaattttaaaactttctgaaatgatgagatataccatttatgaagggaaaaaggatgtcgtttcagtaaaggatgagattgaatatctttctaattatattgagttgcataaaattagatatcgcaataaagtggatattcagtttacacatgatatcgataacaatcttgaagttgcgcctttgctatttattatctttttagaaaatgcttttaaacatgggctagaaaaaaatcatgaagatggctttattcatatgaatttaaacggtgattcaaatcaaatccaattcactattaaaaataaatttgatccaaatcaagaagatgaaactacgggaattgggttaactaatttaaaacgacgcctagatttaacgtatcccaaaaaatatgatttaaacatatcgaacgaaaatagtatctatcttgtaaatctaaaaattgaccttacatga

SEQ ID NO: 26102 - protein, 173 aa, Unknown
  Obtained from environmental sample
  DOMAIN (5)...(71): Histidine kinase
  misc_feature (1)..(173): Xaa is any amino acid
MVIPLNNLYALTIKNSEKAPEVILKLSEMMRYTIYEGKKDVVSVKDEIEYLSNYIELHKIRYRNKVDIQFTHDIDNNLEVAPLLFIIFLENAFKHGLEKNHEDGFIHMNLNGDSNQIQFTIKNKFDPNQEDETTGIGLTNLKRRLDLTYPKKYDLNISNENSIYLVNLKIDLT

SEQ ID NO: 26103 - DNA, 717 bp, Unknown
  Obtained from environmental sample
  misc_feature (1)..(717): n is a, c, g, or t
ttggagcttttgaatcgggctcagggagcttatgttgacgtattatatgtcgctttaaaaatgcgttttgaggacagtattatttttgaaattccggcgcaagcctcaaatcctgaaagtaaagtggtgccgttatcgcttcagttattattagaaaacgcagtaaaacacaatattgtcaccagtagtaaacctttgcatattaaaatttatgaagacactcaaggttatttagtggtggaaaacaacttacaacccaaacaaattttaaataagagtagtggttttggtttagaaaacatcaaacaacgctaccaattattaaccaataaaagtgtaactatatcacagcaaacctcattgtttactgtagcaatacctatgcttaccaaacatttatctattatgaaaacagcacaaacatcacatgagtatagcgacagttatttacgcgccagacaacatgtagacaacttaaaagagttttattataaccttatttcttactgttttgtaattccgtttttaatttttatcaactataaaaccttttggggctttcaatggttttggtttccattatttggttggggaatgggattagcatttcatgcgtataaagtatatgtaaatgatggcgttttaggacgtggctgggaaaaacgcaagattgagcagtttatgaaacaggaagcacacactaaaaaatgggattaa

SEQ ID NO: 26104 - protein, 238 aa, Unknown
  Obtained from environmental sample
  misc_feature (1)..(238): Xaa is any amino acid
MELLNRAQGAYVDVLYVALKMRFEDSIIFEIPAQASNPESKVVPLSLQLLLENAVKHNIVTSSKPLHIKIYEDTQGYLVVENNLQPKQILNKSSGFGLENIKQRYQLLTNKSVTISQQTSLFTVAIPMLTKHLSIMKTAQTSHEYSDSYLRARQHVDNLKEFYYNLISYCFVIPFLIFINYKTFWGFQWFWFPLFGWGMGLAFHAYKVYVNDGVLGRGWEKRKIEQFMKQEAHTKKWD

SEQ ID NO: 26105 - DNA, 429 bp, Unknown
  Obtained from environmental sample
  misc_feature (1)..(429): n is a, c, g, or t
gtgtgtatggcactttggagcgataaagtaattgataatgaagagcatcaatttttaaaacaactgacttcagatttaaatttagagactaaaatcacagaacaagcagtagaagatatcaactgtttttacagtgaaaacaaagataaaatagcattattaaatgctaaaaacatggtgcagagtttttatgataactctaccaaaatggtaagtaaacttataaaacgaaatagcaaacgtcttttaaaagaacttagagagagtaaagagttaatgattttacttacaaaatctaccacaagaccactgactgaaagcgaacagaaaaaaatgcaagatcaattactagatatctttaaatcgatacctagtttagctattttcatgttacccggcggcgctaattttattacctatctgctataa

SEQ ID NO: 26106 - protein, 142 aa, Unknown
  Obtained from environmental sample
  misc_feature (1)..(142): Xaa is any amino acid
MCMALWSDKVIDNEEHQFLKQLTSDLNLETKITEQAVEDINCFYSENKDKIALLNAKNMVQSFYDNSTKMVSKLIKRNSKRLLKELRESKELMILLTKSTTRPLTESEQKKMQDQLLDIFKSIPSLAIFMLPGGANFITYLL

SEQ ID NO: 26107 - DNA, 480 bp, Unknown
  Obtained from environmental sample
  misc_feature (1)..(480): n is a, c, g, or t
gtggttatgaaaattaataaatctcatttacttttggcactcgtaagttttggtttattagtcagtggttgtgacaatatcgaaaaaatgcagcctgaaatatatgcagaaaaggtaggttctaaaaaactaactgacccagataacagtaatgatctcgataaagtgccaacgccgcagagcgaagtcaacttttcagctaattctgcagctaaaacacaatggtctacattcaatagtgatggacaagttaatgagataaaacgtattgtcgttagttacggcggtgagttacaaggcttaggttatagtgatgctaaaatcctagaaactgctgatatttatgtcccaaatgctgatatatcagacgctaaacgcttacagttgactaaaacattatcaaagttggtaggagcacctatcgtaataaacattttagacagtagggtcatcgatgcgatgggaagcttggaactttag

SEQ ID NO: 26108 - protein, 159 aa, Unknown
  Obtained from environmental sample
  misc_feature (1)..(159): Xaa is any amino acid
MVMKINKSHLLLALVSFGLLVSGCDNIEKMQPEIYAEKVGSKKLTDPDNSNDLDKVPTPQSEVNFSANSAAKTQWSTFNSDGQVNEIKRIVVSYGGELQGLGYSDAKILETADIYVPNADISDAKRLQLTKTLSKLVGAPIVINILDSRVIDAMGSLEL

SEQ ID NO: 26109 - DNA, 657 bp, Unknown
  Obtained from environmental sample
  misc_feature (1)..(657): n is a, c, g, or t
ttgcatataaaccaaacactggctttttacgaagcctatggaattaaagggtggcagtcattaaaaatgactattgattatttaaacgataagcatcctgaaatttttactattgctgacgcaaaacgcggagatatcggcaatacctctaccatgtatgccaaagctttttttaaagatttaaattttgattcggtaacagttgcgccatatatgggtagcgattctgtggaaccatttttagcgtttgaaaataaatttacaatactacttgccttaacttcaaacaaaggtggacttgattttcaagggttaaaagtagatgataaaaaattatataaacaggttttacaaactgctttaacttggaaaaacaacgaacaattgatgtttgttgttggagctactaaatcaaaatattttaagggtatccgcgaaattacaccaaatcattttttattagtacctggggttggggctcaaggtggaaatctacaagatgtttgcaaatatggaatcacaaaagatattgggttattgattaattcttctcgtggaattatttatgcaggtaatggcgaagacttttctcaaaaatctcaagaaaaagctttagagctacagttagaaatggctaaggttttaaaaactatataa

SEQ ID NO: 26110 - protein, 218 aa, Unknown
  Obtained from environmental sample
  DOMAIN (1)...(196): Orotidine 5'-phosphate decarboxylase / HUMPS family
  misc_feature (1)..(218): Xaa is any amino acid
MHINQTLAFYEAYGIKGWQSLKMTIDYLNDKHPEIFTIADAKRGDIGNTSTMYAKAFFKDLNFDSVTVAPYMGSDSVEPFLAFENKFTILLALTSNKGGLDFQGLKVDDKKLYKQVLQTALTWKNNEQLMFVVGATKSKYFKGIREITPNHFLLVPGVGAQGGNLQDVCKYGITKDIGLLINSSRGIIYAGNGEDFSQKSQEKALELQLEMAKVLKTI

SEQ ID NO: 26111 - DNA, 339 bp, Unknown
  Obtained from environmental sample
  misc_feature (1)..(339): n is a, c, g, or t
atggccaagtcgaaaaagaagattcaagacggtccgataatcataaaaaaatatgccaatcggcgtctctataacacccagacatccaattatatcaccctcgattttcttgccgagatgacccgcaatgacgaggattttgtcgtcgttgatgccaagtccggagaagatattacccataatgtgctgacccagatcatcgtcgacgaggaaagcaacgggaagcatatgctgccggtcaattttctgcgccagctgatttccatgtatggcaacagcatgcagtctttgatgccgtgctatctggaagcgtcgatggataatttccggaaaaacagn

SEQ ID NO: 26112 - protein, 113 aa, Unknown
  Obtained from environmental sample
  misc_feature (1)..(113): Xaa is any amino acid
MAKSKKKIQDGPIIIKKYANRRLYNTQTSNYITLDFLAEMTRNDEDFVVVDAKSGEDITHNVLTQIIVDEESNGKHMLPVNFLRQLISMYGNSMQSLMPCYLEASMDNFRKNX

SEQ ID NO: 26113 - DNA, 795 bp, Unknown
  Obtained from environmental sample
  misc_feature (1)..(795): n is a, c, g, or t
atgacaaacctagtatacataggcaacaaattaattagttcaggtaaaacagctacaaccattgatactttaggtacaaatcttgaagcatctggttttaaaataacttatgcctctagttataaaaatatctttttgagattaatccatatgctatggaccgtttttaaacacagacaatccaccgactatgtattaatcgatacatacagtacgctaaatttttattacgcctatgctgtaagtaagttatgtaaaatattaggcttaaaatacattcctattttacacggagggaatttacctattcggcttattaaaaaccctaaattaagtgctactatctttaaaaatgcatatgttaatattgcaccttcaaattatattaaagcatcttttaaagaaaaaggttatataaatgtagaagtgataccaaatagtattgacattataaattatccttttttagttagagaaatagataccatagatctactttgggtacgttctttttcaaatttgtacaatccaaaattagcaatcaatgtcttatctgaattaaagaaaaaaggttacaattgttcgttgtgcatggttggtccagacaatgatggtagtttacaagaagttaaaaaatatgccagcaatctaggtttagaggtatcctttacagggaaattgactaaagaagaatggattgctttatctaaaaattacaatgtatttattaataccactaattttgataatacacctgtaagcgtatcgaagctatgcttctcgaccgattcttga

SEQ ID NO: 26114 - protein, 264 aa, Unknown
  Obtained from environmental sample
  misc_feature (1)..(264): Xaa is any amino acid
MTNLVYIGNKLISSGKTATTIDTLGTNLEASGFKITYASSYKNIFLRLIHMLWTVFKHRQSTDYVLIDTYSTLNFYYAYAVSKLCKILGLKYIPILHGGNLPIRLIKNPKLSATIFKNAYVNIAPSNYIKASFKEKGYINVEVIPNSIDIINYPFLVREIDTIDLLWVRSFSNLYNPKLAINVLSELKKKGYNCSLCMVGPDNDGSLQEVKKYASNLGLEVSFTGKLTKEEWIALSKNYNVFINTTNFDNTPVSVSKLCFSTDS

SEQ ID NO: 26115 - DNA, 840 bp, Unknown
  Obtained from environmental sample
  misc_feature (1)..(840): n is a, c, g, or t
ttgctcaccaataaagaatataattcggccctggtttactttaatgaatcaggagcgctttttgaacaggccaattatgaagttggcaaagcctataatctgggtaatataggtatggtgtatgcgaataccggcataaacgaccttgctgaaaaaaacatcaatgaagcgatacgaatactggaagagactggtgactattatcctatcagtgtttatcttatggccatgtctgatatttatgtagaaagaggtgcaccgaaaactgcattaaattatgcacaaaaaagtttgacccttgcccagcagtacggtttaaagaatgaggccagtgatgccaatcttaaattatctgaattgtatgaaatgcagggaaacactaagaaatccttacaacattataaaaaccatattagctatagggatagtgtaaataatatccaggctgtacaatcaatggccgatctgcgtaccgattatgaagtctcacagaaacagacagaaattgacttgcaacagacagaggtaaccttgttaaaccaacaaaaaaagaaccaacgcatcgtggtcattgtcacggtaatcgccttgttcttgataggtttatttgccattggactatttagacgtaataaattcattcaaaaaaccaaactgatcattgagaaagaaaaggaacgatcagataacttgttgctaaatattttaccggaagaaacggcaaaagagctaaaagataatggcaaggtactggctaaaaagtttgaatcggttaccgtattattttcagattttaaaggttttacaaagtattctgaaaattgtctccttaacttctga

SEQ ID NO: 26116 - protein, 279 aa, Unknown
  Obtained from environmental sample
  misc_feature (1)..(279): Xaa is any amino acid
MLTNKEYNSALVYFNESGALFEQANYEVGKAYNLGNIGMVYANTGINDLAEKNINEAIRILEETGDYYPISVYLMAMSDIYVERGAPKTALNYAQKSLTLAQQYGLKNEASDANLKLSELYEMQGNTKKSLQHYKNHISYRDSVNNIQAVQSMADLRTDYEVSQKQTEIDLQQTEVTLLNQQKKNQRIVVIVTVIALFLIGLFAIGLFRRNKFIQKTKLIIEKEKERSDNLLLNILPEETAKELKDNGKVLAKKFESVTVLFSDFKGFTKYSENCLLNF

SEQ ID NO: 26117 - DNA, 828 bp, Unknown
  Obtained from environmental sample
  misc_feature (1)..(828): n is a, c, g, or t
ttgagtttgattcggctcgaggctccaacggctgaaagtgttggaatagattcaacggatgcagtaaaagcttatgaggttttagacactgaatttcatgagcttattacttctaagaaaattgacgctattgaaattgaagatgatctttcaattctagccctagttggttcaaatatgcgaaatcaagtaggcgtaagtggacagatgttcaatgtactgggcaagaatggagtaagtattaaagcgattgctcaaggttcttcagaaagaaatatttcagcggtaatattgcgccaagacttagataaagccctaaatgtattacacgaaagttttttccagtatgtaaccaaacgagttaatttatttatcattggtacaggaaatgttggaaaggcatttattaaacaactagtacaacaattctccttcttaaagaaaaaccatcaacttactatcaagatcattggaattgcaaattcaagattaatgcaattccataaagacggtatcaggctttcaaagtgggaaaccgntcttgaagaaggtaaaccttttgagaaagaagctttctttaagcaaatgcactccttgaatcttcgcaatagtatcttcattgatattactgcctctgaaagcattggcggttcttattctgcaaatttgcagaaaagtattccagttgtaacaccaaaacaaattgctgcacttgtttcgtataccgattacaaaaaacttaatttgctacgcaagaaattcggtagcaaattcctattcgaaccactgtgtgtgctgattacctgtaattcctacccttacgattaa

SEQ ID NO: 26118 - protein, 275 aa, Unknown
  Obtained from environmental sample
  DOMAIN (134)...(268): Homoserine dehydrogenase, NAD binding domain
  misc_feature (1)..(275): Xaa is any amino acid
MSLIRLEAPTAESVGIDSTDAVKAYEVLDTEFHELITSKKIDAIEIEDDLSILALVGSNMRNQVGVSGQMFNVLGKNGVSIKAIAQGSSERNISAVILRQDLDKALNVLHESFFQYVTKRVNLFIIGTGNVGKAFIKQLVQQFSFLKKNHQLTIKIIGIANSRLMQFHKDGIRLSKWETXLEEGKPFEKEAFFKQMHSLNLRNSIFIDITASESIGGSYSANLQKSIPVVTPKQIAALVSYTDYKKLNLLRKKFGSKFLFEPLCVLITCNSYPYD

SEQ ID NO: 26119 - DNA, 558 bp, Unknown
  Obtained from environmental sample
  misc_feature (1)..(558): n is a, c, g, or t
ttgctgaagctgagatcaaaaaagattataagactgatctattgggtaaattatcaacagcataatcttaaaacagccgttcaaacagttaacattattaatactagaggtttttcaatttctgaaagtaatattgaagatggattattaaaagtagtaaaaaatactagcctattaggtcgttggcaactacttatgaaaaaaccgagagttatttgtgattcggcgcataataaagaagggttggcatatgttttaaaacaactctcagaagaaaagtatcagatcttacatattatattaggagttgtaaacgataaaaaactggaaacaattctaaacttatttcctgcaaaggctcaatattatttttgtaaaccggatatcccgagaggtttagatgctaaaatattgcaagaaaaagcggctgattttaatctaaaaggtgagttatatacttcggtaaatgaagcattaaatatggcaaaaattaaagctaattcagacgatttaatatttgttggagggagcacttttgtggtggctgaagtggtttaa

SEQ ID NO: 26120 - protein, 185 aa, Unknown
  Obtained from environmental sample
  misc_feature (1)..(185): Xaa is any amino acid
MLKLRSKKIIRLIYWVNYQQHNLKTAVQTVNIINTRGFSISESNIEDGLLKVVKNTSLLGRWQLLMKKPRVICDSAHNKEGLAYVLKQLSEEKYQILHIILGVVNDKKLETILNLFPAKAQYYFCKPDIPRGLDAKILQEKAADFNLKGELYTSVNEALNMAKIKANSDDLIFVGGSTFVVAEVV

SEQ ID NO: 26121 - DNA, 588 bp, Unknown
  Obtained from environmental sample
  misc_feature (1)..(588): n is a, c, g, or t
ttgaatttagttgcaggaaatgtatcgaatataacatctcctacagatattttagatatcacaacagcagatgaagtgttggctgtagatttctctttaaatggtgaaacaaaaggagttgtattaggtattaaaacaactgataaggtttacaatcatacaaaagcatcttgtgatcgtttaagaggagcagaaattttaaatattcagactgtacaagtaaaaggttataatttcttaatgcaaggaattaagcaaagaaatggagttgtagaatatgcaatttcttttgcaactgcaaagaataataacgataccaactatacaattcaaacaaactggtatgtaaataattacaccaagtttaatgatgtatataacttccaagtatggtctacaaagccagcagatactcaaaagttagttgcagatgttttaaataatttagaatcttttatccctgtaaaacaaacagaaattcagaaagttccagaaacttatgcttctaaaatttacagagataaagctgaattagttgtaatgttaagaagtacagaagaaggaatactgcagaagtatctatggtag

SEQ ID NO: 26122 - protein, 195 aa, Unknown
  Obtained from environmental sample
  misc_feature (1)..(195): Xaa is any amino acid
MNLVAGNVSNITSPTDILDITTADEVLAVDFSLNGETKGVVLGIKTTDKVYNHTKASCDRLRGAEILNIQTVQVKGYNFLMQGIKQRNGVVEYAISFATAKNNNDTNYTIQTNWYVNNYTKFNDVYNFQVWSTKPADTQKLVADVLNNLESFIPVKQTEIQKVPETYASKIYRDKAELVVMLRSTEEGILQKYLW

SEQ ID NO: 26123 - DNA, 504 bp, Unknown
  Obtained from environmental sample
  misc_feature (1)..(504): n is a, c, g, or t
ttgcagaagattcaaaaaagagatccaacttctggtgaatcagcaaacttcatttcatttattgaaaaagaattgcaaccatatattgaaaagaaatacaaaaccaatgattcaaaaactattattggacaatcagcagncggacttttagcaacagaaattttaataaaaaaaatgcaccttttcaacaaatacataatcataagtccaagtttgtggtgggataatggttctctattaaatgaaaaatcggaaatctatcaagagaattttaaaggacatatcgatatttatattggagttgggaaagaaggacttgcaccaacagaaatccctcacgttatggaagttgatgcaaatttattagccgagaaattgaaaagcgcaaaaagcaaaaatgtaaaagtgtattttgattatttgccacaagaagaccacgcaacaattacgcatcaagcaatttttaatgcgttgagaattttatatccaaaaacagataaatag

SEQ ID NO: 26124 - protein, 167 aa, Unknown
  Obtained from environmental sample
  misc_feature (1)..(167): Xaa is any amino acid
MQKIQKRDPTSGESANFISFIEKELQPYIEKKYKTNDSKTIIGQSAXGLLATEILIKKMHLFNKYIIISPSLWWDNGSLLNEKSEIYQENFKGHIDIYIGVGKEGLAPTEIPHVMEVDANLLAEKLKSAKSKNVKVYFDYLPQEDHATITHQAIFNALRILYPKTDK

SEQ ID NO: 26125 - DNA, 708 bp, Unknown
  Obtained from environmental sample
  misc_feature (1)..(708): n is a, c, g, or t
ttggtaggtataaataccgccataacttcccaaaccggttcttatgttggttattcttttgctgtaccatctaatattgccaaaaaggtaattgaagacatcattgagtttggtgatgtacagacggcatacttaggaatcagacctgcagatttgaatagtgaggtggctaaagaacttggtttaaatataactgaaggtgttttaatagcaggtatatctgatgatggtgctgctaaaccggctggattgaaagtgaatgatatcattacaagaattgataatgttgaaatttctcaattttctgacctgcaaggttacttaagttctaaacggccaggcgatgtagtgagtgttactgtgctaagaaatggcgggaaaaagcagtttgaagtaagattagccaatcaattcggaaaagagactattggtaaacttgattttacaaagtatcttataggagatcttaagaaaatatctaacgaggatgcaactaaatacagggttaattatggagttgaaatttataaattaagaaacaggaacctaatggaaaatgaagttaaaaatggagatattattcttagaataggcaaggaaaaagtatatgatgtagatgaaattgaaataattctaagacagaataaagggaagaatgttattttacaaatttttactcaggaaggggttgttgatacctcacattga

SEQ ID NO: 26126 - protein, 235 aa, Unknown
  Obtained from environmental sample
  DOMAIN (33)...(122): PDZ domain (Also known as DHR or GLGF)
  misc_feature (1)..(235): Xaa is any amino acid
MVGINTAITSQTGSYVGYSFAVPSNIAKKVIEDIIEFGDVQTAYLGIRPADLNSEVAKELGLNITEGVLIAGISDDGAAKPAGLKVNDIITRIDNVEISQFSDLQGYLSSKRPGDVVSVTVLRNGGKKQFEVRLANQFGKETIGKLDFTKYLIGDLKKISNEDATKYRVNYGVEIYKLRNRNLMENEVKNGDIILRIGKEKVYDVDEIEIILRQNKGKNVILQIFTQEGVVDTSH

SEQ ID NO: 26127 - DNA, 546 bp, Unknown
  Obtained from environmental sample
  misc_feature (1)..(546): n is a, c, g, or t
atgaagcgtaatttagccatactattactaatcttaactactgttttaagctgtaaaacaccggaagctagaaaaccaaagtcggttaactctggctcttttattgaccaatctgttgctagaaataaagcgttaaataaaaaagaaattaaagcaattgaagcactaatagctagtcaaccagaaaatgattacaaaacctcaggcaacggattttggtactactacaatactaaaattgaaactgacagcattgtaaaacctgattttgcagacattgtaaactttaattatgacgtaaaagatttagatggacaaaccatttatactcaagcagaattaaaaactcaaagttacgcaatggaccaacaagaactttttacaggtttacgtgaaggtctaaaactaatgcaagcaggagaaacggtaacctttttgtttccatcacacaaggcttatggctattatggagacgaaaataaaataggtactaacattccattagtttgtaaagtaaccgttaattcaataacaaaaaacgactag

SEQ ID NO: 26128 - protein, 181 aa, Unknown
  Obtained from environmental sample
  SIGNAL (1)...(17)
  DOMAIN (82)...(175): FKBP-type peptidyl-prolyl cis-trans isomerase
  misc_feature (1)..(181): Xaa is any amino acid
MKRNLAILLLILTTVLSCKTPEARKPKSVNSGSFIDQSVARNKALNKKEIKAIEALIASQPENDYKTSGNGFWYYYNTKIETDSIVKPDFADIVNFNYDVKDLDGQTIYTQAELKTQSYAMDQQELFTGLREGLKLMQAGETVTFLFPSHKAYGYYGDENKIGTNIPLVCKVTVNSITKND

SEQ ID NO: 26129 - DNA, 879 bp, Unknown
  Obtained from environmental sample
  misc_feature (1)..(879): n is a, c, g, or t
gtggttatggaaactgcaactggcgaaattaaagcgatttctaatttagggagaacatcaaaaggaaaatattttgagaaaagaaactatgcagtttgggaaagtcatgaacctggttctacttttaaattagcaagtttaatggctgttttagatgataaatatattgatacatctacagttgtagatacagaaaaaggtagaatttatgtaaacaatagaaaagttgaagattcaaaacatggtggttatggagaaatttctgcagcaagagtttttgaggtttcatcgaatgttggtattgtaaagttgattaaaaaatattacgatcatcaaccagaaaagtttatagaaaaaatagaaaaatacggatttacaaaaccaattggttttcaaattaaaggcgaaggaaaaccttatataccaaaaccatcagacaaagcttggagtaaaatttctttagagtggatggcttggggttatggaatttctgtaacaccaatgcaaactttaatgttttacaatgcagttgccaataatggagttatggtaaaacctcgttttgtaaaagagttaagaagagaagataaagcagaaaaagtttttgaaacagaggttataaacccaagaattgcatcacaagaaaccattaataaaattagaaaagtgatggaaaatgtggtgataaaaggatcagcagatggaatttattcgcctaatttttcgatggctggtaaaacaggaactgctaaaaaatacttccaagagtcaccataccattgcgaatgcgaaggtgggtcctattcaattgaaagattgttgcttctttgcggattttcccacagaaaacctaattatctggcattgtttagtgcttga

SEQ ID NO: 26130 - protein, 292 aa, Unknown
  Obtained from environmental sample
  DOMAIN (1)...(278): Penicillin binding protein transpeptidase domain
  misc_feature (1)..(292): Xaa is any amino acid
MVMETATGEIKAISNLGRTSKGKYFEKRNYAVWESHEPGSTFKLASLMAVLDDKYIDTSTVVDTEKGRIYVNNRKVEDSKHGGYGEISAARVFEVSSNVGIVKLIKKYYDHQPEKFIEKIEKYGFTKPIGFQIKGEGKPYIPKPSDKAWSKISLEWMAWGYGISVTPMQTLMFYNAVANNGVMVKPRFVKELRREDKAEKVFETEVINPRIASQETINKIRKVMENVVIKGSADGIYSPNFSMAGKTGTAKKYFQESPYHCECEGGSYSIERLLLLCGFSHRKPNYLALFSA

SEQ ID NO: 26131 - DNA, 696 bp, Unknown
  Obtained from environmental sample
  misc_feature (1)..(696): n is a, c, g, or t
atgattcccttcttccgtaaaatccgcaaaaaacttgctgacgataacaagcctttaaaatatctgaggtatgccattggtgagattgtattggtggtcattggaattttaattgctcttcagattaatgaatatagaaccaatagggatgttcaatctgaggaaattgaatttataaagtttgtaaaacaggacttgcataaagatttagagaatctaaaagaagcatcagtttttaagaaaatgcaatttgataactgtaaagagattattgaatattacaaacatagtgccgagtcggttcaggatacattagattttgtagataagatagtctcaaccttttatttgaagaatgataaccctagcaacactgcatttgaaactgcaaaactttcaggagggatacaaaaatataaaaacaagactttgatgaatttattgtctacttattattctgacaacgaattgcaactacatttgatagagaccagaaggtatacaaactcttacgccgaaaatttttctttactaaatatggcgggttggaaaaagtatctattagacggagggatcagtccgaattctgacctctctgagagatccagggcggtaccagaatggctgcgattcttgaagatccgatggagatacttcaggttgatacagttgcattgtccacccctggtaaaataa

SEQ ID NO: 26132 - protein, 231 aa, Unknown
  Obtained from environmental sample
  misc_feature (1)..(231): Xaa is any amino acid
MIPFFRKIRKKLADDNKPLKYLRYAIGEIVLVVIGILIALQINEYRTNRDVQSEEIEFIKFVKQDLHKDLENLKEASVFKKMQFDNCKEIIEYYKHSAESVQDTLDFVDKIVSTFYLKNDNPSNTAFETAKLSGGIQKYKNKTLMNLLSTYYSDNELQLHLIETRRYTNSYAENFSLLNMAGWKKYLLDGGISPNSDLSERSRAVPEWLRFLKIRWRYFRLIQLHCPPLVK

SEQ ID NO: 26133 - DNA, 528 bp, Unknown
  Obtained from environmental sample
  misc_feature (1)..(528): n is a, c, g, or t
ttgcccatgaagaatgctagttttctaatagtcctgctgcttttttttagtgcttgtaaagaagacaatcaaatagaaaatgaaatttctaaaattgatgttgcggttactatagaacgttttgatttggcctttgccaatgctgagccaaaagaattgcccaaattaaaaaaaagctatccatttttgttttctgaacgcattcccgattctgtttgggtggagcgcatgaatgactctttgcagcaagaattggaggccgaagtaaaatcgacgttttctaatttcaataaagaagaggaagccatcgcgtctctttttcaacatttaaaatattacgataagagctttacagtgccacgtgttattacagtaaactctgatgtagattaccgtaacaagacgattgtgaccgatacgattgtgtcgatttccttagacnactatttgggagtagaccatcattttaatgagggcatccaaaagttcctgacccaaaatatgaaaccgtcgcaaattgtgacttga

SEQ ID NO: 26134 - protein, 175 aa, Unknown
  Obtained from environmental sample
  SIGNAL (1)...(20)
  misc_feature (1)..(175): Xaa is any amino acid
MPMKNASFLIVLLLFFSACKEDNQIENEISKIDVAVTIERFDLAFANAEPKELPKLKKSYPFLFSERIPDSVWVERMNDSLQQELEAEVKSTFSNFNKEEEAIASLFQHLKYYDKSFTVPRVITVNSDVDYRNKTIVTDTIVSISLDXYLGVDHHFNEGIQKFLTQNMKPSQIVT

SEQ ID NO: 26135 - DNA, 840 bp, Unknown
  Obtained from environmental sample
  misc_feature (1)..(840): n is a, c, g, or t
gtggacagaggagaaccgaatttatttccttatgaaggagattacgaaaatatgcggattaaagttttgggtgaaactccagaaggttataaaacccgaattattaaagatccagtaacagatactttatattactggtataagccaaaatttgaaattgacaccacattctttatcgttaccaatgaaaaatatatagacacctttaaacatcgctttagagcgataaaagcagattctttaaaaatgacggctttaacaaaaggaactttaaattatgatgacgagtttacaattgaaggtaatattccattaacccaaattgatactacaaaaattaaattaatggataaggattcgctttctgtacattataaggtaaaatacgactccatttttaataagtacgaattcccaattgataaaaaagaaggacagacatacaagtttacaatgcttccaggtacatttactgatttctacgaaggcaccaataaagacactttaaattattcggttaaaaccaaattgaaatctgaatatggtaatattaggattaaccttagaaacgctaagcttccattaatcattcaattagttgataacaaaggtgttgttttatatgagcgctatgctaaagactcacctgttgtcgattttacaaacctagaaccaaaacaatatagtctacgtgctatttttgacactaatgaaaacggaaaatacgatacagggaattaccttttaggtattcagccagaacgtgttagttattctcccagcattgatgcaattcgagcaagttttgacttcgntattgattttacgcttttagattaa

SEQ ID NO: 26136 - protein, 279 aa, Unknown
  Obtained from environmental sample
  misc_feature (1)..(279): Xaa is any amino acid
MDRGEPNLFPYEGDYENMRIKVLGETPEGYKTRIIKDPVTDTLYYWYKPKFEIDTTFFIVTNEKYIDTFKHRFRAIKADSLKMTALTKGTLNYDDEFTIEGNIPLTQIDTTKIKLMDKDSLSVHYKVKYDSIFNKYEFPIDKKEGQTYKFTMLPGTFTDFYEGTNKDTLNYSVKTKLKSEYGNIRINLRNAKLPLIIQLVDNKGVVLYERYAKDSPVVDFTNLEPKQYSLRAIFDTNENGKYDTGNYLLGIQPERVSYSPSIDAIRASFDFXIDFTLLD

SEQ ID NO: 26137 - DNA, 429 bp, Unknown
  Obtained from environmental sample
  misc_feature (1)..(429): n is a, c, g, or t
ttggataaaaaagtaaatatagaagctccagcgccaaaaaaaagaaaataccgttttgtacgacgtacgctacgcgtgttcttagctctctttatattcctttttctattaattttatttattagaagtccttggggccaaagcctcattgtcgacaaagccgtacaatatgtttcgaacaaaacacagactaaagtcgctatcgataaactcttcatcacttttggcggtaacattcaactcgacggattatttttagaagacacaaaaggcgacacgttagtatactccaaatctttagaagcaaatgtaccgttggtttcaatgattactggtggcgctattggtatagaccgcttacatttggaaggctgcgccctaatatattcgaaaagattctattcttgctaccatttcacgtttaattga

SEQ ID NO: 26138 - protein, 142 aa, Unknown
  Obtained from environmental sample
  misc_feature (1)..(142): Xaa is any amino acid
MDKKVNIEAPAPKKRKYRFVRRTLRVFLALFIFLFLLILFIRSPWGQSLIVDKAVQYVSNKTQTKVAIDKLFITFGGNIQLDGLFLEDTKGDTLVYSKSLEANVPLVSMITGGAIGIDRLHLEGCALIYSKRFYSCYHFTFN

SEQ ID NO: 26139 - DNA, 798 bp, Unknown
  Obtained from environmental sample
  misc_feature (1)..(798): n is a, c, g, or t
atgaatgttattggaatatatattggttggcgtggtgaggaatccaagtctcctataaaaagccttttatccttagaaagaagggcgggcattgctgatacgattgccattggtaaaaacaaagaactaaaaaatgatattgctgctctagtagcgaatgtccagaataatcctcattcaggacattcgcttattattgggcattctcttggtgggagacttttgtcccgagcatttatggaagatttggagcagaccaagtctgtcaaagactggcctttagggagccgttcactgctagttactttaaattcagcaataagttcaaatgcatttaatcgaatatatgaagatatgccaggctctaagcctaaacctgacgtaaagctgcaaagacctctttggataaactttacttctaaagacgacattgccatatcagagtatatcggattagctactaaacttggaatggatatattccaagaacctggtgaggtaaaaaataatagtgaaaagaaggtaattgggcaatacacaccgtatatttctcatgaagttactgttgatagtgttagacctcactatataaaacctgaatgtgagtttatacaaggaccaaatggtcagctaattcctagaggggttgaaccttggttcaagatacctttatgggatcctaatcatggtaatccgaataccgntgataagatgcaagatacttgcgatgaaaccagacataagtatagcaatgaagaatataaacgtcctgatatgacaggctcacaatcatattga

SEQ ID NO: 26140 - protein, 265 aa, Unknown
  Obtained from environmental sample
  misc_feature (1)..(265): Xaa is any amino acid
MNVIGIYIGWRGEESKSPIKSLLSLERRAGIADTIAIGKNKELKNDIAALVANVQNNPHSGHSLIIGHSLGGRLLSRAFMEDLEQTKSVKDWPLGSRSLLVTLNSAISSNAFNRIYEDMPGSKPKPDVKLQRPLWINFTSKDDIAISEYIGLATKLGMDIFQEPGEVKNNSEKKVIGQYTPYISHEVTVDSVRPHYIKPECEFIQGPNGQLIPRGVEPWFKIPLWDPNHGNPNTXDKMQDTCDETRHKYSNEEYKRPDMTGSQSY

SEQ ID NO: 26141 - DNA, 615 bp, Unknown
  Obtained from environmental sample
  misc_feature (1)..(615): n is a, c, g, or t
gtggatcaagaatcggctcgagacgtcagtgagatcnatatcttcgatgaagactatctagctaagcttgaagtgattaagcagcccaataccaagttagagttactgcaacaactactggctaaagccattggtgagctgaaaaaaaccaataaggtcaaaggcgttgatttcagtaagaagatgaatgcgcttgtagagaagtataacgaccgtgacgagcaagacatactgcgcgctgaagtcattggtgatttctccgatgaaatcatcaagctgtataacgagctacgggttgagatggcatcgtttggtgagatgggcatcgactttgaagaaaaagcgttttatgacatcttactgtcactggctcataagtacgactttacctatcccgaagacaagctgcttgagctgtcaaaagaagtgaaaaaactgatagatgacaaggcaaggtataccgactggaataagcgcgatgatatcaaagcggaactacagtttgatttgatgatactacttgatgaatggggctatccacctgttgactcaaaagaggtatacaaagagatatttgagcaggctgagaattttaagaagaatagggtggtttag

SEQ ID NO: 26142 - protein, 204 aa, Unknown
  Obtained from environmental sample
  misc_feature (1)..(204): Xaa is any amino acid
MDQESARDVSEIXIFDEDYLAKLEVIKQPNTKLELLQQLLAKAIGELKKTNKVKGVDFSKKMNALVEKYNDRDEQDILRAEVIGDFSDEIIKLYNELRVEMASFGEMGIDFEEKAFYDILLSLAHKYDFTYPEDKLLELSKEVKKLIDDKARYTDWNKRDDIKAELQFDLMILLDEWGYPPVDSKEVYKEIFEQAENFKKNRVV

SEQ ID NO: 26143 - DNA, 762 bp, Unknown
  Obtained from environmental sample
  misc_feature (1)..(762): n is a, c, g, or t
atgactatcaatttttcagacttagtgaaaatttatcgtaaagcagatttcgaaaaagtgtctgttggtggattgtatcatatcgaaaataatgaaatgttttcattagttaaaaaattaacttctgatagtaatgttgaatgtactcgtattgaagttctaaagggcaaaattcaaattggagaaactgtagaactagaaattctacagccaaaaacaagtataggatggctttacgatagtgttgatgactttgtcaaaggtgattttattcgcaccttacctcacagtaacaacagtaaaaagccttactatattaaaagtatagattactattctgaagataatgttagccctgatattattactgcctacggctctattcagaatttattgattcgcctcgaaaatatggcagcataccttgatagtgctaatagaaaaattatctttgtaggaaagcaaacatttgaactccattacgatataagcaaaaaccttaatggctttaaattgcttttagaaaattatgccaaggatttagatggtagggtcaaagttataaatgatttttgcgtatggttagatgatggcgacactggtaagcatgttgatgtcaaaaaatctattctagcagtattgctttctgatatacagccccctttaaagaactttgatatcatagatgtagtcgaaaatattgaagttttatatacttctggtcgcgggcaggtcagaattatctcgaagactccagtatga

SEQ ID NO: 26144 - protein, 253 aa, Unknown
  Obtained from environmental sample
  misc_feature (1)..(253): Xaa is any amino acid
MTINFSDLVKIYRKADFEKVSVGGLYHIENNEMFSLVKKLTSDSNVECTRIEVLKGKIQIGETVELEILQPKTSIGWLYDSVDDFVKGDFIRTLPHSNNSKKPYYIKSIDYYSEDNVSPDIITAYGSIQNLLIRLENMAAYLDSANRKIIFVGKQTFELHYDISKNLNGFKLLLENYAKDLDGRVKVINDFCVWLDDGDTGKHVDVKKSILAVLLSDIQPPLKNFDIIDVVENIEVLYTSGRGQVRIISKTPV

SEQ ID NO: 26145 - DNA, 330 bp, Unknown
  Obtained from environmental sample
  misc_feature (1)..(330): n is a, c, g, or t
gtggcttattttattgggaaacagccttggatggttccagcatcaaataactttatagatgttatgattaacgaagctggttttgaaaatggatttaaagcacaaaagcgttatcctgaaattgatatagagagttcggagttaaaagagatagacgccatctttttatctagtgaaccgtttccgtttaaagcagaacatgtattagaatttcagaagaaatttccagaaaagaccgtgaaaattgtagatggtgagctgttttcgtggtatggcagtcggctattaaaatcgtatcagtattttaaaacacttcaccctagcacataa

SEQ ID NO: 26146 - protein, 109 aa, Unknown
  Obtained from environmental sample
  misc_feature (1)..(109): Xaa is any amino acid
MAYFIGKQPWMVPASNNFIDVMINEAGFENGFKAQKRYPEIDIESSELKEIDAIFLSSEPFPFKAEHVLEFQKKFPEKTVKIVDGELFSWYGSRLLKSYQYFKTLHPST

SEQ ID NO: 26147 - DNA, 429 bp, Unknown
  Obtained from environmental sample
  misc_feature (1)..(429): n is a, c, g, or t
atgacagaaattcgtattgaacgcaccacatctactggtcctggtggtcagtcggtaaatacaacgtattcggctattaagttacatcacgaaccaacaggaatgattgtaagttgtcaagatcagaaatcatctcataaaaacttagaaaaagctttaaaggtattacgttcgcgtttatacgatttagaattagcgaagcaacaagccgcagattctgaaaagcgtaaaagtatggtgagttctggtgataggtctgctaagattagaacctacaattatcctcaaggacgagttacggatcatagaattggtttaacgctttacgatttatcaaatatcattaacggtgatattcaaaaaataatagacgaattaatgttagctgaaaacactgagttgttaaaggctaatgatgatgaaatttaa

SEQ ID NO: 26148 - protein, 142 aa, Unknown
  Obtained from environmental sample
  DOMAIN (1)...(103): Peptidyl-tRNA hydrolase domain
  misc_feature (1)..(142): Xaa is any amino acid
MTEIRIERTTSTGPGGQSVNTTYSAIKLHHEPTGMIVSCQDQKSSHKNLEKALKVLRSRLYDLELAKQQAADSEKRKSMVSSGDRSAKIRTYNYPQGRVTDHRIGLTLYDLSNIINGDIQKIIDELMLAENTELLKANDDEI

SEQ ID NO: 26149 - DNA, 579 bp, Unknown
  Obtained from environmental sample
  misc_feature (1)..(579): n is a, c, g, or t
atgaaagtactaacattaaatactgaaacttttgaaaaagagagtctcaaattaatttctaaacttgaagttaatccagatttagttgttggtatattgtcaggaggaggtcatgtgttggaagctatcaaacagcatcccaaagtaattagtagtttatttgaagtagtaaccttacaaagacaatctacaaatgttaaacagcgctttttaaaacctgttttatccatattaccatattctatcttaaattggcttcgtattttagagtctaatagtgtgaaagctaaaatttctaatttaaatttagaaaaattacaagataatactatagcatttgatacaagaaatacaatagcaaaacccataaaaaacattcttattatagatgatgctatagatagtggaaaaaccatgtttgcagttaaaagtaatttgcagcaaaagtttcctaaagcaaaaataaaaatagcagtattagcttggacaattgatagttcaataataaaaccagattattgtttatataataacacattattacgatttccttggtccaatgattataaacgaaaataa

SEQ ID NO: 26150 - protein, 192 aa, Unknown
  Obtained from environmental sample
  misc_feature (1)..(192): Xaa is any amino acid
MKVLTLNTETFEKESLKLISKLEVNPDLVVGILSGGGHVLEAIKQHPKVISSLFEVVTLQRQSTNVKQRFLKPVLSILPYSILNWLRILESNSVKAKISNLNLEKLQDNTIAFDTRNTIAKPIKNILIIDDAIDSGKTMFAVKSNLQQKFPKAKIKIAVLAWTIDSSIIKPDYCLYNNTLLRFPWSNDYKRK

SEQ ID NO: 26151 - DNA, 300 bp, Unknown
  Obtained from environmental sample
  misc_feature (1)..(300): n is a, c, g, or t
gtgactaataaatccgaacaaccgtgtaacattagtttttacaagattaaaaagcagtgtaacattaaagttttttatactataacgcaccaaatatttgataaaaaagtgaaaggtattaacgctatacaacgtaccatccaagtctactacaataacttttttattcgatttattttcgtttataatcattggaccaaggaaatcgtaataatgtgttattatataaacaataatctggttttattattgaactatcaattgtccaagctaatactgctatttttatttttgctttag

SEQ ID NO: 26152 - protein, 99 aa, Unknown
  Obtained from environmental sample
  misc_feature (1)..(99): Xaa is any amino acid
MTNKSEQPCNISFYKIKKQCNIKVFYTITHQIFDKKVKGINAIQRTIQVYYNNFFIRFIFVYNHWTKEIVIMCYYINNNLVLLLNYQLSKLILLFLFLL

SEQ ID NO: 26153 - DNA, 693 bp, Unknown
  Obtained from environmental sample
  misc_feature (1)..(693): n is a, c, g, or t
ttgctgcgccaatggaacatgatactttgcctttttcctttaaaattaggatccatacctccaattgtccacagttaccgtaattttaaggaataccttgccctttccaaaaaattagaacgtaatgatattgttgtatttagctggcccaatgaacacagttgcacaagttttttaattatacgaataggagaatacggaaacctattgaataataaatcgaattatgtaaagcgctgtgtggcaattgcaggagattctttagagatcaaagatggttatatttatattaatggtgagcgaaccaaattacctgatagggctaaacctcaatataagttttatgtaaataccggtggtcaacaattaagtaaatacatgatatccaatagatatcaggttagggatggagaatggggaagaatgcaagatgggaattatataatcaatttaacggatcaggaagctgcgcaactagctaaaaacccaacggttaatgcaataacaaaaatcatagatcctaaaggaactgatggtcaggttttccctaatgtaacttcattaggttggaataaagataattatggaccaatttatattcctgaaaaagggaagtctgttaaacttaataaagaatctttaccgttctacaataaaattattactgatacgaaaagatttaacattgtgtga

SEQ ID NO: 26154 - protein, 230 aa, Unknown
  Obtained from environmental sample
  misc_feature (1)..(230): Xaa is any amino acid
MLRQWNMILCLFPLKLGSIPPIVHSYRNFKEYLALSKKLERNDIVVFSWPNEHSCTSFLIIRIGEYGNLLNNKSNYVKRCVAIAGDSLEIKDGYIYINGERTKLPDRAKPQYKFYVNTGGQQLSKYMISNRYQVRDGEWGRMQDGNYIINLTDQEAAQLAKNPTVNAITKIIDPKGTDGQVFPNVTSLGWNKDNYGPIYIPEKGKSVKLNKESLPFYNKIITDTKRFNIV

SEQ ID NO: 26155 - DNA, 540 bp, Unknown
  Obtained from environmental sample
  misc_feature (1)..(540): n is a, c, g, or t
atgttaagtcaacaggataaggttgatgaagccagagcgaaagaaaaaacacgagtttcaaaagagttacatgatggcgttttgggtagtctctttggagtgcgtctcagtttggatagtattaattttaatgaaggtaaggaggctatgatggcgcgagctaagtatattagtcagcttaaaactattgagcatgatattaggaaaatatcacatgaattaaatactgattttatctctggctcaagttttatggatattattacaacacttattgaatcacaaacgcatgcatataatttagaacacaaatttacatataccgatgatatcaattcggatttagtgtctaacaagatgaaaataaatatttatagaattattcaagagtccatgcagaatatctataaacacgccaatgctaatgttattaccatttgtgtttcattagaaaaaaacttaatttgcttaaatgttgtagacgatggttctgggtttgatatttcaaaaagtaaaaaaggcttggtttacaaaatatga

SEQ ID NO: 26156 - protein, 179 aa, Unknown
  Obtained from environmental sample
  misc_feature (1)..(179): Xaa is any amino acid
MLSQQDKVDEARAKEKTRVSKELHDGVLGSLFGVRLSLDSINFNEGKEAMMARAKYISQLKTIEHDIRKISHELNTDFISGSSFMDIITTLIESQTHAYNLEHKFTYTDDINSDLVSNKMKINIYRIIQESMQNIYKHANANVITICVSLEKNLICLNVVDDGSGFDISKSKKGLVYKI

SEQ ID NO: 26157 - DNA, 549 bp, Unknown
  Obtained from environmental sample
  misc_feature (1)..(549): n is a, c, g, or t
atgcccgactttacaggattcgattttattcaaactttaaaaaatccacccaagataattttaacaacttccgacaaaaattttgctattgaagcctttgaatatgattgtattgtggattatttggtaaaaccattaacattactacgatttataaaagcagtaaacaaagctaaaatttttaaaatagaagctccagaatcagaagggacaacatctcaaattaatgtctcttcagaaaaagaattatttgtaaatattgatagacgcttaataaaaataaatatctcaagtattaaattaatagaggccaaaggagattatattttactaaaaacagatactcaaaattacacagtacattcaacattaaaaaaaattgtagataaacttccagattctcaatttttaaaagtacatcgttcttatgttattaatactagtaaaattatcgatatagaagataatagtgtgttaattgatagagatgttgtacctgtaagtcgctccaacagaccagaactaatgagacgtcttaatttattgtaa

SEQ ID NO: 26158 - protein, 182 aa, Unknown
  Obtained from environmental sample
  DOMAIN (89)...(180): LytTr DNA-binding domain
  misc_feature (1)..(182): Xaa is any amino acid
MPDFTGFDFIQTLKNPPKIILTTSDKNFAIEAFEYDCIVDYLVKPLTLLRFIKAVNKAKIFKIEAPESEGTTSQINVSSEKELFVNIDRRLIKINISSIKLIEAKGDYILLKTDTQNYTVHSTLKKIVDKLPDSQFLKVHRSYVINTSKIIDIEDNSVLIDRDVVPVSRSNRPELMRRLNLL

SEQ ID NO: 26159 - DNA, 426 bp, Unknown
  Obtained from environmental sample
  misc_feature (1)..(426): n is a, c, g, or t
atgtccgacactaatacagaacaaaatatatcacctagagaaaatgcctcagccagcagtattgaggatgacgggtttgttgttcgtgcattaaaaggcgaagagagtgcttataaagatctgatgaccaaatatgatcgtccgatttattttcatgttcgtaaaatgatcaaagagactgagcttgttgaagatctagttcaagaagtttttatgaaagctttcaagaacttacctagctacagtaatgaatatgctttttctacttggttatatagaattgctacaaatcatactattgattacttacgcaaaaagaagcttcaaacactttcgataaacgatccgtataaaantaaagatggtgagctagagattcagttgcctgatgagacttatgctaccgataaagaagtaattcgttaa

SEQ ID NO: 26160 - protein, 141 aa, Unknown
  Obtained from environmental sample
  DOMAIN (41)...(109): Sigma-70 region 2
  misc_feature (1)..(141): Xaa is any amino acid
MSDTNTEQNISPRENASASSIEDDGFVVRALKGEESAYKDLMTKYDRPIYFHVRKMIKETELVEDLVQEVFMKAFKNLPSYSNEYAFSTWLYRIATNHTIDYLRKKKLQTLSINDPYKXKDGELEIQLPDETYATDKEVIR

SEQ ID NO: 26161 - DNA, 309 bp, Unknown
  Obtained from environmental sample
  misc_feature (1)..(309): n is a, c, g, or t
ttggaatatgttttctctgacgctgtacataaggtttcatcgaaaaagaaacaaaaaattgctgttttaagaggaaatggagaacttgataatatatatttggcgagttttttagttcaattaagacaatactataaactagcgcaattcacgttagattcggtaaataataaccctcaaaaaaccttaaaaaaactagaggagtacgatttgaccattattgcaaaacctacagaaaaatttaccgaagaagaaaaatttacgttagatccatatattaccaatggtgggcaaatcattcatggttaa

SEQ ID NO: 26162 - protein, 102 aa, Unknown
  Obtained from environmental sample
  misc_feature (1)..(102): Xaa is any amino acid
MEYVFSDAVHKVSSKKKQKIAVLRGNGELDNIYLASFLVQLRQYYKLAQFTLDSVNNNPQKTLKKLEEYDLTIIAKPTEKFTEEEKFTLDPYITNGGQIIHG

SEQ ID NO: 26163 - DNA, 864 bp, Unknown
  Obtained from environmental sample
  misc_feature (1)..(864): n is a, c, g, or t
atgcaatcctttattgatactgccttagaggctgagatggaagagcatctcggctaccctaaacatgagaaggcagacaagcccaataagcgcaacggccacactaaaaagaccgtccgcagtgacacaggcgatcttgagatatccaccccaagagaccgcggtggcagctttgagcctgtactcgtcagtaagcatcaaacccgtatctcaggtcttgatgacaagatcatattcctttacgccaagggtcaaaccaccaccgagattgtagagagcattaaagagctctacgatgtcgacatctcaagctctcttgtctcaagagtcaccgataacatattagaggacatcaccgcttggcagaacaggccattgaatagtgtttatcctatcgtctatttggactgcatcgtcgtgaagatacgtcaagacaagcagatcatcaacaaagccatttacttagcgctaggcgttaaccttaacggtaaaaaagagctgcttggtatgtggttatcagagaatgaaggcgctaagttctggctgggtgttctcactgaactacaaaaccgcggggtgcaagacatcttaatcgcttgtgtcgacggcttaaagggcttccctgatgccatcaatacggtttatcccaacgctcaggttcagctgtgtatcgtgcatatggtgcgttactccatgaagtttgtaccatggacggataagaaggccgtagcggctgatttaaaggccatctatggcgctgatacgcttgagatggcagaggccaatcttgagcactttgatgaggtgtggggcgagaaataccgcacgtggttaagtcttggcgcaataactgggagggcttaa

SEQ ID NO: 26164 - protein, 287 aa, Unknown
  Obtained from environmental sample
  DOMAIN (1)...(287): Transposase, Mutator family
  misc_feature (1)..(287): Xaa is any amino acid
MQSFIDTALEAEMEEHLGYPKHEKADKPNKRNGHTKKTVRSDTGDLEISTPRDRGGSFEPVLVSKHQTRISGLDDKIIFLYAKGQTTTEIVESIKELYDVDISSSLVSRVTDNILEDITAWQNRPLNSVYPIVYLDCIVVKIRQDKQIINKAIYLALGVNLNGKKELLGMWLSENEGAKFWLGVLTELQNRGVQDILIACVDGLKGFPDAINTVYPNAQVQLCIVHMVRYSMKFVPWTDKKAVAADLKAIYGADTLEMAEANLEHFDEVWGEKYRTWLSLGAITGRA

SEQ ID NO: 26165 - DNA, 519 bp, Unknown
  Obtained from environmental sample
  misc_feature (1)..(519): n is a, c, g, or t
ttgaataacgcccatgcaattgccgatacgccaattgttaatgattataaagccctcgataagtattatccggatgcaaaatttatttatttagagcgtgagcttaacgtatggctaccatcaataaagcaattattattacgtatgcatactaatttaacacgcactgatgggggctttaatattcatctaaagcattgttatttaaatatatttagtaatttaacaattgataatataaacgatgatagttacttaacgcattgttataacacgcatatcaatgacgctaaaaattattttaaacaccaagagcaacgctttttatcaataaatatagcaaaaccgcaaagctacaaaatgctctgtgattttttagcgattaaaagtaataaaacagattttgaaaaaatgaatatgggcggcaaagttactgcctggaacgatataaaacatccgctaaaagttgaatcaacagcaaaagggcgcatagataaactgttacgctacaaggtttaa

SEQ ID NO: 26166 - protein, 172 aa, Unknown
  Obtained from environmental sample
  misc_feature (1)..(172): Xaa is any amino acid
MNNAHAIADTPIVNDYKALDKYYPDAKFIYLERELNVWLPSIKQLLLRMHTNLTRTDGGFNIHLKHCYLNIFSNLTIDNINDDSYLTHCYNTHINDAKNYFKHQEQRFLSINIAKPQSYKMLCDFLAIKSNKTDFEKMNMGGKVTAWNDIKHPLKVESTAKGRIDKLLRYKV

SEQ ID NO: 26167 - DNA, 579 bp, Unknown
  Obtained from environmental sample
  misc_feature (1)..(579): n is a, c, g, or t
atgtatcatatgaatgctatacgcatttcgcctatacctaattttagattccctaaagaagtaaagaatgctattattactagccaaaacacttggaaggtaataaaagataaggttagtattgaaaatgcatatgtggtaggtaaaaaaacctcacagttattaagagaaaacaatattaatattattgaatctcaagattacggtaaagatttagctcataaaatatgcgaatcccataataatgaagagttttatttcttctgcggaaaaaagagaaggaatgaaattcctcaaaaactaaaagaaaataatatttcctttacagaaatacaggtatatgataccttagaaaatcataaagaatttaaacaagaatttgatggcgtcttgttttttagtccgagtgctgtaaaaagctttttcgctgtaaatactttaaaatctgcaattgcattttgtataggtactaccacagctaaagaattagaaaaacacacgaatcatatcataattgcgaaccaacccactatagaaaatgtcatcgtgcaagtggtaaaaaaatataaaaatgattaa

SEQ ID NO: 26168 - protein, 192 aa, Unknown
  Obtained from environmental sample
  DOMAIN (2)...(184): Uroporphyrinogen-III synthase HemD
  misc_feature (1)..(192): Xaa is any amino acid
MYHMNAIRISPIPNFRFPKEVKNAIITSQNTWKVIKDKVSIENAYVVGKKTSQLLRENNINIIESQDYGKDLAHKICESHNNEEFYFFCGKKRRNEIPQKLKENNISFTEIQVYDTLENHKEFKQEFDGVLFFSPSAVKSFFAVNTLKSAIAFCIGTTTAKELEKHTNHIIIANQPTIENVIVQVVKKYKND

SEQ ID NO: 26169 - DNA, 360 bp, Unknown
  Obtained from environmental sample
  misc_feature (1)..(360): n is a, c, g, or t
gtgttcagagttgttttaattataaaaaacatggtttctacaactatcttcattgtttttctatccttttatttgttttacaatacatctaaaaaagtaaaatacaattctaaaaaaacagaaaactggataaatgaaaacattcaattaacaaaaataatagcagctatattattaattatttcaataatactaaacatctatctatttggttttggagcaggaagcttactgtttattatcgtttttatgacaataggaagcttaataatcatattaactccattaaaactaatccgctataaaagtgttcttctactatttataacctcacttttatttgaacttttcatcttttaa

SEQ ID NO: 26170 - protein, 119 aa, Unknown
  Obtained from environmental sample
  misc_feature (1)..(119): Xaa is any amino acid
MFRVVLIIKNMVSTTIFIVFLSFYLFYNTSKKVKYNSKKTENWINENIQLTKIIAAILLIISIILNIYLFGFGAGSLLFIIVFMTIGSLIIILTPLKLIRYKSVLLLFITSLLFELFIF

SEQ ID NO: 26171 - DNA, 303 bp, Unknown
  Obtained from environmental sample
  misc_feature (1)..(303): n is a, c, g, or t
atgcttaaaaagcttaaaaatcagtttaaattatttctgttgaaaaagaaactcaataaaaataaagttttttttaatgaaaatgattttaaattctccgataaaaacgtattaattatagatgaaattattcctgaatttaataaagattctgggtcaagacgcttaactgaaattataaaactattactaaaaaataaagtatcagtatttttagtagcagatttaaaacaatataagtacaagagtgattacattcaaaaatttaaagatatagtgttgatgtatatcaaccagtattga

SEQ ID NO: 26172 - protein, 100 aa, Unknown
  Obtained from environmental sample
  misc_feature (1)..(100): Xaa is any amino acid
MLKKLKNQFKLFLLKKKLNKNKVFFNENDFKFSDKNVLIIDEIIPEFNKDSGSRRLTEIIKLLLKNKVSVFLVADLKQYKYKSDYIQKFKDIVLMYINQY

SEQ ID NO: 26173 - DNA, 351 bp, Unknown
  Obtained from environmental sample
  misc_feature (1)..(351): n is a, c, g, or t
atgcatggttgtattctggcagaagcactaagagtcccctggggaaagaactttcgttttaatgctcatttatttgaaggagaaaaaggtctcttgaatttaaatgggaatgattggttattgtctatagggattaaaaaaaatgtttttattgaagcaccaatgcccaaacgacaaaaattaaataagatttttaaatcggcttataaaaaagaaacggaaaactatttattaaataaattaaaattacatgatgtagtagattttaacttgtcgtctgaaaaaacaatggaagacatgaagattaaaatggaaaaagaagtggataattttataaatgaatacttgtag

SEQ ID NO: 26174 - protein, 116 aa, Unknown
  Obtained from environmental sample
  misc_feature (1)..(116): Xaa is any amino acid
MHGCILAEALRVPWGKNFRFNAHLFEGEKGLLNLNGNDWLLSIGIKKNVFIEAPMPKRQKLNKIFKSAYKKETENYLLNKLKLHDVVDFNLSSEKTMEDMKIKMEKEVDNFINEYL

SEQ ID NO: 26175 - DNA, 369 bp, Unknown
  Obtained from environmental sample
  misc_feature (1)..(369): n is a, c, g, or t
ttggctgataataataaagaggtggtaattacctcaacgctttatagttcagataaacggatcactcgcgttaatggccttattcaacctagcgatataatagcgaccgctgttgggcagtatttaaactgcaacgctattgctgagcaaactatgcttggtgttaacttacaccagaaaaaagataatatgggtgttaattattctcaaggcgtggttatagcgtataaaaaggatagaattaccttaattgatcctgatggcgactttaaaaatatttctgccgccgaaggattttctattgagcaaggcttagacattccatttttagttcacagtatcaaaaagttaaaaacctttactcaataa

SEQ ID NO: 26176 - protein, 122 aa, Unknown
  Obtained from environmental sample
  misc_feature (1)..(122): Xaa is any amino acid
MADNNKEVVITSTLYSSDKRITRVNGLIQPSDIIATAVGQYLNCNAIAEQTMLGVNLHQKKDNMGVNYSQGVVIAYKKDRITLIDPDGDFKNISAAEGFSIEQGLDIPFLVHSIKKLKTFTQ

SEQ ID NO: 26177 - DNA, 351 bp, Unknown
  Obtained from environmental sample
  misc_feature (1)..(351): n is a, c, g, or t
ttggtaaatgtaccaattggtccacatacaataactgtaatagatttaaatggatgtaactcaacaancaaagaggtagttataatagatgtaccaaaatttgttacacctaatggtgatggctattttgattattggcatattactggtgtaaaccaacttaaaggtactgtggttaatatttacgatcgttatggtaaattactaaaaacattaacacatgcttctcttggatgggatggcagatataatggcaacttaatgcctgcaagtgattattggtacgttgcagacataaaaaaaggcgctatagcgtttcagaacaaaggacattttacacttaagctttaa

SEQ ID NO: 26178 - protein, 116 aa, Unknown
  Obtained from environmental sample
  misc_feature (1)..(116): Xaa is any amino acid
MVNVPIGPHTITVIDLNGCNSTXKEVVIIDVPKFVTPNGDGYFDYWHITGVNQLKGTVVNIYDRYGKLLKTLTHASLGWDGRYNGNLMPASDYWYVADIKKGAIAFQNKGHFTLKL

SEQ ID NO: 26179 - DNA, 450 bp, Unknown
  Obtained from environmental sample
  misc_feature (1)..(450): n is a, c, g, or t
gtgacaataaaatcaataaaagattgcgacactttagacgaagttgcaactaaacaaaaacacttgattttcaattgcaacataggtaaagatttggaggattataataagaaagtactttctaaaatattgaaacgttttgataaaaattttttgaatagaagaattggttcagagcatttcaataattttgatattttcgtgtcaattgtatcaagagtactatgcccttccaatatttatatattacagcatactgaaaaatctgaaactctcgatgatttatttgaaatgttaaaagaagttgcttatccagataaaacaataaagtttattaaaaacaaagagataaaaaaacatttcagagaaaagaaaaagcataggaatgaaattcaaaccaaattaaacaatctcaagaaaaatgactcaaaagatgacttacctttttaa

SEQ ID NO: 26180 - protein, 149 aa, Unknown
  Obtained from environmental sample
  misc_feature (1)..(149): Xaa is any amino acid
MTIKSIKDCDTLDEVATKQKHLIFNCNIGKDLEDYNKKVLSKILKRFDKNFLNRRIGSEHFNNFDIFVSIVSRVLCPSNIYILQHTEKSETLDDLFEMLKEVAYPDKTIKFIKNKEIKKHFREKKKHRNEIQTKLNNLKKNDSKDDLPF

SEQ ID NO: 26181 - DNA, 609 bp, Unknown
  Obtained from environmental sample
  misc_feature (1)..(609): n is a, c, g, or t
atgcgtattgaattggcaaaacttttattacaaaataatgatattttactgttagatgagccaacaaaccacttagatattgaatctattatttggttagagaactttttaaagaattattcaggagcaattgtattggtttctcacgataaaatgttcttagataatgtaactaacagaactatcgagatttctttagggcagatttacgattataaaaaaccttattctcaattcttattattaagaggagaaattaaagaaaagcaattacaagcacagaaaaaccaagagaaagaaataaagcaaaagcaagacttaattaataagtttaaagcaaaagcaagtaaagcatctatggcacaatctttaatgaaacagcttgataaagttgagttgattgaagtagatcaagatgataatcaggccatgaatgtgcgttttgcaatttctaaagagccaggtaaaattattgtggaagcagaaaatctatctaaaagttatggtgataaacatgttttacatggtgtagatttattaattgcaagaaactctaaaattgctttggtcgggcaaaatggacagggaaaatctactttaacaaactga

SEQ ID NO: 26182 - protein, 202 aa, Unknown
  Obtained from environmental sample
  misc_feature (1)..(202): Xaa is any amino acid
MRIELAKLLLQNNDILLLDEPTNHLDIESIIWLENFLKNYSGAIVLVSHDKMFLDNVTNRTIEISLGQIYDYKKPYSQFLLLRGEIKEKQLQAQKNQEKEIKQKQDLINKFKAKASKASMAQSLMKQLDKVELIEVDQDDNQAMNVRFAISKEPGKIIVEAENLSKSYGDKHVLHGVDLLIARNSKIALVGQNGQGKSTLTN

SEQ ID NO: 26183 - DNA, 801 bp, Unknown
  Obtained from environmental sample
  misc_feature (1)..(801): n is a, c, g, or t
ttggcaaccgttttagagccagtcgagggcgaccaaatatgtgacccgtgtacaggcagtggctcactgctacttaaatgtggcgctatggtgcgcaaaaactctggctctaaaaaatacgctttatttgggcaagaagcgataggttcaacatgggcactcgccaaaatgaacatgttcctacacggtgaagacaaccaccgcattgaatggggcgacaccattcgtaacccactgctacttgataaagacggcaacggcttattgcactttgatgtcgtaaccgccaacccgccgtttagtttggataagtgggggcatgatgatgccagcaacgacccttatgggcgctttagacgtggtattccaccaaaaaccaaaggcgactatgcgtttatcagccacatgattgaaacgctaaaacccgaaacaggtcgcatgggtgtggtcgtgccgcatggtgtgttatttagagcatcaagcgaaggcaaaatccgccaacaactaattgaagaaaacttgctcgataccgtgattggtttaccagaaaagttgttctttggcacaggtattccagccgccatcttgatattcaaaaaacacaagaccgacaaaaacgtattgtttattaatgccagtcgtgagtttaagtcaggccaaaaccaaaaccagttaacggcagacaacattccaaaagttatcgacacctacaaggctcgtgaaagcgttgataaatacggctacctagccagtgttgatgagcatcaagagaacgactttaacctaaacatccctcgttaa

SEQ ID NO: 26184 - protein, 266 aa, Unknown
  Obtained from environmental sample
  DOMAIN (103)...(261): N-6 DNA Methylase
  misc_feature (1)..(266): Xaa is any amino acid
MATVLEPVEGDQICDPCTGSGSLLLKCGAMVRKNSGSKKYALFGQEAIGSTWALAKMNMFLHGEDNHRIEWGDTIRNPLLLDKDGNGLLHFDVVTANPPFSLDKWGHDDASNDPYGRFRRGIPPKTKGDYAFISHMIETLKPETGRMGVVVPHGVLFRASSEGKIRQQLIEENLLDTVIGLPEKLFFGTGIPAAILIFKKHKTDKNVLFINASREFKSGQNQNQLTADNIPKVIDTYKARESVDKYGYLASVDEHQENDFNLNIPR

SEQ ID NO: 26185 - DNA, 441 bp, Unknown
  Obtained from environmental sample
  misc_feature (1)..(441): n is a, c, g, or t
atggcaaaaggatttaaattcaaaaaaaagcacaaaaataagtggaaacgctatgctgggattgttcacctttggctaggattaatatcaggaatagtagtttttattatggctattactgggtgtatctttgtttttcaagatgagattaaggatgtcgtttttgattggcgccatatagagccacaaaataaatcattcgtagctccttctataattctagataacgtacagaaaagattcaaggatagtgaagccaatatggtggtgtatcaaaataaaatcagaccagcaactgtatctgtaatactagataatatatcttatgatatatttttaaatccatatactggagaaatcactcatttacaaaacctcgatagtgatttttttataacagtggaaactttactcgttttcttctccttccagaacctatag

SEQ ID NO: 26186 - protein, 146 aa, Unknown
  Obtained from environmental sample
  misc_feature (1)..(146): Xaa is any amino acid
MAKGFKFKKKHKNKWKRYAGIVHLWLGLISGIVVFIMAITGCIFVFQDEIKDVVFDWRHIEPQNKSFVAPSIILDNVQKRFKDSEANMVVYQNKIRPATVSVILDNISYDIFLNPYTGEITHLQNLDSDFFITVETLLVFFSFQNL

SEQ ID NO: 26187 - DNA, 453 bp, Unknown
  Obtained from environmental sample
  misc_feature (1)..(453): n is a, c, g, or t
ttgatttttcttgtaatgcttatcacaggattaatattatggtggccaaaaaaatggaaaaaggcctcacaaaatttcaaaataaagtggaagactaaatggcgccgtaaaaattacgattggcatcgagtaactggtttttatttaattttaccggccatagttattgtaataacaggattgagtttttcttacgagtgggttcacgacggtttatttgttattggtaatattgcaaatgatgaaaaattaagttcggctgcaccacttttgaaaaaaaatgacagtttaactagttcatcggcaatagatttggctttncatagaactcaagagttagcgcccgaaagcggtatgtattttgtgtgggatcaaagaaaaggattacctattcttactggtgcctatccagagtctttggaattccgaccaccagtcaaacttttattttga

SEQ ID NO: 26188 - protein, 150 aa, Unknown
  Obtained from environmental sample
  misc_feature (1)..(150): Xaa is any amino acid
MIFLVMLITGLILWWPKKWKKASQNFKIKWKTKWRRKNYDWHRVTGFYLILPAIVIVITGLSFSYEWVHDGLFVIGNIANDEKLSSAAPLLKKNDSLTSSSAIDLAXHRTQELAPESGMYFVWDQRKGLPILTGAYPESLEFRPPVKLLF

SEQ ID NO: 26189 - DNA, 738 bp, Unknown
  Obtained from environmental sample
  misc_feature (1)..(738): n is a, c, g, or t
atgcgaaatggacgaaaaaagcagccttcangttattttgaatttaaaatagatagtattaatcgattagttgaagattctgaaatcttaattaaatggaatggcgaagctattaaagcagacaattctggagaaaacactttttctattcctggaaaaaacaacttcaaaatcatgtctgtaaacgttattcagacaccagaacaatatttgtcaattaacttttctgacccaattaaaaaacagcaaaattttgatggtttagtcactatccaaaatagcaaaaaccctaaatttatagtaaacggaaacgtgttaaaagcctatcctgaatcaaaaattacaggtaatgtacaagtcgatgtttttcaagggataaaaaacgtagacgactataaactaaaaacaccgtttagtgaaactatcgcttttgaagacgttaaacctcaagttaaactaattaatagtggtgtaatactacctaactcacaagagttaaaattcaattttgaagctgtaaacttaagcgctgtagatgttagagtaatcaagatttttgaagataatattttgcaatttttacaagacaatactcttgaaagtaataatcaaaaccaaataagacgtgttggtcgtcgtattgctaaacacaccattaaactaattgaaaaccctatagaaaatgatggaaaatggaaaacctatagcattgacttatccaaatacatcaaatcagan

SEQ ID NO: 26190 - protein, 246 aa, Unknown
  Obtained from environmental sample
  misc_feature (1)..(246): Xaa is any amino acid
MRNGRKKQPSXYFEFKIDSINRLVEDSEILIKWNGEAIKADNSGENTFSIPGKNNFKIMSVNVIQTPEQYLSINFSDPIKKQQNFDGLVTIQNSKNPKFIVNGNVLKAYPESKITGNVQVDVFQGIKNVDDYKLKTPFSETIAFEDVKPQVKLINSGVILPNSQELKFNFEAVNLSAVDVRVIKIFEDNILQFLQDNTLESNNQNQIRRVGRRIAKHTIKLIENPIENDGKWKTYSIDLSKYIKSX

SEQ ID NO: 26191 - DNA, 684 bp, Unknown
  Obtained from environmental sample
  misc_feature (1)..(684): n is a, c, g, or t
ttgccagttttacatcaaattgatgcagattcgccttatattcaagctttaatattgtcgccaacaagagaattggtgcaacaaataaaaaagcaactctttaaatttacaaaatatgttgatgaaaaaatctttttagaagctgtttttggtggcgaaaagattgatagacaaattggtaatttaaaaagaacaacgcatattgttgttgcaactccaggaagattaatcgatttaattgaacgtggagatattgatattagccatgtaaatacagttattttagatgaagctgatgagatgttgagcatgggttttaaacaagatttgaatagaatcttaaaatttaccactaaaaacgacagaaaaacttggttattttctgctacaatgccagaagaaattaagaaaatcgtaaaaacgtatatggatgcaaatgcaccaagagtggaaattaatccgaactctttggtgaatgaaaatattcgtcatcaatatataaaaactacgattaaagaaaaaacgggtttaattattaagtttatcgaaaaaagaggcgcacaaagaggtattattttttgtagaaccaaagctggagcgcaaaatttagcacatcaattaatagaagaaggtttttctgctgctgctttagaaggagatatgcaacaaaaagagcgtgantaa

SEQ ID NO: 26192 - protein, 227 aa, Unknown
  Obtained from environmental sample
  DOMAIN (1)...(138): DEAD/DEAH box helicase
  misc_feature (1)..(227): Xaa is any amino acid
MPVLHQIDADSPYIQALILSPTRELVQQIKKQLFKFTKYVDEKIFLEAVFGGEKIDRQIGNLKRTTHIVVATPGRLIDLIERGDIDISHVNTVILDEADEMLSMGFKQDLNRILKFTTKNDRKTWLFSATMPEEIKKIVKTYMDANAPRVEINPNSLVNENIRHQYIKTTIKEKTGLIIKFIEKRGAQRGIIFCRTKAGAQNLAHQLIEEGFSAAALEGDMQQKERX

SEQ ID NO: 26193 - DNA, 534 bp, Unknown
  Obtained from environmental sample
  misc_feature (1)..(534): n is a, c, g, or t
atgcaaaatcgttttttaaatttttgttttttgtgcgtgataacgctctcttttataaattgtgctaatagaggaaatatcattggaggagaaaaggatattacacctccaaaaattacaaaaacatttcctaaaaattactctacaaactttaatagcaaagagataagaatctattttgacgagtatattaagattaaaaacctatctaaacagcttattatttcgccaccaatggatatcacgccagagataacaccattaggaagctctagcgactttataaaaattaaaatatttgatactttaaaacccaataccacctatgcttttaattttggtaatagtatagtagacaacaacgaagaaaacccatacacgtattataaatatgtgttttctactggtgattatatagattctttaaaagtaaaaggtaaagtaatggatgcattaaaccgtaccacagacccttttatatctgttaatttatatgacaaggattccacttacacagactctgttgtttattaa

SEQ ID NO: 26194 - protein, 177 aa, Unknown
  Obtained from environmental sample
  misc_feature (1)..(177): Xaa is any amino acid
MQNRFLNFCFLCVITLSFINCANRGNIIGGEKDITPPKITKTFPKNYSTNFNSKEIRIYFDEYIKIKNLSKQLIISPPMDITPEITPLGSSSDFIKIKIFDTLKPNTTYAFNFGNSIVDNNEENPYTYYKYVFSTGDYIDSLKVKGKVMDALNRTTDPFISVNLYDKDSTYTDSVVY

SEQ ID NO: 26195 - DNA, 489 bp, Unknown
  Obtained from environmental sample
  misc_feature (1)..(489): n is a, c, g, or t
atggataaagactctactaatgttgcttttacaaccaagttagacacattacaaaatacaatagaggttttatttgataaaaaagaagacaacaaatacaaagtccgattgctaccaaatactgtaaccgacttttttgacaatactaatgacactttaaactttaacttatctaccgttaaagcatctagcttaggaaacgtacgtgttaatattaaaaatggtgtttaccctttgattgtgcaattagtagatgacaaaaacgaggttaaatacgaaaagtatattaccaaaccagaacccttagatttctttttagttaaacctaacaagtattatataagagccatttttgacaccaacaaaaataaaatatatgatacaggagtctatttaacttctaaaaacccagagcgtgtaagctattctgaaaaacctattgaggttagagttggttgggatttaattgaagaatttattctaaaataa

SEQ ID NO: 26196 - protein, 162 aa, Unknown
  Obtained from environmental sample
  misc_feature (1)..(162): Xaa is any amino acid
MDKDSTNVAFTTKLDTLQNTIEVLFDKKEDNKYKVRLLPNTVTDFFDNTNDTLNFNLSTVKASSLGNVRVNIKNGVYPLIVQLVDDKNEVKYEKYITKPEPLDFFLVKPNKYYIRAIFDTNKNKIYDTGVYLTSKNPERVSYSEKPIEVRVGWDLIEEFILK

SEQ ID NO: 26197 - DNA, 429 bp, Unknown
  Obtained from environmental sample
  misc_feature (1)..(429): n is a, c, g, or t
atgctaaattcttttagatataataaatcaaagagaaatgtaattgaattctttaaagattacgacgctaatctaactattgtagaaaagactggcagtatcttaaaaatagaattctcatcaatttctaaagttgatttaattaaagtttcaaacaaattgataaaaacttttgaaagtaacattgttgatttagaagttgttttttgtgataatctagagatgtcaattgatattaaaattattatagccttaaaaagtaaattaccacttagatacaacttagttgatactggcgtgatatattctaatttaattgagtacaacgttaatcagaagtatggaacaactcatgaagatgaaaagggtggtttaattttagctagtaatattggaaactattatttatataaattaaaagttcaatga

SEQ ID NO: 26198 - protein, 142 aa, Unknown
  Obtained from environmental sample
  misc_feature (1)..(142): Xaa is any amino acid
MLNSFRYNKSKRNVIEFFKDYDANLTIVEKTGSILKIEFSSISKVDLIKVSNKLIKTFESNIVDLEVVFCDNLEMSIDIKIIIALKSKLPLRYNLVDTGVIYSNLIEYNVNQKYGTTHEDEKGGLILASNIGNYYLYKLKVQ

SEQ ID NO: 26199 - DNA, 378 bp, Unknown
  Obtained from environmental sample
  misc_feature (1)..(378): n is a, c, g, or t
atgggtgaattttcaaaaatagaaatcaaaatattagaccgtttaacagaagttgtagatggtagattagaatcaattggctatgacaatagcgaaaaagatagaatgctttattctacctgtattaatgatatagaaaaagacaaattaactaaaaaggaaataaagaaacttcaaaagaagatagctaaatgcaactcaaatattgctggatatatttcagcttttctaaataaatatgaactagaacatcacgacggagatttttatagttaccgagaacgtatttgcaggaatttcataagcaattattatgaaggcattgaacaacttgcagaggaatatctaacagctgaaaaagtagagcagggaaaatga

SEQ ID NO: 26200 - protein, 125 aa, Unknown
  Obtained from environmental sample
  misc_feature (1)..(125): Xaa is any amino acid
MGEFSKIEIKILDRLTEVVDGRLESIGYDNSEKDRMLYSTCINDIEKDKLTKKEIKKLQKKIAKCNSNIAGYISAFLNKYELEHHDGDFYSYRERICRNFISNYYEGIEQLAEEYLTAEKVEQGK

SEQ ID NO: 26201 - DNA, 498 bp, Unknown
  Obtained from environmental sample
  misc_feature (1)..(498): n is a, c, g, or t
atgatgaaattcacgcctgtaccaaagcctggaggatcctatgctggaaacaacagaattgtagaacacgtcgtaccagactttgcaattaaaattgttgatggcgagttagagcttactttaaatggtcgtaatgcgccagaattacatgtttctagagaatatagtaacatgatgaaaggttataaagaaagtaaagataaaagtaagtcgcaaaaggatgcagttatgtttataaaacaaaaactagatgcagccaagtggtttatagatgccatcaaacaacgtcaacaaactttatttgtaacaatgagtagcatcatgcattaccaaaaagaatattttttaactggtgatgagcgcaatctaaaaccaatgatattaaaagatattgctgacgagattgaaatggatgtttcaacagtatcacgtgtggctaatagcaaatacgtagatacaccttacggaactaaagttgataaaagaaattttctctga

SEQ ID NO: 26202 - protein, 165 aa, Unknown
  Obtained from environmental sample
  DOMAIN (76)...(162): Sigma-54, DNA binding domain
  misc_feature (1)..(165): Xaa is any amino acid
MMKFTPVPKPGGSYAGNNRIVEHVVPDFAIKIVDGELELTLNGRNAPELHVSREYSNMMKGYKESKDKSKSQKDAVMFIKQKLDAAKWFIDAIKQRQQTLFVTMSSIMHYQKEYFLTGDERNLKPMILKDIADEIEMDVSTVSRVANSKYVDTPYGTKVDKRNFL

SEQ ID NO: 26203 - DNA, 351 bp, Unknown
  Obtained from environmental sample
  misc_feature (1)..(351): n is a, c, g, or t
atgaatgattttaagagaattgatgagatattaagactgcaaagtacggacagttatccatgtctcatcacaccagaaagtattaaagatattcgaatgctggcatgggctgaggtagtgcaactcgtcaacctaaaaaatagtaatcagcctgacttatttaaggcgcttaagcagaaagcgcccagctcagttatttgtaaattgatgcgcatagatgttttatccgttgagtcgtattgtaaatttgccggtattaaaaaggcagactttgagtatcaacaatgtagaaaagctattcagaacaatgtgataggtattccaaaaaacatggattggctggtgaactaa

SEQ ID NO: 26204 - protein, 116 aa, Unknown
  Obtained from environmental sample
  misc_feature (1)..(116): Xaa is any amino acid
MNDFKRIDEILRLQSTDSYPCLITPESIKDIRMLAWAEVVQLVNLKNSNQPDLFKALKQKAPSSVICKLMRIDVLSVESYCKFAGIKKADFEYQQCRKAIQNNVIGIPKNMDWLVN

SEQ ID NO: 26205 - DNA, 600 bp, Unknown
  Obtained from environmental sample
  misc_feature (1)..(600): n is a, c, g, or t
ttgccggtttttatttacattttgcatcatatattagctgaaaaaagtgaacatagaaaaatattaaagcgggttttgtatcttaccaactggaaaaaaactatgataaaagaaaaaatcctctccccttttcaaaaattcgtcaaccttcaaagttccagtggaattctgctattggcaacaacaatcattgctttggtatgggccaattcagcattttcagaaagttatcaatcattttggcaatataaaattggctttatttcagacagctttgaacttaaaaaaccgctgatcctttgggtaaacgatgggctgatggctattttcttctttttgattggattggaaatcaaaagagagtttttgattggtgaactcaattcaactaaaaaaattatgtttccgttgtttggtgcaatcggcggaattgtccttcctgttcttatatatgttattctaaatcaaaatccagaaacattgaaaggctggggaatcccaatggctacggacattgctttttcgttggcaattttaataatgcttggaaatcggtgccttaagtcttgcaatctctcgagccgattcttgatccgctag

SEQ ID NO: 26206 - protein, 199 aa, Unknown
  Obtained from environmental sample
  DOMAIN (44)...(197): Na+/H+ antiporter 1
  misc_feature (1)..(199): Xaa is any amino acid
MPVFIYILHHILAEKSEHRKILKRVLYLTNWKKTMIKEKILSPFQKFVNLQSSSGILLLATTIIALVWANSAFSESYQSFWQYKIGFISDSFELKKPLILWVNDGLMAIFFFLIGLEIKREFLIGELNSTKKIMFPLFGAIGGIVLPVLIYVILNQNPETLKGWGIPMATDIAFSLAILIMLGNRCLKSCNLSSRFLIR

SEQ ID NO: 26207 - DNA, 537 bp, Unknown
  Obtained from environmental sample
  misc_feature (1)..(537): n is a, c, g, or t
ttgaatctcatcccaagaattgagagtaaatttaaaaagtacaatagccgtttggatggacaccataagatgattttttactataattttgcaagcatgcaatttggttcgggcaataacaaagcctgtatattttatctggacaagattatttctaacaaatccttatccatgcgcgaagatttacaatgttttgcacgcgttttaaatttggtggctcattatgaagcaggattggattatcatttggaaagcctattaagaagcacctataaatttcttttgaagattaatgacttatatgaagtgcagaaagaactgataaagtttattaaaggattacaagatatttatccccatgatttaaaaaatgcttttgtaaagctacataaaactttaaagacctatgaagatcatccttatgaacgtcgtgcatttttatatctcgatattatttcttggctagaaagtaaaattgaaaacaaacccgttggccaagtcattagagataagtatttggcggagtctgcctcctaa

SEQ ID NO: 26208 - protein, 178 aa, Unknown
  Obtained from environmental sample
  misc_feature (1)..(178): Xaa is any amino acid
MNLIPRIESKFKKYNSRLDGHHKMIFYYNFASMQFGSGNNKACIFYLDKIISNKSLSMREDLQCFARVLNLVAHYEAGLDYHLESLLRSTYKFLLKINDLYEVQKELIKFIKGLQDIYPHDLKNAFVKLHKTLKTYEDHPYERRAFLYLDIISWLESKIENKPVGQVIRDKYLAESAS

SEQ ID NO: 26209 - DNA, 732 bp, Unknown
  Obtained from environmental sample
  misc_feature (1)..(732): n is a, c, g, or t
ttgaaaatttcagataaggccaaagagctagccattcagcatgaagaaaagaatctggcctatgagattgtggagtttgaaaaaattatagaatcccaatacattacacgcagtatcagcacccgtgccgatgagcttacccaacaagccagggagttgagcaaactaaacgtcattactagtaaactctctaatttatctttacagttgtacagcatgattttgaaatctggctacgttaaaaataaagaagaaggacaaaaagtaacggcttattttaacgaacaacttccaaaatttcaaatcagtaatttgggatttagagaaaaattatggctttataattcccatttatggcatagctttttgctccaggattttttgaattgctataaatatgcctccaaatgggtgaatttattttatgacaatcctaatatgatcagtttgaaccctgtattctttttgaagggcaataactatttattggaagccttattctttatcgggaataaacctaaatttttgaaaagacttgccatttttgaagaccaggtagaacaacccgattttccgaaagatgagaatgtagaagccttagtgtttttatacctcaattttcataggattaatcaacactttattgacgggagctttgatgaccgtttaaatctcatcccaagaattgagagtaatttaaaaagtacaatagccgttggatggacaccataa

SEQ ID NO: 26210 - protein, 243 aa, Unknown
  Obtained from environmental sample
  misc_feature (1)..(243): Xaa is any amino acid
MKISDKAKELAIQHEEKNLAYEIVEFEKIIESQYITRSISTRADELTQQARELSKLNVITSKLSNLSLQLYSMILKSGYVKNKEEGQKVTAYFNEQLPKFQISNLGFREKLWLYNSHLWHSFLLQDFLNCYKYASKWVNLFYDNPNMISLNPVFFLKGNNYLLEALFFIGNKPKFLKRLAIFEDQVEQPDFPKDENVEALVFLYLNFHRINQHFIDGSFDDRLNLIPRIESNLKSTIAVGWTP

SEQ ID NO: 26211 - DNA, 540 bp, Unknown
  Obtained from environmental sample
  misc_feature (1)..(540): n is a, c, g, or t
atgttcaaaacgtcatcatttaccaaaatgattaatagcgaacagcatgtgaccataaaaaacaataacggtaagcacatgaaagtaacagaccacataaaaaacgcaaacggaaaaaccttattttcttttgaaattattccaccaaaaaaaggaaatagtattcagcaattgtacaataatattgacccattaatggaattcaatccaccatttatagatgtgacgacctctagagaagaatacctttacattgaaaaagaagggcttttagaccgtaaaattacacgtatgcgaccaggaactgtgggtatttgtgcggctatatctcacaaatataatgtagatacggttccgcatgtattgtgtggaggttttacaaaagaggaaactgaatatctcttagtggattgtcattatctaggcattcataatgtgatggctttacgaggcgatgccatgaagcatgaacaatattttaaagcttgcgatggtggacacaaatttgccaaagaattggttgggcaattcagaatttaa

SEQ ID NO: 26212 - protein, 179 aa, Unknown
  Obtained from environmental sample
  misc_feature (1)..(179): Xaa is any amino acid
MFKTSSFTKMINSEQHVTIKNNNGKHMKVTDHIKNANGKTLFSFEIIPPKKGNSIQQLYNNIDPLMEFNPPFIDVTTSREEYLYIEKEGLLDRKITRMRPGTVGICAAISHKYNVDTVPHVLCGGFTKEETEYLLVDCHYLGIHNVMALRGDAMKHEQYFKACDGGHKFAKELVGQFRI

SEQ ID NO: 26213 - DNA, 459 bp, Unknown
  Obtained from environmental sample
  misc_feature (1)..(459): n is a, c, g, or t
atggataatataataagatatgaggttggcagcaatgcaatacgacacttacttactgtaagtactacaattgaattatcctatcagtatttaaaatctgagaccaaaaacgaaatggttaaatcttggatagataataaacttagctatctaaaagcgtttaaacagcagtctttatccatattaaacacagtaaatatccaacaatcaagcaagcctagtgtattgttaaagcttaatatgctatggtttaaaataaaacgtaagttttataaaaacgatagtcagcttattattaatgagtgtttgaaacttaacgcttattttttaagtgaagttaataaagaaattaaatcaggtatcttatctaaacctgcttacactttattaaacacgttaaaaaacgaacttttaataactaaacaagagttttacatctctaaactaaaacttagctaa

SEQ ID NO: 26214 - protein, 152 aa, Unknown
  Obtained from environmental sample
  misc_feature (1)..(152): Xaa is any amino acid
MDNIIRYEVGSNAIRHLLTVSTTIELSYQYLKSETKNEMVKSWIDNKLSYLKAFKQQSLSILNTVNIQQSSKPSVLLKLNMLWFKIKRKFYKNDSQLIINECLKLNAYFLSEVNKEIKSGILSKPAYTLLNTLKNELLITKQEFYISKLKLS

SEQ ID NO: 26215 - DNA, 444 bp, Unknown
  Obtained from environmental sample
  misc_feature (1)..(444): n is a, c, g, or t
ttgaattttaatttttttaaatcaaaagcaaataaacagaccatagctttttataatatcgaaaatttatttgatatttataaagatgacttaacacgtgatactgattttaatccaacatccgaaaagcgttggaccattaaaagatacaataataaattaagaaaaattggttatgctatatctaatattggcagaaaagaaaccaactctcatccagcaattattggtctagccgaaattgaaaacgaagctgtattaaaagatttaataacctctaaacatttaaaggaatatccataccaatttgtacactacgatagtaaagatgaacgcggtattgacgttgcctttatttacgatacgactaaatttaaagttacaaactctgaaagctttacgtttagttttaccgaaactgatgggtcgcaagattatacangt

SEQ ID NO: 26216 - protein, 148 aa, Unknown
  Obtained from environmental sample
  misc_feature (1)..(148): Xaa is any amino acid
MNFNFFKSKANKQTIAFYNIENLFDIYKDDLTRDTDFNPTSEKRWTIKRYNNKLRKIGYAISNIGRKETNSHPAIIGLAEIENEAVLKDLITSKHLKEYPYQFVHYDSKDERGIDVAFIYDTTKFKVTNSESFTFSFTETDGSQDYTX

SEQ ID NO: 26217 - DNA, 366 bp, Unknown
  Obtained from environmental sample
  misc_feature (1)..(366): n is a, c, g, or t
ttgaaaaagaaaccaaaaataaaaatcaataataaaatattattctgcccaacgagcgcagcaatggaattgataggtggaaaatggaaaagtgttatacttacccacttaataggcggtaaaaaacgctacaatgagttgcgtaaagaaattcctggtattactgagcgcacattgagtttacagttaaaacaattagaagcagatggtatggtaaacagaaaagtgtttactaaaaaaccacctttaaaagtagaatatacgcttacagagtttggacaaacattggttccaattttaaacctaattgttgattggggattacatgcggcagaaacaaaaggcgagtttttgtttgaggaatag

SEQ ID NO: 26218 - protein, 121 aa, Unknown
  Obtained from environmental sample
  DOMAIN (24)...(115): Transcriptional regulator
  misc_feature (1)..(121): Xaa is any amino acid
MKKKPKIKINNKILFCPTSAAMELIGGKWKSVILTHLIGGKKRYNELRKEIPGITERTLSLQLKQLEADGMVNRKVFTKKPPLKVEYTLTEFGQTLVPILNLIVDWGLHAAETKGEFLFEE

SEQ ID NO: 26219 - DNA, 648 bp, Unknown
  Obtained from environmental sample
  misc_feature (1)..(648): n is a, c, g, or t
atgcagtttatggccgatgttcatttagaatgtgaagcctgtaacgggaagcgttttcaaaaagatgtgctggaagttcagtttgaagggaaaaatatagatgatgtactgaatatgaccatagatgacgccactaacttttttgccgaaaacaaacttgataaaattgttagaaaactaaaacctttgcaagacgttggtttgggttatgtgcaattggggcaaagctcttctaccctatcaggtggggaagcacaaagaataaaactggcttcatttttagtaaaaggtgctactaaagaaaaagcattgttcatttttgatgaacctacaaccggacttcactttcacgatattaaaaagctactgaaatcctttaaggcacttatcgaaaaaggacatagtgtagtggtgatagaacataatatggatctggtaaaatgtgccgatcatattattgatattggtcccggaggaggtgaaaaaggaggaaatattgtagctcagggcactccagaagaacttgttaaatctaaaaaatcttttactgcaaaatatctacaagaaaactataattttatatattctgaactaaatcaagtttattcccagtttattgcagatattttactgaaactctcattctaa

SEQ ID NO: 26220 - protein, 215 aa, Unknown
  Obtained from environmental sample
  DOMAIN (16)...(158): ABC transporter
  misc_feature (1)..(215): Xaa is any amino acid
MQFMADVHLECEACNGKRFQKDVLEVQFEGKNIDDVLNMTIDDATNFFAENKLDKIVRKLKPLQDVGLGYVQLGQSSSTLSGGEAQRIKLASFLVKGATKEKALFIFDEPTTGLHFHDIKKLLKSFKALIEKGHSVVVIEHNMDLVKCADHIIDIGPGGGEKGGNIVAQGTPEELVKSKKSFTAKYLQENYNFIYSELNQVYSQFIADILLKLSF

SEQ ID NO: 26221 - DNA, 537 bp, Unknown
  Obtained from environmental sample
  misc_feature (1)..(537): n is a, c, g, or t
atgggtagcctacttgtaggtacatcgtttgcaaaatcgttagcttttggattagatatccctttaattgatgtaaaccatatgcaagcacatatattggcgcattttatcgaagaggacggttttaaaaagcctccatttccgtttttagccatgactatctctggtggacacacacagattgtaaaagtcaaacattactttgatatggaagttattggagaaactattgatgatgctgttggagaagcatttgataaaagtggtaaaatattaggattaggctatcctgctggtccacaaatagacaaacttgcacaactaggtaatcctaaagccttcccttttactaaacctagagtggatggacttaattttagtttttcaggttttaagactgctgtattgtactttatccaaaaacaagttaaacttaaccctaattttatagcagaaaaccttaacgacatctgtgcatctatacaatatactataattggtattctgacagacaagttaaaaaagcagttaaattaa

SEQ ID NO: 26222 - protein, 178 aa, Unknown
  Obtained from environmental sample
  misc_feature (1)..(178): Xaa is any amino acid
MGSLLVGTSFAKSLAFGLDIPLIDVNHMQAHILAHFIEEDGFKKPPFPFLAMTISGGHTQIVKVKHYFDMEVIGETIDDAVGEAFDKSGKILGLGYPAGPQIDKLAQLGNPKAFPFTKPRVDGLNFSFSGFKTAVLYFIQKQVKLNPNFIAENLNDICASIQYTIIGILTDKLKKQLN

SEQ ID NO: 26223 - DNA, 522 bp, Unknown
  Obtained from environmental sample
  misc_feature (1)..(522): n is a, c, g, or t
ttggtagtgtcaattttgttgacaacagttctttgggaatattccgttctgaataagaattatgaatctgactttaaaatgcgaagtcagcgaaaagtattcggaatttttgagttaattaatgctattgcttggactatgttactatggtttgggaatgataattatagaaatataatttttctgattttcatattttggacatttccactaaccgatttaattatgtggtttatttacaaaaagaaaaaaccatttacagttttcataaaagacaacgaattaattttaaacaagcgttggactcaaaaacggaatctgactgaactcactcaaatccaatttgaccgatttagtaaaaatttaaaacttgatttcaaatcaaaatctagaatttcaattaaaacaacggaatataaaactgacgaaattcaatcattattggagatactaattgagaaatcggaaaatgaagtttttgtaccgaataattatgaaccgaaaataaaaaacagttgctaa

SEQ ID NO: 26224 - protein, 173 aa, Unknown
  Obtained from environmental sample
  misc_feature (1)..(173): Xaa is any amino acid
MVVSILLTTVLWEYSVLNKNYESDFKMRSQRKVFGIFELINAIAWTMLLWFGNDNYRNIIFLIFIFWTFPLTDLIMWFIYKKKKPFTVFIKDNELILNKRWTQKRNLTELTQIQFDRFSKNLKLDFKSKSRISIKTTEYKTDEIQSLLEILIEKSENEVFVPNNYEPKIKNSC

SEQ ID NO: 26225 - DNA, 384 bp, Unknown
  Obtained from environmental sample
  misc_feature (1)..(384): n is a, c, g, or t
gtgtttacattttctatgcatggtaaacataattatccgtttaaaaaagaacaaagcgatttggatattgctttagaaaacaatgttggagacacggaatacctttctattttaaagaacacattacctaaactaattacaaactttcaacctgattttatctattatttatgtggtgtagacgtaattgctacagataaattaggaaaattaggattgacggttacaggctgcaaagcacgtgatcaatttgttttagaaacatgcaaagctaacaacctaccaattatgtgcagtatgggaggaggttacagtcctgacataaaaacaatagtagacgcacacgccaatacgtttagattagcacaagatatatatttttaa

SEQ ID NO: 26226 - protein, 127 aa, Unknown
  Obtained from environmental sample
  misc_feature (1)..(127): Xaa is any amino acid
MFTFSMHGKHNYPFKKEQSDLDIALENNVGDTEYLSILKNTLPKLITNFQPDFIYYLCGVDVIATDKLGKLGLTVTGCKARDQFVLETCKANNLPIMCSMGGGYSPDIKTIVDAHANTFRLAQDIYF

SEQ ID NO: 26227 - DNA, 525 bp, Unknown
  Obtained from environmental sample
  misc_feature (1)..(525): n is a, c, g, or t
atggaaccacttgttaacttcaatgatctattggaaaagtatcggaataaaaatatcgctttattggaaacattactagagaatgcgagtgcggaggatattctggcatcggaatctcttagatcagataattcctttcataagataaagatggaattgggtaaagctgcagattcggcctcaattatgaaatttatctccatcataaacaacaatccatattttacggagctcaatgcaattgcaaaaaagcataataaccgcacgttattggaatatgaacaaattatgaaacaggccgataccactattgaaacatatcataaatctacctctgcctcagaaatacaaaatgttgtagtatcaaacgagcaaaagaatttaattactgatcttttggttaacacaaaagtgactcttatagaaatggaaacatatacattggacagtataggtcttcaaaaaaccttacttctcatcaatgacccgctaatagtgacgaaaaatcggtttcacatcatatga

SEQ ID NO: 26228 - protein, 174 aa, Unknown
  Obtained from environmental sample
  misc_feature (1)..(174): Xaa is any amino acid
MEPLVNFNDLLEKYRNKNIALLETLLENASAEDILASESLRSDNSFHKIKMELGKAADSASIMKFISIINNNPYFTELNAIAKKHNNRTLLEYEQIMKQADTTIETYHKSTSASEIQNVVVSNEQKNLITDLLVNTKVTLIEMETYTLDSIGLQKTLLLINDPLIVTKNRFHII

SEQ ID NO: 26229 - DNA, 474 bp, Unknown
  Obtained from environmental sample
  misc_feature (1)..(474): n is a, c, g, or t
ttggaaaccattcaagatccaaaaaactatgtcgggttttatgtatatagaactttttattttattggaaggaaacttaattatagtggttggcagcgggataaggtaatccggctttttagaaaagataaatgcaaatatgacggcaagttagtccatgaaacaattagcgcagatggccatgtaggtttttttaaaagtaaactagagcattattcttatcagaactttgaccattataatacaaaattaaatcaatatgcatcattaaaatctaaagctttatatgataaagggacaaaagtttctttgttccatatagtaattaaaccaccttatcgctttatttctcattatattataagattaggttttttagatggttttcccggctttataatttcagtaactcaagcttatggagttttaacgagatatattaagttatggttaatgaatcataaacttaaataa

SEQ ID NO: 26230 - protein, 157 aa, Unknown
  Obtained from environmental sample
  misc_feature (1)..(157): Xaa is any amino acid
METIQDPKNYVGFYVYRTFYFIGRKLNYSGWQRDKVIRLFRKDKCKYDGKLVHETISADGHVGFFKSKLEHYSYQNFDHYNTKLNQYASLKSKALYDKGTKVSLFHIVIKPPYRFISHYIIRLGFLDGFPGFIISVTQAYGVLTRYIKLWLMNHKLK

SEQ ID NO: 26231 - DNA, 402 bp, Unknown
  Obtained from environmental sample
  misc_feature (1)..(402): n is a, c, g, or t
gtgattttggttaacagtatagaaatgttgaaacaatatgttaaagaaattcctaataacctgatagatgttttaaaaaaccccataaaacctacaacagttatttataaaaatccaaaaggattggcaaaaaatgtaatggctgctgataaaactatagctattagaatagtgcaagatgaattttgtcaaaaactaattcaaaaattcggtaaacccatagtatcaacttctgccaatattagtggtatgcctgcaccaagaacttttaaagaaattgatccgttgatttcgggtaaggttgattatgtggtaaatttgtaccaagataaaattaatgactcgccttcaacaattattaaaattgatgatgaaggtgagatagaaattattagagaataa

SEQ ID NO: 26232 - protein, 133 aa, Unknown
  Obtained from environmental sample
  DOMAIN (2)...(133): yrdC domain
  misc_feature (1)..(133): Xaa is any amino acid
MILVNSIEMLKQYVKEIPNNLIDVLKNPIKPTTVIYKNPKGLAKNVMAADKTIAIRIVQDEFCQKLIQKFGKPIVSTSANISGMPAPRTFKEIDPLISGKVDYVVNLYQDKINDSPSTIIKIDDEGEIEIIRE

SEQ ID NO: 26233 - DNA, 585 bp, Unknown
  Obtained from environmental sample
  misc_feature (1)..(585): n is a, c, g, or t
atgaaagatatatctgaacaattggcacatatatgtaaanctgtgtcttccgaaagttttttaaataaagaagctttaggaggagaaatccctttgtttatagctgcttatgatgctaaaaaggaaactgaagtttatcaatccattaaaagattaataaaaaaagtggacacaatggggattcccgtaatagaaattaatttatatgatttagtttgcgaaatcctggaagaaaaaggcggtatggaaagaatgtttcgtgtggaaaaggctaagtctaaagaaaagtttcttagagcattgcagtcctcattaaacatgcatgaagtattgatgccaaaaattaaggaactgataactgcgtctaatgctaaattatattttttaacgggaattggattagtattcccttacatacgttcgcacaacgtattgaacaatttacaaaatgtggcaaaagatgcaccgactttagctttttttccaggagaatacgacggtcatgcattaaatctctttggactttttaaagatgataactactacagagcatatgatataagtaatataaagaccaaatcatga

SEQ ID NO: 26234 - protein, 194 aa, Unknown
  Obtained from environmental sample
  misc_feature (1)..(194): Xaa is any amino acid
MKDISEQLAHICKXVSSESFLNKEALGGEIPLFIAAYDAKKETEVYQSIKRLIKKVDTMGIPVIEINLYDLVCEILEEKGGMERMFRVEKAKSKEKFLRALQSSLNMHEVLMPKIKELITASNAKLYFLTGIGLVFPYIRSHNVLNNLQNVAKDAPTLAFFPGEYDGHALNLFGLFKDDNYYRAYDISNIKTKS

SEQ ID NO: 26235 - DNA, 750 bp, Unknown
  Obtained from environmental sample
  misc_feature (1)..(750): n is a, c, g, or t
ttgaagtatatttgtgtcatggctaaagcaaaatttatacttaaagaaccaagcgcaaaggaagaaactttaatctatctagtttacaactaccaatataaaagatttaaattttctacaggagaaaaaattaatcctaaattttggaatgcaacttcacaaagagtaaaagcaacaaagcaatttaaagaataccctgaatttaattcaagattagacaaaattgaaaacggaataaataacacttttagaaaattactaaatgatggaattcaaccctctaatagcttattgaaagaagaattagaaaacgaattatctgataatttagttaaacctaaaaaaactacttttttcgaatttattacaaattacattcaagaaagcaaactaaataaatcgacaggaaccataaaagtttataatactactttcaaatatttaaaagcgtacgctaaaaaatacaagcctattgattttgaaacaataacactcgaattttacaaccactatttaggttatttaaaacttgagaataacctgtcctctaacacagttggaaaacacataaagactattaaatcatttttaaatgaagctactgaaagaggaattaataagaatctagaatttagaaacaaacggtttaaaactctaagagaagaagctgataccatttatttaaatattgaagaattagaaaaaattgaaaacttaaatcttaaagcaaatccaagactgaaaaagtaa

SEQ ID NO: 26236 - protein, 249 aa, Unknown
  Obtained from environmental sample
  misc_feature (1)..(249): Xaa is any amino acid
MKYICVMAKAKFILKEPSAKEETLIYLVYNYQYKRFKFSTGEKINPKFWNATSQRVKATKQFKEYPEFNSRLDKIENGINNTFRKLLNDGIQPSNSLLKEELENELSDNLVKPKKTTFFEFITNYIQESKLNKSTGTIKVYNTTFKYLKAYAKKYKPIDFETITLEFYNHYLGYLKLENNLSSNTVGKHIKTIKSFLNEATERGINKNLEFRNKRFKTLREEADTIYLNIEELEKIENLNLKANPRLKK

SEQ ID NO: 26237 - DNA, 414 bp, Unknown
  Obtained from environmental sample
  misc_feature (1)..(414): n is a, c, g, or t
gtgttgatggcgcagtttatggtggggtcgcttcacgataaatgctatcaaatgccggtttaccgtatccgcaatgtacagattttgcaaaaaacacgacgagagccaagtactgagcagttaaagtcgttacgcagtgcgattaataaaggtatgaagcaagaaacgatcgagttaattgtaaaagtgcctaaccactctgcggttaatcaagagtttattgaacttggcgagctgactgataagcaaagtattgatgaaaaaaatgtattacttacctaccaaactattgataccgagcaattgactgatgagctatttaaatgtgctcattggctagaggttattaagcctgaaaagctgcgacaaagaattgttagcaagcttaaagcggccgctaacatttatcaataa

SEQ ID NO: 26238 - protein, 137 aa, Unknown
  Obtained from environmental sample
  misc_feature (1)..(137): Xaa is any amino acid
MLMAQFMVGSLHDKCYQMPVYRIRNVQILQKTRREPSTEQLKSLRSAINKGMKQETIELIVKVPNHSAVNQEFIELGELTDKQSIDEKNVLLTYQTIDTEQLTDELFKCAHWLEVIKPEKLRQRIVSKLKAAANIYQ

SEQ ID NO: 26239 - DNA, 546 bp, Unknown
  Obtained from environmental sample
  misc_feature (1)..(546): n is a, c, g, or t
gtggcgatgagcaaaattaacgatggaagacttgtaccagtgcgcggaaaagaatgtagcagccagcagaatccattcctgctcaataaaataaaaagctacaaagaattttctacgctggatatgaacggtatttatggtgaagaagaacttaaagatgcttttaaactaacctgccatgattttgaaagtatgtacgcagaaaacttgggcggtggaaaatttaaagtgcaaagattgccaaacgaagctcagttaggccctactctttcctttatatctcgcgattttaacaatgatggaaatatggacattatgggtgttggtgccatttatgacgccgaggtggaaaccatccgttatgacagcaactacggttatgttttattgggcgatggcaaaggtggttttagctattccagagaatatgagcccttcatagccagcgattcaaaaaatatgaaagccatcaaaataaatggcactgaaatgtttattgtagtgagtaacaacgcaccattacaaattttcaatttcaaatcgtag

SEQ ID NO: 26240 - protein, 181 aa, Unknown
  Obtained from environmental sample
  misc_feature (1)..(181): Xaa is any amino acid
MAMSKINDGRLVPVRGKECSSQQNPFLLNKIKSYKEFSTLDMNGIYGEEELKDAFKLTCHDFESMYAENLGGGKFKVQRLPNEAQLGPTLSFISRDFNNDGNMDIMGVGAIYDAEVETIRYDSNYGYVLLGDGKGGFSYSREYEPFIASDSKNMKAIKINGTEMFIVVSNNAPLQIFNFKS

SEQ ID NO: 26241 - DNA, 339 bp, Unknown
  Obtained from environmental sample
  misc_feature (1)..(339): n is a, c, g, or t
ttggttaacaaagcgttttggcaatggctaataacgcaagtaagcgattttaaaatagagcataaactacaatttgaaataaatgcagcagacttttttaaatatcaaatacgtttacaaggcgtattaaaaataataactaagctaaattatcagattattattgatggtattaaaagtagcgaccatattattcaactggttaattatccacaagttttaggagttaaattagcctacgatttagtgcactcaatagaggcaagcacgcatcaacaaaagttgtgtaaaaaacattgtaaatgcttgccagttattaaatatagcggtatttgctag

SEQ ID NO: 26242 - protein, 112 aa, Unknown
  Obtained from environmental sample
  misc_feature (1)..(112): Xaa is any amino acid
MVNKAFWQWLITQVSDFKIEHKLQFEINAADFFKYQIRLQGVLKIITKLNYQIIIDGIKSSDHIIQLVNYPQVLGVKLAYDLVHSIEASTHQQKLCKKHCKCLPVIKYSGIC

SEQ ID NO: 26243 - DNA, 717 bp, Unknown
  Obtained from environmental sample
  misc_feature (1)..(717): n is a, c, g, or t
gtgacttctatagaagttattgaaggtgataaagtagtaaagaatcaaatactggcttatttatcccatcctaatctaaccaatatacaaacgcaatatgtacgcacatatgaacagatgttgtacttagacaaagaatatgctcgccaaaaaagactctatgaaggggaagtaggttcgggtaaagactttcaggaaaccgaagccaattacaaagctaccgttgcagaagtgaaagggtatgaagctcaccttaagcaactaaatttatctgtagataaaatcagaagtgggagcatttttgagcaagttcctgttgttagtcctattgaaggatttatcgaaggagtagaaatacagatcggacagtttgttgatcctcaaaccaaattgtttatgattgtgaataatgaacacattcatgcagatttaatggtgtttgaaaaagatatatacaaagttaaaaaaggtcagaaagtatcgtttacagtagaatccgttccaaatggtcgattaacagggaagatttactctgttggaaaacagtttgagcaaagtcctaaagcggtacacgttcatgccgaaatagatcaaaaagaaagttttctgattcccgggatgtatataaacggaaatatatatgcttctgaaacagaagtaatagctcttcctgaaacagcgattgtagaggatgaaggggtaccatatatgtctnan

SEQ ID NO: 26244 - protein, 239 aa, Unknown
  Obtained from environmental sample
  misc_feature (1)..(239): Xaa is any amino acid
MTSIEVIEGDKVVKNQILAYLSHPNLTNIQTQYVRTYEQMLYLDKEYARQKRLYEGEVGSGKDFQETEANYKATVAEVKGYEAHLKQLNLSVDKIRSGSIFEQVPVVSPIEGFIEGVEIQIGQFVDPQTKLFMIVNNEHIHADLMVFEKDIYKVKKGQKVSFTVESVPNGRLTGKIYSVGKQFEQSPKAVHVHAEIDQKESFLIPGMYINGNIYASETEVIALPETAIVEDEGVPYMSX

SEQ ID NO: 26245 - DNA, 375 bp, Unknown
  Obtained from environmental sample
  misc_feature (1)..(375): n is a, c, g, or t
atgattactattgagactcatacagagaacagcattattaccataaaagcatcagacacattaagtaaaaaagacttcgacaaattggctccgactctgaaagaatttacaggatcaaaccgggattgtcatttattaatgacattagaacggcttaaaggatgggatgaagtgtcgtctttttgggaagatttgaaacttgatgccgaatttataggtgagtttgatcgcattgcaattgtcggagagaagaagtgggaaaaatggggggcaaatcttcttgactcactgacaaaaaccgaattaaagttttttggaattacgaatgcagataatgcctggttatggttaacagataaagtacattcagaatga

SEQ ID NO: 26246 - protein, 124 aa, Unknown
  Obtained from environmental sample
  misc_feature (1)..(124): Xaa is any amino acid
MITIETHTENSIITIKASDTLSKKDFDKLAPTLKEFTGSNRDCHLLMTLERLKGWDEVSSFWEDLKLDAEFIGEFDRIAIVGEKKWEKWGANLLDSLTKTELKFFGITNADNAWLWLTDKVHSE

SEQ ID NO: 26247 - DNA, 792 bp, Unknown
  Obtained from environmental sample
  misc_feature (1)..(792): n is a, c, g, or t
ttgcctaaaaaaaagcaagattattctatttcatttcaaataaatgatacgtctagcacgtcatattttgtgcatctacccaaaacgtataatccaaacaatcaatatccaatgttggtttttttacatggagcaatacgctacaccacattgtctgattatgagacaaaaagtaatttaaaatacgctaatacaaaatataccaagcgtgcagacgttaacgatgttgttttagtgtttccaaaagctgataaaaattttaattggatgattggagacgaaggcttttttatggttccagaaattattaagcaaataaagtcagcaattaatattgatgatgataaagtatttgtctctggtcactctaatggagcaactggctcgttttcatacttaatgaagcagccaacacaatttgctggtttttatggttttaatacacatccaaaagtctatactggcggaacgtttatagaaaatgtaaaagctagaagttttattaatttttctacagatcaagattactattatccgccaaatgcaaatgatagcttaaatagcattatgtctaaaattaaggcggattataaagattacagatataatggctttccgcattggtttcctgattttgatgaggcagaacctgcttatgatatattgtctgaagatcttattaagcgaaaaagaaatcctttttcaaaaacatggcattggcagttgacgacaatgcacatggtactattgatgggtaactattctcaattagatactatcaaaacgacttaa

SEQ ID NO: 26248 - protein, 263 aa, Unknown
  Obtained from environmental sample
  misc_feature (1)..(263): Xaa is any amino acid
MPKKKQDYSISFQINDTSSTSYFVHLPKTYNPNNQYPMLVFLHGAIRYTTLSDYETKSNLKYANTKYTKRADVNDVVLVFPKADKNFNWMIGDEGFFMVPEIIKQIKSAINIDDDKVFVSGHSNGATGSFSYLMKQPTQFAGFYGFNTHPKVYTGGTFIENVKARSFINFSTDQDYYYPPNANDSLNSIMSKIKADYKDYRYNGFPHWFPDFDEAEPAYDILSEDLIKRKRNPFSKTWHWQLTTMHMVLLMGNYSQLDTIKTT

SEQ ID NO: 26249 - DNA, 420 bp, Unknown
  Obtained from environmental sample
  misc_feature (1)..(420): n is a, c, g, or t
atgaaacaaatacttattctttttagcctactctattttagtgcacaagcgcaatctccagaactctctttaacgatatcaaacatagaaactattgaaggttctatagaaattggcgtctttaataccgctcataattatctaaaatcgggagcggcctataaaaattattcggtagaaattactaaagaaatcgaaacccttgttataaaagatttacctaaaggtgaatatgctatttctatgtatcatgatgagaactcagacgataaatgcaataaaaactttataggtatcccgaaagaggcttatggtttctctaataatgttgtgcctaggttctcggcgccttcttatgaagactgtaagtttgttttagatgaaaataaagaaatggaaataaaactgagaagtttttaa

SEQ ID NO: 26250 - protein, 139 aa, Unknown
  Obtained from environmental sample
  SIGNAL (1)...(17)
  misc_feature (1)..(139): Xaa is any amino acid
MKQILILFSLLYFSAQAQSPELSLTISNIETIEGSIEIGVFNTAHNYLKSGAAYKNYSVEITKEIETLVIKDLPKGEYAISMYHDENSDDKCNKNFIGIPKEAYGFSNNVVPRFSAPSYEDCKFVLDENKEMEIKLRSF

SEQ ID NO: 26251 - DNA, 483 bp, Unknown
  Obtained from environmental sample
  misc_feature (1)..(483): n is a, c, g, or t
atgagcgttaccagccaaataaatgttatagcacccggaatgaagattttattcgcatataaaggtcgttatcaaatacgtgatacgacaactatcgagtatctctcttccttggcgaagaaattcggatgtcatacagatttagtctatgatcaagatacctttggggttacagacaatgtactgtcggtgccatttttaaacaaaatgttttcaaaggaccaagcggtcgtagacagtattattaaaaaagatccgcaaatggttgtctttttggatggttttacccaaggtccgtggaacagggatatatctaaagccgtcaaagagatcaataaggatatttcatgtgtgggtctttttcactgcgattcagcgtcactgtatgacgaatatgattatgtattgattggagaacctgaatcgagctttaaaaaattttttaatgataagatattcaatggtgacaaaggcggtttataa

SEQ ID NO: 26252 - protein, 160 aa, Unknown
  Obtained from environmental sample
  misc_feature (1)..(160): Xaa is any amino acid
MSVTSQINVIAPGMKILFAYKGRYQIRDTTTIEYLSSLAKKFGCHTDLVYDQDTFGVTDNVLSVPFLNKMFSKDQAVVDSIIKKDPQMVVFLDGFTQGPWNRDISKAVKEINKDISCVGLFHCDSASLYDEYDYVLIGEPESSFKKFFNDKIFNGDKGGL

SEQ ID NO: 26253 - DNA, 675 bp, Unknown
  Obtained from environmental sample
  misc_feature (1)..(675): n is a, c, g, or t
atgtggtattgcaaatggagtttgaatggtgtcaatatagataccgaaaaatgtaaccagacacttaaacagctcaagaaactcaatgtaaaacttatacagaaaattcaagtattttcaaaaggggaaatcaatttggaaagcccccagcagctacataggctattgtttgaaatactacaaatacaacctaaaatagataaggtaggtaaaaacgggtgttattccacggataaatcacatttgaaaaagttgatggaacaacacgaggtcgttcctttattgttggattatcgtaaaaccaactcattaatcaacttctgtaaacaattacaagaggttaatccagttacaaaaaggttgcatgggcaatttaatcaaattggcactgcgacaggacgatttagttgtagtaagccaaatctacagaatatacccaatgtcaaactaaagcctagtgaaactaatgagctaaaaatattggaatcaagattcagagaaatgttcgttcctaaaagagggtgtcagttcatctgtgccgattattcgcaaattgaaatacgagtagcagcagaaatgagccaagatccatttcttcttaaagcttacaatgaaactgatagcaacggagacaaactagatgtccacaactctcgaccgattcttgatcactag

SEQ ID NO: 26254 - protein, 224 aa, Unknown
  Obtained from environmental sample
  DOMAIN (13)...(224): DNA polymerase family A
  misc_feature (1)..(224): Xaa is any amino acid
MWYCKWSLNGVNIDTEKCNQTLKQLKKLNVKLIQKIQVFSKGEINLESPQQLHRLLFEILQIQPKIDKVGKNGCYSTDKSHLKKLMEQHEVVPLLLDYRKTNSLINFCKQLQEVNPVTKRLHGQFNQIGTATGRFSCSKPNLQNIPNVKLKPSETNELKILESRFREMFVPKRGCQFICADYSQIEIRVAAEMSQDPFLLKAYNETDSNGDKLDVHNSRPILDH

SEQ ID NO: 26255 - DNA, 651 bp, Unknown
  Obtained from environmental sample
  misc_feature (1)..(651): n is a, c, g, or t
atgatggctcagctagtgtttagaagatttcctaatgcaatgcaggcgataaaatatctaaatcagaatgaaattgatttaatatttttagatatacatatgccagattttacaggcttcgattttatagaaaccgtaaaaaacccacctaaaataattttaactacttctgatcctaattttgcaattcaggcttttgaatacgattgtattgtagattacttagtaaagccaattacaccagagcgttttcaaaaagccattcaaaaggcagaagcaacagctagtaaagctttaaaagaatccccatcgtcttcagagaaagtagaaactagttctggtaatgacctctatgttaatatcgatagacgtttaattaaaatagacattccaagtatttatttggtagaagctaaaggcgattacatccaggtaaaaacggatgataaaaactacacagtacattctacgttaaagaaaatagaagataaattaccagacgatttatttctaaaagtacatcgctcttacattattaatattgataagattattgatattgaagataatagtgtgcttattaaaaaagacgttattcctgtaagtcgttctaatagaccagaattaatgaaacgtcttaacttactataa

SEQ ID NO: 26256 - protein, 216 aa, Unknown
  Obtained from environmental sample
  DOMAIN (1)...(96): Response regulator receiver domain
  misc_feature (1)..(216): Xaa is any amino acid
MMAQLVFRRFPNAMQAIKYLNQNEIDLIFLDIHMPDFTGFDFIETVKNPPKIILTTSDPNFAIQAFEYDCIVDYLVKPITPERFQKAIQKAEATASKALKESPSSSEKVETSSGNDLYVNIDRRLIKIDIPSIYLVEAKGDYIQVKTDDKNYTVHSTLKKIEDKLPDDLFLKVHRSYIINIDKIIDIEDNSVLIKKDVIPVSRSNRPELMKRLNLL

SEQ ID NO: 26257 - DNA, 357 bp, Unknown
  Obtained from environmental sample
  misc_feature (1)..(357): n is a, c, g, or t
atgggtaacttaaaatgggctagaaacatcatcaaagcacaaacaggtcttactaatagctcttacacttcaattccagtaggagaaacaacttacttttttataaactgctctgataatattaaaaaacttagtgcagaccgtattgcttttaaacaaactaaagccaaaaagtctaacctttacatgatatctattgatcaaaatggtgcttttgattttgaaaaattaatagactataaagactctaaagtctattacaaggttaatgatggtgttgtaaaccttaatgatcgcacagttattttaccaggtaaaaacaaaaaaaatacacgaattttaaaaattaagttttaa

SEQ ID NO: 26258 - protein, 118 aa, Unknown
  Obtained from environmental sample
  misc_feature (1)..(118): Xaa is any amino acid
MGNLKWARNIIKAQTGLTNSSYTSIPVGETTYFFINCSDNIKKLSADRIAFKQTKAKKSNLYMISIDQNGAFDFEKLIDYKDSKVYYKVNDGVVNLNDRTVILPGKNKKNTRILKIKF

SEQ ID NO: 26259 - DNA, 543 bp, Unknown
  Obtained from environmental sample
  misc_feature (1)..(543): n is a, c, g, or t
ttgactggaataccagaaaaaaatggaaatatacttaggttattattgcctttttcacgagagcaaattgagaattatgcaactgaaaataatttgatgtggagagaagacagtagtaatatagacacaaaatatatacggaataaaattcgacatcaggtaattcctgttttaaaagaattaaatcccggccttttaaattcatttagtaaaacactgcaaaatttaagaggaagccatgatattattaaagattccattgaaaaactaaacaaagttgttgttattcccggggacccgcctgtcggagaggcaggagcaggaatacagaaaatagatatacaaaagcttcaagaatttactaatccaaaagcttatttctatgaactattaatggagtacggttttacagaatggaatgatctaaatgacttattggatgctcagtctggtaagcaaatagtgagtcttacaagtaggattgtgacagatagagattatttattattgacaaaattcggctgtcaaataatctgtaaataa

SEQ ID NO: 26260 - protein, 180 aa, Unknown
  Obtained from environmental sample
  misc_feature (1)..(180): Xaa is any amino acid
MTGIPEKNGNILRLLLPFSREQIENYATENNLMWREDSSNIDTKYIRNKIRHQVIPVLKELNPGLLNSFSKTLQNLRGSHDIIKDSIEKLNKVVVIPGDPPVGEAGAGIQKIDIQKLQEFTNPKAYFYELLMEYGFTEWNDLNDLLDAQSGKQIVSLTSRIVTDRDYLLLTKFGCQIICK

SEQ ID NO: 26261 - DNA, 543 bp, Unknown
  Obtained from environmental sample
  misc_feature (1)..(543): n is a, c, g, or t
atgaagaatatactatatatagtaactgtattttttttgttcacagttactgtcagggcccaaatatttaaaccggttaaatggcaaacatctgttgaaaaagtatcagaatctgaatatgatttagtggtcactgcaacaattgatgaaggttggcatttgtattcacaatcaataccagatgatgggccaattccaacaacatttagttttaaaaatgttgaaagtaaatatcagctaataggtaaaacaattgaaggaaagggtcacgaggagtttgataaagtatttgaaatgaatattaaatactttgaggatgaagcaatttttaaacagcgtatatatttattgaccaaggataaggttgttattaatgaatctgttgaatttatggtttgtgatgacaccagttgtttgccgccaactgaacaagagctacattttgaattacaaggatcggcaagtgaagaaaaaacaaaagatactttgaatagtaaatcttctgaagataacccgaaaaatactacaaacagaaataagtga

SEQ ID NO: 26262 - protein, 180 aa, Unknown
  Obtained from environmental sample
  misc_feature (1)..(180): Xaa is any amino acid
MKNILYIVTVFFLFTVTVRAQIFKPVKWQTSVEKVSESEYDLVVTATIDEGWHLYSQSIPDDGPIPTTFSFKNVESKYQLIGKTIEGKGHEEFDKVFEMNIKYFEDEAIFKQRIYLLTKDKVVINESVEFMVCDDTSCLPPTEQELHFELQGSASEEKTKDTLNSKSSEDNPKNTTNRNK

SEQ ID NO: 26263 - DNA, 306 bp, Unknown; identical to SEQ ID NO: 24047
  Obtained from environmental sample
  misc_feature (1)..(306): n is a, c, g, or t

SEQ ID NO: 26264 - protein, 101 aa, Unknown; identical to SEQ ID NO: 24048
  Obtained from environmental sample
  misc_feature (1)..(101): Xaa is any amino acid

SEQ ID NO: 26265 - DNA, 846 bp, Unknown
  Obtained from environmental sample
  misc_feature (1)..(846): n is a, c, g, or t
gtggatcaagaattcggctcgagacacgcttgcactacaggaggcggaagttatatgcgaaatcccgatgtgggagagtttgatcatattacctgggtaaccatgaaagaagaaggtcctgaagttgttcatatcgaacttcaaggaattcatgataaaaatgtagtgcctgaaaaagattatgcagacattcaggtgctaaggcaagggaactggttggatattgtaccttttgtaagtgagtcagaatccgtttcagaaattgatgtaaaaatgttggtcgaaaacatttcagaacgaacatttttcatacgcgggaaattaccaacacgtgatgggatttatttcgaatctgctcagattaacgaggaattagctccatcccaaaaaaaagaaattattgtgaaagggatacaaacctatactccgatttcaatagcgaagttgaataacgatccgttagaagttggattggaagccggatttgaaagagaaggtaaaagtgatattgcactgaaaacttcaaaaaagcttttaacagattggaagcattctcttaaaaaaacaacgaataagattaaaattgatgggaatttgaacgattggtcaggctctgaaatgatacaagttgatcaccctcaatatttttatgaagattgggattggaaaggcaaagaagacgggcgttttgagtttggggtcaacttcgataatgagaatctaaatattggagtacgtttcacggatcaaaaaactattattgaaaaaggttctttgaaagatcggcaggacaaattttatatacatttagatgccaatcttgaagatgatgagtatggaatattn

SEQ ID NO: 26266 - protein, 282 aa, Unknown
  Obtained from environmental sample
  misc_feature (1)..(282): Xaa is any amino acid
MDQEFGSRHACTTGGGSYMRNPDVGEFDHITWVTMKEEGPEVVHIELQGIHDKNVVPEKDYADIQVLRQGNWLDIVPFVSESESVSEIDVKMLVENISERTFFIRGKLPTRDGIYFESAQINEELAPSQKKEIIVKGIQTYTPISIAKLNNDPLEVGLEAGFEREGKSDIALKTSKKLLTDWKHSLKKTTNKIKIDGNLNDWSGSEMIQVDHPQYFYEDWDWKGKEDGRFEFGVNFDNENLNIGVRFTDQKTIIEKGSLKDRQDKFYIHLDANLEDDEYGIX

SEQ ID NO: 26267 - DNA, 756 bp, Unknown
  Obtained from environmental sample
  misc_feature (1)..(756): n is a, c, g, or t
atgaagatttttttaaaaaaattagcattcttttttattcctattatactctatgtgataatagttttatccttagatatttttaaaatttttaaagattataataactattataatcaagacatcactactttaaatagaacttacgtatcaacaaagatttttcaaaaaaataaagacagtgtaaattatgatagctttatttttggtagctcaagatctcaagcctttaaaactccaatctggaagcactatttaccagaaaaatcgattccgtttcattatgatgcacatagcgaagatttatatggtatttataaaaaattagaatttttagacgatgtaaattcaccaataaaccatgctttaattattattgatagagccgtattgtctggcaccataaaaagactaaatcacctatacattaacccagtggagtttaatgatgtttcaaaatacgaattttatagcagttttattttagcaaatcttaatccacgatttatgatggcatacgccgatttttactgttttaaaacgtatagaaattatatgaaaaattatgtacgtatggacaaatatccagatacgtttacaccaatttataatgactcttattacggattagctaaagagattaaagaagacagtttaggctattataataaattgaaacaacatggtgtattttatcaaagaccacaagaatcaaatattacattagaaaaaactaaaagagaaatagattactaa

SEQ ID NO: 26268 - protein, 251 aa, Unknown
  Obtained from environmental sample
  misc_feature (1)..(251): Xaa is any amino acid
MKIFLKKLAFFFIPIILYVIIVLSLDIFKIFKDYNNYYNQDITTLNRTYVSTKIFQKNKDSVNYDSFIFGSSRSQAFKTPIWKHYLPEKSIPFHYDAHSEDLYGIYKKLEFLDDVNSPINHALIIIDRAVLSGTIKRLNHLYINPVEFNDVSKYEFYSSFILANLNPRFMMAYADFYCFKTYRNYMKNYVRMDKYPDTFTPIYNDSYYGLAKEIKEDSLGYYNKLKQHGVFYQRPQESNITLEKTKREIDY

SEQ ID NO: 26269 - DNA, 468 bp, Unknown
  Obtained from environmental sample
  misc_feature (1)..(468): n is a, c, g, or t
atggctacagcgttatttcatttgccatttgttaaaagcgtcttttttgacgaaaactatgtgtcaatcacaaaatatgatatcgcagaatggaatgacatttcttttgaattaagagagtttataaaaaattacatagaggatgctaaagaaatagtatcacctaatgcaccagaagttgttgaaaaatctgtagaaaaagtagaagcacactttgaaacattagatgacacctctaagcaaattgtaaacattctagaagaatatattaagcctgctgttgcaagtgatggagggaacatccaatttgaatcctatgatgaaactactaaaaccgtaaaagtaattttacaaggtgcatgtagtggttgtccatcttcgacatttacattaaaaaacggaattgaaaatatgcttaaagagatgttagcaggaaaagtagaatctgttgtagctctaaatggttaa

SEQ ID NO: 26270 - protein, 155 aa, Unknown
  Obtained from environmental sample
  DOMAIN (82)...(153): NifU-like domain
  misc_feature (1)..(155): Xaa is any amino acid
MATALFHLPFVKSVFFDENYVSITKYDIAEWNDISFELREFIKNYIEDAKEIVSPNAPEVVEKSVEKVEAHFETLDDTSKQIVNILEEYIKPAVASDGGNIQFESYDETTKTVKVILQGACSGCPSSTFTLKNGIENMLKEMLAGKVESVVALNG

SEQ ID NO: 26271 - DNA, 420 bp, Unknown
  Obtained from environmental sample
  misc_feature (1)..(420): n is a, c, g, or t
atgaaaaaatcaatgcagcgtaaattgccacaaattaagcagcaaatatcgataactaccgatcaattaatggaaattgacgacttgttagagtttgataatcaacttaccgcgcctttacacggctttgaaaatgcacatgattattaccgccaagccagtgctatgccatatttaaaacatatagcggtgccaacattaattattcatgccaaagacgatcctatgctctctataaaggccgtaccaagtaggcaagatgtgagtgagcatgttacgctgcgcatctctgaaaaaggcgggcatgtgggctttattagcggtaaaaatccatttaagccggtattttggttagagcaagcggtgccaagttattttggccaatatgtattaaataaaaccaacaaagagtcagtatga

SEQ ID NO: 26272 - protein, 139 aa, Unknown
  Obtained from environmental sample
  misc_feature (1)..(139): Xaa is any amino acid
MKKSMQRKLPQIKQQISITTDQLMEIDDLLEFDNQLTAPLHGFENAHDYYRQASAMPYLKHIAVPTLIIHAKDDPMLSIKAVPSRQDVSEHVTLRISEKGGHVGFISGKNPFKPVFWLEQAVPSYFGQYVLNKTNKESV

SEQ ID NO: 26273 - DNA, 345 bp, Unknown
  Obtained from environmental sample
  misc_feature (1)..(345): n is a, c, g, or t
ttgtttaatagatctatattctataaaataaaggcattcatatatagatatcgcaaccaagacattaaggataccattatgggcagtttttccattacgcattggctgatattattggtggtagtggtggtcgtatttggcacctcaaagcttagaaatgccggaaaggatttgggcggtgctgttaaaggctttaaagaggcagtcaaagacgaaaatgcagagcatgccaaaaaacaggtggttctcgatcatgatggcaatgcacacccaacagatcgcgccgaaaccaataaagtgccagatagcgatattgacactgtgcctgttgacgataagcacccn

SEQ ID NO: 26274 - protein, 115 aa, Unknown
  Obtained from environmental sample
  DOMAIN (30)...(84): mttA/Hcf106 family
  misc_feature (1)..(115): Xaa is any amino acid
MFNRSIFYKIKAFIYRYRNQDIKDTIMGSFSITHWLILLVVVVVVFGTSKLRNAGKDLGGAVKGFKEAVKDENAEHAKKQVVLDHDGNAHPTDRAETNKVPDSDIDTVPVDDKHP

SEQ ID NO: 26275 - DNA, 324 bp, Unknown
  Obtained from environmental sample
  misc_feature (1)..(324): n is a, c, g, or t
atgcgtatgaagaaggaagtcaccaccctaaaaaaaatagctgaatctctaaacatttcaatttcaacagtttctagagctttgaatgatcatcaagatattagtagccagactaaagaaaaagtaaaaaaattggccaaggaaatgaattacatcccaaatcttttcgcaaaaggatttcgacaacatcggtctaatatcataggagttgtggtttcaaatgtcacacatcattatacgaccaccatcataagagggattcttgaagaagctgcggcacgagttatagggtggattatttctgaatccaataatgatagttga

SEQ ID NO: 26276 - protein, 107 aa, Unknown
  Obtained from environmental sample
  DOMAIN (8)...(33): Bacterial regulatory proteins, lacI family
  misc_feature (1)..(107): Xaa is any amino acid
MRMKKEVTTLKKIAESLNISISTVSRALNDHQDISSQTKEKVKKLAKEMNYIPNLFAKGFRQHRSNIIGVVVSNVTHHYTTTIIRGILEEAAARVIGWIISESNNDS

SEQ ID NO: 26277 - DNA, 471 bp, Unknown
  Obtained from environmental sample
  misc_feature (1)..(471): n is a, c, g, or t
atgttagaaatagaacgtaaatttttggttaattcttcaagttataagtccgaagcttttaaacaaacccaaattatacaaggatttttaaatacccacaaagcgcgaactgttcgggttagagtaaaaggggataagggctatttaacggttaaaggtgagtcgtctagtaatgggctaacccgttttgaatgggagaaggaaataactaaaaaagaagccgaatcacttttgaatttatgtgagcctggtgtgattagcaaaataagatatgaggttaaagtagaggatcacatctttgaaatcgatgaattttcaggtgataatttggggttagtaatagctgaagtggaattgaattctgaaactgaaaattttaaaaagcctgaatggttgggagaggaagtgacaggagatattaagtattataattcgcaattaagtaatacaccttattgcgattggaaataa

SEQ ID NO: 26278 - protein, 156 aa, Unknown
  Obtained from environmental sample
  DOMAIN (1)...(149): CYTH domain
  misc_feature (1)..(156): Xaa is any amino acid
MLEIERKFLVNSSSYKSEAFKQTQIIQGFLNTHKARTVRVRVKGDKGYLTVKGESSSNGLTRFEWEKEITKKEAESLLNLCEPGVISKIRYEVKVEDHIFEIDEFSGDNLGLVIAEVELNSETENFKKPEWLGEEVTGDIKYYNSQLSNTPYCDWK

SEQ ID NO: 26279 - DNA, 870 bp, Unknown
  Obtained from environmental sample
  misc_feature (1)..(870): n is a, c, g, or t
atggcagcaaccgcatacaaatttggtaatgacaccccctatctttataagactttagattatggaaaaacctggaaattaattaccagcggcattccacatgaagaattcacacgttgtatagaagcagataccaaccgaaaaggcttactatatacaggtacagaatggggggtgtttgtatcttttgatgatggtgtgtcctggaaaccaatgccattgaatttgcctattgtttcaataagagatttactaattaaggacagtaagttaattactgcaactcatggtagagggttttggattattgacgatttagcagttttgcatcaaatgagtgatgctattttagaaaaacaatcgtacttattcaaacccaatagagcttaccggccaggaaaagtcaattttagttttttttctaataatggaaaagatgcgactctggaaattctttctaataaagatgaatccatcatttcttttgatattgaaaaattaaaaggaagtgaattaatgtcttgggatatgcgctatcctggattcgaaccatttgaaggcatgcatttttactcgtcacccaatcgcggtccaaaagcagttccgggcacttataaagcacgattcatttctggaaaagataccattatacaagctttcgaaatattaaaagacccccgactcactgtaactcanaccgaattggaacagcagtttactttctcaatgaaagttagagaaagtgtcactaaagccaataataagctaacagagattagagtattacgtacgtctatttcagataaaaattctggggacgctaaacaattaaaagcattagaaaatcaattacaagaccagcgtatttga

SEQ ID NO: 26280 - protein, 289 aa, Unknown
  Obtained from environmental sample
  misc_feature (1)..(289): Xaa is any amino acid
MAATAYKFGNDTPYLYKTLDYGKTWKLITSGIPHEEFTRCIEADTNRKGLLYTGTEWGVFVSFDDGVSWKPMPLNLPIVSIRDLLIKDSKLITATHGRGFWIIDDLAVLHQMSDAILEKQSYLFKPNRAYRPGKVNFSFFSNNGKDATLEILSNKDESIISFDIEKLKGSELMSWDMRYPGFEPFEGMHFYSSPNRGPKAVPGTYKARFISGKDTIIQAFEILKDPRLTVTXTELEQQFTFSMKVRESVTKANNKLTEIRVLRTSISDKNSGDAKQLKALENQLQDQRI

SEQ ID NO: 26281 - DNA, 570 bp, Unknown
  Obtained from environmental sample
  misc_feature (1)..(570): n is a, c, g, or t
ttgcaagttttaggaggttatggtttttgtaccgatttttcgctacancaatattatagagacatcagaatttctgctttgtatgaaggtacaacaggaattcaatcgcaagatttgttgggcaggaaagtaccaatgcaaaatggaaaagggttggaattattatctgcagaaattgtaaaaacaattatttctgcttctatagatgatgatttaaaagtctatggaattattttaggtgataaattaaaacaatctcaaaaaatattgggtcatttaatgccttttgcaatgaaaggaaattacgaacgctatttagcagatgccaatttatttatggaatatatgagtattcttgtgctaggttggttatggttagaaatggctgtagatgcaaaaaagcaaatcaataatgctgataaaaaatattcagaaactttttatgaaagtaaaattcacaccatgaaattctactttaaatatgaagtttctaaaacaaatgcgttagcagaatctttaatgaataatgaagttttaactattaaaaaagataaagaacttattttataa

SEQ ID NO: 26282 - protein, 189 aa, Unknown
  Obtained from environmental sample
  misc_feature (1)..(189): Xaa is any amino acid
MQVLGGYGFCTDFSLXQYYRDIRISALYEGTTGIQSQDLLGRKVPMQNGKGLELLSAEIVKTIISASIDDDLKVYGIILGDKLKQSQKILGHLMPFAMKGNYERYLADANLFMEYMSILVLGWLWLEMAVDAKKQINNADKKYSETFYESKIHTMKFYFKYEVSKTNALAESLMNNEVLTIKKDKELIL

SEQ ID NO: 26283 - DNA, 666 bp, Unknown
  Obtained from environmental sample
  misc_feature (1)..(666): n is a, c, g, or t
atggcaatgggcaagatgatctctgagatttcgcatgatctgaaacgtcctttaacgaatatcaaaggatcattgcagattatggcacagcgttggccccagataacggaaaatgatgatttctttgaaactgccgagcaggagctcagccgtttaaatgaattagttctggagctggtcgacttttccaatcctaaaaaatatcttatggagcaaaagaaaatttctgaagtgattcttcgtgtatatcggttggttgaaaatgatttgaagaaaaagagtattaactttctacaagaatttgaagatgatttagctaacgtaatgattaatgaaaatgagattgttgaggtactgcttaatcttatcttaaatgctattgatgcgatgccggaaggcggaaccttagctataaaagcgataaaagagattgataagaatagtcataagccttttgttaaactgctgatcagcgattccggtattggaatcccaccggaaaatcataataaaatttatgatcgttactttactaccaaagaaacaggtaccggtttagggctggcgatttgtgaccggattattatggcacataatggtcgtcttgattttgaatcagtacaaaatcaaggtactacttttagaatcctcctgccatctgtttaa

SEQ ID NO: 26284 - protein, 221 aa, Unknown
  Obtained from environmental sample
  DOMAIN (2)...(68): His Kinase A (phosphoacceptor) domain
  misc_feature (1)..(221): Xaa is any amino acid
MAMGKMISEISHDLKRPLTNIKGSLQIMAQRWPQITENDDFFETAEQELSRLNELVLELVDFSNPKKYLMEQKKISEVILRVYRLVENDLKKKSINFLQEFEDDLANVMINENEIVEVLLNLILNAIDAMPEGGTLAIKAIKEIDKNSHKPFVKLLISDSGIGIPPENHNKIYDRYFTTKETGTGLGLAICDRIIMAHNGRLDFESVQNQGTTFRILLPSV

SEQ ID NO: 26285 - DNA, 870 bp, Unknown
  Obtained from environmental sample
  misc_feature (1)..(870): n is a, c, g, or t
ttgtcacttattgaaaacgacattagtcgtaccccgcgcgccatcactaaatttatagtggcggtaaccgacccaaaactaggcgagtcaattatggaccctgcttgtggtactggtggctttttagcgtgtgcattcgaccatgtaaaatcaaactatgttaaatcgggcgacgaccaccaaatattacaaaagcaaatacacggcgtagaaaaaaaacaacttccgcatttactgtgtactaccaatatgatgcttcacggcattgaagtaccggtacaagttaaacacggcaataccttaaacaaaccgctttcaagctgggatgaccaagtagatgtcatcatcaccaaccctccgtttggcggcactgaagaagatggcatagaaaaacacttcccaagcgacatgcaaactcgcgaaaccgccgacttgttcttacaactcattatagaagtacttaataccaaagggcgcgcagcagtggtattgccagatggcaccttgtttggtgaaggcgtaaaaaccaaaattaaaaaactattggtagaggaatgtaacttacataccataatacgcttacccaatggcgtgtttaacccgtacaccggtattaaaaccaacatcctgttttttactaaaggcacgccaacaaaagacgtgtggttttacgagcacccatacccagncggtgtcaaacattacaacaaaaacaaaacaatgaagtttgaaaaattaagactgagctcgaatggtgcggcactgaggcagacggttttgcagagcgaaatgaaaccgagcaagcttggaatatcattgagatattatgctcgtattacacttgatttaaaaccggtttggagagtataa

SEQ ID NO: 26286 - protein, 289 aa, Unknown
  Obtained from environmental sample
  DOMAIN (13)...(190): Putative RNA methylase family UPF0020
  misc_feature (1)..(289): Xaa is any amino acid
MSLIENDISRTPRAITKFIVAVTDPKLGESIMDPACGTGGFLACAFDHVKSNYVKSGDDHQILQKQIHGVEKKQLPHLLCTTNMMLHGIEVPVQVKHGNTLNKPLSSWDDQVDVIITNPPFGGTEEDGIEKHFPSDMQTRETADLFLQLIIEVLNTKGRAAVVLPDGTLFGEGVKTKIKKLLVEECNLHTIIRLPNGVFNPYTGIKTNILFFTKGTPTKDVWFYEHPYPXGVKHYNKNKTMKFEKLRLSSNGAALRQTVLQSEMKPSKLGISLRYYARITLDLKPVWRV

SEQ ID NO: 26287 - DNA, 501 bp, Unknown
  Obtained from environmental sample
  misc_feature (1)..(501): n is a, c, g, or t
ttgattcggctcgagtatcaaagcttaagctattggaagatcaacggttttgaagtgtatgaggaagctataaataatgtggctgtaacttatgccaatactaccgaagggatacaggcacaagagattattaatggttctttggaagcactgcgttcttcagaattctctgaaaacgacagttttaaaagttttaaagttatttatgaattcgataacataccagaaaatggtttggaggattttgtaaaaatgttagatgaaagcgttaaaaaagtagcatattttaatttaagtacttcggtggatgtgtataataaagaaaagacttttgtggtggttcacggtttaaaaagtattgaaggatcgcaaggctttattcaacttttagataaagaagaccagaaaaaaataaaacgcccgtttttctctatttcttcaaaaaactaccgtacacttcaaattcataaaaatttagacgcgtataaagcgattcagtaa

SEQ ID NO: 26288 - protein, 166 aa, Unknown
  Obtained from environmental sample
  misc_feature (1)..(166): Xaa is any amino acid
MIRLEYQSLSYWKINGFEVYEEAINNVAVTYANTTEGIQAQEIINGSLEALRSSEFSENDSFKSFKVIYEFDNIPENGLEDFVKMLDESVKKVAYFNLSTSVDVYNKEKTFVVVHGLKSIEGSQGFIQLLDKEDQKKIKRPFFSISSKNYRTLQIHKNLDAYKAIQ

SEQ ID NO: 26289 - DNA, 540 bp, Unknown
  Obtained from environmental sample
  misc_feature (1)..(540): n is a, c, g, or t
ttgctcatcaccttaaggattctcatgattttcattgttatactgataatgcatcgggggcgcactacaggttttcctttacctattattgtatggacaagtaaagggttaaagacttttatgtcttcggcgtttcatcataatgataacggtcaggttattgtagaaaaagacgggactcaattagtaaaacaccactccaatatatacgagttagaaaagggtgcaactgcacttaattttaacgaagaacaccatcctacaaatgcatcaaaagttattgacttttctataactaaaagtgttttcggaatgttattaacaggattattaatgttgttagcatttggagcattagcaagaggttataaaaaagggaaaacaattcctaaaggattttctagagttttagaacctttagtaatttatgtgcgtgacgaaatcgcaagaccaaatattggagagaaaaagtaccgtaaatttatgggcttcctattaacggtgttcttttttatctggatattaaatctattggtttaa

SEQ ID NO: 26290 - protein, 179 aa, Unknown
  Obtained from environmental sample
  misc_feature (1)..(179): Xaa is any amino acid
MLITLRILMIFIVILIMHRGRTTGFPLPIIVWTSKGLKTFMSSAFHHNDNGQVIVEKDGTQLVKHHSNIYELEKGATALNFNEEHHPTNASKVIDFSITKSVFGMLLTGLLMLLAFGALARGYKKGKTIPKGFSRVLEPLVIYVRDEIARPNIGEKKYRKFMGFLLTVFFFIWILNLLV

SEQ ID NO: 26291 - DNA, 468 bp, Unknown
  Obtained from environmental sample
  misc_feature (1)..(468): n is a, c, g, or t
atgaataatatggtaacaacagaaggaattgcaaaaagaacaaaaaaaattcaagaaactcaagatgaaagaaatgaaaaatattacgcatggttaaagaatttaattactatttcaattgctctttttggtttaataatttcatttaaaagtggaataataaaaactaaattagaatcacttttttttataatatccatattttcactcggacttggaatcctttttgctctattaactttatttggagaagtaagagttttagatcttctgagaaaaaaatattatgaattaactttatcttacatagatggagaaagtaaaaaagtagaattcgaaaacgtaaatgtaccccccttatataaactttcatcttatttatatgtaattttctatataatttcattggtaactttaattttatactcaacaattgaggaattaaaagcagttgtaacttccctttaa

SEQ ID NO: 26292 - protein, 155 aa, Unknown
  Obtained from environmental sample
  misc_feature (1)..(155): Xaa is any amino acid
MNNMVTTEGIAKRTKKIQETQDERNEKYYAWLKNLITISIALFGLIISFKSGIIKTKLESLFFIISIFSLGLGILFALLTLFGEVRVLDLLRKKYYELTLSYIDGESKKVEFENVNVPPLYKLSSYLYVIFYIISLVTLILYSTIEELKAVVTSL

SEQ ID NO: 26293 - DNA, 543 bp, Unknown
  Obtained from environmental sample
  misc_feature (1)..(543): n is a, c, g, or t
atgaaattcacatcaaaaatatgttttataaatttctttaaaaaatactatctttcaacttcaattttaaagaacatgaaaaacgcccaagaatactttgatgaatatgctgtaagtcatcaaaatgaaactaatcaagctatccattatatttgtgtaccacttattttctttagcgtcattggtttgttgatgtgcataccaacttcttttttaagagatacttttggtttgtacaatcctttattagaaaattgggcagcagttgttggtgttgttatttccttcttttatttaaaattaggcttttggcattttgtggaaatgctttttgtgatgctaatttgtatcattcttaatttttggattggtaacaattttaatttactgattgtttccatcaccatttttgtgttggcttggattggtcagttttatggtcataaagtggaaggtgcaaaaccatcattcttaaaagatttagaatttttattaattggtccactttgggtgattcagaaattagggaggaagaagaaatag

SEQ ID NO: 26294 - protein, 180 aa, Unknown
  Obtained from environmental sample
  DOMAIN (26)...(179): Protein of unknown function (DUF962)
  misc_feature (1)..(180): Xaa is any amino acid
MKFTSKICFINFFKKYYLSTSILKNMKNAQEYFDEYAVSHQNETNQAIHYICVPLIFFSVIGLLMCIPTSFLRDTFGLYNPLLENWAAVVGVVISFFYLKLGFWHFVEMLFVMLICIILNFWIGNNFNLLIVSITIFVLAWIGQFYGHKVEGAKPSFLKDLEFLLIGPLWVIQKLGRKKK

SEQ ID NO: 26295 - DNA, 642 bp, Unknown
  Obtained from environmental sample
  misc_feature (1)..(642): n is a, c, g, or t
atggagaattgtttccattgtggtgatgtatgcgatagaactttaattaaatatgaagagaaacacttttgttgtcatggttgcaaaacagtgttcgatattttaaatgaaaatgatctctcatattattacgatttacagcagacgccaggaattacaccttctcgaatagaaggtaaatacgactttcttgagaataaaataatttcagaaaaattattagaatttaacgaacaaggtattcaggtagtaacattactaattccatcaatacattgtagttcgtgtatttgggttttagagaatttaaataaactgaatccagctgttaaaacagcacaagtcgattttcctaaaaaaacggttcgtattacgtattcgagtgatcagttaaatttacacgacttagtaaccttgttagctagattaggttacgatccttatatttcattagaagatgcttccgaaaagaaatccaagacagaccgtactttaatttataaattaggaattgcaggtttggctttcggaaacattatgtttctgtcatttccagaatattttaaagtcgatgagctttggttggaacgttataaacacgtgtataggtgggtgatgtttaggcttttcgcttcccgttga

SEQ ID NO: 26296 - protein, 213 aa, Unknown
  Obtained from environmental sample
  misc_feature (1)..(213): Xaa is any amino acid
MENCFHCGDVCDRTLIKYEEKHFCCHGCKTVFDILNENDLSYYYDLQQTPGITPSRIEGKYDFLENKIISEKLLEFNEQGIQVVTLLIPSIHCSSCIWVLENLNKLNPAVKTAQVDFPKKTVRITYSSDQLNLHDLVTLLARLGYDPYISLEDASEKKSKTDRTLIYKLGIAGLAFGNIMFLSFPEYFKVDELWLERYKHVYRWVMFRLFASR

SEQ ID NO: 26297 - DNA, 753 bp, Unknown
  Obtained from environmental sample
  misc_feature (1)..(753): n is a, c, g, or t
ttgtttttaggtacaactggtgttggtaaaccagagttagctaaagcattagccagaatattctgtttgatgatgaaagcgcgatggaccagaatagatatgagcgtataccaagagcgtcatgcgttaagcagattagttggtgcgcctccaggatatgttggttatgatgaaggtgggcaactaaccgaagcagttagacgtaaaccatattctgtagtgcttttagacgaaattgaaaaagcgcatccagacacgtttaatattttattacaagtgttagacgaaggacatttaacagataataaaggtcgtattgcagattttaaaaacactattattatcatgacctccaacatgggaagtcaaataatacaagagcgttttgatgctgtaaaagatgtagaaactgctattgaaggtgctaaagtggatgttttagccttattaaaacaaacggtaagacctgagtttataaataggattgatgacataattatgtttacacctttaacacaagataatattacagaaattgtaggattacagctaaaaggtatttctaaaatgattgcaaaacaagggataacttttgatgcaacacctgaagctattaaatatctagcagataaaggttataatccagaatatggtgcaagacctgtaaaacgtgtcattcagaaagatgtacgtaaccaattaagtaaagagattttatcaggaaaagtaacaacagatagtaatcttctatga

SEQ ID NO: 26298 - protein, 250 aa, Unknown
  Obtained from environmental sample
  misc_feature (1)..(250): Xaa is any amino acid
MFLGTTGVGKPELAKALARIFCLMMKARWTRIDMSVYQERHALSRLVGAPPGYVGYDEGGQLTEAVRRKPYSVVLLDEIEKAHPDTFNILLQVLDEGHLTDNKGRIADFKNTIIIMTSNMGSQIIQERFDAVKDVETAIEGAKVDVLALLKQTVRPEFINRIDDIIMFTPLTQDNITEIVGLQLKGISKMIAKQGITFDATPEAIKYLADKGYNPEYGARPVKRVIQKDVRNQLSKEILSGKVTTDSNLL

SEQ ID NO: 26299 - DNA, 405 bp, Unknown
  Obtained from environmental sample
  misc_feature (1)..(405): n is a, c, g, or t
gtgatcagaatcggctcgagtgtagaagaaaatgcaaaaataacagatgaagtatgggacagcataatatctaaagcagccaaatcaagagaaaacgagagagttttgaaaaataaaggattgttagatacggataataaattatcttcgtcttataacaatgtgcttgatgaattaataaaatactatggtcgtatgttaattccagaggacagccatagttctctctcgtctttctttaataatcgaacacctgacaaaggtgaaaaaattccaaataagggtgagcagatcataaaatctcttaatgaatcgaaagtaaaaagtgaatgtttaaaaaagataaatgttgtttctaaagatactgatttcactaatgacgattcggatgatgataaaaattag

SEQ ID NO: 26300 - protein, 134 aa, Unknown
  Obtained from environmental sample
  misc_feature (1)..(134): Xaa is any amino acid
MIRIGSSVEENAKITDEVWDSIISKAAKSRENERVLKNKGLLDTDNKLSSSYNNVLDELIKYYGRMLIPEDSHSSLSSFFNNRTPDKGEKIPNKGEQIIKSLNESKVKSECLKKINVVSKDTDFTNDDSDDDKN

SEQ ID NO: 26301 - DNA, 810 bp, Unknown
  Obtained from environmental sample
  misc_feature (1)..(810): n is a, c, g, or t
atggatcaagaatcggctcgagatataaagaaatttaaaaaaaagcttaatgaaagtaatacttcagaagggattagcctttacattcatctgccattttgcgagagtttatgtaccttttgtgggtgtaataaacgtatcacaaaaaaccatacagtagaaatgccttaccttaaagcggttttaaaagaattgtctttatacaaaactcttttaggtgaaaaacctattataaaacaaattcatttaggtggaggaacaccaacatttttcacccctgaaaatctaaattttttaataactggtatttttaaaattgcaaaaaaagcagaacattacgattttagttttgaaggtcaccccaacaacacaacaaagacgcatttaaaaacactagccgaaaatggctttacacggatatgttatggtgttcaagattataacgatacggtacaaagagcaattaatcgtattcagcctttcgagaatgtgctcaatgccacacaaaacgctagagatgctggttacacttctgtgggtcacgatattatttacggcttaccgtttcaaacagaagctcacgtaattaatactatagaaaaaacgattgcacttaaaaccaatcgtattgctttttacagctatgcacacgtgccgtggataaaaggaaatggccaacgtggctataaggaagaaaacttaacgaattccgaattaaagcgtctgcaatacgaaactggaaaacaactattattagatgcgggttatgtggagattggaatggatcattttgccttaaaaagcgaatag

SEQ ID NO: 26302 - protein, 269 aa, Unknown
  Obtained from environmental sample
  DOMAIN (28)...(202): Radical SAM superfamily
  misc_feature (1)..(269): Xaa is any amino acid
MDQESARDIKKFKKKLNESNTSEGISLYIHLPFCESLCTFCGCNKRITKNHTVEMPYLKAVLKELSLYKTLLGEKPIIKQIHLGGGTPTFFTPENLNFLITGIFKIAKKAEHYDFSFEGHPNNTTKTHLKTLAENGFTRICYGVQDYNDTVQRAINRIQPFENVLNATQNARDAGYTSVGHDIIYGLPFQTEAHVINTIEKTIALKTNRIAFYSYAHVPWIKGNGQRGYKEENLTNSELKRLQYETGKQLLLDAGYVEIGMDHFALKSE

SEQ ID NO: 26303 - DNA, 432 bp, Unknown
  Obtained from environmental sample
  misc_feature (1)..(432): n is a, c, g, or t
atgcaacctaaaattctaagatttttacaagaaggagaaattgaagtcgttgttggattaggatctaaaaaattagatgtacgcgtcattgcagcaaccaatagaaacttattggcagagatagagaaaaagcaatttagagaagatttatactttagattaaatgtatttccaattgcggttccagccttaagagatcgtaaggatgatattccattgttagtagagcattttgtagataaatttggtaaaacttatgaaaaacagatcaaatatatatctgatgatgcgatgtcccaactcaaagcttacaattggtctggaaatattagagagcttgaaaacttaattgagcgcgcattaatactatctaatagcgatactttaattattcctggttttgtaaacattaatcaaaaatctaagcaatga

SEQ ID NO: 26304 - protein, 143 aa, Unknown
  Obtained from environmental sample
  DOMAIN (1)...(114): Sigma-54 interaction domain
  misc_feature (1)..(143): Xaa is any amino acid
MQPKILRFLQEGEIEVVVGLGSKKLDVRVIAATNRNLLAEIEKKQFREDLYFRLNVFPIAVPALRDRKDDIPLLVEHFVDKFGKTYEKQIKYISDDAMSQLKAYNWSGNIRELENLIERALILSNSDTLIIPGFVNINQKSKQ

SEQ ID NO: 26305 - DNA, 387 bp, Unknown
  Obtained from environmental sample
  misc_feature (1)..(387): n is a, c, g, or t
gtggcttctggcttattggtttttttagcattgcatcctactcagtctaacgcacaacaaacccccaagccagttatacaatctataataaataataatcaaattcaaggtaaagtagcggtttctatattaaaagaacgttttatttctgaaactgttctagatgaaaacaatttaccgcttcccgacgtaaaagttactataaaaggaaaacctataggagttttaaccgattttgatggatattataaactgaaagcacaaaaagatgatgttttagaatttcgttatataggttataatacaatggaattaataatgaatcaagatagcgtttttaatatttcatttgaagaccaaaagaaaacaacgacaattaaatcgtaa

SEQ ID NO: 26306 - protein, 128 aa, Unknown
  Obtained from environmental sample
  SIGNAL (1)...(18)
  misc_feature (1)..(128): Xaa is any amino acid
MASGLLVFLALHPTQSNAQQTPKPVIQSIINNNQIQGKVAVSILKERFISETVLDENNLPLPDVKVTIKGKPIGVLTDFDGYYKLKAQKDDVLEFRYIGYNTMELIMNQDSVFNISFEDQKKTTTIKS

SEQ ID NO: 26307 - DNA, 618 bp, Unknown
  Obtained from environmental sample
  misc_feature (1)..(618): n is a, c, g, or t
ttgaccacccatatgaatgtaggccaacaatttgatttttcaatcattgccaagctctctggagtaggctctaagcagctacatgcacttaatcaagggtatttaaaaaatcaaagttcacccaatggtccgcatacgttattactgccaattgagcaacaggcactattaaacagctcgttttttaaaactaactttgctggagagtacatagttaaacaaaacgatacgctttacagtattgctaggcgctttggcatgcctttaagtaccttaaagcaacttaataataaacaaaacaacttaattggcgttggtgaaaaattacttgttggccagcccaaaacacttccggaatcattgactattgattataaaattagcccctaccttgagcatcaagaagtggtaattgcaacactcgaaatagactatgaagtgcaaccaggcgataccttgtggagcattagccagctttacaatgtgccgcatagtgacctagctaaatggaataaactgtcagcgccgagtatgctcaaancaggtattcaattagtgttatttattcctcaggccgaaaaggctcaagtaacaactattaaaaaagattattggtag

SEQ ID NO: 26308 - protein, 205 aa, Unknown
  Obtained from environmental sample
  DOMAIN (145)...(188): LysM domain
  misc_feature (1)..(205): Xaa is any amino acid
MTTHMNVGQQFDFSIIAKLSGVGSKQLHALNQGYLKNQSSPNGPHTLLLPIEQQALLNSSFFKTNFAGEYIVKQNDTLYSIARRFGMPLSTLKQLNNKQNNLIGVGEKLLVGQPKTLPESLTIDYKISPYLEHQEVVIATLEIDYEVQPGDTLWSISQLYNVPHSDLAKWNKLSAPSMLKXGIQLVLFIPQAEKAQVTTIKKDYW

SEQ ID NO: 26309 - DNA, 453 bp, Unknown
  Obtained from environmental sample
  misc_feature (1)..(453): n is a, c, g, or t
atgccgttgcgaaaacacggtggttatagaaatgcaaattctaaatttgtacatctcacagctccatacaataaatataaattgatttctaggttatcatttgataatatttctttagatagactgcaaaaacgtacaacaggctatattgaagcacaaaaaagcatagctgtaagtggtttgggcagtgttggctcacatttaatttattttctacgaaatttaccgatcaataaatttcatttaattgataacgattcactttctcctgaaaatattaaaaggcattatttagggcttttatattcgaagcaaaaaaaagttgatgcaataaagaacgatttaaacaatttaaaccctttgtataaaattgaagttagggatgattctataaataatttaatattaaatgagcaacaatacaacctcaaaaatatattcatggattggtga

SEQ ID NO: 26310 - protein, 150 aa, Unknown
  Obtained from environmental sample
  misc_feature (1)..(150): Xaa is any amino acid
MPLRKHGGYRNANSKFVHLTAPYNKYKLISRLSFDNISLDRLQKRTTGYIEAQKSIAVSGLGSVGSHLIYFLRNLPINKFHLIDNDSLSPENIKRHYLGLLYSKQKKVDAIKNDLNNLNPLYKIEVRDDSINNLILNEQQYNLKNIFMDW

SEQ ID NO: 26311 - DNA, 495 bp, Unknown
  Obtained from environmental sample
  misc_feature (1)..(495): n is a, c, g, or t
atgacaaataataatcataaaagaagaaaagataaaatttacaaacaattatcacgaacaaatatatattttactttttggttaatattaatgatgattgcgagatttggttcgattcttcctttcattttgtttggaacgccaggttatgataatcaattaaatttattcgaagaatattggtttttatttgttttaattccaattgtagtttttgcccaaaattggtttattgttagattagtttatcgttctacaaagtggatattttattcaatcttaatttgtgtagcaataacatttacattaaaaactacaacatcaattaatcaagaaattttaaacagagcttattataaaaaatttgaatcggattataattatattgaccaacaaataaataaagcaaaagttgaatacggaattgatcttaaagaaaatacattagaaacattaaaacaatggaaactgaaagtcaaccgaacaagtagttaa

SEQ ID NO: 26312 - protein, 164 aa, Unknown
  Obtained from environmental sample
  misc_feature (1)..(164): Xaa is any amino acid
MTNNNHKRRKDKIYKQLSRTNIYFTFWLILMMIARFGSILPFILFGTPGYDNQLNLFEEYWFLFVLIPIVVFAQNWFIVRLVYRSTKWIFYSILICVAITFTLKTTTSINQEILNRAYYKKFESDYNYIDQQINKAKVEYGIDLKENTLETLKQWKLKVNRTSS

SEQ ID NO: 26313 - DNA, 471 bp, Unknown
  Obtained from environmental sample
  misc_feature (1)..(471): n is a, c, g, or t
ttgtcaaaacatatagaccaggctccagaatgttttagtcctaatgtaattatgcgtccattgtatcaagaagttattttgccaaatttatgttacattggtggaggtggtgagctagcttactggtttcagttaaaagctaattttgaagctaataatgtcgtttttccaatattacttttacgtaattcggttttaataaaaacaaaacagcaagcagataaacttaaaaaactaagcatatctgataaggacttgtttttaaaacgtgatagttttattaacaaaaaagtacgagaaatttctaatattgatattgatttttctgagcaaattcaacatctaaaatcacagtttcaacaactttataagcttgcagaatcaacggataagtcttttgttggtgctgtagcttctcaagaaaaaaagcaaattactgggttgggcacatcttggaaaccagattgttaa

SEQ ID NO: 26314 - protein, 156 aa, Unknown
  Obtained from environmental sample
  misc_feature (1)..(156): Xaa is any amino acid
MSKHIDQAPECFSPNVIMRPLYQEVILPNLCYIGGGGELAYWFQLKANFEANNVVFPILLLRNSVLIKTKQQADKLKKLSISDKDLFLKRDSFINKKVREISNIDIDFSEQIQHLKSQFQQLYKLAESTDKSFVGAVASQEKKQITGLGTSWKPDC

SEQ ID NO: 26315 - DNA, 393 bp, Unknown
  Obtained from environmental sample
  misc_feature (1)..(393): n is a, c, g, or t
atgaaagagtcatttgttctatgttcaagttgtttttctaatcaaggtttaaaaatttcagcacagaagctcggtactaaaagcaatacgagctgtaaaggttgtaatgagagtaagggctataaactgacaaagaatattttaaatgatttagctcatcagtttttcgtaatgggaagtagcattaaaagtgattatggaggcgcaccccgaatccagttcaatgagcatcaagaaacaagcattatttgtactgatgatattaatcaagatataaagctatttgaaaaatatcttggtgtgggattttttcactatgggtctagattatggactctaggttatattacacccttggaagaactcaagatgaaattagaaatgtttttataa

SEQ ID NO: 26316 - protein, 130 aa, Unknown
  Obtained from environmental sample
  misc_feature (1)..(130): Xaa is any amino acid
MKESFVLCSSCFSNQGLKISAQKLGTKSNTSCKGCNESKGYKLTKNILNDLAHQFFVMGSSIKSDYGGAPRIQFNEHQETSIICTDDINQDIKLFEKYLGVGFFHYGSRLWTLGYITPLEELKMKLEMFL

SEQ ID NO: 26317 - DNA, 321 bp, Unknown
  Obtained from environmental sample
  misc_feature (1)..(321): n is a, c, g, or t
ttgcctagtttttcatcggacaaagaaaaatattgtatttctggacgtggaattttaacagcttactacaatgttaaaaatttagaagttcgtttatctaagcatttaataagagcaccttttacaggagttttaatagaaactttagtgacttctggaactttggtaagatctggccgaaaattaggcgagtttatagatacagatatttacgaattggaggtttctataaattctgaatttgcagatttattaaaagttggcaatgcagttgagcacacagttgcgtaccaaactaaactatctaagcgaagtgtctga

SEQ ID NO: 26318 - protein, 106 aa, Unknown
  Obtained from environmental sample
  misc_feature (1)..(106): Xaa is any amino acid
MPSFSSDKEKYCISGRGILTAYYNVKNLEVRLSKHLIRAPFTGVLIETLVTSGTLVRSGRKLGEFIDTDIYELEVSINSEFADLLKVGNAVEHTVAYQTKLSKRSV

SEQ ID NO: 26319 - DNA, 510 bp, Unknown
  Obtained from environmental sample
  misc_feature (1)..(510): n is a, c, g, or t
atgcctatagaatacgatgttgcagaagtgagaaatggtggtagtttttctacaaggagagttactgctagtcaaaaaggaagaaccatttgtattatggcagcttcttgtcatattaaagaagatggttttgagcatcaaacagatataaaaatcgatattaaacaacctgaagaattgttaagttgggaagaaatggttgtaaaatttggtgctattttaccaaaaagaatttcatcttttttaaagattgaaagaccaatagattttaaacctgtgcatactccaaatcctttacaaccaaaaaatttacctgcaaaagaagaagtttggtttaaattaaaaggcgatattccaaaaatggatattcaactgaaacatcaaattttaacttatatttctgattacaatgttttaaatgcagcttttaatccgaatgcaaaagattataattttggcaatacaattactgctagtttagatcattctatgtgttttttagagatttga

SEQ ID NO: 26320 - protein, 169 aa, Unknown
  Obtained from environmental sample
  misc_feature (1)..(169): Xaa is any amino acid
MPIEYDVAEVRNGGSFSTRRVTASQKGRTICIMAASCHIKEDGFEHQTDIKIDIKQPEELLSWEEMVVKFGAILPKRISSFLKIERPIDFKPVHTPNPLQPKNLPAKEEVWFKLKGDIPKMDIQLKHQILTYISDYNVLNAAFNPNAKDYNFGNTITASLDHSMCFLEI

SEQ ID NO: 26321 - DNA, 588 bp, Unknown
  Obtained from environmental sample
  misc_feature (1)..(588): n is a, c, g, or t
atgaacaaattaacaatcctaatacattgtaatgaccaatcaggaattattgcaagtgttacaaattttattgccaataataatggtaacattgtttacatagaccaatatgttgatagagaacaaaacatattttttatgcgtttggaaagcgaatttgaacgaaacacatttaatatcgaagcttttaaggttacttttaaaaatgagttagccgatcgtgttaaaatgaaatggcgtatttactctgccaaaacaaaaccaaaaatggcactatttgtatccaaatatgaccattgcttatatgatatattaggacgttataactctggagaattagacgtagacattccgtttataattagtaaccacaacactttaaaacccattgcagacagttttaatataccgttttatcatattccagttantaaagagactaaagccaaagcagaagaccagcaattaaaactttgtaaaaaacatggtattaattttattgttttggcacgctatatgcaaattgtatccaataaaataataagtcaatatctaaataaggttattaatatacaccactctttttaa

SEQ ID NO: 26322 - protein, 195 aa, Unknown
  Obtained from environmental sample
  DOMAIN (4)...(83): ACT domain
  misc_feature (1)..(195): Xaa is any amino acid
MNKLTILIHCNDQSGIIASVTNFIANNNGNIVYIDQYVDREQNIFFMRLESEFERNTFNIEAFKVTFKNELADRVKMKWRIYSAKTKPKMALFVSKYDHCLYDILGRYNSGELDVDIPFIISNHNTLKPIADSFNIPFYHIPVXKETKAKAEDQQLKLCKKHGINFIVLARYMQIVSNKIISQYLNKVINIHHSF

SEQ ID NO: 26323 - DNA, 714 bp, Unknown
  Obtained from environmental sample
  misc_feature (1)..(714): n is a, c, g, or t
atgttatcgaatactttcgagccgaaagataaagttataaacactatttcttctactttaaaaggacataaattcccgaagaaaattgtaacgcctgtcgcagcagatattatgattaaagaggttgaagccttgttagaaaacgacaaacgccttttagtgagtaaaaattatgaagtgtatttggcaccagctaaagacattccaaatattattagagagattgggcgtttgcgagagattacctttagagaagtaggggaaggaaccaatgaagcaatcgatttagatagttttgatacgtattatcaccatatgtttttatgggatagtgaagccgaaataatagcaggggcgtatagaatgggtttaggttctaaaattttcgcgaaatacggtatagatgggttctatttacaagatttatttcgatttgagccagaattacataaaatgatgggcgaatctatagaacttggtcgtgcatttattattaagagttatcaacaaaaaccaatgcctttatttttattatggaagggtattgtacacactaccttacgtttcccagagcataaatatttaattgggggggttagtattagtaatcagttttctaatttctcgaaatcgctaatgatcgagtttatgaaatcgcattattacgacccgtatgtggcacaatatgtccatccaaaaaagaatttaaagtga

SEQ ID NO: 26324 - protein, 237 aa, Unknown
  Obtained from environmental sample
  misc_feature (1)..(237): Xaa is any amino acid
MLSNTFEPKDKVINTISSTLKGHKFPKKIVTPVAADIMIKEVEALLENDKRLLVSKNYEVYLAPAKDIPNIIREIGRLREITFREVGEGTNEAIDLDSFDTYYHHMFLWDSEAEIIAGAYRMGLGSKIFAKYGIDGFYLQDLFRFEPELHKMMGESIELGRAFIIKSYQQKPMPLFLLWKGIVHTTLRFPEHKYLIGGVSISNQFSNFSKSLMIEFMKSHYYDPYVAQYVHPKKNLK

SEQ ID NO: 26325 - DNA, 324 bp, Unknown
  Obtained from environmental sample
  misc_feature (1)..(324): n is a, c, g, or t
gtgcatatcaaaggcatcaaagacgtgcctatagataaaataacgggctacgtgagtgtacaccgctatcgttttaaaccgatagaggtacaagtagaatctctagccaaaaaaatggagattagcaatgacgaggcaatggcgatagttgttaaacgcaaagctgaattaaagctgccttttatcagaatgtttagtgaaagcaataaagcccattatccattgcaaattttacaacaacctagtaaacaggacgtaactggtggttttaatgtatacggtatgaatggcatgcgcgataacgttactgtgccgcagtggtag

SEQ ID NO: 26326 - protein, 107 aa, Unknown
  Obtained from environmental sample
  misc_feature (1)..(107): Xaa is any amino acid
MHIKGIKDVPIDKITGYVSVHRYRFKPIEVQVESLAKKMEISNDEAMAIVVKRKAELKLPFIRMFSESNKAHYPLQILQQPSKQDVTGGFNVYGMNGMRDNVTVPQW

SEQ ID NO: 26327 - DNA, 738 bp, Unknown
  Obtained from environmental sample
  misc_feature (1)..(738): n is a, c, g, or t
ttgatagtccaaaaagcaataaaaaacgtaaaaacaatagaagtagaaacaaaaagcctgtccataacaaagctgaggttaaaactactgataacaaaaaagctaaacctaacaaaagggttaatacaaataataaaaatcaggccaatagcaaagcgcaaccaaataaaaaccaaccaaataaaagtcaggcaaatagtgctaagccaaaacctaaacctaggccaaaacgtaagccaaacaaaaaaagacctgaaaacaataacaattcaactaatgaaaataagtaaaattctagttgtcttattgctagtattgctatcgtcatgcgatgataaagcggtgtttgatcagtatcaaagtgtttcaacatcttggaacaaaaaagatgtagttaattttaaaataaacgcgccagactctatcaatccttataatttatttgttaacgttagaaatacaaatgattataaatttagtaatttgtatttaatcgtcgaaatgaattttcctcacggaaaaactttaacagatactttagagtacgatatgactaaaaaaaatggtgagtggttaggtgaagggttatcatccgtaaaagaaaataaattgtggtacaaaaaaggtgttatttttaatgaaagtggtacgtataacgttaatgtgcaacaagctatgagaggtagtggtcaagttaatggtatcgttaacctagaaggtatacagacgtacaactag

SEQ ID NO: 26328 - protein, 245 aa, Unknown
  Obtained from environmental sample
  misc_feature (1)..(245): Xaa is any amino acid
MIVQKAIKNVKTIEVETKSLSITKLRLKLLITKKLNLTKGLIQIIKIRPIAKRNQIKTNQIKVRQIVLSQNLNLGQNVSQTKKDLKTITIQLMKISKILVVLLLVLLSSCDDKAVFDQYQSVSTSWNKKDVVNFKINAPDSINPYNLFVNVRNTNDYKFSNLYLIVEMNFPHGKTLTDTLEYDMTKKNGEWLGEGLSSVKENKLWYKKGVIFNESGTYNVNVQQAMRGSGQVNGIVNLEGIQTYN

SEQ ID NO: 26329 - DNA, 687 bp, Unknown
  Obtained from environmental sample
  misc_feature (1)..(687): n is a, c, g, or t
gtgaaaaaatctcgaacacttaatttatttcatcagtttttctctcatgaatctataaaacatatttgcttaagagacatagaaagtaaaaattactttgattctgttattaatccgaaaattgaaactgtcacttatccagattcagtatttgctcttaaaattcctaatgtgacaaaagagccaaatgaaaaagttttaggtgtagtcttaagaagtcatgcttctttggtaggcgagtatcaagaagtaagaaaagcagtcgatgaagcaaaatcgattggttataaggttaaaattattgttgccgcatttggtgagttaggtgagggggatttaaaagtatctcaagatttctcacagtcggatgaagagatactttactcaaatgatctaatggagctttgtactgaaattggcaaatgtagcttgttgcttagtatgaagtttcatgttgtggttataggtacaatgtaccaagttcctgtaatccaattatcttcaactcaaaaaaataagaatttatttagatatttacagcgccctgatttaatcggtaattatcgtgatgagatgttatatcgtcaaatacctctgaagccagcacctattcactcaatgataactggaaagataaagcgtgactcaagacaaggttatgaagcacttgaaatctgcaatggatag

SEQ ID NO: 26330 - protein, 228 aa, Unknown
  Obtained from environmental sample
  misc_feature (1)..(228): Xaa is any amino acid
MKKSRTLNLFHQFFSHESIKHICLRDIESKNYFDSVINPKIETVTYPDSVFALKIPNVTKEPNEKVLGVVLRSHASLVGEYQEVRKAVDEAKSIGYKVKIIVAAFGELGEGDLKVSQDFSQSDEEILYSNDLMELCTEIGKCSLLLSMKFHVVVIGTMYQVPVIQLSSTQKNKNLFRYLQRPDLIGNYRDEMLYRQIPLKPAPIHSMITGKIKRDSRQGYEALEICNG

SEQ ID NO: 26331 - DNA, 750 bp, Unknown
  Obtained from environmental sample
  misc_feature (1)..(750): n is a, c, g, or t
atgattgagacgcatagacacaaagatgatctttcatttctctggagtgaatcaggtgttgatcttgtagtagatgcaggaaagtatgcatatactagggataaatatagacagtatataaaaagcttaagggctcataatactttattgtttaagaaaaaataccgttcaaaaggcgttgaaaaggagaaagagtatgactttatgccagattactcgactcctatctataaacatactaagtatgggttttatttggagatacataaaagaataaaagactctgatttaatagccgttagaaaattttacttttctcctggcttatggttggtagtttgtgatcaagttactcactcaaacgattcaattcaggtcacaagtcatttgcattttgctccggaatttaattggattccaaattctaataccgaaatcaatagtacatattcattaactgatggatgtaataatttatatactaaaattgctactaataataggtttaatactacaatatcagatgatggtgaatttgatcctacaatagatattagtaagtttgatcctaatgtaaatggttttgtttcaaggaagtataaaaacgtagagccggctccgtttttgagtgtagtcggttacggtaatatgaaggtagcgatagctatatctttaaataataatgatactagcctttcatttgatgatgaaccttcgtttggagtgttgatggcattgataaattcttga

SEQ ID NO: 26332 - protein, 249 aa, Unknown
  Obtained from environmental sample
  misc_feature (1)..(249): Xaa is any amino acid
MIETHRHKDDLSFLWSESGVDLVVDAGKYAYTRDKYRQYIKSLRAHNTLLFKKKYRSKGVEKEKEYDFMPDYSTPIYKHTKYGFYLEIHKRIKDSDLIAVRKFYFSPGLWLVVCDQVTHSNDSIQVTSHLHFAPEFNWIPNSNTEINSTYSLTDGCNNLYTKIATNNRFNTTISDDGEFDPTIDISKFDPNVNGFVSRKYKNVEPAPFLSVVGYGNMKVAIAISLNNNDTSLSFDDEPSFGVLMALINS

SEQ ID NO: 26333 - DNA, 903 bp, Unknown
  Obtained from environmental sample
  misc_feature (1)..(903): n is a, c, g, or t
gtggagcttttgactcggtcgagatgcagaatattttcttgccgttttggagcttccaaaccaatcgggaaaaacggaaaagaactttgcgatttacttgtagtatgtgctaatacggtcattattatatctgtaaaagacatcaagttttcagaacataaaaatcaaaaaatacagcaaaagcgttggtcgaagaaagctatagaaagctatataaatcaaataaaaggagctgaacggcatttgaattctgtagacagtattcttttaaaagacagaaaaaaatctattaaactgccaaaaaaagatcaaagggtaatttatagaatagccattgcttttggtagtgataaagattaccaaattcctattggaaattatcaagaggagtttgtacatatttttgatgagaaatctactgcaactatactttctgagttggacacaattaccgatttcacaaactatctatttgcaaaagaaaaatttcttaaaaattgtaatttacttgttgcttgtgaggttgattttctggcaatttatatagaaacaactttagagtttgatcaacctgttgatgttttaacttgtcctgatgatttgtgggaaagctatcttacatcacaagagtattataattggcgagaaactattaagcctagttttatatgggattatatgataaatcatcttttcaattaccacataacagactctactagtcaagaaagaagagataatatggagtttgcggttagattgattaatcaagaaaataggatgaatagaatagagttaggaatatgtttagacgatgcaattaacaaaaagtctaatgctaggatgttactaccccaagaaaatgctaaccatctatacgtgtntattccattaactcaataa

SEQ ID NO: 26334 - protein, 300 aa, Unknown
  Obtained from environmental sample
  misc_feature (1)..(300): Xaa is any amino acid
MELLTRSRCRIFSCRFGASKPIGKNGKELCDLLVVCANTVIIISVKDIKFSEHKNQKIQQKRWSKKAIESYINQIKGAERHLNSVDSILLKDRKKSIKLPKKDQRVIYRIAIAFGSDKDYQIPIGNYQEEFVHIFDEKSTATILSELDTITDFTNYLFAKEKFLKNCNLLVACEVDFLAIYIETTLEFDQPVDVLTCPDDLWESYLTSQEYYNWRETIKPSFIWDYMINHLFNYHITDSTSQERRDNMEFAVRLINQENRMNRIELGICLDDAINKKSNARMLLPQENANHLYVXIPLTQ

SEQ ID NO: 26335 - DNA, 318 bp, Unknown
  Obtained from environmental sample
  misc_feature (1)..(318): n is a, c, g, or t
atgcagggaaaaaaggattaccaggaaaaactgttcgcccgtttccaattgagcgagcgtatacctaagaacaatttctacagacgtttaaaagaggttctggacttggatttactctataatctgaccaaaggctattacggtgagagtggtcaaaagagcatagaccccgtggtcttcttcaagctttgccttgtgggctacctggagaacatcatcagcgaccgtaagcttatcgcccattgttcgatgcgcttggatattctttttttcgtaggctatgacattgacgaggacttccctggcacagtaccataa

SEQ ID NO: 26336 - protein, 105 aa, Unknown
  Obtained from environmental sample
  misc_feature (1)..(105): Xaa is any amino acid
MQGKKDYQEKLFARFQLSERIPKNNFYRRLKEVLDLDLLYNLTKGYYGESGQKSIDPVVFFKLCLVGYLENIISDRKLIAHCSMRLDILFFVGYDIDEDFPGTVP

SEQ ID NO: 26337 - DNA, 321 bp, Unknown
  Obtained from environmental sample
  misc_feature (1)..(321): n is a, c, g, or t
ttgaagtacccgttgagaacctttgttggtaccaaaaggcctggcatagatcctgttaatatcaaatgttttaaaaccatagtctaccatttgttttacagacccagacatgacgcctttaccccaatggatatccgccagccaataacccagctccatattctttttgtgcagatcagtttgttggtgcagtccaatacctcctgctgctttgccgtctacttcaatggcaaaaataagtgttggcctatcattggcagccatattgataaaatcgatgccatctttttccatataaggatgtggaaatgcgtctgttag

SEQ ID NO: 26338 - protein, 106 aa, Unknown
  Obtained from environmental sample
  misc_feature (1)..(106): Xaa is any amino acid
MKYPLRTFVGTKRPGIDPVNIKCFKTIVYHLFYRPRHDAFTPMDIRQPITQLHILFVQISLLVQSNTSCCFAVYFNGKNKCWPIIGSHIDKIDAIFFHIRMWKCVC

SEQ ID NO: 26339 - DNA, 702 bp, Unknown
  Obtained from environmental sample
  misc_feature (1)..(702): n is a, c, g, or t
gtggcggaaggcgttgatacttattatatccagcttaccagaaaaattacaccaattaaagacttagtagctgtctggaaaatgtatacttttttaaaaaaagaaaaaccatttataatacattctcacacacctaaagcaggattagtgtctatgttggcagcaaagctagcaggagtcccaaaccgtttgcatacagtagcaggattacctttgttagaaagcactggtctaaaaagagttgttttagacttcgtagaaaagcttacctatatgtgcgccaccaaggtatacccaaattctaatgcacttaaaaatattattatcgataataaattagcaaagcaaaacaagcttaaagttattggttacggtagttcaaatgggattaatttagattattttaaccctaaaaattttactgctgaagatgttttagctttaaaaaaacaattaggaataaaaagtgaaaactatgtatatatctttgttggtagaatagtaaaagataagggtattaatgaagtaatagaaagttttgttcaagtaaatcttgagaatcctaatacaaaactagtcttggttggaccctttgaagcagatttggatccaattaaacccgaaaactttaaagaaatcaagaacaatcaccatattattgaaataggctatgtaaatgatgtcgaccttacttttaaatag

SEQ ID NO: 26340 - protein, 233 aa, Unknown
  Obtained from environmental sample
  misc_feature (1)..(233): Xaa is any amino acid
MAEGVDTYYIQLTRKITPIKDLVAVWKMYTFLKKEKPFIIHSHTPKAGLVSMLAAKLAGVPNRLHTVAGLPLLESTGLKRVVLDFVEKLTYMCATKVYPNSNALKNIIIDNKLAKQNKLKVIGYGSSNGINLDYFNPKNFTAEDVLALKKQLGIKSENYVYIFVGRIVKDKGINEVIESFVQVNLENPNTKLVLVGPFEADLDPIKPENFKEIKNNHHIIEIGYVNDVDLTFK

SEQ ID NO: 26341 - DNA, 315 bp, Unknown
  Obtained from environmental sample
  misc_feature (1)..(315): n is a, c, g, or t
atgaaaaaaagtaactctataatttatttattaagcttaactttattattttttagctcggtaagctttgcccagcaaacatgtaaattacctgctcaagcaacaccagaggttactaagcgttacattcagtgcctagatgatcagttaaatacagctaaacaactgcaaaacacttggatccaaaagcgcaaatttgagttaaataaattagaatttgaaactggcaatacgcaaattttacagctgtttatacaaagcattgccagtaacgaaattatattaagcatagttgccaatggcgctantcattaa

SEQ ID NO: 26342 - protein, 104 aa, Unknown
  Obtained from environmental sample
  SIGNAL (1)...(20)
  misc_feature (1)..(104): Xaa is any amino acid
MKKSNSIIYLLSLTLLFFSSVSFAQQTCKLPAQATPEVTKRYIQCLDDQLNTAKQLQNTWIQKRKFELNKLEFETGNTQILQLFIQSIASNEIILSIVANGAXH

SEQ ID NO: 26343 - DNA, 609 bp, Unknown
  Obtained from environmental sample
  misc_feature (1)..(609): n is a, c, g, or t
atggtggatggacaattaactaggcttcctgacaaccagcactatccatttgatcaaggatcaatggagtatcataattctcaatacttgagaactatgtcagacttgtacataaaaagtataagatctgggactaagcgtattgaagattacttcaaagaattagataaaatgagtgttacggatgcaaaatccctactatatacgtataatattttacttaataaaagttgggaaaatataaattatgacaatgatgattataaaaacttattgatcaaagagcttaaaacctggagttcacccattgataaatttaatgagttattggatgttagagcaacgaaggttttaccaaaaagttatcttgactggtttaaaaatgatctacgatgctcactttttatcaccaatcttatctataatgtttttaaaaactcagcttttaaaggtaaggatgagctaataacagcaattacaagttttttgccatataacattatttattttaatagccatgtaaataacgaatttggttatttcaatagagtacagataatagatgattggaaagtttcgaatttactctcgataaaatccacgtattga

SEQ ID NO: 26344 - protein, 202 aa, Unknown
  Obtained from environmental sample
  misc_feature (1)..(202): Xaa is any amino acid
MVDGQLTRLPDNQHYPFDQGSMEYHNSQYLRTMSDLYIKSIRSGTKRIEDYFKELDKMSVTDAKSLLYTYNILLNKSWENINYDNDDYKNLLIKELKTWSSPIDKFNELLDVRATKVLPKSYLDWFKNDLRCSLFITNLIYNVFKNSAFKGKDELITAITSFLPYNIIYFNSHVNNEFGYFNRVQIIDDWKVSNLLSIKSTY

SEQ ID NO: 26345 - DNA, 399 bp, Unknown
  Obtained from environmental sample
  misc_feature (1)..(399): n is a, c, g, or t
ttgaagatgaaacaacaacacactattactttaaccattagtcttttattgtgcttatgtttctcgctgcaagcacaagaggaagatcttactattaaaaaagatacagtcaagttaaaatacggattaagaataggaactgacgctagtaaattaattagaactgctttagatgatgattattctgggtttgaactaaacgcggattacagacttactagagattggtttttagctggagaaattggtactgaagaaaaaatcacatctaatgattatttaagcgttactgctaaaggtagttactttaaagcaggtgttgattataatatgcataacaactgggatgacttagacggcatgatttatacaggtttcattcctcggccgaattcttga

SEQ ID NO: 26346 - protein, 132 aa, Unknown
  Obtained from environmental sample
  misc_feature (1)..(132): Xaa is any amino acid
MKMKQQHTITLTISLLLCLCFSLQAQEEDLTIKKDTVKLKYGLRIGTDASKLIRTALDDDYSGFELNADYRLTRDWFLAGEIGTEEKITSNDYLSVTAKGSYFKAGVDYNMHNNWDDLDGMIYTGFIPRPNS

SEQ ID NO: 26347 - DNA, 357 bp, Unknown
  Obtained from environmental sample
  misc_feature (1)..(357): n is a, c, g, or t
atgaaaaatttaattttagttgccgttattctattttttaactttggatgttctcaaattaaaggaatacatatcacagaagtttcacaaagtgaattagatgaagttgtattgattgatgttaggacacctggcgaatttaatgctgggcatttggataaagctatgaatattgattggttaggggatagtttctcatcggagtttgaaaaaatagaaaagaaccagaccatttacctctattgtaaaagtggaaaacgtagtgccgatgcaaccaaattcctggattccttggggtacaagaatgttgttaaccttgaaggaggttatattgcttgggccaaaaagaacaaataa

SEQ ID NO: 26348 - protein, 118 aa, Unknown
  Obtained from environmental sample
  DOMAIN (25)...(116): Rhodanese-like domain
  misc_feature (1)..(118): Xaa is any amino acid
MKNLILVAVILFFNFGCSQIKGIHITEVSQSELDEVVLIDVRTPGEFNAGHLDKAMNIDWLGDSFSSEFEKIEKNQTIYLYCKSGKRSADATKFLDSLGYKNVVNLEGGYIAWAKKNK

SEQ ID NO: 26349 - DNA, 579 bp, Unknown
  Obtained from environmental sample
  misc_feature (1)..(579): n is a, c, g, or t
gtgtttttagatgtagagatgccatatggtaacgcatttgatttattagacaaagttggtgatcgtgatttcgaaaccatttttgtaaccgcatataacaattacgcaatggatgccctaaatgcacacgcatcttattatttaatgaaaccaatagatattgacgagctcattaaagcagttgactatgtatccgaaattaagttaaaagaagacgcattacaagaccaagtattaatacctaaaaccaataatgtagcaggtaaaataaccataccacagcaagacggttttgaggtgttaaatactaaagatattttgtattgtaaagcagatgataattatactgagatctatttaaacaacaataaaaagaaagtagtcagtaagacactaaaatattttgaagacgcgttaacaccatcaggatttgctcgtgtacacaaaagctacctaattaatgtaagcgaagtcgttaaatacgttaaaggaaaaggaggaagtgttatacttagtaacggacaagaaattatggtgtctgcttcaaaaaaatcagatttattatcttactttaaataa

SEQ ID NO: 26350 - protein, 192 aa, Unknown
  Obtained from environmental sample
  DOMAIN (96)...(192): LytTr DNA-binding domain
  misc_feature (1)..(192): Xaa is any amino acid
MFLDVEMPYGNAFDLLDKVGDRDFETIFVTAYNNYAMDALNAHASYYLMKPIDIDELIKAVDYVSEIKLKEDALQDQVLIPKTNNVAGKITIPQQDGFEVLNTKDILYCKADDNYTEIYLNNNKKKVVSKTLKYFEDALTPSGFARVHKSYLINVSEVVKYVKGKGGSVILSNGQEIMVSASKKSDLLSYFK

SEQ ID NO: 26351 - DNA, 603 bp, Unknown
  Obtained from environmental sample
  misc_feature (1)..(603): n is a, c, g, or t
gtggtaagagattcttcggggactattacgagtactattgggcgttattatatgaacgatagaaaatacaggtttttaaataccgtaaaattagttaacccagaatatgtattaactaccaatcaattagatttttattcagaaactggtcacgcgtatatgtatggcccctccactattgttggagaaacgagtactatttattgcgaacgtggtttttataataccaacgaagacacaggctattttattaaaaactctaaaatagattacgacaatcgagaggttaaaggcgatagtatgtattttgatagaaaccgggattttgcttcagcttcaaataatatagtaatcacagacaccataaataacagcattataaaaggccattacgccgaagtttttaaatctaaagattcaacatttattaccaaacgtgctttagctatttcagtacaagaaaacgactctatttatattcacgcggatacgttaatggttacgggtaaggaggataatagaattacgcgagccttcaaaaatgctaaaatttacaaatcggatttaagtgcgaaatcagattctattcacgtaaaatcataa

SEQ ID NO: 26352 - protein, 200 aa, Unknown
  Obtained from environmental sample
  misc_feature (1)..(200): Xaa is any amino acid
MVRDSSGTITSTIGRYYMNDRKYRFLNTVKLVNPEYVLTTNQLDFYSETGHAYMYGPSTIVGETSTIYCERGFYNTNEDTGYFIKNSKIDYDNREVKGDSMYFDRNRDFASASNNIVITDTINNSIIKGHYAEVFKSKDSTFITKRALAISVQENDSIYIHADTLMVTGKEDNRITRAFKNAKIYKSDLSAKSDSIHVKS

SEQ ID NO: 26353 - DNA, 552 bp, Unknown
  Obtained from environmental sample
  misc_feature (1)..(552): n is a, c, g, or t
gtgacctataaacaaacgctagattggatgtttttgcaacttccaatgtatcaaaataaaggaaaggtcgcttttaattcaaagatggacggcatcaattcgttagctagccatttatataatccacacaaaaaaattaagactattcatgtggcaggaaccaatggaaaaggttctagtagccatatgttagcatctgtattgcaagaggctggttataaggttggtctatatacttcacctcatttaaaggattttagagaacgcattcgaatcaatggaaaaaaagttggtaaaaagtgggtggtaaattttattgatgaaaatcaatcgttcttcgaaagaaataaattatccttttttgaaatgaccgtaggtatggctttttcatattttgcaaatgaaaatgtcgatgtagcggttattgaggtaggcttaggtggtagattagattctactaatataattacaccagaagtaagcttaattacgaatatagggtttgatcataccgatatgtcaggggatacccttgcgaaaaatagcctatga

SEQ ID NO: 26354 - protein, 183 aa, Unknown
  Obtained from environmental sample
  misc_feature (1)..(183): Xaa is any amino acid
MTYKQTLDWMFLQLPMYQNKGKVAFNSKMDGINSLASHLYNPHKKIKTIHVAGTNGKGSSSHMLASVLQEAGYKVGLYTSPHLKDFRERIRINGKKVGKKWVVNFIDENQSFFERNKLSFFEMTVGMAFSYFANENVDVAVIEVGLGGRLDSTNIITPEVSLITNIGFDHTDMSGDTLAKNSL

SEQ ID NO: 26355 - DNA, 540 bp, Unknown
  Obtained from environmental sample
  misc_feature (1)..(540): n is a, c, g, or t
ttgccgctacagatttggaatagttttatcgataaaagtaaaacgtatctatatgttgatgttggggntggaagttcagagttttctgtgatccatcaaggaattaccaccgcttcaaaatcgtttaaaataggaaccgtaaggttgttaaatgacattgtccaaaaagaagcttggttagaactggaagcttggattaaaaccaacaccaaggattttgagaaaattgatctactgggttcgggtggaaacatcaataaaatcttcaagatttcaggaaaagctttgggtaaacctctaacctatttctatctgacctcttattacaacatgcttcaaacctatagttatgaagaacgtattacggaactcgacctaaatcaagatagggcagatgtaatcattccagcaaccagaatttatctttctgccatgaaatggagtgacgccaaatatatttatgtcccaaagattgggctttcagatgggataattaagagtgtttattttggtgcggtttctagcgtaaacatcgtataa

SEQ ID NO: 26356 - protein, 179 aa, Unknown
  Obtained from environmental sample
  misc_feature (1)..(179): Xaa is any amino acid
MPLQIWNSFIDKSKTYLYVDVGXGSSEFSVIHQGITTASKSFKIGTVRLLNDIVQKEAWLELEAWIKTNTKDFEKIDLLGSGGNINKIFKISGKALGKPLTYFYLTSYYNMLQTYSYEERITELDLNQDRADVIIPATRIYLSAMKWSDAKYIYVPKIGLSDGIIKSVYFGAVSSVNIV

SEQ ID NO: 26357 - DNA, 798 bp, Unknown
  Obtained from environmental sample
  misc_feature (1)..(798): n is a, c, g, or t
gtgttcacaatttcccatgttgcaagttcgctgatcaatgccgncaaaaacggtaaaaaagtaaccgttgccatcgagttgcaggcacgttttgatgaacaagccaacattgactatgcagaacaaatggaaacggatggtgtcaatttattatttggggtaaagggacttaaggttcatagtaaaatgtgtgttattgagcgcgaagaaaataataagatcaagcggtacggatttttaagtaccgggaatttcaatgaatccacggctaaactttatacggattttaccttgttcacttccgaccaaagaattttaaaggatgtggtgaaagtgtttgattttttcgaaaccaattataaaattttcaggtataagcacatcatcgtgtcgcctcattatacaaaaaccaaattatttaagctgatcgacactgaaattgagaacgtcaaaaagggtaaacctgcatttatcaagctgaagcttaatagtatttccagttatatgatggtggataaactttacgaagccagtagggcaggtgttaagattcagatgattgtaagaggcatctgtagtctggttcccggaattaaaggcatgagtgacaatattgaggtgatcagtattatcgataagtttaaggaacataccagattattggtatcttgcaacaataatgaccccaaagtatctatttcatcaancgattggatgtcgcggaatatcgaccatagagtgcaggtacctgtccaatctatgatgctgatattcacacacgcattctggatgtcttga

SEQ ID NO: 26358 - protein, 265 aa, Unknown
  Obtained from environmental sample
  DOMAIN (1)...(264): Polyphosphate kinase
  misc_feature (1)..(265): Xaa is any amino acid
MFTISHVASSLINAXKNGKKVTVAIELQARFDEQANIDYAEQMETDGVNLLFGVKGLKVHSKMCVIEREENNKIKRYGFLSTGNFNESTAKLYTDFTLFTSDQRILKDVVKVFDFFETNYKIFRYKHIIVSPHYTKTKLFKLIDTEIENVKKGKPAFIKLKLNSISSYMMVDKLYEASRAGVKIQMIVRGICSLVPGIKGMSDNIEVISIIDKFKEHTRLLVSCNNNDPKVSISSXDWMSRNIDHRVQVPVQSMMLIFTHAFWMS

SEQ ID NO: 26359 - DNA, 684 bp, Unknown
  Obtained from environmental sample
  misc_feature (1)..(684): n is a, c, g, or t
gtggcatcagacatcaataaacctaatggacaaaaaacaatacctccagaagaagttattgcttttttagaagagctacctattgaaaaattttatggtattggaaaagttactgctgctaaaatgtacaatttaggaatttttacagggaaagacttaaaagaaaaatcgttaacgtttttgactaaacattttaaaaaatcggggagccattattttaacatagttagaggaatacaacatagcgttgttaaaccagataggatacgaaaatcagtagcaactgagcatacatttaatacaaaccttacttcagagatctatatgctggaaaaacttgaacatatagctacagaattggaaattcgcctgaaaaaatcaaaaatcttaggtaaaaccattaccttaaaaattaagtatagtgatttttcattgcagaccagaagtaaaacgttgcaatttttttttaatgataaagaaatattgctcaaagtgaccgaagagcttttatttcaagaaaaaatgaacgactctgttagattattaggaatatctcttacaaatttaaatacgaatctaaaatatacagaggaggcttttgatataccaattaaaattggagttttaaaaggtaactttggaataatatttgtggtaattattattaccaattattcattatga

SEQ ID NO: 26360 - protein, 227 aa, Unknown
  Obtained from environmental sample
  DOMAIN (1)...(191): impB/mucB/samB family
  misc_feature (1)..(227): Xaa is any amino acid
MASDINKPNGQKTIPPEEVIAFLEELPIEKFYGIGKVTAAKMYNLGIFTGKDLKEKSLTFLTKHFKKSGSHYFNIVRGIQHSVVKPDRIRKSVATEHTFNTNLTSEIYMLEKLEHIATELEIRLKKSKILGKTITLKIKYSDFSLQTRSKTLQFFFNDKEILLKVTEELLFQEKMNDSVRLLGISLTNLNTNLKYTEEAFDIPIKIGVLKGNFGIIFVVIIITNYSL

SEQ ID NO: 26361 - DNA, 471 bp, Unknown
  Obtained from environmental sample
  misc_feature (1)..(471): n is a, c, g, or t
ttgttacaacatataaccaaagatttaaataaaaaaaagacaattattgtagggtattcttatggaggaccaatagctttggcagataaaaccaagtataaaaaaacaattttaattgcgccagcagtttacagtaatgtagaacctaatttttggtttacaaatatttataaatggaaattaacacgttggctaatcccaaatatttggaaacaagcaggaaaagaaaaattaacacataaagaagatttgagaaaatttgaggatgattggacaaccaataaaaataatattgtaagtattcatggtactaatgatattattgtgccatttgcaaactcaaaattcttagaaaaaaaatttcctaaaaatcagtttgagttaattaatattccaaatgcaaatcattatttaatttggactgaatttaaacaaattagagaacaatttttaaatgctttagaagaatga

SEQ ID NO: 26362 - protein, 156 aa, Unknown
  Obtained from environmental sample
  misc_feature (1)..(156): Xaa is any amino acid
MLQHITKDLNKKKTIIVGYSYGGPIALADKTKYKKTILIAPAVYSNVEPNFWFTNIYKWKLTRWLIPNIWKQAGKEKLTHKEDLRKFEDDWTTNKNNIVSIHGTNDIIVPFANSKFLEKKFPKNQFELINIPNANHYLIWTEFKQIREQFLNALEE

SEQ ID NO: 26363 - DNA, 642 bp, Unknown
  Obtained from environmental sample
  misc_feature (1)..(642): n is a, c, g, or t
atggaccctctttcttcacttaggagcgaagcggaagttgccttaagaaggccaagatcaacagatgaatacaaaaaaacagtagagcaaatgctcgacgaagtattgagaataagcgaaatggtacagcttcttcttcaattatcaagagtcgaatctgttcagatcattcagcctgtgcccataaacataagtcgtattatagagagtgttacaaaacaaaaacagaacgccgcaaaacaaaagaatatcgaaattgatattgattgccatccagatctatatgtaaaagctgaaggaacttatatagaagaaatcgttaacaaccttttggataatgctgttaagtacactaattctaatggatttatcaaggttcaattacgacgctcaggcggaaaagcagtacttcacgtttcagattctggggtaggttttaccggcaaaacaaaaacccgactattcgaacgattttttagggccccggaatcaaaagtccaagaacaacttggaagcgggctcggtctatcacttgttaaagcaatagtagaacaatatgatggtagaattgaagcttatagtgatgggataggtaaaggcagtacttctgtagttcaattacccctagttaagaagacgtaa

SEQ ID NO: 26364 - protein, 213 aa, Unknown
  Obtained from environmental sample
  DOMAIN (98)...(210): Histidine kinase-, DNA gyrase B-, and HSP90-like ATPase
  misc_feature (1)..(213): Xaa is any amino acid
MDPLSSLRSEAEVALRRPRSTDEYKKTVEQMLDEVLRISEMVQLLLQLSRVESVQIIQPVPINISRIIESVTKQKQNAAKQKNIEIDIDCHPDLYVKAEGTYIEEIVNNLLDNAVKYTNSNGFIKVQLRRSGGKAVLHVSDSGVGFTGKTKTRLFERFFRAPESKVQEQLGSGLGLSLVKAIVEQYDGRIEAYSDGIGKGSTSVVQLPLVKKT

SEQ ID NO: 26365 - DNA, 621 bp, Unknown
  Obtained from environmental sample
  misc_feature (1)..(621): n is a, c, g, or t
ttgtgtgctattgattgtggtataatttcaataataataatttctatttttcacaatattttaaaagtagaaaagcctttaccaatttatcaaccagcaatggttaatactgagttggttgatagcacaatccaacatcaaattaattatcataaaatagccaactttagtttaactaatcaaaacggtaaaacaattactcaagcagattataaggataaaatttacgtagcagatttcttttttactacttgtcaaaccatttgtccaataatgactgacaatatggaaaaaattcagaaagagattattaatgatgatgatgttatgttactatctcattctgttactccagagattgatacagttgagcagttaaaaagctacgctataaaaaaaggagttaatgataaaaaatggaacttagtaactggagataaaggtgaaatatatagactagcaagaaaaagttatttagcagtaaaagacgacggaatgcctgataattatgggatggtccatactgaaaactttatgctaattgacaaaaaaggtcaaattagaggatattacgatggtaccaaaaanggaagatattaccacacttttaaacgatattaa

SEQ ID NO: 26366 - protein, 206 aa, Unknown
  Obtained from environmental sample
  DOMAIN (9)...(201): SCO1/SenC
  misc_feature (1)..(206): Xaa is any amino acid
MCAIDCGIISIIIISIFHNILKVEKPLPIYQPAMVNTELVDSTIQHQINYHKIANFSLTNQNGKTITQADYKDKIYVADFFFTTCQTICPIMTDNMEKIQKEIINDDDVMLLSHSVTPEIDTVEQLKSYAIKKGVNDKKWNLVTGDKGEIYRLARKSYLAVKDDGMPDNYGMVHTENFMLIDKKGQIRGYYDGTKXGRYYHTFKRY

SEQ ID NO: 26367 - DNA, 486 bp, Unknown
  Obtained from environmental sample
  misc_feature (1)..(486): n is a, c, g, or t
atgtgcaaattacttagaggtgttaaagcacacatcattgaccttcctggtacatatagcctaaccgcatcgtctctagacgaaaacgtagttatagaattattactaaacaaaaacgataaagattttccggatgttgcagtcgtagttagtgatgttgaaaacttaaaacgaaacctactactttttacacaaataaaagatttagaaatccctacaatcttagtcattaatatggctgacaggatgaaatacaaagggatttcattggatattgagcatttagaaaaagaattacaaactaaaatagctgttattagtaccagaaaaaatgaaggtatagataacttaaaacagttaatttctaattataaagaactatcaactacgccttgcttaaatgcatcggaaatagataaagaatattttgacaaattaagaaaagccttccctaaccaattactttacaaattatggttgaggtaa

SEQ ID NO: 26368 - protein, 161 aa, Unknown
  Obtained from environmental sample
  DOMAIN (4)...(161): Ferrous iron transport protein B
  misc_feature (1)..(161): Xaa is any amino acid
MCKLLRGVKAHIIDLPGTYSLTASSLDENVVIELLLNKNDKDFPDVAVVVSDVENLKRNLLLFTQIKDLEIPTILVINMADRMKYKGISLDIEHLEKELQTKIAVISTRKNEGIDNLKQLISNYKELSTTPCLNASEIDKEYFDKLRKAFPNQLLYKLWLR

SEQ ID NO: 26369 - DNA, 795 bp, Unknown
  Obtained from environmental sample
  misc_feature (1)..(795): n is a, c, g, or t
ttggattcggctcgagaatctgttgcttgtacagaatcgtttgaaaatactctttacaacaattataatagagatatttctatgatgcaacaaaggttagactctattcaaatagcggttttacaaaacccaagtttagattttaaagagaaatataaaaaagcttatagagatgtaaatgctgttcaaaacaaatatgttgaatctgcaaaaggtaaatatgttgctccatttataatcgctagtgcaagaaaaaatactccagaaattttaaattctgccaatgattatttggcgaatattaaaaatacatttttcgattatttggatttttcgaacaaaaccttaatgaattcttcgtttttaataaacagagttttagattatgtgttttacattaattatgccgaagatttagagcaacaacaagttctttttaaatcatctattgatactgtgctttcaaaaattaaaaatcaagggtataaaagagatattattcagtttttaatagagcaatttgagacttctaaaaatttagaaattatagattatctgtttgaaaaacattacaataagttacctatcaatttacaagacgctaaatttaaaaacgaaaaacaagcattatttgctgctgaagttggcagaattgcaccagatttttcttggacagaaaatggtagaaacttaaaattatcaancttacatgatgcagaaaactatgtgtcagtttctcggagtacaggttgttctcactgtttgagagaaatcctgaattgtatacgtatatga

SEQ ID NO: 26370 - protein, 264 aa, Unknown
  Obtained from environmental sample
  misc_feature (1)..(264): Xaa is any amino acid
MDSARESVACTESFENTLYNNYNRDISMMQQRLDSIQIAVLQNPSLDFKEKYKKAYRDVNAVQNKYVESAKGKYVAPFIIASARKNTPEILNSANDYLANIKNTFFDYLDFSNKTLMNSSFLINRVLDYVFYINYAEDLEQQQVLFKSSIDTVLSKIKNQGYKRDIIQFLIEQFETSKNLEIIDYLFEKHYNKLPINLQDAKFKNEKQALFAAEVGRIAPDFSWTENGRNLKLSXLHDAENYVSVSRSTGCSHCLREILNCIRI

SEQ ID NO: 26371 - DNA, 372 bp, Unknown
  Obtained from environmental sample
  misc_feature (1)..(372): n is a, c, g, or t
atggcagaacataatgaacttggtaaaagaggagaaaaatttgcagctgaatatctactcaaaaacgattataaaattcttgaaagaaactaccgatatttaaaatcagaagtagatattattgcacaaaaaggaaacactttagtgggtgttgaagtaaaaacaagaagttcagattattttggagatccacaagattttatcacgcctaaaaaaataaaattactagtttctgcaatcgattatcatgtggtgccaagagatccacatgtcgcggttcgaatcgatattattgccatcttagaccaaaacactaaatccccatggagccttctgcacatgcttcctcgtattctcacattactctttnnt

SEQ ID NO: 26372 - protein, 124 aa, Unknown
  Obtained from environmental sample
  DOMAIN (10)...(101): Uncharacterised protein family UPF0102
  misc_feature (1)..(124): Xaa is any amino acid
MAEHNELGKRGEKFAAEYLLKNDYKILERNYRYLKSEVDIIAQKGNTLVGVEVKTRSSDYFGDPQDFITPKKIKLLVSAIDYHVVPRDPHVAVRIDIIAILDQNTKSPWSLLHMLPRILTLLFX

SEQ ID NO: 26373 - DNA, 648 bp, Unknown
  Obtained from environmental sample
  misc_feature (1)..(648): n is a, c, g, or t
ttgnggcaaaatattaaagcgtatgctgagattcaggtacgatttaaaaccgaagataatcaaatgctacctacagcctcatttttagccatggccgaaaaacttgatatggctatagaaatcgacaggctaattattgactcatcacttgagaaaataaaaagccgaaatctttcagaaaagttttttggtttaaatgttacgccttcaagtgcgcacaacgaccagtttgtaatttggttagaacgccgattattaaaagatacccatattgcatcaaaacttgtttttgaagtaagtgaatttgggctacaacaaaacattaaagcgagtaaacgctttattgacatgattcatcgcgtgggtgctcgcataacagttgagcgttttggtgttggcttaacatcgtttaagtttttccgcgatttaaaaccagactttattaaaatggatgccagttatacccgcggcctagaagatgataaaaacaatcaatattttatgcgcttaatggtcgatttagcacacaggattggtgtaagtgtttttgctgaaggggtcgaaagccaagaagaaaagcacattatagaaaccctgtgcttagatggtgtacaaggttactacatagaaaaacctaaagacatttga

SEQ ID NO: 26374 - protein, 215 aa, Unknown
  Obtained from environmental sample
  DOMAIN (1)...(212): EAL domain
  misc_feature (1)..(215): Xaa is any amino acid
MXQNIKAYAEIQVRFKTEDNQMLPTASFLAMAEKLDMAIEIDRLIIDSSLEKIKSRNLSEKFFGLNVTPSSAHNDQFVIWLERRLLKDTHIASKLVFEVSEFGLQQNIKASKRFIDMIHRVGARITVERFGVGLTSFKFFRDLKPDFIKMDASYTRGLEDDKNNQYFMRLMVDLAHRIGVSVFAEGVESQEEKHIIETLCLDGVQGYYIEKPKDI

SEQ ID NO: 26375 - DNA, 825 bp, Unknown
  Obtained from environmental sample
  misc_feature (1)..(825): n is a, c, g, or t
atgaagcagcataaaaaaacagtgttactcgttattaattgtctacaaggcggtggtgcggaacgtgtcgtattaacattggggcaagggttttatgaattgggctatgaagtacatattctaagatttaagccgttagtacagtatgacttaagtccgaatcttaactaccatgtacttaagtttaagccgtataaactgataccaggggcacaaagacgtgaccatatttttgcacgtgctgttgataaatacgtgtcgaaaaatatcggtcagcctgacatcatactgtccaacctagatcgtgccgatagcattttaagtaatagtaaactgcctaatatcacttatattattcataacacagtatcactactctataaatttaataaaaatcacgacgctgagcagttaaagcaaagaatgatagatatatatgccaagcatccttgtgtgtgcgtcagtgaaggcgctcaaaaagactttatcaaaagctttggtcatattacgccaaccaccgccattcacaatccaattgataaaaacagtattcaacaacaagccgatgcttttgtccctgactaccagaactatattattcatgtcgggagctttaaagatgccaagcgtcatgatgtattggtaaatgcttatgcaaaaacagatcaatctatgcctttactgctcttgggtcaagggaagcatagaagtgaaacagagcgactggtaacagagttaaagctagaagaccaagtaatatttggaggaattcgcgaatatccctttccttatatcaaaaatgcgcagttaagatatgacctctga

SEQ ID NO: 26376 - protein, 274 aa, Unknown
  Obtained from environmental sample
  misc_feature (1)..(274): Xaa is any amino acid
MKQHKKTVLLVINCLQGGGAERVVLTLGQGFYELGYEVHILRFKPLVQYDLSPNLNYHVLKFKPYKLIPGAQRRDHIFARAVDKYVSKNIGQPDIILSNLDRADSILSNSKLPNITYIIHNTVSLLYKFNKNHDAEQLKQRMIDIYAKHPCVCVSEGAQKDFIKSFGHITPTTAIHNPIDKNSIQQQADAFVPDYQNYIIHVGSFKDAKRHDVLVNAYAKTDQSMPLLLLGQGKHRSETERLVTELKLEDQVIFGGIREYPFPYIKNAQLRYDL

SEQ ID NO: 26377 - DNA, 525 bp, Unknown
  Obtained from environmental sample
  misc_feature (1)..(525): n is a, c, g, or t
atgattaatagtgttattagaacaagaaaaaaagaagttaaaaataataaaaagaaagtactcttagtcattaactgtctacaaggtgncggcgctgaacgtgttgttctgactttaggacagggattctatgatttgggttatgaagtacatattttacggtttaagccccgtgtagattacgagcttaatccaaaactaaactaccactttattgattttaagcgttataaactgataccaaaattagaacgtcgtgacaaagtttttgcgttcgtagtcgatcgttacatttcaaaaaacattggtcagcctgatatgatactgtctaatctagatcgtgcagatagtattttaagcaatagcaaactacctaatatattttatgtgattcataacacagtgtctttgttatataaattcgataatacgaatgctgctgacacactaaagtcaaagatgattaacatctacaccaagatgcctgtatatgtgtcagtatgcagctctcgagccgattcttga

SEQ ID NO: 26378 - protein, 174 aa, Unknown
  Obtained from environmental sample
  misc_feature (1)..(174): Xaa is any amino acid
MINSVIRTRKKEVKNNKKKVLLVINCLQGXGAERVVLTLGQGFYDLGYEVHILRFKPRVDYELNPKLNYHFIDFKRYKLIPKLERRDKVFAFVVDRYISKNIGQPDMILSNLDRADSILSNSKLPNIFYVIHNTVSLLYKFDNTNAADTLKSKMINIYTKMPVYVSVCSSRADS

SEQ ID NO: 26379 - DNA, 666 bp, Unknown
  Obtained from environmental sample
  misc_feature (1)..(666): n is a, c, g, or t
atgttaaaactattttcagcaaatttttgggacgttgtagcaagactaatattgcgcaacaaaatagctattctattaggtgttgtacttgttactattttttttagtacacaatggaagtacatgcgctttacttacactgaagctaatttattgcctgatgaccatgaggtcaatattacttacaacgattttttaaaagtttttggagaagaaggtaacttaattgtccttggtgttaaagacacaaccccatttactgtagagaaattaaatgcttggaatgcactttctgatagttttagggaagctccagaagtagaaactgtagtctccataaaagatcttcaaaaattagttaaagatcaagaaaacgaaaaatttgcattagagccttttattaaagactcagtagcttcaatagaacagattgaaaaactgcaagaccaactttttaatcaatatcctttttacgataattttttattcaacaaaaaaactaaaacagtacgtactgctatctatttacaaaaagatatagttaatacacctgctagaaaggattctgtgatggacaatttagttgaaaacgttaaggcttttgagactagtcaggcactgaatgttcgtatttctggaatgccatacattcgcacacttaatgnn

SEQ ID NO: 26380 - protein, 222 aa, Unknown
  Obtained from environmental sample
  misc_feature (1)..(222): Xaa is any amino acid
MLKLFSANFWDVVARLILRNKIAILLGVVLVTIFFSTQWKYMRFTYTEANLLPDDHEVNITYNDFLKVFGEEGNLIVLGVKDTTPFTVEKLNAWNALSDSFREAPEVETVVSIKDLQKLVKDQENEKFALEPFIKDSVASIEQIEKLQDQLFNQYPFYDNFLFNKKTKTVRTAIYLQKDIVNTPARKDSVMDNLVENVKAFETSQALNVRISGMPYIRTLNX

SEQ ID NO: 26381 - DNA, 609 bp, Unknown
  Obtained from environmental sample
  misc_feature (1)..(609): n is a, c, g, or t
ttgttganggctcaagcggttaaaatttctaaaagagttcaagttccgttttctgaaaaagaaattaataaagttatagataatttaaatgagtttgacgattttgagtctgtacggaacaaattgattgttgaattattgtattcaacaggaatgaggcgggcagaattaattgaaataaaaaaaagttcaataaattttacgaattgcacgttaaaagtattaggtaaaagaaataaagaaaggtatattccattattgaattcagtgctgcaaaccttaaaaacttatttggatttaagacaagaagtaaattctgattgtgataatttattaattacgataaaaggaaataaaatatatccaactcttgtttatagaataataaatgattattttagtgcggtatcttctaaagtaaaaaagagtccgcatgtaatacgtcattcgtttgcaactcatttacttaatgaaggagcagatttcaattctgtcaaagaattactcggtcattcaagcttagcttcaaaccaagtatatacccatagcagtttgactgaattaacaaaagtatataagccaagtcatcctaggaggcccaagacctga

SEQ ID NO: 26382 - protein, 202 aa, Unknown
  Obtained from environmental sample
  DOMAIN (17)...(190): Phage integrase family
  misc_feature (1)..(202): Xaa is any amino acid
MLXAQAVKISKRVQVPFSEKEINKVIDNLNEFDDFESVRNKLIVELLYSTGMRRAELIEIKKSSINFTNCTLKVLGKRNKERYIPLLNSVLQTLKTYLDLRQEVNSDCDNLLITIKGNKIYPTLVYRIINDYFSAVSSKVKKSPHVIRHSFATHLLNEGADFNSVKELLGHSSLASNQVYTHSSLTELTKVYKPSHPRRPKT

SEQ ID NO: 26383 - DNA, 708 bp, Unknown
  Obtained from environmental sample
  misc_feature (1)..(708): n is a, c, g, or t
ttgattcggtcgaggtacttaccggtggaatgtcttcattggtcaagagaaaaaatgattcaacgaaccaaaaatttaatacgccaaacagcatccgaaataattggagtactcgatgtttctaattattacccaatagatactcttcatacactgaacttaattgataaaagtgataacaacgtaaacgatctaaaattcatactgggattaataaactcaatatttttcaaatttctatacaattggaagttggacgaagcgggtaaagtatatccacaaatcaaaaaagtgaatattgaatggataccattgcccaattatacgattaccgaagttgattgtatggcaaatctagttagtactgttcaaattttgatagaggatttgaataagctcaaaagtcaatttaaaagatatttgatctctaaaattcaaatagttaagatatctagcaatatggaaaactggcaaaacatcgattctacggagtttataatcgaattgagtaaagctataaaaacatccaataaacaacgtgaaaaagaaaaccaaaaaccaataaacattcttacaaaaacagatgaatttgaatggcttgatctctttgaaaagaataagaaaaaagcccaagagctgcaatcacaaattgattccatagagcaaacaaatagatgctatggtttacgaactgtatggattgagtga

SEQ ID NO: 26384 - protein, 235 aa, Unknown
  Obtained from environmental sample
  misc_feature (1)..(235): Xaa is any amino acid
MIRSRYLPVECLHWSREKMIQRTKNLIRQTASEIIGVLDVSNYYPIDTLHTLNLIDKSDNNVNDLKFILGLINSIFFKFLYNWKLDEAGKVYPQIKKVNIEWIPLPNYTITEVDCMANLVSTVQILIEDLNKLKSQFKRYLISKIQIVKISSNMENWQNIDSTEFIIELSKAIKTSNKQREKENQKPINILTKTDEFEWLDLFEKNKKKAQELQSQIDSIEQTNRCYGLRTVWIE

SEQ ID NO: 26385 - DNA, 801 bp, Unknown
  Obtained from environmental sample
  misc_feature (1)..(801): n is a, c, g, or t
atgaaaattttagttattcagcaaaaaatgattggcgatgtgcttactacaagtgtattgtttcaggttttgcgtgaaaaatatcctaatgccgaattgcattatcttattaattcgcatacattggcagttgtagataacaatccttttatagataagtttattttttttacaccagaaattgaagcgtctaaaattgcgttttataaatttataaaaactattaaaactgaaaaatacgacattactattgatgcgtacgggaagttaagtagtacattaatctcttatttttctaaagctaaaataagaattgcttaccataaaaaatacacggcttatttacttacccatcctattaaaagaatacagactccaaaacacaacagcagtttagcattagaaaatcggtttagattactagaacctttaaacattaattttaaaaagataaaaccccaaatatatttaaagactattgaaattgaagcggcaaaaacgctattaacacgcgctagtattgatttaaaaaagcctttatttatgataagtgttttaggtagtagcgatacgaaaacgtatccttttgagtatatggccacgttattagacactattgttaatacggtagcaaatgcacagatactttttaattatataccaaatcaaagactccaagcggaagccatctaccatttttgctcaccagaaacacagacacacattttattaccggtctatggcaaaagtttacgagaatttctagcaattacaagttggactcagcgatcatccnnttaa

SEQ ID NO: 26386 - protein, 266 aa, Unknown
  Obtained from environmental sample
  misc_feature (1)..(266): Xaa is any amino acid
MKILVIQQKMIGDVLTTSVLFQVLREKYPNAELHYLINSHTLAVVDNNPFIDKFIFFTPEIEASKIAFYKFIKTIKTEKYDITIDAYGKLSSTLISYFSKAKIRIAYHKKYTAYLLTHPIKRIQTPKHNSSLALENRFRLLEPLNINFKKIKPQIYLKTIEIEAAKTLLTRASIDLKKPLFMISVLGSSDTKTYPFEYMATLLDTIVNTVANAQILFNYIPNQRLQAEAIYHFCSPETQTHILLPVYGKSLREFLAITSWTQRSSX

SEQ ID NO: 26387 - DNA, 657 bp, Unknown
  Obtained from environmental sample
  misc_feature (1)..(657): n is a, c, g, or t
ttgtttccaggtgtagtaattcctattaccgcaggaagagacaaatcaataaagcttattaacgatgctaataaaggcggaaaggtaataggtgtagtctctcaaatagatgaaactgttgaagatcctacagcagcagatatttataaaaaaggaacagtagcacgaattcttaaagtgctaaaaatgcccgatggtaataccacaatgattattcagggtaaaaaacgatttgaaattgatgaaatcgtatcagaagacccatacattacagcgactgtaaaagatgttaaggaagataaacctgaagccgaaaaccaagagtttagtgcaattattgagtctattaaggaattatcgttacagataattaaaaatagtcctaacattcctaccgaggcaacctttgcaattaagaatattgaaagcgattcgtttttagtaaactttgtgtcttcaaacatgaatttatctgttgaagaaaaacaaaaattattagaaataaacgatctaaaagaacgtgcattagccactttaaagtacatgaatgttgaacttcagaaattggagcttaaaaacgatattcagtctaaagtgcaaaatgacatgaatcaacaacaacgcgagtacttttacatcaactcgaccgattcttga

SEQ ID NO: 26388 - protein, 218 aa, Unknown
  Obtained from environmental sample
  DOMAIN (1)...(184): ATP-dependent protease La (LON) domain
  misc_feature (1)..(218): Xaa is any amino acid
MFPGVVIPITAGRDKSIKLINDANKGGKVIGVVSQIDETVEDPTAADIYKKGTVARILKVLKMPDGNTTMIIQGKKRFEIDEIVSEDPYITATVKDVKEDKPEAENQEFSAIIESIKELSLQIIKNSPNIPTEATFAIKNIESDSFLVNFVSSNMNLSVEEKQKLLEINDLKERALATLKYMNVELQKLELKNDIQSKVQNDMNQQQREYFYINSTDS

SEQ ID NO: 26389 - DNA, 603 bp, Unknown
  Obtained from environmental sample
  misc_feature (1)..(603): n is a, c, g, or t
atgaatacacaaacactagaacaaatgaaacagttaagattctatggtatgcatagagcttttaacgaaactttacagacaggaagtattccttacaccaatgatgaactcattgcttatctattacaatcagaatgggatgacaggcttaacaggaaaatagaacgtctgactaaagccgccaggtttaggtataatgctcttatagaaaatattaattatgatctaagtagaaacatagataaaaataaaatacaacgatttgccagttgcgattttattaaaaacaaagaaaatatcttgatcacaggcagtacaggagtaggaaaaagttacattacctctgctataggccacggtgcttgttctttaggatttaaggtaatgtattttaatacacaaaaattatttacaaaactaaagacatcaaaagctgatgggtcttatctgaaaataattaataaactggaaaaaccagatttacttatcctcgatgattttggacttagagctcttgacagcattaatagaccacttcttatggaacttatcgaagatagacctgccaaaagatcctaccttataagctctcatttaccatag

SEQ ID NO: 26390 - protein, 200 aa, Unknown
  Obtained from environmental sample
  DOMAIN (51)...(200): IstB-like ATP binding protein
  misc_feature (1)..(200): Xaa is any amino acid
MNTQTLEQMKQLRFYGMHRAFNETLQTGSIPYTNDELIAYLLQSEWDDRLNRKIERLTKAARFRYNALIENINYDLSRNIDKNKIQRFASCDFIKNKENILITGSTGVGKSYITSAIGHGACSLGFKVMYFNTQKLFTKLKTSKADGSYLKIINKLEKPDLLILDDFGLRALDSINRPLLMELIEDRPAKRSYLISSHLP

SEQ ID NO: 26391 - DNA, 369 bp, Unknown
  Obtained from environmental sample
  misc_feature (1)..(369): n is a, c, g, or t
ttgaggaatatactgggaacaattgcgactattccagaatgttgttcccaaaatgaacaggaaatcctcatgaagggataccggaatatagttgataccagttattcaggaaagacctattcggatagggttattcattttcttaaaatgtacgagccaaaagttaagcttcagacaaaaatcacatttcaaaagatcatggccctgctcaggtctgtattctacctgggaattattaacaagagcagaatctggtactggaaattatttttctggagtttgattaacaagcctgaaactttttccctggctattacctacagcatctatggttaccacttccggaaagttttcagggaagacttatga

SEQ ID NO: 26392 - protein, 122 aa, Unknown
  Obtained from environmental sample
  misc_feature (1)..(122): Xaa is any amino acid
MRNILGTIATIPECCSQNEQEILMKGYRNIVDTSYSGKTYSDRVIHFLKMYEPKVKLQTKITFQKIMALLRSVFYLGIINKSRIWYWKLFFWSLINKPETFSLAITYSIYGYHFRKVFREDL

SEQ ID NO: 26393 - DNA, 603 bp, Unknown
  Obtained from environmental sample
  misc_feature (1)..(603): n is a, c, g, or t
ttgttaattggatcttgtaatagtagtaaagtttttaaggaaaaatggacaataaaagaagctcctgaaatttttaaagcacgctttgaaacaaccaaaggcaacttcgatatagaagcacatcatgattggtctccgaaggcagttgacagattatatcaattaattatgagtgatttttattctgatgtagcactttttagagttgtacctgattttgttgtacaatttggcatacataatgattctgttttaaataattcatggcgtaattataaagttgtggatgaaccagcaattaaacctaatgaagaaggagcaatatcttttgcgagaggtgggatagaatcgcgtacgactcaaatatttatcaatttaaagagtaattcaccaagattagacactattttttatagtggtgttaaaggatttccggtagttgctaaagttaccaatggaatggaagttgttaaatcattttataacggttatgctgagcaaccttcttctaagcaagattctattcaattaaaaggaaatagctacttaaagaataattttccaaaactagactatattaaaaaggcatatataattaaataa

SEQ ID NO: 26394 - protein, 200 aa, Unknown
  Obtained from environmental sample
  DOMAIN (26)...(177): Cyclophilin type peptidyl-prolyl cis-trans isomerase
  misc_feature (1)..(200): Xaa is any amino acid
MLIGSCNSSKVFKEKWTIKEAPEIFKARFETTKGNFDIEAHHDWSPKAVDRLYQLIMSDFYSDVALFRVVPDFVVQFGIHNDSVLNNSWRNYKVVDEPAIKPNEEGAISFARGGIESRTTQIFINLKSNSPRLDTIFYSGVKGFPVVAKVTNGMEVVKSFYNGYAEQPSSKQDSIQLKGNSYLKNNFPKLDYIKKAYIIK

SEQ ID NO: 26395 - DNA, 564 bp, Unknown
  Obtained from environmental sample
  misc_feature (1)..(564): n is a, c, g, or t
atgaatcctttaaccgacacacaactttggaaacattcgtatagtgaagtttacgatctctataatcgtattttcgattgcaaaggtcacggttggagtaacgtacaaagcacacatattaatttacctttttttgatgataaagaatttgagaaattacatgctgccattcgaattattttaccattaattccaggtctatgtgcaagttcaccaattctagaaggaaaaaacacaggatttaaagatatccgtttagaatactataaaaccaatcaaaaagagattcctgaaatgacaggtttagtcattccagagcgtgtatttaccaaacttgattattattctacaatattcgagccgataaaaacagctataaaacctaaagacaaaaagggggttttagaccatcattttttaaattccagaggtgctattgcacgttttgatagaaatgctatagaaatccgactggtagatatacaagaatgtccacaatctgatatggctatttgcgtattaattattgaaactttaaatattagtctctcgaccgattcttga

SEQ ID NO: 26396 - protein, 187 aa, Unknown
  Obtained from environmental sample
  misc_feature (1)..(187): Xaa is any amino acid
MNPLTDTQLWKHSYSEVYDLYNRIFDCKGHGWSNVQSTHINLPFFDDKEFEKLHAAIRIILPLIPGLCASSPILEGKNTGFKDIRLEYYKTNQKEIPEMTGLVIPERVFTKLDYYSTIFEPIKTAIKPKDKKGVLDHHFLNSRGAIARFDRNAIEIRLVDIQECPQSDMAICVLIIETLNISLSTDS

SEQ ID NO: 26397 - DNA, 525 bp, Unknown
  Obtained from environmental sample
  misc_feature (1)..(525): n is a, c, g, or t
ttggtaagtaacattatgttggcttggaatggtagtttaggtatttctaaatacaatggtattacaagtcctgcctattgtgtgtatcgcattaaaggagacaataaccctaattattttggctatttgttttctactgcatttatgaaagcggagtttagaaaaaagtcttttggcattattgatagtagattacgtttatattccgataagttttttagtattcctgctcctgtaccacccaaagcagagcaagaccaaattgtagcctacataaaagaacaatccaaaaaaataaaacacttcattaaaaagaagcaaacctttattggcttactaaaagagcaaaaacaaagcgttattgataagttattaattaataaaggtaaaaaggtaaagataaaatattgtgtttctaaaataggtggtggtgttacaccaaaaggaggagctactgtttataagaaaagtggatactgtttttacgcagccaacatatttacaatgatgtttgtacttagataa

SEQ ID NO: 26398 - protein, 174 aa, Unknown
  Obtained from environmental sample
  misc_feature (1)..(174): Xaa is any amino acid
MVSNIMLAWNGSLGISKYNGITSPAYCVYRIKGDNNPNYFGYLFSTAFMKAEFRKKSFGIIDSRLRLYSDKFFSIPAPVPPKAEQDQIVAYIKEQSKKIKHFIKKKQTFIGLLKEQKQSVIDKLLINKGKKVKIKYCVSKIGGGVTPKGGATVYKKSGYCFYAANIFTMMFVLR

SEQ ID NO: 26399 - DNA, 516 bp, Unknown
  Obtained from environmental sample
  misc_feature (1)..(516): n is a, c, g, or t
atggaaggcttaaccaatttaggaatgggctatgtttttgaagaattgatacgaaagttcaatgaagaaaacaatgaagaagcaggagaacactttaccccaagagagattattaagttaatgacccatttaatttttgaacccttaaaaggtaaaattaaagacggaacctatttaatatacgacccagcttgcggtagtggtggtatgcttacagaagcagaacattttgctaaaaatttgaatccaaaggcaacctttcatttatacggtcaagaagtaaaccctgaaacctatgccatttgtaaagcagatatgttgattaaagatgaagacccagagaaaattgcttttggctctacattaagtaaagacggttttccaaacttacagtttgattttatgataagtaatccaccgtatggaaaaacttggaaagtagataaagatgccattctcgataaaaaagacatcatagacccacgttttaccagtaggtgttccaagaataaatga

SEQ ID NO: 26400 - protein, 171 aa, Unknown
  Obtained from environmental sample
  misc_feature (1)..(171): Xaa is any amino acid
MEGLTNLGMGYVFEELIRKFNEENNEEAGEHFTPREIIKLMTHLIFEPLKGKIKDGTYLIYDPACGSGGMLTEAEHFAKNLNPKATFHLYGQEVNPETYAICKADMLIKDEDPEKIAFGSTLSKDGFPNLQFDFMISNPPYGKTWKVDKDAILDKKDIIDPRFTSRCSKNK

SEQ ID NO: 26401 - DNA, 789 bp, Unknown
  Obtained from environmental sample
  misc_feature (1)..(789): n is a, c, g, or t
ttggtcggcccatcgacgcgagggccaatcctggcaatcactgttaggttttacgcaggattgaatgggaaaacttacacaaatggcatgtcatgctctttggagcgttttaagttaatagcgtctgaagaattgaatagtaaaattgatgatatatctttgcgatacgaatttattcatataaatgaccaaaaatccgaattatcttggacagaactcattagtaaagccatgttaaaacgtgtagctttaacggaaaatgcccattatgccacaccagaaattcactttgataaaaccaaggaaaaaggccatccgtttgcctaccatgtatatggaacagctattattaccactacagtagattgcacacgtggaacttatgaatttgatagcgtgaaaatggttcacgattacggcaaaagtatgagtgaagggattgatttaggtcaagttgaaggtgctttaattcaaggtattggttggatgacgatggaagaaattgcgtataatgaagatggaaaattactttctaatgccttatcaacttataaaattccagatttattttcggtgcctaaaattgttgaaaccattcctttggaaactgaaggtcatgagcacgctattttaaaatcgaaagccgttggtgaaccccctttaatgtatggtattggtgcttattttgcacttcaaaatgcaattaaagcctttaatccgaattataatttaaagtttcatgcacctatgacaccagaaaaagttttgatgagtctttatcaaaaataa

SEQ ID NO: 26402 - protein, 262 aa, Unknown
  Obtained from environmental sample
  misc_feature (1)..(262): Xaa is any amino acid
MVGPSTRGPILAITVRFYAGLNGKTYTNGMSCSLERFKLIASEELNSKIDDISLRYEFIHINDQKSELSWTELISKAMLKRVALTENAHYATPEIHFDKTKEKGHPFAYHVYGTAIITTTVDCTRGTYEFDSVKMVHDYGKSMSEGIDLGQVEGALIQGIGWMTMEEIAYNEDGKLLSNALSTYKIPDLFSVPKIVETIPLETEGHEHAILKSKAVGEPPLMYGIGAYFALQNAIKAFNPNYNLKFHAPMTPEKVLMSLYQK

SEQ ID NO: 26403 - DNA, 888 bp, Unknown
  Obtained from environmental sample
  misc_feature (1)..(888): n is a, c, g, or t
atgcgaagtagtcagaaattggacccacttaatggatcattggtttacggatctctgaaagaggatgattatcgaaaaggcaattatccaaaattaatgctattcaatcaagcttctaaattcattaaatgggaaatcattaatgaattattggactattccagactttcatccgggcttggaagctttgagagcaacgacttccattttcagaatgtagttaatgatgttgtgtatttatgcaacacattgattactagaaaagaggtgaaactaaaaacacaaatcgattcaaatattccaaagatattgttgggggacccctctaagctttcccaggtattaatcaatcttttgggaaattccataaaatttgttgaaaagggggagatatcattgaatattaaaatcaagaaaagggacaggaacagcattcgtcttgaattcatgatcaaggatacgggaatagggatctcagagaataatttaaaacacatttttgacccctttaagcaggccgaccaaagcacatttgcccattatggtggttcagggctgggtttaagtattgtaaaacagataattgaaagaagcaaaggggaaatcacagtctccagcgagttaggagtgggatcaacattcaaattttttctcccctatgaaattagtaaagacaaggatatggtaaaaaaagaggaaagtacttttagtttagatgaaggcataaaacaagtgagagacatgaacattttagtgtttgaagataattctctcaaccaaaaactaatcgagacaagactaaaaagttgggggtgtgaaacttttatcactgccgatgcctataccggtatggatattttagaaaccatgctattgatattgttctaa

SEQ ID NO: 26404 - protein, 295 aa, Unknown
  Obtained from environmental sample
  DOMAIN (106)...(221): Histidine kinase-, DNA gyrase B-, and HSP90-like ATPase
  misc_feature (1)..(295): Xaa is any amino acid
MRSSQKLDPLNGSLVYGSLKEDDYRKGNYPKLMLFNQASKFIKWEIINELLDYSRLSSGLGSFESNDFHFQNVVNDVVYLCNTLITRKEVKLKTQIDSNIPKILLGDPSKLSQVLINLLGNSIKFVEKGEISLNIKIKKRDRNSIRLEFMIKDTGIGISENNLKHIFDPFKQADQSTFAHYGGSGLGLSIVKQIIERSKGEITVSSELGVGSTFKFFLPYEISKDKDMVKKEESTFSLDEGIKQVRDMNILVFEDNSLNQKLIETRLKSWGCETFITADAYTGMDILETMLLILF

SEQ ID NO: 26405 - DNA, 489 bp, Unknown
  Obtained from environmental sample
  misc_feature (1)..(489): n is a, c, g, or t
atgagtaatcataagttaatcatatcgtcagcaggttcaggtaaaacaacttttctagttagagaagcgattaaattagctgataaaaaagttttaattacaacttataccgaagccaacgaaaaagaaattagaaaaaagtttattgatgaaatcggatatattcccaaaaacgttaccattaaaacatggttctcatttttaattcaacattgtattaagccttttcaaggattgatgaatgataagttattcgacaatgatataaaaggaatgattttagttagcaaacaatctgctgttagatttatttcagacaaggggtttcctgttacttttaaagaagaagataattttgatgaacattattttagtaaagggaataaatttattctgataaaatttctaagttcatttgtaatttatcaaccaacagatagtggagatacctttaacagcatttcaagatttttgatcatatatacatga

SEQ ID NO: 26406 - protein, 162 aa, Unknown
  Obtained from environmental sample
  misc_feature (1)..(162): Xaa is any amino acid
MSNHKLIISSAGSGKTTFLVREAIKLADKKVLITTYTEANEKEIRKKFIDEIGYIPKNVTIKTWFSFLIQHCIKPFQGLMNDKLFDNDIKGMILVSKQSAVRFISDKGFPVTFKEEDNFDEHYFSKGNKFILIKFLSSFVIYQPTDSGDTFNSISRFLIIYT

SEQ ID NO: 26407 - DNA, 360 bp, Unknown
  Obtained from environmental sample
  misc_feature (1)..(360): n is a, c, g, or t
ttggatatagcagaacaattagacttacctgttgcacttgtgacagataatgataaaattacgttgggggataggaaaagatacgctggatttaaagatgtagcaactataaatatttttgcagaccaaagatatgagttaaatactcttgaaccacaatttgtagatgctaataaacacccattaggaaaattgtgtgaagtaattggtgttgattttacaaagtataatacagaagaactcatatccaaaaaaatgccaaagatggaaacgacttgggctttaagagtattttcatctgatgtagacctagaattccctgattatattaatagattgataatttgggctaatgagtaa

SEQ ID NO: 26408 - protein, 119 aa, Unknown
  Obtained from environmental sample
  misc_feature (1)..(119): Xaa is any amino acid
MDIAEQLDLPVALVTDNDKITLGDRKRYAGFKDVATINIFADQRYELNTLEPQFVDANKHPLGKLCEVIGVDFTKYNTEELISKKMPKMETTWALRVFSSDVDLEFPDYINRLIIWANE

SEQ ID NO: 26409 - DNA, 363 bp, Unknown
  Obtained from environmental sample
  misc_feature (1)..(363): n is a, c, g, or t
atggttaaaaaaacgttggtgttaggagcatctttaaaagaagatagatattctaatgttgctattaaaaaattgattgcgaataagcatgaagtaaaagccattggtttaagaaaaggaaaaatcagtagcgttaaaattgttactggatttcccaaattaaatgatattgatacagtaacgttatatctacaaccgtcacgtcaaaaagaatattatgaatacctaatttccttaaaaccaaaaagggtaatttttaatccgggcactgagaatacagaatttattgaattattagaaagaaataatattgatatagaagttgcttgtactttggttttgcttacgatagatcgctactga

SEQ ID NO: 26410 - protein, 120 aa, Unknown
  Obtained from environmental sample
  misc_feature (1)..(120): Xaa is any amino acid
MVKKTLVLGASLKEDRYSNVAIKKLIANKHEVKAIGLRKGKISSVKIVTGFPKLNDIDTVTLYLQPSRQKEYYEYLISLKPKRVIFNPGTENTEFIELLERNNIDIEVACTLVLLTIDRY

SEQ ID NO: 26411 - DNA, 354 bp, Unknown
  Obtained from environmental sample
  misc_feature (1)..(354): n is a, c, g, or t
atgagtcaaaaaagaatttggaaagagtacataactgcacaatcaaaaattttagagcacaaatctaagcctattggaattgacacctcaaacactgttcagtttaatgggctaaaattaaatctttccattgaccaagaaatattcaaacaagttttcaagaaagaggttgaacatattttcaatatccaagactttagctttaacagcggatatattcagacaagcgttgaaaataccgcaaacattgaaaacaaacaactcactaacttaaaagaactttcagaaaagtgctacatcgactttaacgaaaacccagtcattgaaggaacaattacaaaancggggaaataa

SEQ ID NO: 26412 - protein, 117 aa, Unknown
  Obtained from environmental sample
  misc_feature (1)..(117): Xaa is any amino acid
MSQKRIWKEYITAQSKILEHKSKPIGIDTSNTVQFNGLKLNLSIDQEIFKQVFKKEVEHIFNIQDFSFNSGYIQTSVENTANIENKQLTNLKELSEKCYIDFNENPVIEGTITKXGK

SEQ ID NO: 26413 - DNA, 636 bp, Unknown
  Obtained from environmental sample
  misc_feature (1)..(636): n is a, c, g, or t
atgaaaattttaagtcaatcacaatataatcagggaattggtaaatacaagctcctttcttctaatgccggtgtaggttctattattacctctaaattaggctcctatgttttaatacttgatattaataaatggaagtttatagaatgggcaaatagaaaaatatctataatcagagaaaacgaatctgataatcaaaaaatatataatcaagctagaattgaaataaataatagagggcttttattagttgatgataagaggtttgtagaattcttaaaaattgaaaaagagctagaatctttggtttgtttgattgacattccacatatgtcattaaatgaaagttttaatactcctaactggaaaaatcacccaataaaaactgcacttgctagaaatgaagaagaaggtaagtcttctgattatatgataaatgctgctcattttcctaaatggttcatcagtgatcaaggaaaacaactacaaacaattagtgagtggaaagatatctgcaacactgaatgtcataaccagaatggccaattaaaaatgacccattttgctcctacacgagatggcaatgatttcaaccgtgaattcaattcccaaatctcgaacgtaccttgtcgataa

SEQ ID NO: 26414 - protein, 211 aa, Unknown
  Obtained from environmental sample
  misc_feature (1)..(211): Xaa is any amino acid
MKILSQSQYNQGIGKYKLLSSNAGVGSIITSKLGSYVLILDINKWKFIEWANRKISIIRENESDNQKIYNQARIEINNRGLLLVDDKRFVEFLKIEKELESLVCLIDIPHMSLNESFNTPNWKNHPIKTALARNEEEGKSSDYMINAAHFPKWFISDQGKQLQTISEWKDICNTECHNQNGQLKMTHFAPTRDGNDFNREFNSQISNVPCR

SEQ ID NO: 26415 - DNA, 474 bp, Unknown
  Obtained from environmental sample
  misc_feature (1)..(474): n is a, c, g, or t
atgttttcttatatcaaatttctattaaaatctcagaatcaacatggtttgcattcgccttttgtgtacgattttattaccaaaggattgtatcaacaaaaaataaaaaataacgaagtattagatgttaatgagctaaaaaatctatcaaaaaaacaattgataattttcactaaaattgtgaattattttgagattaaaaatattgattttgatataaattcctttgtagaaaacaaaaattcaacttataaaatgctctttacaaaagatttatcaactttaaaaaacatcaattttaagcttttaaattctcatcatatcattattgttgatcaaattcatcagcaaaaaaaagagtggcaaaacatcattaatttacaagatgcaacagttacaatagatctgttttattttggattaattttctttagaaaagaacaagtaaaagaacattttattataagaagttaa

SEQ ID NO: 26416 - protein, 157 aa, Unknown
  Obtained from environmental sample
  misc_feature (1)..(157): Xaa is any amino acid
MFSYIKFLLKSQNQHGLHSPFVYDFITKGLYQQKIKNNEVLDVNELKNLSKKQLIIFTKIVNYFEIKNIDFDINSFVENKNSTYKMLFTKDLSTLKNINFKLLNSHHIIIVDQIHQQKKEWQNIINLQDATVTIDLFYFGLIFFRKEQVKEHFIIRS

SEQ ID NO: 26417 - DNA, 777 bp, Unknown
  Obtained from environmental sample
  misc_feature (1)..(777): n is a, c, g, or t
atggaagttattttagccctaatttttttcgtaatttgtttaagctcactcgttatcacttttgtggcaataattcaaatagccagcaatgattttaaagaatctaaaatacaatggattataatttcaatgattgcgtttattggaccaatattatggctgactaaaggtcgcaaactcataattaaaaatggagaatccgaaagaaatgacaatacgaaaaaaacaagcctgcctgaacattattctcaactaataaagaatattggaacaccattaaaaatcctgactctaatagcattcgctcttattctttatggatatttagccagagtatttgatatatttttcttttgggaaagtaaatcaatcggatttggattattacttatagcaattgcgaaatttttgcttgacgatatcaatttaaggcgtgaaaacaaaatgcatcgaattgttttctatttagtattcggaattctatgcttatctattttcataaaaggcataattgctgttatcataccaaattctgacgcttacactacagctactgaacttttaaaaacagattctgaattaatagccgaagttggagaaattagctctttttcttatttgccttctggcagtatgggaacacataaagacaaatatggaacaactggtaatgcaaatttgactttaatagtaaaaggaaataaaaaatatattgagaagaatgtagtcttgataaaagaattagaagaagattggaaaataatatctctgaattaa

SEQ ID NO: 26418 - protein, 258 aa, Unknown
  Obtained from environmental sample
  misc_feature (1)..(258): Xaa is any amino acid
MEVILALIFFVICLSSLVITFVAIIQIASNDFKESKIQWIIISMIAFIGPILWLTKGRKLIIKNGESERNDNTKKTSLPEHYSQLIKNIGTPLKILTLIAFALILYGYLARVFDIFFFWESKSIGFGLLLIAIAKFLLDDINLRRENKMHRIVFYLVFGILCLSIFIKGIIAVIIPNSDAYTTATELLKTDSELIAEVGEISSFSYLPSGSMGTHKDKYGTTGNANLTLIVKGNKKYIEKNVVLIKELEEDWKIISLN

SEQ ID NO: 26419 - DNA, 900 bp, Unknown
  Obtained from environmental sample
  misc_feature (1)..(900): n is a, c, g, or t
ttgcaaaagttgaaatttcttttgatgatttttttgaagggccaggaaaattggatagaaatgattaaaggtttctttggtaattttcatgacaatgtagaagatgtaaaagaaaatgcagaaagagaaagtggggaacgatttttaggaaagcatcctgattctggtaaaacagttttagtaagacttggaaaattcggaccaattgcacaaattggagctccagaagatgaagaaaaaacttttgcaagcttaaataaagatcagaatttaggtacaattacaatggaagaagccttggaattgtttttattaccaaaaaccttaggaacttatgaaggtgaagaagtaattgtttctaatggacgttttggaccttacattaaattcggaactatgtttgtttctttggataaaggagaaaacccaatggaggttgatttatcaagagcagaagagttaattgttgccaaacaaaaagcagatgcaccaatttatcattatgaagatttgcctgtacaaaaaggtgttggacgttttgggccttttataaaatggaattctatttttatcaacgtaaataaaaagtacgattttgataatctttctgatgatgatattatagagttaatcgaaattaaaaagcagaaagaaatagataaagtacttcataattgggaagatgttggcattcgagttgaaaaagcaagatgggggcgttttaatgttttgaaaggtaaaattaaaattgagttaccaaaaactacagatatagaaaacttatcgaaagaagaagctgttaaaatgatcgaggcaaaaacaccgaagaaaaaagcagcgaaaaagaagcctgcagcaaaaaagaaagctccagctaaaaaaactgcaaaaaagaaataa

SEQ ID NO: 26420 - protein, 299 aa, Unknown
  Obtained from environmental sample
  misc_feature (1)..(299): Xaa is any amino acid
MQKLKFLLMIFLKGQENWIEMIKGFFGNFHDNVEDVKENAERESGERFLGKHPDSGKTVLVRLGKFGPIAQIGAPEDEEKTFASLNKDQNLGTITMEEALELFLLPKTLGTYEGEEVIVSNGRFGPYIKFGTMFVSLDKGENPMEVDLSRAEELIVAKQKADAPIYHYEDLPVQKGVGRFGPFIKWNSIFINVNKKYDFDNLSDDDIIELIEIKKQKEIDKVLHNWEDVGIRVEKARWGRFNVLKGKIKIELPKTTDIENLSKEEAVKMIEAKTPKKKAAKKKPAAKKKAPAKKTAKKK

SEQ ID NO: 26421 - DNA, 411 bp, Unknown
  Obtained from environmental sample
  misc_feature (1)..(411): n is a, c, g, or t
atgaacgacggtatgggcaattatgtggcccaagaggtagttaaattaatgattcaaaaggaatgtagggtaaaaggagggcatgtacttgttttgggcattacctttaaggaaaactgtcccgatattcgaaacagtaaagtaatagacgttataggggaattgcgtaaatacaacctcaatatagatgtttatgatccctgggcaaaagctaccgatgtttctaatgagttcggattgcgcttattgagcgaagaatcccaactgaaaagtaattatgaagctataatattggcagttggccataaagaattttcagattttcaactggaaaaatacaaagcatccccttctgttgtttttgatgtaaagtctttttttccaaaaacaattgtagacggatgtttatag

SEQ ID NO: 26422 - protein, 136 aa, Unknown
  Obtained from environmental sample
  DOMAIN (30)...(129): UDP-glucose/GDP-mannose dehydrogenase family, UDP binding domain
  misc_feature (1)..(136): Xaa is any amino acid
MNDGMGNYVAQEVVKLMIQKECRVKGGHVLVLGITFKENCPDIRNSKVIDVIGELRKYNLNIDVYDPWAKATDVSNEFGLRLLSEESQLKSNYEAIILAVGHKEFSDFQLEKYKASPSVVFDVKSFFPKTIVDGCL

SEQ ID NO: 26423 - DNA, 597 bp, Unknown
  Obtained from environmental sample
  misc_feature (1)..(597): n is a, c, g, or t
ttgttggaacaacaggaaattgaaaattataaaaagcatctggaagaattaaatgaatatattaaagacaatatggtgaatacattagggctttatgctacttcaatacgctggaaaggagcagaaaatctttatttttatgactctataactatcgcttttgaaaatgcttatcctgaactggaaatagctcaaaaattacgtgaaaaagtaagtcgattacaacaaacttctattggtggtattgcgccggatatcgaaatgaatactccggaagacaaggctataaagttatcttttgttcaaaaaaaatatactcttatcgatttttgggccagctggtgcggcccatgcaggagtgaaagtgaaacacttaacaaactctatcaacaatataatagtaaaggatttgagatttatggcgtttctttagatgataaaaaatacaaatgggtaaaagccatccaaaaagatgatagaacctggacaaacgtatcatcattacaaggttttaaaacccctgcatcatatgactatgctgttactgctttacctgataactacataatagatgctgaccagaaagatcatagataa

SEQ ID NO: 26424 - protein, 198 aa, Unknown
  Obtained from environmental sample
  misc_feature (1)..(198): Xaa is any amino acid
MLEQQEIENYKKHLEELNEYIKDNMVNTLGLYATSIRWKGAENLYFYDSITIAFENAYPELEIAQKLREKVSRLQQTSIGGIAPDIEMNTPEDKAIKLSFVQKKYTLIDFWASWCGPCRSESETLNKLYQQYNSKGFEIYGVSLDDKKYKWVKAIQKDDRTWTNVSSLQGFKTPASYDYAVTALPDNYIIDADQKDHR

SEQ ID NO: 26425 - DNA, 876 bp, Unknown
  Obtained from environmental sample
  misc_feature (1)..(876): n is a, c, g, or t
ttgatcaagaattcgcaaaaaaacaagaaaactataaccgttttacaaactgttttagatcatattgttgcaggtaaaagtttgtcagaatctataaaagatcaaaatgatttttcggattatgaatattattcgcttaagattggagaagaaacgggtactactgctaaaataacggaacaactgggagaattttatagtcgaaaaaatgaacaacgaaaaaacttgattaatgctattacttacccatgcattatactgagtacagctattatggtagtcatttttatgttgcagtttgttgtgccgatgtttgaggatatttttaaacagcaaaatgtagaattaccagcaattacgatttttgtagtcaatacttctgcttttattaaaaattatggatggttacttcttgtttttttcgtggctataattttatctagagcattattaaataaaaagcaatggtacaaaaagtctaaagatcttataatttctagaattccgtttgttggtagttttgtggaaacggtctacttatcgcaatttacacaagctattgcattgttagcggcttcaaaagtccctattgtgaatagtattaaattagtaaagaagatgattgatttttatccattgaccaatgctttagaaaccgttgaacaacaattattaaaaggagatacattgagtgatagtcttagtcggcacaaattgtttgatgctaaaatgatagccttggtaaaagtagcggaagaaactaatcagacagaatatatgtttgagagatntaacaatcagtataattctaaaagttcagcaacgtcaaaactattatctactgttatggaggctataattatactggtcgtttga

SEQ ID NO: 26426 - protein, 291 aa, Unknown
  Obtained from environmental sample
  misc_feature (1)..(291): Xaa is any amino acid
MIKNSQKNKKTITVLQTVLDHIVAGKSLSESIKDQNDFSDYEYYSLKIGEETGTTAKITEQLGEFYSRKNEQRKNLINAITYPCIILSTAIMVVIFMLQFVVPMFEDIFKQQNVELPAITIFVVNTSAFIKNYGWLLLVFFVAIILSRALLNKKQWYKKSKDLIISRIPFVGSFVETVYLSQFTQAIALLAASKVPIVNSIKLVKKMIDFYPLTNALETVEQQLLKGDTLSDSLSRHKLFDAKMIALVKVAEETNQTEYMFERXNNQYNSKSSATSKLLSTVMEAIIILVV

SEQ ID NO: 26427 - DNA, 567 bp, Unknown
  Obtained from environmental sample
  misc_feature (1)..(567): n is a, c, g, or t
atgtttgaaaaggatttatcgaaatatccagagttagaacacgcgagagatgtctttttaatggggtgctatacaggtcagcgtataagtgactataacggattaaaagaagaagatattattaccattgatggtgtgcaattttttgaaatcaaacaaaagaaaaaccgtaaatacggtagagttgtgcattgtcctattaccaaagaaatgaaatctataatgaatgcgaggtataacggaaaaccacctaaaaaaatacacgagcaagatttaaacgaaaacatcaaacaagttggtcaaatgttagaatgggatgagttaatcaagtgtgagtacaccaaaggcggtaagcttaatatagaaatgattccaaaatacgacttaatcaaatcgcatactgcaagaagaagtttctgcaccaacaaatataaagcaggaatgagtgtgtttgatataatgctattttcaggccatacaactgaaaaagaattttataagtatattagaatcaaaaatcaagaaagagcatcacatattgtcaaaggaggtttttttaacgtttaa

SEQ ID NO: 26428 - protein, 188 aa, Unknown
  Obtained from environmental sample
  DOMAIN (1)...(178): Phage integrase family
  misc_feature (1)..(188): Xaa is any amino acid
MFEKDLSKYPELEHARDVFLMGCYTGQRISDYNGLKEEDIITIDGVQFFEIKQKKNRKYGRVVHCPITKEMKSIMNARYNGKPPKKIHEQDLNENIKQVGQMLEWDELIKCEYTKGGKLNIEMIPKYDLIKSHTARRSFCTNKYKAGMSVFDIMLFSGHTTEKEFYKYIRIKNQERASHIVKGGFFNV

SEQ ID NO: 26429 - DNA, 690 bp, Unknown
  Obtained from environmental sample
  misc_feature (1)..(690): n is a, c, g, or t
atgtttgatactatccagtttacaaaggataaaaatgaaatgaaagattggtttccgttaatcatgcataacagagatgaagatgaagtgatggctgcatccagaattgacagaggtacagaggttaattatggaacgttaacggagacattattcaatattttagaaaccaaatttgatacaccagtgtattgtaatatggaagttatagatattgatccaagtccagatattgattggacggtagagatggaaaatattgaaactaacccaaaatataatctagaatctaaacatgtttttattggagcaggaggaggaagtcttcttttattacaaaaagtagaaattgaagaaaaagaaggatatggtggttttcctattagtggcgaatggttagtttgtaaaaatgaagacattattaaacagcataatgctaaagtatatagtaaggctggacttggcgatccgccaatgtccacaccgcatttagatacacgttatattaacggaaaacgcgaattgctttttggtccttttgcgggttttagccctaaatttttaaaagaaggttctaattttgatttattaaaatcggttaaatttgataatatttcgcctttattaggagctttttggcataatctaccattaactaagtatttaatagagcaatacatcctctcatga

SEQ ID NO: 26430 - protein, 229 aa, Unknown
  Obtained from environmental sample
  DOMAIN (1)...(229): Malate:quinone oxidoreductase (Mqo)
  misc_feature (1)..(229): Xaa is any amino acid
MFDTIQFTKDKNEMKDWFPLIMHNRDEDEVMAASRIDRGTEVNYGTLTETLFNILETKFDTPVYCNMEVIDIDPSPDIDWTVEMENIETNPKYNLESKHVFIGAGGGSLLLLQKVEIEEKEGYGGFPISGEWLVCKNEDIIKQHNAKVYSKAGLGDPPMSTPHLDTRYINGKRELLFGPFAGFSPKFLKEGSNFDLLKSVKFDNISPLLGAFWHNLPLTKYLIEQYILS

SEQ ID NO: 26431 - DNA, 765 bp, Unknown
  Obtained from environmental sample
  misc_feature (1)..(765): n is a, c, g, or t
ttgaatattgttatactgttctttttgctcagttttttggcgctggttctttcgcactttccagtttacaatgatatttggctctacgggaatagagattgtgtgagccttgaaatgcctaaaaataaaagaagctggttgggtcttaatataatatattttgataccagcaaagcaaaaccgggcaccagcgtcacttttgataatgaagccgtgaaaaatctgcgacgcagcttgggcgtcctcatttacattgcgatgttccaaatattcctaatgatgattccccgttactttggagtgtattttaatgcatcctatatttcggctttcttgctcctcattactttaatcgcatataatttttggggaaagcgttataaccagtggaaaaaagatttaaaagagggagatgaagcaancaaaaaggaaactgttgaatatattattaaatatgtgggcagatttccacgctattacctggcttgtgtaatcatggttctcataacggctattcttgtggccatctttaaatgggaccgcatcccttttattgcatttcttatcaccttgggttgccaaatgtacctctatatatatctcaaaatatgccgcacctttttaaagtatgtgtttcatacaaaagaacttcacgatgaaaaaacagacatgtttaaaaaggaaaccctggaactatttgacaaatacggcgatattaaaagcaaaaattccaagtatttgagtatttggacagttgagcgaann

SEQ ID NO: 26432 - protein, 255 aa, Unknown
  Obtained from environmental sample
  SIGNAL (1)...(18)
  misc_feature (1)..(255): Xaa is any amino acid
MNIVILFFLLSFLALVLSHFPVYNDIWLYGNRDCVSLEMPKNKRSWLGLNIIYFDTSKAKPGTSVTFDNEAVKNLRRSLGVLIYIAMFQIFLMMIPRYFGVYFNASYISAFLLLITLIAYNFWGKRYNQWKKDLKEGDEAXKKETVEYIIKYVGRFPRYYLACVIMVLITAILVAIFKWDRIPFIAFLITLGCQMYLYIYLKICRTFLKYVFHTKELHDEKTDMFKKETLELFDKYGDIKSKNSKYLSIWTVERX

SEQ ID NO: 26433 - DNA, 726 bp, Unknown
  Obtained from environmental sample
  misc_feature (1)..(726): n is a, c, g, or t
atgtggattagaattattagacagaatccaaatggagaaaattttgaagttagatttgaagtagaagataatggtattggaattagtgaagaaaagcaacaaaatatgtttgaaagtttttctcaaggatcaattcaaatcaaccgtaaatatggaggaactggacttggtctatccattgttaaaggattaatagatatattaaaaggaaaaatttacatgaaaagtcagctaggaaaaggaactacctttttctttgaaatacctatgaaaaaaagtaatgagattattgttgagaaaaaggcaaactactttaacgaaattgacgaaattgaattaagcaacataaaaatactagttgtagaggataacaagattaaccaaatgatcaccaaaaaaatcctgaataaaatgaaactgtattgtgacgttgtggataatggtgaagaggctgttgacatggttaaaaccaccaaatacgatgttgtattaatggacatccacatgccaggaattagtggtatggaagccacaaaaattatcagaacctttgataaagaacttactatttttgcattaactgctgttactattgaggataaaatgcaagaatttgaagaagctggatttacagatattatccctaaaccttttaaacaagaagacttcgagaaaaaactttttaatgccttaatgctatcggaaaaaggaacaaccctaccctaa

SEQ ID NO: 26434 - protein, 241 aa, Unknown
  Obtained from environmental sample
  DOMAIN (2)...(91): Histidine kinase-, DNA gyrase B-, and HSP90-like ATPase
  misc_feature (1)..(241): Xaa is any amino acid
MWIRIIRQNPNGENFEVRFEVEDNGIGISEEKQQNMFESFSQGSIQINRKYGGTGLGLSIVKGLIDILKGKIYMKSQLGKGTTFFFEIPMKKSNEIIVEKKANYFNEIDEIELSNIKILVVEDNKINQMITKKILNKMKLYCDVVDNGEEAVDMVKTTKYDVVLMDIHMPGISGMEATKIIRTFDKELTIFALTAVTIEDKMQEFEEAGFTDIIPKPFKQEDFEKKLFNALMLSEKGTTLP

SEQ ID NO: 26435 - DNA, 528 bp, Unknown
  Obtained from environmental sample
  misc_feature (1)..(528): n is a, c, g, or t
atggtttgtaataccattgaagctaaaaaccaaaccgttttttacgccacacaagccagagataacgcaccacattacgagcattctaagataggatacaattatagaatgagcaatataagtgctggtattggcagaggacaaatggaagtcttagacaaacatataggattaagaagagacatgaataccttttatgttaacctatttaaaaacattaaaggtatagaagtccaaaaacaacctaacactgacttttactcaaatttttggttaagttgtattttaatacatgaagaggcaccttttaccaaagcacagtttcaaaaagcaatggaggctgcaaatattgaaaccagacctttatggaagccaatgcacatgcaacccgtttttaaaacagcaatatattatggagataatttaagcgaagtgttgtttaaaaaaggactatgcttaccaagcggttctaatttgataaaagaagacttagaccgtattacaaaagttgtaaaaggactactttaa

SEQ ID NO: 26436 - protein, 175 aa, Unknown
  Obtained from environmental sample
  DOMAIN (1)...(172): DegT/DnrJ/EryC1/StrS aminotransferase family
  misc_feature (1)..(175): Xaa is any amino acid
MVCNTIEAKNQTVFYATQARDNAPHYEHSKIGYNYRMSNISAGIGRGQMEVLDKHIGLRRDMNTFYVNLFKNIKGIEVQKQPNTDFYSNFWLSCILIHEEAPFTKAQFQKAMEAANIETRPLWKPMHMQPVFKTAIYYGDNLSEVLFKKGLCLPSGSNLIKEDLDRITKVVKGLL

SEQ ID NO: 26437 - DNA, 606 bp, Unknown
  Obtained from environmental sample
  misc_feature (1)..(606): n is a, c, g, or t
atgaaaaatcataaaattgtattcgtatgctcatatcctccacgcgagtgcggtattgctactttttcacaagatttgatacggaccttgaaaagatgctttggctcaaccatggatatcgaggtttgtgctctggaaaatgaatgctgcgatgctaatgattatccagaagaagttacatataaaatagatgcccaagagttaaattcctttttcaaagtagctaataagttaaatgaaagggacgatattggaatggtttgtatacaacacgagtttgggctgtttggaggtgactacggtagccatttagtggctttccttcttaagttagacatcccaatctcttgtgtgtttcatacggttcttcccaatcctgataaaaaaagaactaaaataatgcaggcgttggatgatctttccgagaaactgattgtactcacaaacaaatccgcagaaatactagaaattgattatcatattgatactaacaaaatagctgtcataccccatggcacccatattgtgctgtggaaagaaaaacaacgtcttaaaaatagatatggctttcaaaataaaaatgtactatccacatttgttatttaa

SEQ ID NO: 26438 - protein, 201 aa, Unknown
  Obtained from environmental sample
  misc_feature (1)..(201): Xaa is any amino acid
MKNHKIVFVCSYPPRECGIATFSQDLIRTLKRCFGSTMDIEVCALENECCDANDYPEEVTYKIDAQELNSFFKVANKLNERDDIGMVCIQHEFGLFGGDYGSHLVAFLLKLDIPISCVFHTVLPNPDKKRTKIMQALDDLSEKLIVLTNKSAEILEIDYHIDTNKIAVIPHGTHIVLWKEKQRLKNRYGFQNKNVLSTFVI

SEQ ID NO: 26439 - DNA, 546 bp, Unknown
  Obtained from environmental sample
  misc_feature (1)..(546): n is a, c, g, or t
atgaaaattgaaaaagacagattagaagacttaaaatcatacaacataatggatacctctacagaagaggaactggatgaacttgttgaaatagcttctttaatttgtgacactcctgtttcattaatcacattaatcgatgagaaccgtcaatggtttaaggcaaacaaaggtttagcttcattacaaacactacgagaagactcgttttgccaacatacgttgcataatccaaaagatgtattagtgattaatgattcgctaaatgacgatcgcgttaaaaatagccctatggttaaaggccagcccaacattcgtttttatgctggtgctcctttagaaacaccagatggaaacgttttaggaacattgtgtattatagattataagcctaggactattacaaaaaatcaggaaaaagtattaaaaatactctcaaaaaaggtaatggattacctgaatcttcgcagagaactccaaaaccaaaagaaaacaattgaattaaacatagaaacgaatcactggagccgattcttgatccactag

SEQ ID NO: 26440 - protein, 181 aa, Unknown
  Obtained from environmental sample
  DOMAIN (20)...(153): GAF domain
  misc_feature (1)..(181): Xaa is any amino acid
MKIEKDRLEDLKSYNIMDTSTEEELDELVEIASLICDTPVSLITLIDENRQWFKANKGLASLQTLREDSFCQHTLHNPKDVLVINDSLNDDRVKNSPMVKGQPNIRFYAGAPLETPDGNVLGTLCIIDYKPRTITKNQEKVLKILSKKVMDYLNLRRELQNQKKTIELNIETNHWSRFLIH

SEQ ID NO: 26441 - DNA, 306 bp, Unknown
  Obtained from environmental sample
  misc_feature (1)..(306): n is a, c, g, or t
ttgattcggctcagacttaagttacaacgcgttattgaagattttgaggttgcttttgccaaacaaaatcgcgaaattttagtaggtccattacaaagttttatgaagcaaatgattccggatggcttacacgtcaaacttttaatttacaaagacaatgtgcttattgacaccattataaaaacatcttttcatgggtatgttacttttaatttaaagcctgcagtttaccaaaacgacacgtatagttttagtgttgaaaccgctggaataaataaaacatttaataataaaaaactatggtag

SEQ ID NO: 26442 - protein, 101 aa, Unknown
  Obtained from environmental sample
  misc_feature (1)..(101): Xaa is any amino acid
MIRLRLKLQRVIEDFEVAFAKQNREILVGPLQSFMKQMIPDGLHVKLLIYKDNVLIDTIIKTSFHGYVTFNLKPAVYQNDTYSFSVETAGINKTFNNKKLW

SEQ ID NO: 26443 - DNA, 477 bp, Unknown
  Obtained from environmental sample
  misc_feature (1)..(477): n is a, c, g, or t
atggttatcgcttggttagacaacatgattgatttggtaaaatctatagataaggtacatcctgtaactattgcttggtcaaacacccaaagtgcaccaattttaaaagacaaggtagatattgtatcgtttcattattatgaagacttaagcgaattagatgaagctatgaaaaccttgaaaaaagaaatacctgacaaaccattagtattacaagaatttggtatctcatcttacaatggtttttggaaacctttgggaagtaatgtagaggatcaagctaattatcataaaaaaatacaagaaattattgctactaataaattacaatttatgtcttggacattatatgattttgtcgacgtaccaaaagctgtagttggtagcagaccttggcgtagaaatacccaaaagcattttgggtttattgataaaaatggtgtaaaaaaagcatcgtttaaatatattactaactag

SEQ ID NO: 26444 - protein, 158 aa, Unknown
  Obtained from environmental sample
  misc_feature (1)..(158): Xaa is any amino acid
MVIAWLDNMIDLVKSIDKVHPVTIAWSNTQSAPILKDKVDIVSFHYYEDLSELDEAMKTLKKEIPDKPLVLQEFGISSYNGFWKPLGSNVEDQANYHKKIQEIIATNKLQFMSWTLYDFVDVPKAVVGSRPWRRNTQKHFGFIDKNGVKKASFKYITN

SEQ ID NO: 26445 - DNA, 393 bp, Unknown
  Obtained from environmental sample
  misc_feature (1)..(393): n is a, c, g, or t
atgaaaacgaagtcactatccttttttatggcccacaatgctatatcgcctagcatatatacaactactcaattaccaacttggaattatattagagtacatttaactggaaaagtgactaaaattgaaagtactgaagctttaaaacaatcgttgattactatgactgaatttttagaagctccagaccacaactatgttttggaaaccgacaatcctagattagataaaaatttagagtatattaaaatgtttgaaatcacaatagacacttgggaaggcaagtttaaattgtctcaagataaaaaaccaaaggataaggaaaatgcacgccaagccttaataaaagctaaccaagaaagcattaaacaatttttagattcaattttttaa

SEQ ID NO: 26446 - protein, 130 aa, Unknown
  Obtained from environmental sample
  SIGNAL (1)...(13)
  misc_feature (1)..(130): Xaa is any amino acid
MKTKSLSFFMAHNAISPSIYTTTQLPTWNYIRVHLTGKVTKIESTEALKQSLITMTEFLEAPDHNYVLETDNPRLDKNLEYIKMFEITIDTWEGKFKLSQDKKPKDKENARQALIKANQESIKQFLDSIF

SEQ ID NO: 26447 - DNA, 342 bp, Unknown
  Obtained from environmental sample
  misc_feature (1)..(342): n is a, c, g, or t
ttgatggaaacctctcaacccaaaaagacttggtctttacaagataataaacgtacacaatcagaacgcgatttatttaaagcaacagggaagcctaaaaaaaataagaatgttacgtatttgctttctgtaataggtgctttattgttagttagctttttgctgcctaaattatacgatcaggtaattactgtttgtataatagacactatatgtttaaattcagagcataactttatattatatccactgtatattttttgtactatagtaatattgatcttagcaatttatggtgcttatgtagttggtaaaaaaataggagaacggtttaaggtttaa

SEQ ID NO: 26448 - protein, 113 aa, Unknown
  Obtained from environmental sample
  misc_feature (1)..(113): Xaa is any amino acid
MMETSQPKKTWSLQDNKRTQSERDLFKATGKPKKNKNVTYLLSVIGALLLVSFLLPKLYDQVITVCIIDTICLNSEHNFILYPLYIFCTIVILILAIYGAYVVGKKIGERFKV

SEQ ID NO: 26449 - DNA, 360 bp, Unknown
  Obtained from environmental sample
  misc_feature (1)..(360): n is a, c, g, or t
atgaacatcaaaaatacagcattaaaagaaagaattaaggaacttacttgtttgtatgaagtttcttcaattattgtaaatgctgatgctgtagagatttcagaaacactaaaagcaattggtaaaagcttaaaaaagggtttccaatttcctgaacaaacagaaattttaattgaaattcctttacataattacaaaactggaaatataaataatgaacatcaaatttctgctgatgtaattctgttcaacaaaattaaagggaaaattgttgcatccataaaaaaaaaatcttttttatttttaagtgaagagcaactattattagacaatgttgctttaaaactggggatttattag

SEQ ID NO: 26450 - protein, 119 aa, Unknown
  Obtained from environmental sample
  misc_feature (1)..(119): Xaa is any amino acid
MNIKNTALKERIKELTCLYEVSSIIVNADAVEISETLKAIGKSLKKGFQFPEQTEILIEIPLHNYKTGNINNEHQISADVILFNKIKGKIVASIKKKSFLFLSEEQLLLDNVALKLGIY

SEQ ID NO: 26451 - DNA, 456 bp, Unknown
  Obtained from environmental sample
  misc_feature (1)..(456): n is a, c, g, or t
atgaaatttatacagtatttaagcctttcgatagtatcaagttttttatttatgcaatgctctagcgcacaaaaacttcaaaaggaagcagcttttcaaacagataaagcctactatcaaaaatgggtagcaggtcttaaggatggtggttctggtataaatgtgtttattcctatagactctaattctaaaaatttaaaattagatagtttatattttagaggacatatagtaaccttacaaactaaacctaattttcctgatttgtacattggacgtataacaactaatgccaatcagccaaaagattatagtgtagatacatcagatattccttttgacttaaaggataacgaagcagtagttagttatacagaaaatggtacaactaagtacttaaagattgagaatctagtcgaaaaacaaatggacaatacccactcgaccgattcttga

SEQ ID NO: 26452 - protein, 151 aa, Unknown
  Obtained from environmental sample
  misc_feature (1)..(151): Xaa is any amino acid
MKFIQYLSLSIVSSFLFMQCSSAQKLQKEAAFQTDKAYYQKWVAGLKDGGSGINVFIPIDSNSKNLKLDSLYFRGHIVTLQTKPNFPDLYIGRITTNANQPKDYSVDTSDIPFDLKDNEAVVSYTENGTTKYLKIENLVEKQMDNTHSTDS

SEQ ID NO: 26453 - DNA, 555 bp, Unknown
  Obtained from environmental sample
  misc_feature (1)..(555): n is a, c, g, or t
atgctactttcaccttttaatatgctggttatggatgagccaaccaatcatttggatattgcttccaagaatgttttaaaacgagcattacaaaattttgaaggcaccttaattttagtatctcacgaccgtgattttttacagggattaactaaaacagtttatgaatttaaaaatgggcatattaaagaatatctgggagatattgattattatttgtctacacataatatcgataatttacgtgaagttgaaaaaagaactcaagtaaataagattaaagatacaagtgtcaaaaaatcataccatcaaatcaaacaaagtcaaaaagagtttaaaagactgcaaaataaattgactaaaattgaaagtgatatagctatcatggaagacaatatttctactattgatgtagatttatcagataatgaaaagtacaaagagctaacttctgatcccgatttttttaataattaccaagtgaaaaaggataatttagataagctgatgaaagaatgggagaaattgcatgggttattagaacatttaaaatag

SEQ ID NO: 26454 - protein, 184 aa, Unknown
  Obtained from environmental sample
  misc_feature (1)..(184): Xaa is any amino acid
MLLSPFNMLVMDEPTNHLDIASKNVLKRALQNFEGTLILVSHDRDFLQGLTKTVYEFKNGHIKEYLGDIDYYLSTHNIDNLREVEKRTQVNKIKDTSVKKSYHQIKQSQKEFKRLQNKLTKIESDIAIMEDNISTIDVDLSDNEKYKELTSDPDFFNNYQVKKDNLDKLMKEWEKLHGLLEHLK

SEQ ID NO: 26455 - DNA, 801 bp, Unknown
  Obtained from environmental sample
  misc_feature (1)..(801): n is a, c, g, or t
ttgttcgggtcagtaagtaggtatgtgtatctagagtttaatgaagagtcttttagagcgtttgaagccatttataataacatcaaaacaacttttttaagtcagtttaatgctatcgttaaagatgaaaaaatcaatagagctttacttagtagaactaataaaaaaattaagcaaggagaagctagaaaagacaatcatttagctagacagtttagagatgaaaagactaatgctgatactaaaattgaagattttctaaatgaaaagaataatcttttagaggaagttggtggattaagattgaagctaacttcacataaaaaagtaagatctgaatatgagaaaaactttaatttagtagagacagataaaaagaagtacgatgttacccaaaaacttttagttaagattaatgagttaattaaaagaatcaaggaagataaaaagtattctttacaaaaatctgtgtctttaggtttaaagaagttaatgcataaaaaagatttcatttctaatgttagagttaatattatagatgatgttatggacattgacttattagacaaaaaaggacaagtaatagataaggactccttatctaaaggagagcaacagctttatgcaacagctttgttaaaagcacttgtcgatgagtctggaattaagtttcctgtttttattgatagtcctttacagaagtttgataagtatcactctaagaacataattaaagagttttacccatctatttcagaaccggtagtgtcgtttcctttattggcccaagagcttgtctga

SEQ ID NO: 26456 - protein, 266 aa, Unknown
  Obtained from environmental sample
  misc_feature (1)..(266): Xaa is any amino acid
MFGSVSRYVYLEFNEESFRAFEAIYNNIKTTFLSQFNAIVKDEKINRALLSRTNKKIKQGEARKDNHLARQFRDEKTNADTKIEDFLNEKNNLLEEVGGLRLKLTSHKKVRSEYEKNFNLVETDKKKYDVTQKLLVKINELIKRIKEDKKYSLQKSVSLGLKKLMHKKDFISNVRVNIIDDVMDIDLLDKKGQVIDKDSLSKGEQQLYATALLKALVDESGIKFPVFIDSPLQKFDKYHSKNIIKEFYPSISEPVVSFPLLAQELV

SEQ ID NO: 26457 - DNA, 708 bp, Unknown
  Obtained from environmental sample
  misc_feature (1)..(708): n is a, c, g, or t
atgaccataaaagaatctatactaaagtgccttgaagatacaaaatcaatgctcacaacaactgagatatacgaacatattgttaaaaaaggttattatgaatttggtgcaaaaaaaccaacgcacgttatttatagtgaaataagagatttaagaattaaaggagacacaagaataaaaagaattaaattttcgggaaaaaattataagtattatttaaaaaagttagagagtgaaattaatattgacaaggttgaattaagcattactaaaactccaacaaggaatgattttaaggaaagagacttacatattttgctagcaacatatctaaaaaactctaacacttattgtaaaacaatttttcacgaacagtcaaagaattctaaagatagccatcaaaagtgggtgcatccagatactattggaatacaatttactagtcttaaatcaaaaatcaatcaagtatttctaaaagccataaatagacttgaatcttttagaatttcttcctacgaaatacagacagagatacactcagatcatgacttaaaaaaacattatttccaagcagtttcaaattcaagctgggctacttatggatatcttgttgcttttgaacttagtgacactttatttgaagaactggccagattaccatcactctcttggcattggagttatacagatagctacaaatccttatga

SEQ ID NO: 26458 - protein, 235 aa, Unknown
  Obtained from environmental sample
  DOMAIN (3)...(234): Protein of unknown function (DUF511)
  misc_feature (1)..(235): Xaa is any amino acid
MTIKESILKCLEDTKSMLTTTEIYEHIVKKGYYEFGAKKPTHVIYSEIRDLRIKGDTRIKRIKFSGKNYKYYLKKLESEINIDKVELSITKTPTRNDFKERDLHILLATYLKNSNTYCKTIFHEQSKNSKDSHQKWVHPDTIGIQFTSLKSKINQVFLKAINRLESFRISSYEIQTEIHSDHDLKKHYFQAVSNSSWATYGYLVAFELSDTLFEELARLPSLSWHWSYTDSYKSL

SEQ ID NO: 26459 - DNA, 399 bp, Unknown
  Obtained from environmental sample
  misc_feature (1)..(399): n is a, c, g, or t
ttgaataattatatagagtactgctatctagaaaatgataagcctagctatgaacgaattaagttaactgaatccgacttatctgagtgcataaataaatatagagtattctcacgaaaacttgagatagaaaatttatttgacgttttgatagaggagtttaaaacattcaaatcattgcttactatggctcaactttcacaagagttttcacatttctctgaggtacatgcttatatagaaaatcaaaaagcccgtactaaattaaatatctcctatctaagtattttgaatactggaaaattagttttagatcggttgtacaataaacgtgataatttttcgataattaatgatattgatcaatctttattacctgaactattaatagaaagatag

SEQ ID NO: 26460 - protein, 132 aa, Unknown
  Obtained from environmental sample
  misc_feature (1)..(132): Xaa is any amino acid
MNNYIEYCYLENDKPSYERIKLTESDLSECINKYRVFSRKLEIENLFDVLIEEFKTFKSLLTMAQLSQEFSHFSEVHAYIENQKARTKLNISYLSILNTGKLVLDRLYNKRDNFSIINDIDQSLLPELLIER

SEQ ID NO: 26461 - DNA, 570 bp, Unknown
  Obtained from environmental sample
  misc_feature (1)..(570): n is a, c, g, or t
atgcaggaccaggtaaccgacatggttccttatatatccggcgacataatcaataaaaaggccgccaactggctggggacttatacaaagcaagccgactataagccgtttttcctctgggcacactatatggatgtccatgagccttatatcccagatcaaaaatatatcgacaagatcgatccttccataaaactaactaaaggtgaaatgttcaccatgttcaaagaggtcatcctgccgcgagatgcctctgaccccgacaaaatagaacttctcagaaagttgtattgcgctcatgtaatccaggttgatgaatacgcaaaagaatttttcagcaatctcgaaacgttaggcctgcttgataatacaatagttattatcacaaccgaccacggcgatgagtttggtgatcacgcaagtctttcccacgacggcaacatgtattcagaactgctaaatgttccgcttatcatttacgactctgaccttaaagaaaacaagagagttgatactgtcgtaaagcggagtcgatgtaagccctactatagcaaatctgtttggacttga

SEQ ID NO: 26462 - protein, 189 aa, Unknown
  Obtained from environmental sample
  misc_feature (1)..(189): Xaa is any amino acid
MQDQVTDMVPYISGDIINKKAANWLGTYTKQADYKPFFLWAHYMDVHEPYIPDQKYIDKIDPSIKLTKGEMFTMFKEVILPRDASDPDKIELLRKLYCAHVIQVDEYAKEFFSNLETLGLLDNTIVIITTDHGDEFGDHASLSHDGNMYSELLNVPLIIYDSDLKENKRVDTVVKRSRCKPYYSKSVWT

SEQ ID NO: 26463 - DNA, 786 bp, Unknown
  Obtained from environmental sample
  misc_feature (1)..(786): n is a, c, g, or t
ttgaatatttatcttccaaatggttattccgcagattccctaaaaacctatcctgtaatttatttacttgacggctctattgacgaagattttgtacatattgcaggtttggtacaatttggctccttttcttggatcaatatggttcctgaatctattgttgttggtatagcaaatgttgacagaaaaaaagattatacctatccgtctactgataaggaatatgtgaaagaatatccaactacgggtcattcctcgccatttataaaatttattgcagaggaagttcagccgttcattgaaaaaacatataaagtttctttggaaaaaacactcattgggcaatctttaggaggtcttttagcaaccgaaatacttttcaaaaaaccagatatgttcaacaattacataattgttagcccaagtttatggtatgattatgagtctttgctgaaaagtacaccccaagcctaccaaacaaataaatcaatttttatatctgtgggcgaagaaggagattggatgaaaagagtagcaaaggaattgtatgaaaaactggagaaatctaacaataaaaacaccaaattatactataaatttttaaaagaccaagaacacggagacgcactccatcttgcagttatagtgcttgtgaagaaatgtttccagagaaaaaaaagtagctgtgcaaaaaatactaactacataaacgggaattccttggaccgtttccaaaacattgttggagaattacatccttctattggcgaagcctattcgcaatag

SEQ ID NO: 26464 - protein, 261 aa, Unknown
  Obtained from environmental sample
  DOMAIN (2)...(209): Putative esterase
  misc_feature (1)..(261): Xaa is any amino acid
MNIYLPNGYSADSLKTYPVIYLLDGSIDEDFVHIAGLVQFGSFSWINMVPESIVVGIANVDRKKDYTYPSTDKEYVKEYPTTGHSSPFIKFIAEEVQPFIEKTYKVSLEKTLIGQSLGGLLATEILFKKPDMFNNYIIVSPSLWYDYESLLKSTPQAYQTNKSIFISVGEEGDWMKRVAKELYEKLEKSNNKNTKLYYKFLKDQEHGDALHLAVIVLVKKCFQRKKSSCAKNTNYINGNSLDRFQNIVGELHPSIGEAYSQ

SEQ ID NO: 26465 - DNA, 594 bp, Unknown
  Obtained from environmental sample
  misc_feature (1)..(594): n is a, c, g, or t
ttganttcggctcgagatgcgcctataaaagaaaatgtttacattccaaaaccgaataaaaacgcaagcgaaaatcctttacctaaccaagagtattcaccacaaatcaaagataaaccattaccaatttggttaaaacaaaaacaaaaagtagaaccagaagccgataaaatctaccggccatcaggtcaaattatagcacagctatcaggtcagaattccttagctttaaatcgtgataattatgaaaaattactaacggttgaagactatatttacgaaacacaaacgtttaaacgtattctaaatcaagaatcgacaactatagaaggcatcgatgaaggctattatattatcgggactttagtttacgattttgatgaggctattgcttaccaaaatgaattaaaagggaaaggtgttaactcgaaaatttttaaggataaaggaaactctttttatgtgtatctctataattcagataatttttacgatgtatttatgcttagaaaagcattcctcaaagtcgactttttaaggaaagttgggatactgaatataaatataaaaaagggaggactaaaaaagatataa

SEQ ID NO: 26466 - protein, 197 aa, Unknown
  Obtained from environmental sample
  misc_feature (1)..(197): Xaa is any amino acid
MXSARDAPIKENVYIPKPNKNASENPLPNQEYSPQIKDKPLPIWLKQKQKVEPEADKIYRPSGQIIAQLSGQNSLALNRDNYEKLLTVEDYIYETQTFKRILNQESTTIEGIDEGYYIIGTLVYDFDEAIAYQNELKGKGVNSKIFKDKGNSFYVYLYNSDNFYDVFMLRKAFLKVDFLRKVGILNINIKKGGLKKI

SEQ ID NO: 26467 - DNA, 657 bp, Unknown
  Obtained from environmental sample
  misc_feature (1)..(657): n is a, c, g, or t
atgcaattcagtactattttaggtcaaactcatattaaaaaacatcttacgcaaagcgtttttaatggtagaattcctcacgcccaattatttattggtccagaaggctctggaacgttaccaatggcaattgcttatgctcagtatattttgtgtaagaatactgaaggtaacaacaacaacggtaacgtagcttgtaacttaaaatttaagtcgttttctcatcctgatttacattttgcctttccagtaactacaaacgataaaattaaaaagcatcctgtttctaaacatttcttagaagaatggcgagatttattaactacccaaccgtatggtaatttatttgattggtataaacgtttgggggtagataacaagcaaggtcaaattggggtagatgaagcgcaagacatcgtaaagtctttaagtttaaaagcatacgaaggaggccataaagtgatgattatttggatggctgaacagatgaacacatctgcgtccaataagctttcaaaactacttgcagagccgncaaggcaaaaccgtattatactaattactgaagatgaagaacaacttattaccactataaaatccaaatgccattattacatttcccgcattagcagaattgatattcaagaagcttactaa

SEQ ID NO: 26468 - protein, 218 aa, Unknown
  Obtained from environmental sample
  misc_feature (1)..(218): Xaa is any amino acid
MQFSTILGQTHIKKHLTQSVFNGRIPHAQLFIGPEGSGTLPMAIAYAQYILCKNTEGNNNNGNVACNLKFKSFSHPDLHFAFPVTTNDKIKKHPVSKHFLEEWRDLLTTQPYGNLFDWYKRLGVDNKQGQIGVDEAQDIVKSLSLKAYEGGHKVMIIWMAEQMNTSASNKLSKLLAEPXRQNRIILITEDEEQLITTIKSKCHYYISRISRIDIQEAY

SEQ ID NO: 26469 - DNA, 753 bp, Unknown
  Obtained from environmental sample
  misc_feature (1)..(753): n is a, c, g, or t
atgcattggatgattatggttataagccactgccgacattctgttggtataatttttaaatttgntggaacagataacgacaacgacggtataattaataaagaagataattgtcctaatgtatttgntttagcaatgtttaatggttgcccagatacagataaagatggtataatggatcaagaagataattgtccagatatcgctggaactttaaatggttgtccagacgctgataacgatggtgttgcagacccatatgacaaatgtccaaattttgctggagacaaaactaataacggttgtcctttacctgataccgataatgatggtgtaccagacaaatttgacaaatgtccctctgttaaaggactaaacaataataatggttgtcctcctgaagctgatattaatcaaacaaatatagcatctaaaccaaaagctgttttaatttattttgaattaagtaaatctgaaatcacagctgaaagcaaaaaaatattagataatgttgcctcttacattacaaaatcaaacattaaaacttacgaaatatcaggacacacagataatacgtcctctgcagaaactaatttaaaactgtctttagctagagccaatgctgttagagattatttagttgcaaaaggtattgataaaaccaaactaataacgcgaggttttggtgaagaatttcctgttgattcttctaatacggaagaaggcagacataaaaacagacgtgtagaataa

SEQ ID NO: 26470 - protein, 250 aa, Unknown
  Obtained from environmental sample
  DOMAIN (152)...(247): OmpA family
  misc_feature (1)..(250): Xaa is any amino acid
MHWMIMVISHCRHSVGIIFKFXGTDNDNDGIINKEDNCPNVFXLAMFNGCPDTDKDGIMDQEDNCPDIAGTLNGCPDADNDGVADPYDKCPNFAGDKTNNGCPLPDTDNDGVPDKFDKCPSVKGLNNNNGCPPEADINQTNIASKPKAVLIYFELSKSEITAESKKILDNVASYITKSNIKTYEISGHTDNTSSAETNLKLSLARANAVRDYLVAKGIDKTKLITRGFGEEFPVDSSNTEEGRHKNRRVE

SEQ ID NO: 26471 - DNA, 753 bp, Unknown
  Obtained from environmental sample
  misc_feature (1)..(753): n is a, c, g, or t
gtgaactggacatatgaagccgaaggtgtatcaaagaccaatgaagttggagaagatgcacacggcgaagaagcccacgttgaaggagaggaagaaggtggtcacagcgaggaagaaggcgttgtagaacttacaaagcaacaagctgaaaccatcggtttggaaatgaaatctttggaggaacggaatttagggaacaacattaaggtaacaggtacgctggaacttttcccacaggataaggcgaatatcagtccgtttgttggtggaaatgtgagttccataaaagtaatacctggagataatgtaagtaaaggacaggtattggcatatatagaacacccagatatcattgcaatgcaacaggaatatcaggaaaaaaatgacgaactggtctttttgaaacaggattttgagcgcaagcagactctttatgacaaaggtgtttcttctggaaaggaatttcagatggcgcagtcaaaatttcgttccacaacatccagcgtcaatggtttgcggtcccaattgagactgttgggcattaatccggacaaagtggctgaaggccaaatatattccgctgttcccattaccacacccataagtggctatgtggatgaagtaatgattagccttggcgattacgtggcgcaacaatccaaaatgttctcaataagcgataattcaaagatttatgtcaaattcaaaatatatgagaaggacataaactttaccagaaggacaacagcttga

SEQ ID NO: 26472 - protein, 250 aa, Unknown
  Obtained from environmental sample
  misc_feature (1)..(250): Xaa is any amino acid
MNWTYEAEGVSKTNEVGEDAHGEEAHVEGEEEGGHSEEEGVVELTKQQAETIGLEMKSLEERNLGNNIKVTGTLELFPQDKANISPFVGGNVSSIKVIPGDNVSKGQVLAYIEHPDIIAMQQEYQEKNDELVFLKQDFERKQTLYDKGVSSGKEFQMAQSKFRSTTSSVNGLRSQLRLLGINPDKVAEGQIYSAVPITTPISGYVDEVMISLGDYVAQQSKMFSISDNSKIYVKFKIYEKDINFTRRTTA

SEQ ID NO: 26473 - DNA, 501 bp, Unknown
  Obtained from environmental sample
  misc_feature (1)..(501): n is a, c, g, or t
ttgtcaaaacatatagaccaggctccagaatgttttagtcctaatgtaattatgcgtccattgtatcaagaagttattttgccaaatttatgttacattggtggaggtggtgagctagcttactggtttcagttaaaagctaattttgaagctaataatgtcgtttttccaatattacttttacgtaattcggttttaataaaaacaaaacagcaagcggataaacttaaaaaactaagcatatctgataaggacttgtttttaaaacgtgatagttttattaacaaaaaagtacgtgaaatttctaatattgatattgatttttctgagcaaattcaacatctaaaattacagtttcaacaactttataagcttgcagaatcaacggataagtctnttgttggtgctgtagcttctcaagaaaaaaagcaaattaatgggttggcacatcttgaaaaaagattgttaactgctccaaaaagaaaatttaagatcatgtag

SEQ ID NO: 26474 - protein, 166 aa, Unknown
  Obtained from environmental sample
  misc_feature (1)..(166): Xaa is any amino acid
MSKHIDQAPECFSPNVIMRPLYQEVILPNLCYIGGGGELAYWFQLKANFEANNVVFPILLLRNSVLIKTKQQADKLKKLSISDKDLFLKRDSFINKKVREISNIDIDFSEQIQHLKLQFQQLYKLAESTDKSXVGAVASQEKKQINGLAHLEKRLLTAPKRKFKIM

SEQ ID NO: 26475 - DNA, 594 bp, Unknown
  Obtained from environmental sample
  misc_feature (1)..(594): n is a, c, g, or t
ttgataataggaggaaacggtacaataggaaaaactgttgttgcgcattttaaagaaaacaaccaaataataatcgctggacgtagcaatagcgatgtaactgttgatatttcagatagcaagtcaataaaagctatgtttgaacaaattggaaaattagatgctattatttgtattgcaggagaggcaaaatgggacgattttaataatcttactgaagacgattattatattggattaaaaagtaaattaatgggacaagttaatctggttcgtattggacaacagtatttaaacccaaaaggatcaataactttatccactggtattttagcagacgatcctgttgttaagacaacaagtgctgctatggtaaatggtggtattcatagttttgtacaagcagtagctctagaaattgaaaacggaattagagtaaatgtggtttcttcaggaatggtagaagatgcttataaaaaatacaaagactattttcctggacacaatccaatcccaatgcttaaagttataaatggctatgttagaagcgtaaatggaaagggaaatggcgaaataattagaatttacaactaa

SEQ ID NO: 26476 - protein, 197 aa, Unknown
  Obtained from environmental sample
  misc_feature (1)..(197): Xaa is any amino acid
MIIGGNGTIGKTVVAHFKENNQIIIAGRSNSDVTVDISDSKSIKAMFEQIGKLDAIICIAGEAKWDDFNNLTEDDYYIGLKSKLMGQVNLVRIGQQYLNPKGSITLSTGILADDPVVKTTSAAMVNGGIHSFVQAVALEIENGIRVNVVSSGMVEDAYKKYKDYFPGHNPIPMLKVINGYVRSVNGKGNGEIIRIYN

SEQ ID NO: 26477 - DNA, 387 bp, Unknown
  Obtained from environmental sample
  misc_feature (1)..(387): n is a, c, g, or t
ttggaaaacataaaaatattagttgttgaggataataagatcaaccaaatgatcacgaaaaaaatccttaacaaaatgaaactaaattgtgaaatagtagataatggcgaagaagctgttgaaaaagtacgaactgaagcgtttgatgttgttttaatggatattcacatgccaggaattagcggacttgaagcaacgaagcgtatcaggaaattcaatccagatttaaccattttggcactaacggctgtaactattgaagataaaatgcatgaatttgatgaagctggatttacagatattatttcaaaacctttcaaacaagaagattttgagaaaaaactttttgaaacattaatagaaaataaagaatccaaatctgtttaa

SEQ ID NO: 26478 - protein, 128 aa, Unknown
  Obtained from environmental sample
  DOMAIN (4)...(123): Response regulator receiver domain
  misc_feature (1)..(128): Xaa is any amino acid
MENIKILVVEDNKINQMITKKILNKMKLNCEIVDNGEEAVEKVRTEAFDVVLMDIHMPGISGLEATKRIRKFNPDLTILALTAVTIEDKMHEFDEAGFTDIISKPFKQEDFEKKLFETLIENKESKSV

SEQ ID NO: 26479 - DNA, 303 bp, Unknown
  Obtained from environmental sample
  misc_feature (1)..(303): n is a, c, g, or t
atgacaactaacagatctaacgcggttacaaatattagtatctttaaatgtaaaggattgtcaaaaccaaaaattaatgcaatattttcattaaagaataataacacagataaaaatagaatggttgatcctaataatgttataaaagatgttgaaacaattttacctttttctttttctttagaaaaaaacctaaaaaaggccgtttccaaaccaaaagataagaaagcaataaaatacgccgcaaaaacaaaataccatgtgttgtcggcatatttgtcggattcaagggttgaagtgtga

SEQ ID NO: 26480 - protein, 100 aa, Unknown
  Obtained from environmental sample
  misc_feature (1)..(100): Xaa is any amino acid
MTTNRSNAVTNISIFKCKGLSKPKINAIFSLKNNNTDKNRMVDPNNVIKDVETILPFSFSLEKNLKKAVSKPKDKKAIKYAAKTKYHVLSAYLSDSRVEV

SEQ ID NO: 26481 - DNA, 672 bp, Unknown
  Obtained from environmental sample
  misc_feature (1)..(672): n is a, c, g, or t
atgaaatattcagaaatgtcattctgtgataaaaaaaatagaatattcaaagattatagtatcaattctaaaggagacacaatcggaaaaaaatgtgaacgactatttaataaaaaagaacttactatcaaaagcgtttgttatacagattctactgaaaatatcctttctatttataagttacataagaatttcaaaaaaagcatatttgaattttatcataacaataaattatctggaaaaagaatttttgaatacgcatcaaataaaattgattatgttgattttggttatgacaaaaacaataaactcaaagataaaacacttataattcacgataaaaaaggtcgaataattaaatctacaagttacaatctagaagacaatagtattaaaaatatcattgagcataagtatgacaaaaacgggaatgaatatgaacaaaattggtataagaaaggaaaaaaacttttcacttcttacactaacagaaaatttgatgacagaaataattatatttatggagaaaaactatttttcaaaaattcagataccataaaatctattacaacaatagaatataaatatgataaaaaaggtaatattatttatagattaattaatacgcacaaccaaccatctctcatagaagaaagaaaaataacttattaa

SEQ ID NO: 26482 - protein, 223 aa, Unknown
  Obtained from environmental sample
  misc_feature (1)..(223): Xaa is any amino acid
MKYSEMSFCDKKNRIFKDYSINSKGDTIGKKCERLFNKKELTIKSVCYTDSTENILSIYKLHKNFKKSIFEFYHNNKLSGKRIFEYASNKIDYVDFGYDKNNKLKDKTLIIHDKKGRIIKSTSYNLEDNSIKNIIEHKYDKNGNEYEQNWYKKGKKLFTSYTNRKFDDRNNYIYGEKLFFKNSDTIKSITTIEYKYDKKGNIIYRLINTHNQPSLIEERKITY

SEQ ID NO: 26483 - DNA, 306 bp, Unknown
  Obtained from environmental sample
  misc_feature (1)..(306): n is a, c, g, or t
gtgataaaaaaaatagaatattcaaagattatagtatcaattctaaaggagacacaatcggaaaaaaatgtgaacgactatttaataaaaaagaacttactatcaaaagcgtttgttatacagattctactgaaaatatcctttctatttataagttacataagaatttcaaaaaaagcatatttgaattttatcataacaataaattatctggaaaaagaatttttgaatacgcatcaaataaaattgattatgttgattttggttatgacaaaaacaataaactcaaagataaaacacttataa

SEQ ID NO: 26484 - protein, 101 aa, Unknown
  Obtained from environmental sample
  misc_feature (1)..(101): Xaa is any amino acid
MIKKIEYSKIIVSILKETQSEKNVNDYLIKKNLLSKAFVIQILLKISFLFISYIRISKKAYLNFIITINYLEKEFLNTHQIKLIMLILVMTKTINSKIKHL

SEQ ID NO: 26485 - DNA, 648 bp, Unknown
  Obtained from environmental sample
  misc_feature (1)..(648): n is a, c, g, or t
atggcaaaaaagacaattttaaacgagaagtctatggactttttagagaaatatttaaataatgcttcacctacaggttacgaatgggacggacagaaaatatggatggaatacctaaagccgtatgtagatgaatttattactgatacttatggtaccgcagtaggaattattaatcctgatgcaaaatataaagtggttattgaaggccacgcagatgaaatttcgtggtatgtaaactatattagtgacgacggacttatttatgtggtaagaaatggtgggagtgatcaccaaattgcgccgagtaaaattgtaaatattcacacaaaaaatggcattgtaaaaggtgtttttggatggccagcgattcacacaagaaataaatcgaaagaagaagccccgaaaccagagaatatttttattgattgtggatgtaaaactaaagatgaagttgaagaacttggggtacatgtaggttgtgttattacttacccagacgaattccatatcttaaacaaaaacaactttgtttgtcgtgcattagacaatagaatgggtggttttatgattgctgaagtggcgcgtttattaaaagaaaacaagaaagaatacctttcgtctttatataccaactcgacaagctga

SEQ ID NO: 26486 - protein, 215 aa, Unknown
  Obtained from environmental sample
  DOMAIN (52)...(209): M42 glutamyl aminopeptidase
  misc_feature (1)..(215): Xaa is any amino acid
MAKKTILNEKSMDFLEKYLNNASPTGYEWDGQKIWMEYLKPYVDEFITDTYGTAVGIINPDAKYKVVIEGHADEISWYVNYISDDGLIYVVRNGGSDHQIAPSKIVNIHTKNGIVKGVFGWPAIHTRNKSKEEAPKPENIFIDCGCKTKDEVEELGVHVGCVITYPDEFHILNKNNFVCRALDNRMGGFMIAEVARLLKENKKEYLSSLYTNSTS

SEQ ID NO: 26487 - DNA, 714 bp, Unknown
  Obtained from environmental sample
  misc_feature (1)..(714): n is a, c, g, or t
ttggaagcttttgaattcggnctcgagaaacatatggcgtgtacgctaaattataattttaaagatgtttttaagctaagagatgttcaaaaacattttgcagatttaaacatcgaactactgaaaggaaagcacattcaggatgatgaacattatcatcatagaattctatcaaaatactacatagagttcaaaaaatattatgatgttttctatcgtcttgttttagataagaaaacatttgaaggagtaacttatttcttcttaacctttagcgaggagtctaaaggaatactttcagatcataccagacatagagatttaactgctattgagacaatcacagcaattaccctgcttcaaatgtattatgataggtactttgaaaatgtaaaagaaatttcctttttaaaagatatcaaatcaaaaattttaggtagcgagtttagtagcctgtacaaatctgttttctttaaaaatggagcaagagataattttacaccaaaggagtgggccaatgtaacgaaaaatattaaaaatgttattcaagattttgagcagttaggttgggtagatcaactaactcaaaaaggggaaaatgatttttcctttgttataaaagaatctatacatcgctttcagatgatgtatgagtacgaaatatcaaattttgaagagtttgtaaataacctaacagaaacagataatgaataa

SEQ ID NO: 26488 - protein, 237 aa, Unknown
  Obtained from environmental sample
  misc_feature (1)..(237): Xaa is any amino acid
MEAFEFGLEKHMACTLNYNFKDVFKLRDVQKHFADLNIELLKGKHIQDDEHYHHRILSKYYIEFKKYYDVFYRLVLDKKTFEGVTYFFLTFSEESKGILSDHTRHRDLTAIETITAITLLQMYYDRYFENVKEISFLKDIKSKILGSEFSSLYKSVFFKNGARDNFTPKEWANVTKNIKNVIQDFEQLGWVDQLTQKGENDFSFVIKESIHRFQMMYEYEISNFEEFVNNLTETDNE

SEQ ID NO: 26489 - DNA, 345 bp, Unknown
  Obtained from environmental sample
  misc_feature (1)..(345): n is a, c, g, or t
atgaaacgtacattcagcatgagtattattttaatcttagcacttagttttttcaacgctgcacccaaagaagtcggtaaaagtgacgtcaaagttgccgttttaaaatttaagactgaagttatagattacggcaccattgttcaaaattcggaaggtcatcgcctatttacatttaccaatacaggagacgctcctttggtaattaccaaagtaaaaacgagctgtggttgtaccgttcctaactattcaaagctccagtacttcccggtaaactggagaaataacattaatacgatactaccgactaggtgcatttaccaaaactataacggttatgtctaa

SEQ ID NO: 26490 - protein, 114 aa, Unknown
  Obtained from environmental sample
  SIGNAL (1)...(20)
  DOMAIN (54)...(88): Protein of unknown function (DUF1573)
  misc_feature (1)..(114): Xaa is any amino acid
MKRTFSMSIILILALSFFNAAPKEVGKSDVKVAVLKFKTEVIDYGTIVQNSEGHRLFTFTNTGDAPLVITKVKTSCGCTVPNYSKLQYFPVNWRNNINTILPTRCIYQNYNGYV

SEQ ID NO: 26491 - DNA, 405 bp, Unknown
  Obtained from environmental sample
  misc_feature (1)..(405): n is a, c, g, or t
ttgggtcaattaaaaccggattgtagaggattccttacggttcattgccaaacaattggtacggattggaatcagatctctatatgtggtctgcaaatcatggtgcaaaacattctcatgggagcatattgctttattccattttgggagtatccatgtgtattaatctattttttgtttatcgcttatggaaacgtgacacttctgaaattgattgaactaaaagcaaaattatctaaacaagaacaagtagttttagaacatttactcttagataaaactaataaagatattgctgaatctctttttctaagtgtaagcacagtaaaaactcatactcataacatttataagaaattaaatgtacaatctagaaacgacgcaaaatccctgtttaccaagtaa

SEQ ID NO: 26492 - protein, 134 aa, Unknown
  Obtained from environmental sample
  DOMAIN (75)...(132): Bacterial regulatory proteins, luxR family
  misc_feature (1)..(134): Xaa is any amino acid
MGQLKPDCRGFLTVHCQTIGTDWNQISICGLQIMVQNILMGAYCFIPFWEYPCVLIYFLFIAYGNVTLLKLIELKAKLSKQEQVVLEHLLLDKTNKDIAESLFLSVSTVKTHTHNIYKKLNVQSRNDAKSLFTK

SEQ ID NO: 26493 - DNA, 513 bp, Unknown
  Obtained from environmental sample
  misc_feature (1)..(513): n is a, c, g, or t
gtgcgaaacatggtacaaccaatttttgatgaacataaaaatgttattggtaaaagaggtgtagtaagaaatattacagaagaaaagaacttaataaaattaaataaacaagttggtagtttagctaaaattggaatttgggaattaaatttgcttgaggaaactattttctggtcagaagaagtacatttaattcacggaacagatcctgaaaattttaaaccaaaattagaagaagctataaatttttatagagaagattttcatgagcttataaattctagtatcgaaaaatgtatttcaaaaggtaaatcttatgatatagaggctgttattattacagttgataaacaagaattatgggtccgtgtaaatttaaaagcagaatttgtagatgatgttggtatccgtatctatggtagtgtccagaacataaacgaacgcaaacaagctgaaattgcagttctggaaagtgacgctaaatttagaactatttttgaattgcctctctag

SEQ ID NO: 26494 - protein, 170 aa, Unknown
  Obtained from environmental sample
  misc_feature (1)..(170): Xaa is any amino acid
MRNMVQPIFDEHKNVIGKRGVVRNITEEKNLIKLNKQVGSLAKIGIWELNLLEETIFWSEEVHLIHGTDPENFKPKLEEAINFYREDFHELINSSIEKCISKGKSYDIEAVIITVDKQELWVRVNLKAEFVDDVGIRIYGSVQNINERKQAEIAVLESDAKFRTIFELPL

SEQ ID NO: 26495 - DNA, 468 bp, Unknown
  Obtained from environmental sample
  misc_feature (1)..(468): n is a, c, g, or t
atgtttctaatgcttttagaaaatagtcgtaaaattacatacgagctctcaccacctgtattatatcaattaggaatcgtagatgccttagattggtatgcagaagaaactgaagacaaatacgacattaaatttcaatttattagcaatgtagatactgttaaacttaccgatattaaatcaatcttaatatttagatgtgttcaagaagcagttacaaacactattaaatatgcagaagctactgcaataactttaaaattaactaaagataaaaatggagttgatattttaattacagataatggaaaaggtttcgacactgcagtattaaatgccagtggaaattctagttctggttttggtttatttgcagtaaaagaacgtattagaagtatgagtggaacgttagcaattacatccgaaataaaagttggtacaaaaattaaaatttatgtacctttataa

SEQ ID NO: 26496 - protein, 155 aa, Unknown
  Obtained from environmental sample
  DOMAIN (59)...(155): Histidine kinase-, DNA gyrase B-, and HSP90-like ATPase
  misc_feature (1)..(155): Xaa is any amino acid
MFLMLLENSRKITYELSPPVLYQLGIVDALDWYAEETEDKYDIKFQFISNVDTVKLTDIKSILIFRCVQEAVTNTIKYAEATAITLKLTKDKNGVDILITDNGKGFDTAVLNASGNSSSGFGLFAVKERIRSMSGTLAITSEIKVGTKIKIYVPL

SEQ ID NO: 26497 - DNA, 351 bp, Unknown
  Obtained from environmental sample
  misc_feature (1)..(351): n is a, c, g, or t
atgatagctaaagaagtagttaaacaattttacgcgcttgattttgctaaagatgatactgttttagattttattcatccacaatgtgaattaaactggaatagtagcaaaggctatacgcatttgaattataaaggaattaaagaaaaaattactggtataaaagaatcgtatttaacttttaactataaactaagtcatttattagaagacgataatactgttaccgcacgatataccatttatggtacaccaatagagcaagataatgaagataataatgaagtaccaatagctcattttatctccatttgggaggtaaagacagaaattatacggcgtatgagatag

SEQ ID NO: 26498 - protein, 116 aa, Unknown
  Obtained from environmental sample
  misc_feature (1)..(116): Xaa is any amino acid
MIAKEVVKQFYALDFAKDDTVLDFIHPQCELNWNSSKGYTHLNYKGIKEKITGIKESYLTFNYKLSHLLEDDNTVTARYTIYGTPIEQDNEDNNEVPIAHFISIWEVKTEIIRRMR

SEQ ID NO: 26499 - DNA, 591 bp, Unknown
  Obtained from environmental sample
  misc_feature (1)..(591): n is a, c, g, or t
atgatattaagtgatttatcagaatctaaagtgaattgcttaaatatttctgatactgtccttttctggacaaatgaatgcgactatgaatctttgaccgaattgattaaagttgcttacgaattcaattggatgcaaattggatataatttccctattcgaggttcaatagtgaaaggaaaaattagaatggtttcaggtcaacatacaaacacaaatggcggttcatattcagttcaatgtttgtatggaaaaggattaataaaagctcacgataaagctgaatatcaaaattgggctggaactgtaatagatgaaagtataatttcggatttagagaaaaacgcaaacggaattgactttttatctgagttcgccattaaatataaggttccgtataaaatagatgtagatttaggagaagaatatgttttgaaagtagtgaaaggaattagcaacgaaactgcattaaaaaacacaaaggaaagcatcgcaggagtttttgcacttgacaacaaatctaccgaaccaaaaagtgttcagttaaaaattgaaaacacattgaaattcattgagtttttagcggaataa

SEQ ID NO: 26500 - protein, 196 aa, Unknown
  Obtained from environmental sample
  misc_feature (1)..(196): Xaa is any amino acid
MILSDLSESKVNCLNISDTVLFWTNECDYESLTELIKVAYEFNWMQIGYNFPIRGSIVKGKIRMVSGQHTNTNGGSYSVQCLYGKGLIKAHDKAEYQNWAGTVIDESIISDLEKNANGIDFLSEFAIKYKVPYKIDVDLGEEYVLKVVKGISNETALKNTKESIAGVFALDNKSTEPKSVQLKIENTLKFIEFLAE

SEQ ID NO: 26501 - DNA, 453 bp, Unknown
  Obtained from environmental sample
  misc_feature (1)..(453): n is a, c, g, or t
ttggggcaattacgctgtttaggtatttactttagcccagtaaatttttatttttttgncgataacgatacaaaatttagttacatgatcgcagaggttagcaacacaccttggaatgaacgccactattatttagttccgttagaaaaaaaagtgaactttaagaaaaccttttccgtatcaccttttatggacttggacatgaactaccactggcatattcgacaaacgcaggataaagcattaatacagattaaaaatatacgcgacgagcaggtattattcgacgctacactaaggttaaaacgccacgaattaactgagcaacaagtaagtaggttgcttaaacgttttccggcgatgacttggtcaatttttaagggtatttattatcaagcattaaagttgtttattaaaagagtgccttttttaggccactcaggtaagccataa

SEQ ID NO: 26502 - protein, 150 aa, Unknown
  Obtained from environmental sample
  DOMAIN (1)...(149): Protein of unknown function (DUF1365)
  misc_feature (1)..(150): Xaa is any amino acid
MGQLRCLGIYFSPVNFYFFXDNDTKFSYMIAEVSNTPWNERHYYLVPLEKKVNFKKTFSVSPFMDLDMNYHWHIRQTQDKALIQIKNIRDEQVLFDATLRLKRHELTEQQVSRLLKRFPAMTWSIFKGIYYQALKLFIKRVPFLGHSGKP

SEQ ID NO: 26503 - DNA, 390 bp, Unknown
  Obtained from environmental sample
  misc_feature (1)..(390): n is a, c, g, or t
ttggcttatacttggtgtttgttaattaccagctatccaaagagtcctaaggttaattttaagattatgaaaaacgtatatcaagtcaattattggtcagtcttaataaccatattacttagtttaaccttttggggcggaataatagcgttgcctattttaggaactatacaaatagtaataagcctaattataattaacaaatttaaaacgctaactaaagcaaaccgaatactttttactagctacacagtgttaacagtgtttctgattatattttttaaacaattaaaaggtgaagaattaggtgttttatttatgtgggcaatagtgtccttattcctagcttgtttccatttatatataacctataatatctcaaaatcatga

SEQ ID NO: 26504 - protein, 129 aa, Unknown
  Obtained from environmental sample
  misc_feature (1)..(129): Xaa is any amino acid
MAYTWCLLITSYPKSPKVNFKIMKNVYQVNYWSVLITILLSLTFWGGIIALPILGTIQIVISLIIINKFKTLTKANRILFTSYTVLTVFLIIFFKQLKGEELGVLFMWAIVSLFLACFHLYITYNISKS

SEQ ID NO: 26505 - DNA, 339 bp, Unknown
  Obtained from environmental sample
  misc_feature (1)..(339): n is a, c, g, or t
atgaacgaaaagattttggaatataaaggtttaataactaaagcggaacttgaactttttgccaattcaaattttaagaaatggaaaatttctttagttagtgataaacgagaaattttaggtggcgaaaaaagtggcgatgaattttatccaacaaaaaacaacattcaaattgtcattaaaaagtttgccaacgattatatggatttagttcaaaaaactatcccaaattataaaccgactgaattaaaacagacagaaccaattaaagaagtagcaacggaattttgctttgtctatttaatgcacgacacggccaatggatattttaaaatctga

SEQ ID NO: 26506 - protein, 112 aa, Unknown
  Obtained from environmental sample
  misc_feature (1)..(112): Xaa is any amino acid
MNEKILEYKGLITKAELELFANSNFKKWKISLVSDKREILGGEKSGDEFYPTKNNIQIVIKKFANDYMDLVQKTIPNYKPTELKQTEPIKEVATEFCFVYLMHDTANGYFKI

SEQ ID NO: 26507 - DNA, 738 bp, Unknown
  Obtained from environmental sample
  misc_feature (1)..(738): n is a, c, g, or t
gtgctgttctataaatccgaactactgttttatcattttactcgtattaataaagtgtgttttgcatatttgttgggattaaaaaaaacgagaatgatacgtaaaatattattaggaatactttttctggttttctgttttagtccggctaaagcacaaggaattgaacaaattgaggtatcaaaatctatcgaaaataaaatagattcaattttcaaagagtttgataactctgcaacacctggtctttctgtaggatttatgcaaaacggaaaactcatattctcgaaaggatatgggatggctgatttagaacacaatactcctatagatacttcaagtgttttctcattagcatctgtttcaaaacagtttacggtatttgcaattctacttttggaacaacgaggaaaattatcgcttaatgatgatgtcagaaaacaccttcccgaatttaacgattatagtgaaaccgttacattacagcagttggcaaatcacagtagcggaattagaagtcaattacaacttctcggtcaggctggctacatttcagataacgtaataacaaaagaagatgcgcttaaaataatttatgatcaagaagaattaaattttaaaccgggctcggaatttagttattcaaattcgggatatgtccttttagcagaagttgtggagaaagtttcagggaaaccattttctttatttatgaaagaaaatgttttgaacctttag

SEQ ID NO: 26508 - protein, 245 aa, Unknown
  Obtained from environmental sample
  DOMAIN (68)...(245): Beta-lactamase
  misc_feature (1)..(245): Xaa is any amino acid
MLFYKSELLFYHFTRINKVCFAYLLGLKKTRMIRKILLGILFLVFCFSPAKAQGIEQIEVSKSIENKIDSIFKEFDNSATPGLSVGFMQNGKLIFSKGYGMADLEHNTPIDTSSVFSLASVSKQFTVFAILLLEQRGKLSLNDDVRKHLPEFNDYSETVTLQQLANHSSGIRSQLQLLGQAGYISDNVITKEDALKIIYDQEELNFKPGSEFSYSNSGYVLLAEVVEKVSGKPFSLFMKENVLNL

SEQ ID NO: 26509 - DNA, 432 bp, Unknown
  Obtained from environmental sample
  misc_feature (1)..(432): n is a, c, g, or t
ttgaacaaagaaaatacttttcaacttggcgatagcgagaaagtccaagcgttttttagtaaaagtggaacaattgaatctattgctattttggtcaatggagagcaagtggagttttacaataagtatttaccaaagaaatattctgctaaagaattagaagaatttattggaacctattacagcgaagaattgaatactcaatacattttagaaattaaaagtggagttataactgtctcgcacccaaaaatgattttgataactctgcaacctataaaaatggacagcttcttgggttcaagttggcaatttaggtctcttgaatttgaacgaaatgaaaaaaatcagattataggatttagaatatcttccgaccgtgttaaaaaagtacgtttcaaaaaaattgctcacaatctatgtccaaaataa

SEQ ID NO: 26510 - protein, 143 aa, Unknown
  Obtained from environmental sample
  misc_feature (1)..(143): Xaa is any amino acid
MNKENTFQLGDSEKVQAFFSKSGTIESIAILVNGEQVEFYNKYLPKKYSAKELEEFIGTYYSEELNTQYILEIKSGVITVSHPKMILITLQPIKMDSFLGSSWQFRSLEFERNEKNQIIGFRISSDRVKKVRFKKIAHNLCPK

SEQ ID NO: 26511 - DNA, 642 bp, Unknown
  Obtained from environmental sample
  misc_feature (1)..(642): n is a, c, g, or t
ttgtcggctagctttttttgtctaattttcagctcacaatcgtttgataaaattataatgaagttaaagaaatttatttccctggcatttttatgccttttcgcagtcaatattcaagcccaggaaggttatgaactctggttagattatacagcaatacaggatcctgatgttgaaaaaaaatatgcaccttttctaaataatgtagaattaattggtaattcttctacaattcaggctataaaagacgagttacaactagctcgagaaggttttgcttttgaaaattcaaaacccagtaatgattcaaaattaattattggagtacaaagcaaactgccaatgccaataaaaaacattgtcaatactgaagccctgggagaagaagggtataaaatcacttcccttaataatgggaagaccattgtagtaagtggaaattctgaaatagcccttctttatggaacctatggcttgcttcgcgaaatgcagcaaaaaaatgacatttcaaatttaaagattgaagaaaaaccaaaaatccagaagcgtgtgctaaatcactgggataatttagaccgcacggtagaacgtggttacgccggtttctcaatttgggattgcatcttttaccccaacttataa

SEQ ID NO: 26512 - protein, 213 aa, Unknown
  Obtained from environmental sample
  DOMAIN (46)...(159): Glycosyl hydrolase family 67 N-terminus
  misc_feature (1)..(213): Xaa is any amino acid
MSASFFCLIFSSQSFDKIIMKLKKFISLAFLCLFAVNIQAQEGYELWLDYTAIQDPDVEKKYAPFLNNVELIGNSSTIQAIKDELQLAREGFAFENSKPSNDSKLIIGVQSKLPMPIKNIVNTEALGEEGYKITSLNNGKTIVVSGNSEIALLYGTYGLLREMQQKNDISNLKIEEKPKIQKRVLNHWDNLDRTVERGYAGFSIWDCIFYPNL

SEQ ID NO: 26513 - DNA, 453 bp, Unknown
  Obtained from environmental sample
  misc_feature (1)..(453): n is a, c, g, or t
ttgtatcttcgaaagcaattcaacaaaataaaaatgagtaattatcacatcaagcatttagaagagtattataaagtatatcgcaattcagttagagaaccagaagtattttgggaagaaattgctgaagaacattttagttggcgtaaacgttgggacaaagtcttgtcatgggattttaaaaagccagaagttaaatggtttgaaggcgctaaactgaacattactgaaaattgtattgaccgtcatttaagaactaaaggaaataaaacagcgattttatttgagccgaacaaccctgatgaagaagcacaacatataacgtacaacaggttatacgaacgtgtaaatcaatttgcaactgtgttgaaggacaatggaattaacaagggagatcgtgtatgtatttacttggcaatgattcctgagttggcatttcattattgggtgtng

SEQ ID NO: 26514 - protein, 151 aa, Unknown
  Obtained from environmental sample
  misc_feature (1)..(151): Xaa is any amino acid
MYLRKQFNKIKMSNYHIKHLEEYYKVYRNSVREPEVFWEEIAEEHFSWRKRWDKVLSWDFKKPEVKWFEGAKLNITENCIDRHLRTKGNKTAILFEPNNPDEEAQHITYNRLYERVNQFATVLKDNGINKGDRVCIYLAMIPELAFHYWVX

SEQ ID NO: 26515 - DNA, 375 bp, Unknown
  Obtained from environmental sample
  misc_feature (1)..(375): n is a, c, g, or t
atggagttttctaacgtaggcggcttagtaatgcctattctattagagctgacttttgaagatggcagcaaagaagagcgttatattgcggccgaaatttggcgtcgtaattataaaaatgtgcaaaaactaatagtgacagacaaaaataaatcgctggtgtcggttactatcgatccgcgctgggaaacggctgacgtagatattgaaaataataactacccacgtcgtattattccatcacgcatagaagtatttaaaaaagaaaagagcaaagcaaaagtaagccgcgatattatgcaagatattaaaaccgagcttaaaaaagacgaatctaaaggcgacgaanataataatagtgaggagcaacaataa

SEQ ID NO: 26516 - protein, 124 aa, Unknown
  Obtained from environmental sample
  misc_feature (1)..(124): Xaa is any amino acid
MEFSNVGGLVMPILLELTFEDGSKEERYIAAEIWRRNYKNVQKLIVTDKNKSLVSVTIDPRWETADVDIENNNYPRRIIPSRIEVFKKEKSKAKVSRDIMQDIKTELKKDESKGDEXNNSEEQQ

SEQ ID NO: 26517 - DNA, 414 bp, Unknown
  Obtained from environmental sample
  misc_feature (1)..(414): n is a, c, g, or t
ttgcaggctctttttttatacctttgtgtcatggataaaacaactcaaatatttggacttagagctattattgaagctttaaatgctggcgaacatgtagataaagtctttttgcaaaaaggacttaaaggcgacttgtttcaagaattagaaacagtactaaaagacaagagagttaactcgtcttacgttccggctgagaaactaaatagattaacaaaaaacaatcaccaaggtgcagttgcacaaattgctcctgttaagttttatgacattgaggagttgtttgacatggtgtccaaaaaaaatacaactccgctttttttattattagatcaacttagtgatgttagaaactttggtgctataatacgtactgcagaatgtactggagtagacggcataataatataa

SEQ ID NO: 26518 - protein, 137 aa, Unknown
  Obtained from environmental sample
  misc_feature (1)..(137): Xaa is any amino acid
MQALFLYLCVMDKTTQIFGLRAIIEALNAGEHVDKVFLQKGLKGDLFQELETVLKDKRVNSSYVPAEKLNRLTKNNHQGAVAQIAPVKFYDIEELFDMVSKKNTTPLFLLLDQLSDVRNFGAIIRTAECTGVDGIII

SEQ ID NO: 26519 - DNA, 666 bp, Unknown
  Obtained from environmental sample
  misc_feature (1)..(666): n is a, c, g, or t
atgaaagcatacgtcgattttgagataaataaaattcaagaattaagggtaatccatgcattaattgaaaatggttcgttaatatttattcccgaaagtcaaaaatataagtttaaaccattgattgacaaatttgatttggtattgtccgatgaaaacctttccgaagttaaattatcaagtttgattacaataaatcatgaaatacctaagactaaaattagagatttgtcttgtcctttaatttttccaataggaatagttaggtttttatatgaaaattggtctgagaatagagtttataaattttcgtttgctggtttaatcacaccaacacgtcataaagttattcagaattggttgactaatagtttaaaaagtaataagaaattaaattataattctagtagttttaaaatcagaatgattaaaaaaatatatcaaaaattatttaagaataaaacacctgttttcagatatgaagatttgtatatttcaaactcaataaaaggacgagtttttccagggaaatcctgggatgattatcattatgctttcttactaaaatctaaatttgttttatgtccatcaggagattcatctggtctaatcgtttttttgaaccaatttaagtggtgcaattccaataatagacaaatatcgtga

SEQ ID NO: 26520 - protein, 221 aa, Unknown
  Obtained from environmental sample
  misc_feature (1)..(221): Xaa is any amino acid
MKAYVDFEINKIQELRVIHALIENGSLIFIPESQKYKFKPLIDKFDLVLSDENLSEVKLSSLITINHEIPKTKIRDLSCPLIFPIGIVRFLYENWSENRVYKFSFAGLITPTRHKVIQNWLTNSLKSNKKLNYNSSSFKIRMIKKIYQKLFKNKTPVFRYEDLYISNSIKGRVFPGKSWDDYHYAFLLKSKFVLCPSGDSSGLIVFLNQFKWCNSNNRQIS

SEQ ID NO: 26521 - DNA, 579 bp, Unknown
  Obtained from environmental sample
  misc_feature (1)..(579): n is a, c, g, or t
ttgaaaacttacattattcctacaatttctactaaaaaatcggtttctttaattcgggaagcaaaaaagaagggattagatgtaagctgcagtgtagctattcataacttgatctttaccgacgaactcctgaaggattttgataccaatgctaaagttttaccgccattaagaaccaaagaagatattaaagcgcttataaaaggtttaaaagacggaactatagatatgcttaccagcgatcacagcccaatggatactgagcataagaaagttgaatttgataatgcactttatggtactattggattggagtctgcttttggagctttaaacaacattttttctaccgaagaagttgtagaaatgctttctaaaggaaaacaaagatttggtgtggaagacatcgaaattaaagaaggaaatcctgcagatctaagtttatttattcctgatgaacattatgaattcactgaaaatcatattttttccacctcaaaaaacagtatttttaaagggtatcaactaaaaggaaaagctttgggaataattactaaagcggggaattttggtttataa

SEQ ID NO: 26522 - protein, 192 aa, Unknown
  Obtained from environmental sample
  misc_feature (1)..(192): Xaa is any amino acid
MKTYIIPTISTKKSVSLIREAKKKGLDVSCSVAIHNLIFTDELLKDFDTNAKVLPPLRTKEDIKALIKGLKDGTIDMLTSDHSPMDTEHKKVEFDNALYGTIGLESAFGALNNIFSTEEVVEMLSKGKQRFGVEDIEIKEGNPADLSLFIPDEHYEFTENHIFSTSKNSIFKGYQLKGKALGIITKAGNFGL

SEQ ID NO: 26523 - DNA, 714 bp, Unknown
  Obtained from environmental sample
  misc_feature (1)..(714): n is a, c, g, or t
gtgcacctcaagggccagggcatcacgtcgatcatcatcagccacaagctcaacgagatcaagcagatcgccgatacggttacggtgatccgagatggcaaagcgatcgaaacgatccctaagcagcatgtcagcgaagaacgcatcatcaaagacatggtggggcgcgacctcgcgcatcgttacccggatcacacccctcacattggtgaggaagtgttgcgcgttgagaactggactgcgcaccacccgcaggatccttcacgcgtgatggtcgacaaggtcaatctcaacgtcaaaaagggcgagattgtgggtattgccgggcttatgggtgccggtcgcaccgagttcgccatgagccttttcggccgcacctatggttcgcgcgtcaccggcaaggtcttcaaatatggcaaggaaattcagacgcgcacggtagccgaggcgatcgagaatggcatcgcctacgcgaccgaagaccgcaaaacgtacggtctcaatctcattgaagatatcaagcgcaacatctccctggcatctctcggcagcctctcacgcttcggcctcgtgaacgacaatgaagagttcaaggtagccaacgagtaccggacatctatgaacatcaagtcgccgacggtgctggcgcttgcgggaaagctctcgggcggtaaccaacaaaaggtggtgctgtcgaagtggataccaggctga

SEQ ID NO: 26524 - protein, 237 aa, Unknown
  Obtained from environmental sample
  misc_feature (1)..(237): Xaa is any amino acid
MHLKGQGITSIIISHKLNEIKQIADTVTVIRDGKAIETIPKQHVSEERIIKDMVGRDLAHRYPDHTPHIGEEVLRVENWTAHHPQDPSRVMVDKVNLNVKKGEIVGIAGLMGAGRTEFAMSLFGRTYGSRVTGKVFKYGKEIQTRTVAEAIENGIAYATEDRKTYGLNLIEDIKRNISLASLGSLSRFGLVNDNEEFKVANEYRTSMNIKSPTVLALAGKLSGGNQQKVVLSKWIPG

SEQ ID NO: 26525 - DNA, 666 bp, Unknown
  Obtained from environmental sample
  misc_feature (1)..(666): n is a, c, g, or t
ttggtaaaaggttttattaatgattgggctgtaaaacaattattgttaagtaacgcagaaagtaacagctctttagaagaagttacagaaattaactctttagtaaaagattacaaagaaagtttacttattaatagttacaaagaaaggcttataaatcagcaattagatactgttattagtgaaactgaaatagctcttttttatgaaaataataaagagaattttaaactgaatgaggagttattaaaaataaaataccttcattttgataacaatattatcaataaaaaagaatttataaaactttttcaatctgataaaattgaagatttagaagcattagaaaaacaacaattaagttttaaatattaccaatttaacgattcaatttggacacaattagataaggttttgttaaaactgccattttctaaagaaaatctgttaaataaaacaaaattcctccaaaaacaagattcattaggtttatatttggtggctataaacgatgttttaattaggaatgatacagctcctttaagctatatagaacccaccataaaacaaatgattttacacagacgtaaaattgaattaattagagatatagaaaaaatattagtaaaagatgcaacaaaaaacaacaattttaaaacatactaa

SEQ ID NO: 26526 - protein, 221 aa, Unknown
  Obtained from environmental sample
  misc_feature (1)..(221): Xaa is any amino acid
MVKGFINDWAVKQLLLSNAESNSSLEEVTEINSLVKDYKESLLINSYKERLINQQLDTVISETEIALFYENNKENFKLNEELLKIKYLHFDNNIINKKEFIKLFQSDKIEDLEALEKQQLSFKYYQFNDSIWTQLDKVLLKLPFSKENLLNKTKFLQKQDSLGLYLVAINDVLIRNDTAPLSYIEPTIKQMILHRRKIELIRDIEKILVKDATKNNNFKTY

SEQ ID NO: 26527 - DNA, 762 bp, Unknown
  Obtained from environmental sample
  misc_feature (1)..(762): n is a, c, g, or t
ttgataaacaacgaaaacaaaaacgcaaaaaaactaattgattctctttacaatcaattagaaaaagatgtgcagtttaaaacattagctagaaagttttctgaagattctggttcaaaatctaaaggaggaaaactaagacagtttggaactggagttatggtaaaaccttttgaagatgtagcttttagcttaaaaaaagaaggcgaatattctaaaccttttcaaacacgttttggctggcatattttacagttgataaaaaagcaccctgttcaatcttttaacgaactacaggatgaacttaaaagtaaagtaaaatctggagatagagctcaattatctgaacaagcagttattgctaaattaaagaaaaaatatacaatttctgaaaacgaaaacgcaaaagctatttttgatcagaagaacataagaaacattggcaaagattctttacaagctgttttgtttacgattaatgatttagaaataaaacaagaggcatttgtagcttatattataaatagaaataattctcctgtgtacgaactttttaatgagtttaaagacaaagagattttaagttattacaaagaaaacttagaaaaaactgaaccagaatttgcttatactttacaagaatatagagatggcttgttgttatttgaattgatgcaacaaaaaatatggggaaaatcatctaaagatactttaggattaaaaaaccattatgatgccaatttatctaaatttcaaaattaa

SEQ ID NO: 26528 - protein, 253 aa, Unknown
  Obtained from environmental sample
  DOMAIN (1)...(88): PPIC-type PPIASE domain
  misc_feature (1)..(253): Xaa is any amino acid
MINNENKNAKKLIDSLYNQLEKDVQFKTLARKFSEDSGSKSKGGKLRQFGTGVMVKPFEDVAFSLKKEGEYSKPFQTRFGWHILQLIKKHPVQSFNELQDELKSKVKSGDRAQLSEQAVIAKLKKKYTISENENAKAIFDQKNIRNIGKDSLQAVLFTINDLEIKQEAFVAYIINRNNSPVYELFNEFKDKEILSYYKENLEKTEPEFAYTLQEYRDGLLLFELMQQKIWGKSSKDTLGLKNHYDANLSKFQN

SEQ ID NO: 26529 - DNA, 300 bp, Unknown
  Obtained from environmental sample
  misc_feature (1)..(300): n is a, c, g, or t
atggcaagtttatggacgtttatacttattggtagtgtaatttacttattttggctaaaccgaaaagtagccgaggcggcgaacgttcatgctaaacgccaaagcgatcagctgcaggtgcaattaatgagcgttgcctgtagtaaacgccgctttggttttttaaaaagtggtaaacctggagtgaaaagcgaatttatttttgagttttcaagtgatggcgaaaatgcctatcagggaatactgatcatggaaaatgagtatttaaaaagtgtggttattccaccgcataaaatataa

SEQ ID NO: 26530 - protein, 99 aa, Unknown
  Obtained from environmental sample
  misc_feature (1)..(99): Xaa is any amino acid
MASLWTFILIGSVIYLFWLNRKVAEAANVHAKRQSDQLQVQLMSVACSKRRFGFLKSGKPGVKSEFIFEFSSDGENAYQGILIMENEYLKSVVIPPHKI

SEQ ID NO: 26531 - DNA, 816 bp, Unknown
  Obtained from environmental sample
  misc_feature (1)..(816): n is a, c, g, or t
ttggtggttttctctttgggatggatgacttacaaactatacaatactggaaacagaaaagaaagtacaaatctaaaagattggattctactcttcttttgggctatttttacacatccacttttagattgttttacaccttatggaacacaattattcgcgcctttttctgattacagagttgcttataataacatttctgtggtagatcctttgtacacattaccttttttaatttgtatgattgttttgatgtttatcaacagaactaaagctaaaagaaaagtttggttaaaagcaggaatttacatcagctcagcttatatgattttgacaatttttaataagctttatatggatgctgtttttaaaaaatcttttgaaaaagcaggaatttcttatactcgttttacagctcaacctacaattttaaataatattttgtggtatgcagttgcagaaactgataacgattatcattttgctttttattctttgtttgataaaagtgcactctcagaaaagattatcaaaattgaaaaaaaccacgatattattgatatgaatgatgataatttacaaacacttgcttggtttagtaatggttattttaaaatcaccaaaaaagaaaaaataggcacttataaatatatcgatttaagatatccaccattaaatcctgatgatgccaatacatccgtttttaactttacactttataacgaaaatgatgagtgggatattctaccatttaatggaaatccgccaaatggagaggattttgggaagtttgttgagagattaaaaggaatttag

SEQ ID NO: 26532 - protein, 271 aa, Unknown
  Obtained from environmental sample
  misc_feature (1)..(271): Xaa is any amino acid
MVVFSLGWMTYKLYNTGNRKESTNLKDWILLFFWAIFTHPLLDCFTPYGTQLFAPFSDYRVAYNNISVVDPLYTLPFLICMIVLMFINRTKAKRKVWLKAGIYISSAYMILTIFNKLYMDAVFKKSFEKAGISYTRFTAQPTILNNILWYAVAETDNDYHFAFYSLFDKSALSEKIIKIEKNHDIIDMNDDNLQTLAWFSNGYFKITKKEKIGTYKYIDLRYPPLNPDDANTSVFNFTLYNENDEWDILPFNGNPPNGEDFGKFVERLKGI

SEQ ID NO: 26533 - DNA, 522 bp, Unknown
  Obtained from environmental sample
  misc_feature (1)..(522): n is a, c, g, or t
atggatagaaattataatgatgatggagttaaanttggtgaagttttctatgatggtggagcaaaaaaagctggtttaaaagatggagatgttattgtgaaaattaacgatatgaaaatttctaaattctcggagttattaggtcaattaacagctaaaagacctggagattatgtgaatgttactattaatagagatggagattacatgacaaaaagtattgagttaagtaaaaaaccaatcagatacgtatctaattcttttaggtgggaattgaaaaatgtttcaaaagaggaattaaaagaaaaaaatattgaccaaggagctaaaataatatatacagcagataccagatatagagatagtttggttaactatattattacaaaagtcaatgatcaaaaagttaataatgctgaaaatgcagttaaattattagaaaaggctgcaaaaggagggtattcaatagttattgaagttataaatgtaagtggagaaaaagaaaccttaagatttagataa

SEQ ID NO: 26534 - protein, 173 aa, Unknown
  Obtained from environmental sample
  misc_feature (1)..(173): Xaa is any amino acid
MDRNYNDDGVKXGEVFYDGGAKKAGLKDGDVIVKINDMKISKFSELLGQLTAKRPGDYVNVTINRDGDYMTKSIELSKKPIRYVSNSFRWELKNVSKEELKEKNIDQGAKIIYTADTRYRDSLVNYIITKVNDQKVNNAENAVKLLEKAAKGGYSIVIEVINVSGEKETLRFR

SEQ ID NO: 26535 - DNA, 366 bp, Unknown
  Obtained from environmental sample
  misc_feature (1)..(366): n is a, c, g, or t
atgtggtctatggactatattactgaattgctacaaaaaaactatattaaaacgcatattgaaacttctggagcgtattctttttctggaaaatgggattggttttgtctttcgccaaagaaaacaaaattacctttaaaagaaaattatagagaagcagatgagttaaaaatgattattcataatcaatctgattttatttttgcagaagaacaagctgctaaagtgggtaaaaaatgtcaattatttttacagccagaatggagtaaaaaagaaaaaatgacagagcaaattgttgaatacgtaatgaaaaatcctaaatggaaaatttctctacagactcacaaatacttgaatattccttaa

SEQ ID NO: 26536 - protein, 121 aa, Unknown
  Obtained from environmental sample
  misc_feature (1)..(121): Xaa is any amino acid
MWSMDYITELLQKNYIKTHIETSGAYSFSGKWDWFCLSPKKTKLPLKENYREADELKMIIHNQSDFIFAEEQAAKVGKKCQLFLQPEWSKKEKMTEQIVEYVMKNPKWKISLQTHKYLNIP

SEQ ID NO: 26537 - DNA, 756 bp, Unknown
  Obtained from environmental sample
  misc_feature (1)..(756): n is a, c, g, or t
nnacacggtgtacccattactataaaagcaaaaaaagaaggtgtttcgccacaagagattgtagataaatatcacgctattataaaacagtcttttgaagattttggtatttcttttgataattattcacgtacttcagctaaaatacaccacgatactgcatctgaatttttcacgactttatataataaaaatgaatttgttgaagaaacgacagagcaattatatgatgccgaagctaatcagtttttagcagatcgttttgtaacaggaacctgcccaaaatgtggcaatgaagaagcttacggcgaccaatgcgaaagttgtggaactagcttaaatgctaccgatcttattaatccgaagtcggcaataacaggaaatgtacccactctaaaacaaaccaaacactggtttttacctttaaacaaacacgaagcctttttaaaagaatggattcttaaaggacataaaaaagattggaaacctaatgtttacggacaagtaaaatcgtggattgacgacggtttgcgtccgagagcagtaactagagatttagattggggaattcctgtacctttaaaaggagcagaaggcaaagtgctttacgtgtggttcgatgcgcctattggctatatttctgcaantaaagaatgggcagaacgtgtagacaaagattgggaaccgtattggaaagacgaaaatacaaaattagtacattttataggtaagacaatattgacctcacgtatctga

SEQ ID NO: 26538 - protein, 251 aa, Unknown
  Obtained from environmental sample
  misc_feature (1)..(251): Xaa is any amino acid
MHGVPITIKAKKEGVSPQEIVDKYHAIIKQSFEDFGISFDNYSRTSAKIHHDTASEFFTTLYNKNEFVEETTEQLYDAEANQFLADRFVTGTCPKCGNEEAYGDQCESCGTSLNATDLINPKSAITGNVPTLKQTKHWFLPLNKHEAFLKEWILKGHKKDWKPNVYGQVKSWIDDGLRPRAVTRDLDWGIPVPLKGAEGKVLYVWFDAPIGYISAXKEWAERVDKDWEPYWKDENTKLVHFIGKTILTSRI

SEQ ID NO: 26539 - DNA, 504 bp, Unknown
  Obtained from environmental sample
  misc_feature (1)..(504): n is a, c, g, or t
ttggaaattaatttaatgttaagatgcttcaccgctatatctacaatattgttactctctggttgtgctaacaatgcaattgttgagcttcaaaaactagattcaaaaagtttaacaaacaaaaatatacaaataatcgatgatggtaaaactaaagattcaattaaacatatcattgctggcaagttagataaatacggctttaaatatcaaattgtcgatatttcacagtctaactctaacgtaacaaataaccctaagctgacttactctgcaaactggtggtgggacatggctagttatatgcgctatttgaacattgagataaaagacaacagccaaactatcgcactggtaaaaattgacaccgtgaagtgtggtggttttgacaagtttggttcagcccaacgacgcactgagatcaccttagatttactcctaagtgacttgagcaaagaagaagccaatgaactgatttgtcttggtggccaacctaaaaactaa

SEQ ID NO: 26540 - protein, 167 aa, Unknown
  Obtained from environmental sample
  misc_feature (1)..(167): Xaa is any amino acid
MEINLMLRCFTAISTILLLSGCANNAIVELQKLDSKSLTNKNIQIIDDGKTKDSIKHIIAGKLDKYGFKYQIVDISQSNSNVTNNPKLTYSANWWWDMASYMRYLNIEIKDNSQTIALVKIDTVKCGGFDKFGSAQRRTEITLDLLLSDLSKEEANELICLGGQPKN

SEQ ID NO: 26541 - DNA, 345 bp, Unknown
  Obtained from environmental sample
  misc_feature (1)..(345): n is a, c, g, or t
atggcaactctatcctataaaaatatacgtgtaaattacacttcaaccggtaaaggatctgccattgttttactacatggctttttagaaaatagttttatgtggaatgaaattattccggttttatcaaaaagaaataaagtcataacagttgatttatttggacatggtaaaacagaaaatctgggatatattcataccatggaagagcaggcaactatggttcggtcgcttttaaaaacactcaacataagaaaagctacactcattggtcattcaatgggcggatatgtngtattggcttttgcagaactatttcctaaaaacactaaaggaatttgttga

SEQ ID NO: 26542 - protein, 114 aa, Unknown
  Obtained from environmental sample
  misc_feature (1)..(114): Xaa is any amino acid
MATLSYKNIRVNYTSTGKGSAIVLLHGFLENSFMWNEIIPVLSKRNKVITVDLFGHGKTENLGYIHTMEEQATMVRSLLKTLNIRKATLIGHSMGGYVVLAFAELFPKNTKGIC

SEQ ID NO: 26543 - DNA, 324 bp, Unknown
  Obtained from environmental sample
  misc_feature (1)..(324): n is a, c, g, or t
atgcttaacagatttatatttattactgtactatttgtatttttatcttgcggaaacgaaaacgtaatacaactaccagaaatacaaaatgcagaaataactcagattttagacgtctctcctgcttatatcttttatgatgacaccaaacaagatagtgtagagttaaaccgaaaaaacttaattatttctactaactggttagtaaacgttgacaagcgcttaagattagaacaagcgttaccatctatactaaaactacaagagaagaagcgtatgcaaccatgcataacaatgaaaaagctagaaattattacattgtaa

SEQ ID NO: 26544 - protein, 107 aa, Unknown
  Obtained from environmental sample
  misc_feature (1)..(107): Xaa is any amino acid
MLNRFIFITVLFVFLSCGNENVIQLPEIQNAEITQILDVSPAYIFYDDTKQDSVELNRKNLIISTNWLVNVDKRLRLEQALPSILKLQEKKRMQPCITMKKLEIITL

SEQ ID NO: 26545 - DNA, 828 bp, Unknown
  Obtained from environmental sample
  misc_feature (1)..(828): n is a, c, g, or t
ttgaaacacgtctctaaaataggagatactactaaaaaaagtaataaccattgcggaagtgcagaagctgtgtttaaagaaaagaaacaaaaccttttaaaaattgatggtataggcgaaattattttaagtgaattatatcaatctagtcattttgaagaagcagataaagaactaaaatttattaaagacgaaaacctaaaacatcacgtttttactgactcaacgtatccatcaaacctaaaacattgcattgatagtcctatagttttgtttgaaagcggaaacattaaccttaataataaacatattattagtattgttggagccagaaaaatcacaacatcaggtattgcattttgtgaaaaattaattgaagagttagccatatataaaccaattataatttcgggatttgcttatggtacagatattacagcacataaagctgccattaaaaataaattacaaactataggttgtttagcacatggcttaaaccaaatttaccctaaagtgcataaaaagtacgttgcagaagttgaaaataatggaggcttttttactgacttttggagtagcgatacttttgatcgtaacaattttttaaaaagaaaccgcattattgcaggcattagtcaagcgactatagtaattgaatctgcagaaaaaggcggtagtctggtaacagcagatattgcaaactcatataacagagatgtgtctgcagtccctggacgtgtcacagatagtcaaagtattggttgtaataatctaattaaacaagaaaaagcgcatttgctatctacgcctttagatgtgccttaa

SEQ ID NO: 26546 - protein, 275 aa, Unknown
  Obtained from environmental sample
  DOMAIN (61)...(268): SMF family
  misc_feature (1)..(275): Xaa is any amino acid
MKHVSKIGDTTKKSNNHCGSAEAVFKEKKQNLLKIDGIGEIILSELYQSSHFEEADKELKFIKDENLKHHVFTDSTYPSNLKHCIDSPIVLFESGNINLNNKHIISIVGARKITTSGIAFCEKLIEELAIYKPIIISGFAYGTDITAHKAAIKNKLQTIGCLAHGLNQIYPKVHKKYVAEVENNGGFFTDFWSSDTFDRNNFLKRNRIIAGISQATIVIESAEKGGSLVTADIANSYNRDVSAVPGRVTDSQSIGCNNLIKQEKAHLLSTPLDVP

SEQ ID NO: 26547 - DNA, 501 bp, Unknown
  Obtained from environmental sample
  misc_feature (1)..(501): n is a, c, g, or t
ttgaattggntgagcagccgatggggtgnacgtagcgaaaacataatgattgtagacttagtgcgtaacgatttgtcgcataccgcaacaaaaggcagcgtaaaggttgaagaattgtgtaaaatatatactttcgatcaagtgcatcaaatgatttctactgtagtttcaaaagttgatgaaagcacaagtcctataaaaatactgcaaacaacatttccaatggggagtatgacgggtgttccaaaaatttcagctttaaaaattatcgaaaactttgaggaaaccaaacgtggattgtattctggagccgtgggttatattaccccaaatggtgatttcgattttaatgtggtcatacgaagtattctttataacgcaaccaaaaattacgtttcatattctgttggtggcgctattactgctaaaagcaacccagaaaaagagtacgaagagtgtttaattaaagctaaagcaatgcgcgacgtgcttgaaaactag

SEQ ID NO: 26548 - protein, 166 aa, Unknown
  Obtained from environmental sample
  DOMAIN (1)...(164): chorismate binding enzyme
  misc_feature (1)..(166): Xaa is any amino acid
MNWXSSRWGXRSENIMIVDLVRNDLSHTATKGSVKVEELCKIYTFDQVHQMISTVVSKVDESTSPIKILQTTFPMGSMTGVPKISALKIIENFEETKRGLYSGAVGYITPNGDFDFNVVIRSILYNATKNYVSYSVGGAITAKSNPEKEYEECLIKAKAMRDVLEN

SEQ ID NO: 26549 - DNA, 483 bp, Unknown
  Obtained from environmental sample
  misc_feature (1)..(483): n is a, c, g, or t
atgattaatattagagaatatatagaaaaaacagtggtaatatctgatcaagattggcaactgttttcgtctaaattagagaatagaacttttaaaaagaaaagtacaatattagacgttggcgatacagaaaactatatttcgtttatagaaaaaggtatcgctcgttttttaattccgaaggaagaaaaagaaatagatttgacctttggattttgttttaaaaatgagtttgtaagtgcttacgattcttttttgaccagaaaaccttcattatataagttacaagcgttaaaggatattaccatgtggagcatatcttatgacgatctgcaggaagtgtacgaaaaaagttttgcaggtaatgtaattggtcgtttatcctcagaacgtttgtttttaattaaatcaaaacgcgagcaatcgcttttaaacgaaactgctgaagagcgttatttaaatttgtttacggagcgtccaaan

SEQ ID NO: 26550 - protein, 161 aa, Unknown
  Obtained from environmental sample
  DOMAIN (25)...(120): Cyclic nucleotide-binding domain
  misc_feature (1)..(161): Xaa is any amino acid
MINIREYIEKTVVISDQDWQLFSSKLENRTFKKKSTILDVGDTENYISFIEKGIARFLIPKEEKEIDLTFGFCFKNEFVSAYDSFLTRKPSLYKLQALKDITMWSISYDDLQEVYEKSFAGNVIGRLSSERLFLIKSKREQSLLNETAEERYLNLFTERPX

SEQ ID NO: 26551 - DNA, 453 bp, Unknown
  Obtained from environmental sample
  misc_feature (1)..(453): n is a, c, g, or t
ttgatcatgactccagaagaaaagaaattggcattaagttttattgacaataaaggtaagttgccatggccaaccgaaaggggtattgtagttagaaaatacggcatacaaaaacatccaaccctttccggaataacgattcaaagtaacggcgtgcatgttgctacggaaaaaaaagctatggcaagatccatttttaatggaaccgtactatctattcaattattacctggtcgtaaaaaaatggtgttagtgcaacacggtaattatatttctgcctataaaaatttagacaatgtactcgttaaaaaaggagaaaaaattagtaccaagcaagcaataggtacaattcatactgatacaaccactggtaaaactattttagcttttagtttatttaaagaaactaatattcaaaacccggagcaatgggtatataaaatgggggtataa

SEQ ID NO: 26552 - protein, 150 aa, Unknown
  Obtained from environmental sample
  DOMAIN (47)...(141): Peptidase family M23
  misc_feature (1)..(150): Xaa is any amino acid
MIMTPEEKKLALSFIDNKGKLPWPTERGIVVRKYGIQKHPTLSGITIQSNGVHVATEKKAMARSIFNGTVLSIQLLPGRKKMVLVQHGNYISAYKNLDNVLVKKGEKISTKQAIGTIHTDTTTGKTILAFSLFKETNIQNPEQWVYKMGV

SEQ ID NO: 26553 - DNA, 726 bp, Unknown
  Obtained from environmental sample
  misc_feature (1)..(726): n is a, c, g, or t
atgcgcttgcgccagttaacaggtttagagcaagataagttgcgtactgagtatgatgccattatgaagacaattattgatcttaaagatatcttagacaagaaagagcgtcgtatggatattattaaaggagagctagaagttgttagagataaatatggtgatgagcgtcgttctgtaattgaatatgctggtggagatttaagtattgaagatatgatacctgatgcacaagttgtaattacaatttcgcatgcaggttatattaagcgtactttactttcagaatataagacacagcatagaggaggagttggtcaaaaagcatcaacaacacgtaatgaagatttcctagaacatttatttgtaggaactaatcaccagtacatgttattctttacacaaaaagggaaatgtttctggatgcgtgtttatgaaattccagaaggatcaaaaacgtcgaaaggtagagcaattcaaaaccttataaatattgaacaagacgataaagtaatggcttttatctgtactcaagatttaaaagatgaagaatacataaatagtcattatgttattatggcgactaaaaagggtcaagttaagaagacgtctttagaacagtattctcgtccaagaactaatggtattaatgccattactattaaggaggatgatgttatattggaagctaagttaacaacaggagtaatcaatgatgtgcgctaa

SEQ ID NO: 26554 - protein, 241 aa, Unknown
  Obtained from environmental sample
  DOMAIN (188)...(235): DNA gyrase C-terminal domain, beta-propeller
  misc_feature (1)..(241): Xaa is any amino acid
MRLRQLTGLEQDKLRTEYDAIMKTIIDLKDILDKKERRMDIIKGELEVVRDKYGDERRSVIEYAGGDLSIEDMIPDAQVVITISHAGYIKRTLLSEYKTQHRGGVGQKASTTRNEDFLEHLFVGTNHQYMLFFTQKGKCFWMRVYEIPEGSKTSKGRAIQNLINIEQDDKVMAFICTQDLKDEEYINSHYVIMATKKGQVKKTSLEQYSRPRTNGINAITIKEDDVILEAKLTTGVINDVR

SEQ ID NO: 26555 - DNA, 630 bp, Unknown
  Obtained from environmental sample
  misc_feature (1)..(630): n is a, c, g, or t
ttggttaaagagggcgtttgtgtggtaatttctccattgattgcattgatgcaagatcaggtagaaaacttaaaaaagcgtcatataaaagcaacacttataaaatcgggttcttctcaagatgatatgattgccctttttgacaatattaaatttggggattataaatttttatatatttctccagaaagactacaatctttatttattcaacaaaaattaaaagaacttaatattagttttgttgctattgatgaagcacattgtatttctgaatggggtcatgattttagaccaagctacaggaatattaaaattttaaaagagctaattcccaacacaaattttattgctttaactgcaactgccaaccaaagagttttagatgacattgccaaaaatcttgatttaaaaaatcctacaatttttaaaaaatctttttatagagaaaatttagcatatcaaatttttaatgtggaagataaattattaaggttgactcaaattttttcgaagacaaaaacaccagcaattgtgtatgtgagttcaagaaaaagaaccgaagaaattgcacgttttttaacggctaataattttaaaagtagtttttatcatgggtggattatctga

SEQ ID NO: 26556 - protein, 209 aa, Unknown
  Obtained from environmental sample
  DOMAIN (1)...(131): DEAD/DEAH box helicase
  misc_feature (1)..(209): Xaa is any amino acid
MVKEGVCVVISPLIALMQDQVENLKKRHIKATLIKSGSSQDDMIALFDNIKFGDYKFLYISPERLQSLFIQQKLKELNISFVAIDEAHCISEWGHDFRPSYRNIKILKELIPNTNFIALTATANQRVLDDIAKNLDLKNPTIFKKSFYRENLAYQIFNVEDKLLRLTQIFSKTKTPAIVYVSSRKRTEEIARFLTANNFKSSFYHGWII

SEQ ID NO: 26557 - DNA, 831 bp, Unknown
  Obtained from environmental sample
  misc_feature (1)..(831): n is a, c, g, or t
ttgacttggctgagatgcgtactgttttangtaaccaaaaagcataagtatttaccatataaagacaaagaaacgctacttaacgcattacagttaactaacgagtatctatcgtcttactataatgataatcgcattccaaatcatggttttgacaccattactaaagagttgcaattattaaaaatagaaaatacctatttagaaacccatagtcttaaaaaactaatttctatatccttaaccgctaacgatattgtcaaatttttaaaaaagtttgacacctattatccaggtttacaccaatttagctcacaaattgaagtcaccactgctataattgaaaaggtggatagcgttgtggatcgttttggagacgtaaaggataacgcttcggctttattacaaaacattagacaacaaataaataagttaaaaggtaaaattaactctagctttacctctgccttaaaccaatatcacaacctagaatatttagatgatattagagagtctgtggtggacaacaaacgcgtactagcagtaaaagctatgtatagacgtaaagttaaaggtgccattatgggtggaagtaaaacaggaagtattgtttatattgagcctgaaaccacgttacaacacaccagagaacttaataatttagaatacgaagaaagcgaagaagtcgtgcgtatcctaaaagaagtgaccaattacattcgtcattacttaccgttattagagttatttcaaacctttttacccgaaatggatgtgatttccgcgaaagcgaaatatgctaaatccatgaacgctattttaccagaaatn

SEQ ID NO: 26558 - protein, 277 aa, Unknown
  Obtained from environmental sample
  misc_feature (1)..(277): Xaa is any amino acid
MTWLRCVLFXVTKKHKYLPYKDKETLLNALQLTNEYLSSYYNDNRIPNHGFDTITKELQLLKIENTYLETHSLKKLISISLTANDIVKFLKKFDTYYPGLHQFSSQIEVTTAIIEKVDSVVDRFGDVKDNASALLQNIRQQINKLKGKINSSFTSALNQYHNLEYLDDIRESVVDNKRVLAVKAMYRRKVKGAIMGGSKTGSIVYIEPETTLQHTRELNNLEYEESEEVVRILKEVTNYIRHYLPLLELFQTFLPEMDVISAKAKYAKSMNAILPEX

SEQ ID NO: 26559 - DNA, 645 bp, Unknown
  Obtained from environmental sample
  misc_feature (1)..(645): n is a, c, g, or t
atgatttattacccgttatctacgctaatgattgctggaataagggagattttaataataacgacaccagatgatttaccgttattcaaaaaactactgtcggatggtaagcaattgggttgtacatttcaatatgctattcagccagaaccaaagggtttgnccgaggcttttattataggtaaggagtttattggaaatagtaaggttgctctaattttaggagataatattttttatggtaatggtctggaaaaattattaaaagaaaattctaagccagaaggcggaataatttatggatatcatgtaaataacccagatagatatggtgtggttgaatttgatgaatttggaaaagctatttcaattgttgaaaaacctcaaattcctaaatctaattacgctattccgggaatttatttttatgataataatgtagtaaagatagcagagcaaataaaaccgagcaatagaggagaactggaaatcacagatgtaaatattgcttacttaaataaaggtaacttgaaagtaagtgttcttgataaaggaattgcttggttagatacgggcacctttagttctttgatgaacgcatctcagtttgtgcaagtaatagaagaacgtcaaggtttaaaatag

SEQ ID NO: 26560 - protein, 214 aa, Unknown
  Obtained from environmental sample
  DOMAIN (1)...(207): Nucleotidyl transferase
  misc_feature (1)..(214): Xaa is any amino acid
MIYYPLSTLMIAGIREILIITTPDDLPLFKKLLSDGKQLGCTFQYAIQPEPKGLXEAFIIGKEFIGNSKVALILGDNIFYGNGLEKLLKENSKPEGGIIYGYHVNNPDRYGVVEFDEFGKAISIVEKPQIPKSNYAIPGIYFYDNNVVKIAEQIKPSNRGELEITDVNIAYLNKGNLKVSVLDKGIAWLDTGTFSSLMNASQFVQVIEERQGLK

SEQ ID NO: 26561 - DNA, 522 bp, Unknown
  Obtained from environmental sample
  misc_feature (1)..(522): n is a, c, g, or t
ttgattgtattagtattttcacaatgtacaaatgaaaacgcctttttgattgaaaagaatagagtagggttagtctcgagtattgataaagtaagtgatattgaaatgatttttgctaatgattctgtagtgagtcatttaagcgaaggtgatttaggagatggcaaatcaaagtttaatggagataatgatgagtacctaatttactctaaagaaggaaaacatttattaacgcttgttccaaaaatctcacaagattcatcatcaacaattaaatatgtagatgtgtttgacaatcagtttaggactgataaagagttggcattaacatcgcaatttaaagatgttaatttgcattatatgattaataaagtagaaactactttgtcatctgcaactttatatattgacgagttaaacgctacaattacaattgataaaaaagaattgggagtaacccgtttagtactgacaaagttcagttggaacaaattccagaaatggcaaaaatcaaatcaatga

SEQ ID NO: 26562 - protein, 173 aa, Unknown
  Obtained from environmental sample
  misc_feature (1)..(173): Xaa is any amino acid
MIVLVFSQCTNENAFLIEKNRVGLVSSIDKVSDIEMIFANDSVVSHLSEGDLGDGKSKFNGDNDEYLIYSKEGKHLLTLVPKISQDSSSTIKYVDVFDNQFRTDKELALTSQFKDVNLHYMINKVETTLSSATLYIDELNATITIDKKELGVTRLVLTKFSWNKFQKWQKSNQ

SEQ ID NO: 26563 - DNA, 600 bp, Unknown
  Obtained from environmental sample
  misc_feature (1)..(600): n is a, c, g, or t
ttgtgggtaattccgttttctaacggaaatacaagtattggctttgtaagcaaaactggatttgttaattcttataaagggacaccaactgaacgcttatcagaaatgatgaaactatctgattactattatgagcgctttaaagatgttgactttttgtttaagccaattattattcaaaatttttctaaatcagtaaagcaattgtatggagatgggtatgcattgactgggaattctgcagaatttttagaccctattttttcatcaggagtaacttttgcaaccgaatctggattgttagctgcaaaattagcttgtaaagaattacaaggaaaaactgttaattgggaaacagaatacaccaaatatattgctgaaggtgttgctgttttttcatcgtatgttaatgaatggtacacaggtaatttgcagaaattgttttttactagaccagaaaatcctgaaattaaaaaacagatatgtgctgtattagcaggatatgtttgggataaaacaaacccgtttgttaccaaacacaaccgaatcataaaaacggttgctcatgtaattgatatggagcaagaattgaataaatag

SEQ ID NO: 26564 - protein, 199 aa, Unknown
  Obtained from environmental sample
  misc_feature (1)..(199): Xaa is any amino acid
MWVIPFSNGNTSIGFVSKTGFVNSYKGTPTERLSEMMKLSDYYYERFKDVDFLFKPIIIQNFSKSVKQLYGDGYALTGNSAEFLDPIFSSGVTFATESGLLAAKLACKELQGKTVNWETEYTKYIAEGVAVFSSYVNEWYTGNLQKLFFTRPENPEIKKQICAVLAGYVWDKTNPFVTKHNRIIKTVAHVIDMEQELNK

SEQ ID NO: 26565 - DNA, 528 bp, Unknown
  Obtained from environmental sample
  misc_feature (1)..(528): n is a, c, g, or t
atggagattatttccataccgcttgaaggcgatctgcaacatatggatagcatgggcaacaccacaattataaaacaaggcgatgttcaggtgatgagtgcaggtacgggtattcagcatagcgagtacaacaaaaacaaagatcgacccgtaaaatttttacagatctggattattcctaacaaaaaggatgtggcaccccgatacgaccaaatttcccttcgggagattgaaagaaaaaacacgttttaccagattttatcacctaatcccgaagatcaaggcgtatggctacaccaagatgcctggttccatttgggcgattttgaaactggaaacaaagcgacttatacgctaaagaaaaaaggtaatggtatttatgtttttgttttggaaggtgaggtcgaaatcaataatcagtttttaggcaaaagggatggctatggcatttgggatgcggaccagtttgattttaaatctgtgggcgcatccaaggtattattgatggaagttcctatggcaatttag

SEQ ID NO: 26566 - protein, 175 aa, Unknown
  Obtained from environmental sample
  DOMAIN (1)...(58): Pirin
  misc_feature (1)..(175): Xaa is any amino acid
MEIISIPLEGDLQHMDSMGNTTIIKQGDVQVMSAGTGIQHSEYNKNKDRPVKFLQIWIIPNKKDVAPRYDQISLREIERKNTFYQILSPNPEDQGVWLHQDAWFHLGDFETGNKATYTLKKKGNGIYVFVLEGEVEINNQFLGKRDGYGIWDADQFDFKSVGASKVLLMEVPMAI

SEQ ID NO: 26567 - DNA, 321 bp, Unknown
  Obtained from environmental sample
  misc_feature (1)..(321): n is a, c, g, or t
atgaaaggaattttacttaacaatttaggatcaccagacacaacagatgtaaacgatgtaaaaacttatttagacgagtttttaatggatgaacgtgtaattgatattccatactggaaacgttatgttttaattaaaggaattatcttaaacacaagacctaaaaaatctgcagcagcttacaagaaaatttggtgggatgaaggttctcctttagtagtaatttctgaaagatttacagaaaaattaaaaaagaaaactgatttaccaatcgaacttgccatgcgttatggatctatgactatggaacaagggtattaa

SEQ ID NO: 26568 - protein, 106 aa, Unknown
  Obtained from environmental sample
  misc_feature (1)..(106): Xaa is any amino acid
MKGILLNNLGSPDTTDVNDVKTYLDEFLMDERVIDIPYWKRYVLIKGIILNTRPKKSAAAYKKIWWDEGSPLVVISERFTEKLKKKTDLPIELAMRYGSMTMEQGY

SEQ ID NO: 26569 - DNA, 600 bp, Unknown
  Obtained from environmental sample
  misc_feature (1)..(600): n is a, c, g, or t
atgaacacgcctttagcagaacgattacgtccacaaactttagacgactatataagtcagtcacatttagtaggtccaaacgggactttaaccagtcatattaatcaaggcattatacctagtatgatactttggggacctcctggtattggaaaaacaacgttggctaatattattgcgcaaacctctaagcgtcctttttatactttaagcgcaattagctctggtgttaaagatgtgcgagaggttattgagaaggctaaaaatagtggtggtttatttactgctaaaaacccaattttgtttattgatgagattcatagatttagcaaatcacagcaagatagtttattacaagctgtagaaaagggttgggtaacgctaattggtgcaacgactgaaaacccaagttttgaggtaatatcggcattattgtcacgctgtcaggtttatattttaaaagcttttgaaaaaagtgatttagaggaccttttaaagcgtgcgattgaaaaagacgaatacttatctaaaaagactataaaaattaatgaaacgagtgccttatngcgtttgtcaggtggtgatgctagaaaattttaa

SEQ ID NO: 26570 - protein, 199 aa, Unknown
  Obtained from environmental sample
  DOMAIN (41)...(198): ATPase family associated with various cellular activities (AAA)
  misc_feature (1)..(199): Xaa is any amino acid
MNTPLAERLRPQTLDDYISQSHLVGPNGTLTSHINQGIIPSMILWGPPGIGKTTLANIIAQTSKRPFYTLSAISSGVKDVREVIEKAKNSGGLFTAKNPILFIDEIHRFSKSQQDSLLQAVEKGWVTLIGATTENPSFEVISALLSRCQVYILKAFEKSDLEDLLKRAIEKDEYLSKKTIKINETSALXRLSGGDARKF

SEQ ID NO: 26571 - DNA, 597 bp, Unknown
  Obtained from environmental sample
  misc_feature (1)..(597): n is a, c, g, or t
ttggaaaaaagtagtgattacaaatccaacgttaaaaacacttttaaactaatcaaaggttataaatcagtagatgaattaggtagcaaaaatcttaaacatttgaccaatttagaaattcaacaaaaaaatgttttaaataataacggtcacatttttctaactaatataaatccagatgtttcggcttgcattaaacaatctaaaattaacattggcgatatttgtaactgtgcaacaggcttctattctggaaatgacaaagaccgtttgaaagttataagtaaagagattcgtaattctaaaagatatgaagtagttgacaaagaaaaaatcacatataattgtagctcaagacctttgaatggaattgaaaacgataaaatattcgttccaattgtaaaaggtggaaatataaaatatgttaagccggacaactggtttatggaatggtcaaaggaattagttagcttttataaaaaagacaaaaaagctcgttaccaaaattcatcctattattttagaaaaggtattggtgtgccaatggttagttctacttccataacaggagttctaattgagaatagattattcgac

SEQ ID NO: 26572 - protein, 199 aa, Unknown
  Obtained from environmental sample
  misc_feature (1)..(199): Xaa is any amino acid
MEKSSDYKSNVKNTFKLIKGYKSVDELGSKNLKHLTNLEIQQKNVLNNNGHIFLTNINPDVSACIKQSKINIGDICNCATGFYSGNDKDRLKVISKEIRNSKRYEVVDKEKITYNCSSRPLNGIENDKIFVPIVKGGNIKYVKPDNWFMEWSKELVSFYKKDKKARYQNSSYYFRKGIGVPMVSSTSITGVLIENRLFD

SEQ ID NO: 26573 - DNA, 798 bp, Unknown
  Obtained from environmental sample
  misc_feature (1)..(798): n is a, c, g, or t
atggatttagttgatttttcagaagaaaaatataatgagattaaatcaaattttgaagtgttaatgaaaaaacgagagtatcaagatcagaacattacatttatacccgtaagtgctttaaaaggtgataatgttgtaaatgcttcagaaaatatgccttggtataacggacaaacattattatctcattttgagaatttaagttcaaacgatgtgtataatgaagacgtgccgcgatttcctgtgcaatatgttattagaccaaaaaccgaagagtttcacgattttcgggggtatgcaggaaaagtatatggaggagaattaaatgtaggagacacgattgttgttttaccttcactaacaaaatcaaaaattaaagagattcatttctataataatacaatagaaacggcaacaaaccaatcgtcagttgtgataacattaaaagacgatgttaatattagccgtggagatatgattgtaaaagaaagcgaggtacccaagatacaaaaagaatttacagcaactatatcttggatggattcacaaactttaaaacaaggcggtaaatatattgttcaacatggggttaataaagttatggcaaaaatagaggctattcatcataaaatcaatcctgattattctggtgtagatgatacggtaaatactttaaaaatgaacgatattgcacttgtgacctttaacttacataaacccatttntcttgatccttttaaaaaacccagaacaaatggagcatctattctaatagatgttaactctaacaatactggg

SEQ ID NO: 26574 - protein, 266 aa, Unknown
  Obtained from environmental sample
  DOMAIN (96)...(161): Elongation factor Tu domain 2
  misc_feature (1)..(266): Xaa is any amino acid
MDLVDFSEEKYNEIKSNFEVLMKKREYQDQNITFIPVSALKGDNVVNASENMPWYNGQTLLSHFENLSSNDVYNEDVPRFPVQYVIRPKTEEFHDFRGYAGKVYGGELNVGDTIVVLPSLTKSKIKEIHFYNNTIETATNQSSVVITLKDDVNISRGDMIVKESEVPKIQKEFTATISWMDSQTLKQGGKYIVQHGVNKVMAKIEAIHHKINPDYSGVDDTVNTLKMNDIALVTFNLHKPIXLDPFKKPRTNGASILIDVNSNNTG

SEQ ID NO: 26575 - DNA, 651 bp, Unknown
  Obtained from environmental sample
  misc_feature (1)..(651): n is a, c, g, or t
atgaatttggcagataatatttcttacagcttacatgatttagaagatgcactttctctagggatgatcagtcgagagcaatggcaagagcatttcaatgatagtaacagcttgttcgatattgttgaaaacctagaaaatgaaagagtagaaaaagaatccaactttgattgcataactagaaagcttttcggtgatgaaagttatgaaagaaaagatgcgattggtcgtctagttaaccttatgataactaatgctgaaatagttgagaatggttccaactgtaaaaatgcattactaggtcttgaggttaagctaaaaaaagaagtggaagagttaagagaacatatttttaaaattgtatatgaggtcgtcatcaaggatgtgaatgttcaacagcttgagttcaaaggacaaaagctagttatagagttgtttcaagttttggctaaagatcctgagaggttcctgccccagtctaccaaagtaatttggaaagattctatgaaaaatctgccagtagaagatcaagaggcagctcagatgcgagtaatttgtgattttattgctggtatgactgatgattacgctactaagttttatgagaagttttttactcctaacaaaggttctatctttgataggttgtga

SEQ ID NO: 26576 - protein, 216 aa, Unknown
  Obtained from environmental sample
  misc_feature (1)..(216): Xaa is any amino acid
MNLADNISYSLHDLEDALSLGMISREQWQEHFNDSNSLFDIVENLENERVEKESNFDCITRKLFGDESYERKDAIGRLVNLMITNAEIVENGSNCKNALLGLEVKLKKEVEELREHIFKIVYEVVIKDVNVQQLEFKGQKLVIELFQVLAKDPERFLPQSTKVIWKDSMKNLPVEDQEAAQMRVICDFIAGMTDDYATKFYEKFFTPNKGSIFDRL

SEQ ID NO: 26577 - DNA, 825 bp, Unknown
  Obtained from environmental sample
  misc_feature (1)..(825): n is a, c, g, or t
atggtgcctaagggatgggaggttaaaagctttgaagatgttgcgtttgttggtaatggacaggttgaccctagagaagagccttattcttcaatgtggcatattgggccagagaatgttacttctgatactggtcgaataaagaacgtcagacaatgttccgagttaggactaatatctggaaagtatgagtttgacagagaatctatagtttattccaagatccgtcctaatcttaataaagtttgtagacctgattttgatggtgtttgtagcgcagatatgtacccaatatggactaaagaaggattatttgctgactacttattttactatatgttagggccaaagttttatagcactgcggtttcaatgtccatgcgtacaggaatgccgaaaataaatcgtactgatttagatacgattaaaataaatattcctcctctcccagaacaacaaaagatcgccaaaatcctatccacttgggataaagcgattagtccgaccgagcgtttaattgagaatagtacccagcagaaaaaagccttgatgcagcaattgctgacgggtaaaaagcggttgcttgatgagtcggggaaaaggtttgagggagagtggaaggatgcaacagtatcatctttcggtaaggtgattactggtaacactccgncaaaaaatgattccagtaattatgatggcagtatatcttgggctaacagcgaggattttaagcgaaagtatgtctcaaatactaaagttaaactaacagaacaggagccaataaagttaaaatcgtccctaaggaaatgtttaatcactgtatag

SEQ ID NO: 26578 - protein, 274 aa, Unknown
  Obtained from environmental sample
  DOMAIN (6)...(164): Type I restriction modification DNA specificity domain
  misc_feature (1)..(274): Xaa is any amino acid
MVPKGWEVKSFEDVAFVGNGQVDPREEPYSSMWHIGPENVTSDTGRIKNVRQCSELGLISGKYEFDRESIVYSKIRPNLNKVCRPDFDGVCSADMYPIWTKEGLFADYLFYYMLGPKFYSTAVSMSMRTGMPKINRTDLDTIKINIPPLPEQQKIAKILSTWDKAISPTERLIENSTQQKKALMQQLLTGKKRLLDESGKRFEGEWKDATVSSFGKVITGNTPXKNDSSNYDGSISWANSEDFKRKYVSNTKVKLTEQEPIKLKSSLRKCLITV

SEQ ID NO: 26579 - DNA, 753 bp, Unknown
  Obtained from environmental sample
  misc_feature (1)..(753): n is a, c, g, or t
atgattacacgttcttttcccgatggcactattgtccaagacaaaattaacgccaccactcatataccggaagaaattcacaaattcacacaacagtttgttgtagcaaaagatgaaaaattcaaatttattaacaatggaattttcggttatataggctatgatgccgttcgttattttgaagatattcagatcgaaaaaaaagaggacacgctacatattcctgatatttactatgccgtttatcagaatattatcgtaatcaaccattttaaaaaccaagcatatatttttgcccattgtttttcagaaaaggataatattgatgagatccatcatttgatcaaagcgactaattttgctgcttacagttttaaaaccgatggagaaatatcctccaatcttacggatgacgaatataaaaaccatgttgagctggctaaaaagcattgtggaaggggagatgtatttcaactggttttatctaaaaaattcaaacaatattttaaaggagatgagtttaatgtatatagggctttacggagtattaatccgtcaccttatttattttattttgattatggtgattttaagatctttggtagttcacccgaagcacaattgatagtgaaaaatggccaatcagaaattcacccaattgccggaacttttaaacggaccggtaatgatgaaaaggactctgaattagcgaaacaattatctattgatcaaaaagaaaatgcagnacattaa

SEQ ID NO: 26580 - protein, 250 aa, Unknown
  Obtained from environmental sample
  DOMAIN (1)...(97): Anthranilate synthase component I, N terminal region
  misc_feature (1)..(250): Xaa is any amino acid
MITRSFPDGTIVQDKINATTHIPEEIHKFTQQFVVAKDEKFKFINNGIFGYIGYDAVRYFEDIQIEKKEDTLHIPDIYYAVYQNIIVINHFKNQAYIFAHCFSEKDNIDEIHHLIKATNFAAYSFKTDGEISSNLTDDEYKNHVELAKKHCGRGDVFQLVLSKKFKQYFKGDEFNVYRALRSINPSPYLFYFDYGDFKIFGSSPEAQLIVKNGQSEIHPIAGTFKRTGNDEKDSELAKQLSIDQKENAXH

SEQ ID NO: 26581 - DNA, 411 bp, Unknown
  Obtained from environmental sample
  misc_feature (1)..(411): n is a, c, g, or t
gtgtatgactttacaactggtgttattgaaaacaatccaaacattgataacattatagcagtaaatgaaaaagaattgaagcaatttaaatttatgcaacgcttgattagacgagttaaaaaaaataactatgatattatttttgacccttactctaaattacaaagtcggattatttgttatttttcgggagctagcatgcgaataggttttcagaaaagaggtaaaaacccttggtttaatttttacacacatactgtccctttattagaagaaaaaaaacatataagtggtaaagctattgaagacaggataaatatgtttaactgtttttttccgttaccggaaaataaaattgattatgaacctcacatagttttaaccgataaagagcaacaatacacaagttag

SEQ ID NO: 26582 - protein, 136 aa, Unknown
  Obtained from environmental sample
  misc_feature (1)..(136): Xaa is any amino acid
MYDFTTGVIENNPNIDNIIAVNEKELKQFKFMQRLIRRVKKNNYDIIFDPYSKLQSRIICYFSGASMRIGFQKRGKNPWFNFYTHTVPLLEEKKHISGKAIEDRINMFNCFFPLPENKIDYEPHIVLTDKEQQYTS

SEQ ID NO: 26583 - DNA, 411 bp, Unknown
  Obtained from environmental sample
  misc_feature (1)..(411): n is a, c, g, or t
atggctcgcattttagcaattgattacggaaagattagaacaggattagcagtgactgatgagatgcagattattgcttctggattgactactgtaaatactaaagagcttattacttttttaaaagactatctaagtaaggagcaagtcgaattatttttagtcggagaaccaaaacaaatggataatacgccaagtgagagtgaagcgttaattattccgtttttggttaaattagaaaatgcatttcctaagattccgataaaacgtgtagacgagcgttttacctctaaaatggcgacgcaaacattaatagatagcggattaaagaaaaaacaaagacaaaataaagcgcttttagacgaggttagtgcaaccataatcttacaaaactatcttgataatcaataa

SEQ ID NO: 26584 - protein, 136 aa, Unknown
  Obtained from environmental sample
  DOMAIN (2)...(135): Uncharacterised protein family (UPF0081)
  misc_feature (1)..(136): Xaa is any amino acid
MARILAIDYGKIRTGLAVTDEMQIIASGLTTVNTKELITFLKDYLSKEQVELFLVGEPKQMDNTPSESEALIIPFLVKLENAFPKIPIKRVDERFTSKMATQTLIDSGLKKKQRQNKALLDEVSATIILQNYLDNQ

SEQ ID NO: 26585 - DNA, 492 bp, Unknown
  Obtained from environmental sample
  misc_feature (1)..(492): n is a, c, g, or t
ttgaaagtattgaaagctggatattcatttttttggggggaaaaaaaaaaccaagggcactttatcctgtatttgtgtctcctttttgatttagattcggtcaatattgataaccgtactatcagggaattaaccattcaatatcctcatatttattttttgtgtctatctaaggatcgatttcaccctagaattgaaagatgcaatttgttaccatatttattgccccccatagactataacttaaagccattggattatgacngcaaacttacatttactttgagcttaagcattgttatttgggatcattgtgcaaaatttgcggaatttccaaaaattttccggtttcacacaatcacaaaaacatttcaaaaagaacacacagtgtcacatcaagttaaaaacgaaccccgaaaaattgtcaaaaccgggcagaggggcaaaacacattggggggaaaaaaaaaaccagcaacaaaaaaatccttaa

SEQ ID NO: 26586 - protein, 163 aa, Unknown
  Obtained from environmental sample
  misc_feature (1)..(163): Xaa is any amino acid
MKVLKAGYSFFWGEKKNQGHFILYLCLLFDLDSVNIDNRTIRELTIQYPHIYFLCLSKDRFHPRIERCNLLPYLLPPIDYNLKPLDYDXKLTFTLSLSIVIWDHCAKFAEFPKIFRFHTITKTFQKEHTVSHQVKNEPRKIVKTGQRGKTHWGEKKNQQQKNP

SEQ ID NO: 26587 - DNA, 330 bp, Unknown
  Obtained from environmental sample
  misc_feature (1)..(330): n is a, c, g, or t
ttgttatttgggatcattgtgcaaaatttgcggaatttccaaaaattttccggtttcacacaatcacaaaaacatttcaaaaagaacacacagtgtcacatcaagttaaaaacgaaccccgaaaaattgtcaaaaccgggcagaggggcaaaacacattggggggaaaaaaaaaaccagcaacaaaaaaatccttaattcttccccttgggggccaaaaatttcttggaatttattgccctttggacacgcaaattcaacagcggcaattttgttccaccgggcccagacatcccctttttcattcacaaaaagcctaaacttggcttga

SEQ ID NO: 26588 - protein, 109 aa, Unknown
  Obtained from environmental sample
  misc_feature (1)..(109): Xaa is any amino acid
MLFGIIVQNLRNFQKFSGFTQSQKHFKKNTQCHIKLKTNPEKLSKPGRGAKHIGGKKKTSNKKILNSSPWGPKISWNLLPFGHANSTAAILFHRAQTSPFSFTKSLNLA

SEQ ID NO: 26589 - DNA, 435 bp, Unknown
  Obtained from environmental sample
  misc_feature (1)..(435): n is a, c, g, or t
atggcttttttagatatacaggaaggtccatatttagtacaaccaacagacgaagcttttgataatggggaaagaccaattaatgtagataaaaccaatttagtatggttaaacgctaaggatattgaatggatttcagaaaaaagtaatgtagaaactgcttttttatggggaagccacgaaaaaaatcaattacgtgctacacttttaaaactaccagctggtttcaatgggaaaattaaaaatttaagtccaaattttagagcagttgttatttctggtggaatttcacatcagttttctaaaaaagaagataaaaaggaattaacgtctggatcttattttggagtcgaagaagattctaaatctattattactacagatcaagaaactgtgatttacatccgtagtaacggagattttaaagtcaaataa

SEQ ID NO: 26590 - protein, 144 aa, Unknown
  Obtained from environmental sample
  misc_feature (1)..(144): Xaa is any amino acid
MAFLDIQEGPYLVQPTDEAFDNGERPINVDKTNLVWLNAKDIEWISEKSNVETAFLWGSHEKNQLRATLLKLPAGFNGKIKNLSPNFRAVVISGGISHQFSKKEDKKELTSGSYFGVEEDSKSIITTDQETVIYIRSNGDFKVK

SEQ ID NO: 26591 - DNA, 558 bp, Unknown
  Obtained from environmental sample
  misc_feature (1)..(558): n is a, c, g, or t
ttgaaatttgatttagtagataattatctcaacgttaaaaaacacctattaaaagataaaatctcaaaattagaagatattcattttgctgctgaaacccaagaaagatatatagaccttgttgattctaaacagaaacccgataaaattgatatatacgtggatagattaggacttcaaagcgaatggatgtccaaaaataatcaggtctattttgcaatagaatgtaaacgaatcagaattttatcggacacaaaagcttatataggtgacattagaaaagtagcaaatagaaatcacaccaatttaaggcttccttttgagggacaaatagccttcattgagaatttgaatatagaccatcacaaagtaatgacaaaagccaatagtattttaaaaaaagatatagaaatcaatactcttcaatatttaaaattccaaagttttcacagtttttttcaaaatacctacagttcagttcacacaaaaaattttgggggaaaagaatcattttatgtttaccatctactatttgacttaatagtccagaataagtaa

SEQ ID NO: 26592 - protein, 185 aa, Unknown
  Obtained from environmental sample
  misc_feature (1)..(185): Xaa is any amino acid
MKFDLVDNYLNVKKHLLKDKISKLEDIHFAAETQERYIDLVDSKQKPDKIDIYVDRLGLQSEWMSKNNQVYFAIECKRIRILSDTKAYIGDIRKVANRNHTNLRLPFEGQIAFIENLNIDHHKVMTKANSILKKDIEINTLQYLKFQSFHSFFQNTYSSVHTKNFGGKESFYVYHLLFDLIVQNK

SEQ ID NO: 26593 - DNA, 435 bp, Unknown
  Obtained from environmental sample
  misc_feature (1)..(435): n is a, c, g, or t
gtgtacaggtcgctaaagtggcttaacataccaacttcttttagcgctcctaccagtaataatacacctacaaaaaacaacaaggtgtcgtattctatttcacgaatgaaatctatcatgtctttgtttatgtcttttttgcgcattaaaaattgcgctactaaaaacatcatagacaaaccaaacaaaaaggtaagcaatggcggtacactgtataaaacactcagtgttaaggtagcaataaccgtagataagaagataactgcaattgtaatatcggttttttcaatgcgtttttgcttcgttttagtacagtcgagctggccatttaagccaattgacaacagtgcggctaacagcatcacacttacaaatgctggcccaattaacaataacaaattgctaatattaatttggcatctaaaaatatcataa

SEQ ID NO: 26594 - protein, 144 aa, Unknown
  Obtained from environmental sample
  misc_feature (1)..(144): Xaa is any amino acid
MYRSLKWLNIPTSFSAPTSNNTPTKNNKVSYSISRMKSIMSLFMSFLRIKNCATKNIIDKPNKKVSNGGTLYKTLSVKVAITVDKKITAIVISVFSMRFCFVLVQSSWPFKPIDNSAANSITLTNAGPINNNKLLILIWHLKIS

SEQ ID NO: 26595 - DNA, 606 bp, Unknown
  Obtained from environmental sample
  misc_feature (1)..(606): n is a, c, g, or t
atgaagtactacttatttattttactagttggtttaagcacaacttttggtttttctcaaactaaaaaagaaaacacaaaagcagtaacttctatcaaaaaaagtattgactctactgctgtaaaagcagaatctactgtcaaaggtatcattattgatgccacttcaagacaacccttagaaaacgtaaacattgttaatctaaatcaagttataggtacagctacaaatgataaaggtgaatttgaattgcgtgcacaagcaaatgacacccttcacctatcctatttaggttttaaatccattaaagttaaagtaaccaatgactgggttgatcaaatcgaaaaatctactattacactaacagagttagctttagctctagaagaagttgttgttactggattaaagttaacaggttatttagaagtagacattaagcaagtaaatataaccacaaattatagatatagtattccgggtctttctaatggttatgaagccggaaaaaagcacctagtgctgatactaaggtttcaggatcactacttaatccgtttgatttttatacaacacctttatataaagggaagagttagaagttaa

SEQ ID NO: 26596 - protein, 201 aa, Unknown
  Obtained from environmental sample
  SIGNAL (1)...(19)
  misc_feature (1)..(201): Xaa is any amino acid
MKYYLFILLVGLSTTFGFSQTKKENTKAVTSIKKSIDSTAVKAESTVKGIIIDATSRQPLENVNIVNLNQVIGTATNDKGEFELRAQANDTLHLSYLGFKSIKVKVTNDWVDQIEKSTITLTELALALEEVVVTGLKLTGYLEVDIKQVNITTNYRYSIPGLSNGYEAGKKHLVLILRFQDHYLIRLIFIQHLYIKGRVRS

SEQ ID NO: 26597 - DNA, 390 bp, Unknown; identical to SEQ ID NO: 20551
  Obtained from environmental sample
  misc_feature (1)..(390): n is a, c, g, or t

SEQ ID NO: 26598 - protein, 129 aa, Unknown; identical to SEQ ID NO: 20552
  Obtained from environmental sample
  misc_feature (1)..(129): Xaa is any amino acid

SEQ ID NO: 26599 - DNA, 396 bp, Unknown
  Obtained from environmental sample
  misc_feature (1)..(396): n is a, c, g, or t
gtggatcaagaatcggtcgagagttatcaatgcagatcagttatctcgcttcacttagtgcctccaccccgatgtgataatataactaaatcaaaacagatcattgaaggattaccaactattaaggcagcgtcctgtgacgcacttatggttgctgattcttatctttttttagaatgcgaattatataaaattgtggatgggtttgacgaaaactgtctgataactggtaagattatcagggctgttgcgaataaaaattatgtccgaatatctgaactggatgaacaagagcaaataaaaaatcatcccttattagcttatattgcttatgggcgatttgcaaaaattgaacaaacctataattttccttttccaaaagattttaaaaggtaa

SEQ ID NO: 26600 - protein, 131 aa, Unknown
  Obtained from environmental sample
  misc_feature (1)..(131): Xaa is any amino acid
MDQESVESYQCRSVISLHLVPPPRCDNITKSKQIIEGLPTIKAASCDALMVADSYLFLECELYKIVDGFDENCLITGKIIRAVANKNYVRISELDEQEQIKNHPLLAYIAYGRFAKIEQTYNFPFPKDFKR

SEQ ID NO: 26601 - DNA, 510 bp, Unknown
  Obtained from environmental sample
  misc_feature (1)..(510): n is a, c, g, or t
ttgcttatgggcgatttgcaaaaattgaacaaacctataattttccttttccaaaagattttaaaaggtaataacatgaataatgaggtagcttcaaaaatatgggatcatttggaagaaaatcaagaaggaatgcttcattttttaaaacaaattgttgccatagaaactccttcacataataaggaagctcagcttgaactatttcagtttctggagaaaaagtttcattcattaggttattatgtattgcatgtcccaggaaaagagactggtggttatttatatgcgcgccctttagttagaagaaaaaataatcctattcaattattgataggtcattgtgatacagtttggagtattaatactttgaaagaaatgccgatctctaaacaagatggtaccattcggggtcctggtatttacgatatgacagcacgattaacccagatttttttttcaatccaaaccctacaaagtttagcgttgtcttcagcagtaacaccgtga

SEQ ID NO: 26602 - protein, 169 aa, Unknown
  Obtained from environmental sample
  misc_feature (1)..(169): Xaa is any amino acid
MLMGDLQKLNKPIIFLFQKILKGNNMNNEVASKIWDHLEENQEGMLHFLKQIVAIETPSHNKEAQLELFQFLEKKFHSLGYYVLHVPGKETGGYLYARPLVRRKNNPIQLLIGHCDTVWSINTLKEMPISKQDGTIRGPGIYDMTARLTQIFFSIQTLQSLALSSAVTP

SEQ ID NO: 26603 - DNA, 570 bp, Unknown
  Obtained from environmental sample
  misc_feature (1)..(570): n is a, c, g, or t
gtgcttaaccgaaaagttagctctaatctgcacgctacgagccatatacaaaaccgttaccaaacattaaaaatgaaaaaccgaattcaaaaaggatatttatcaattggtatagaaatcgatggaaacaagattctgactgaattaataaatagaagtgatagtcctaatgaattactcagcaaacaatttgagatttttcatatggattttctagttggattaaaaagcattcaagaattcgatgaaatttcatttaatagatatattgaaaagattaacgaaacaaaaggaaaattaaacttttggggtgaaaaatttgaaactgttattcattcgaaattaataaaagcttgtcctaaaataatatctgaccttaaaagaggtgttgacggaattgagcctgatattctttttaaatacaaagaagagcaattaggaattgaattaacaactctgaaaattttaaatgctcctaaaaataaagaacagattctttcaaaaattactgataaaattttagaaaaaaatataaaccatattcaagcgaaaaatgtggtctattattga

SEQ ID NO: 26604 - protein, 189 aa, Unknown
  Obtained from environmental sample
  misc_feature (1)..(189): Xaa is any amino acid
MLNRKVSSNLHATSHIQNRYQTLKMKNRIQKGYLSIGIEIDGNKILTELINRSDSPNELLSKQFEIFHMDFLVGLKSIQEFDEISFNRYIEKINETKGKLNFWGEKFETVIHSKLIKACPKIISDLKRGVDGIEPDILFKYKEEQLGIELTTLKILNAPKNKEQILSKITDKILEKNINHIQAKNVVYY

SEQ ID NO: 26605 - DNA, 555 bp, Unknown
  Obtained from environmental sample
  misc_feature (1)..(555): n is a, c, g, or t
ttgggtaattgtagaactttcatgtcttttgatatgattttcaggtatttcaggcatctaggttataaagtacgatatgttagaaatattacagacgcaggccatttagtagatgacgctgaagatggtgaagataaaattgcgaaaaaggccagactagaaaaattggagccgatggaagttgtacaacgctacactgtcgattttcataatattttagagaaatttaattttttacctccaagtatagaacctaccgcaacaggtcatatcatagaacaaattgaaatcattaaggatattcttgaaaagggatttgcttatgaaaccaatggttctgtatattttgatgtggctaagtttaacaaagaacacgaatacggtaaacttagcgggcgtaagttagaagatatgattgcgaatacccgtgatcttgccgcacaagacgacaaacataatcctcaagattttgccctttggaaaaaagcagaaccacaacacattatgcgttggccgtcaccanntggggagacggattcccaggctggcatttag

SEQ ID NO: 26606 - protein, 184 aa, Unknown
  Obtained from environmental sample
  DOMAIN (1)...(184): tRNA synthetases class I (C) catalytic domain
  misc_feature (1)..(184): Xaa is any amino acid
MGNCRTFMSFDMIFRYFRHLGYKVRYVRNITDAGHLVDDAEDGEDKIAKKARLEKLEPMEVVQRYTVDFHNILEKFNFLPPSIEPTATGHIIEQIEIIKDILEKGFAYETNGSVYFDVAKFNKEHEYGKLSGRKLEDMIANTRDLAAQDDKHNPQDFALWKKAEPQHIMRWPSPXGETDSQAGI

SEQ ID NO: 26607 - DNA, 333 bp, Unknown
  Obtained from environmental sample
  misc_feature (1)..(333): n is a, c, g, or t
gtgtctggatttgatgtttttattccaaaagatggtatttacatttccatacaagttttaggctttacagacaaaaacggaaaattacttccaaataaaaaatatcaagaagttaaaactagacgtggtattgtaaaagtatcaacaacctttagacctttattaccttttacagaccaaatttctgaaaaaaccacttttgtaaaacgtgtttttcaaaacaatggacaatgggttctttttgataaaaaaaacattgataactcaaatcttttaaacgctggtttaaacaattatggtatgggtttaaaaatggaagtttataaagagtaa

SEQ ID NO: 26608 - protein, 110 aa, Unknown
  Obtained from environmental sample
  misc_feature (1)..(110): Xaa is any amino acid
MSGFDVFIPKDGIYISIQVLGFTDKNGKLLPNKKYQEVKTRRGIVKVSTTFRPLLPFTDQISEKTTFVKRVFQNNGQWVLFDKKNIDNSNLLNAGLNNYGMGLKMEVYKE

SEQ ID NO: 26609 - DNA, 345 bp, Unknown
  Obtained from environmental sample
  misc_feature (1)..(345): n is a, c, g, or t
atgcactctagatatttcattattttacttttagtactatttacaattaatagttttagtcaaactacaattattgatagtattacaaaaaatggcgtctcgtttgcaacagtttcatttggaaacggaaatggaatatttgctgatgacgatggtaaatttttcttcactaaaaagctatattcagatatcgattcgcttttcgtttcagcattaggatacaaagacgttaagctggcttcaaaaaacctaaaagacaccctttatttaacaccacaatctgaccttttagacgaggttatcgttactgctaaaacttcacgaaaaccacaagaatttcattaa

SEQ ID NO: 26610 - protein, 114 aa, Unknown
  Obtained from environmental sample
  SIGNAL (1)...(20)
  misc_feature (1)..(114): Xaa is any amino acid
MHSRYFIILLLVLFTINSFSQTTIIDSITKNGVSFATVSFGNGNGIFADDDGKFFFTKKLYSDIDSLFVSALGYKDVKLASKNLKDTLYLTPQSDLLDEVIVTAKTSRKPQEFH

SEQ ID NO: 26611 - DNA, 930 bp, Unknown
  Obtained from environmental sample
  misc_feature (1)..(930): n is a, c, g, or t
atggctgggctaggcatagagtctgcattgcagcaactagaagttaaagaggttattgtggttaacgatggaagtacagataattctttagcaatcataaaggggcttcagaatacagatcagcgtgtgaaaatttttcatcataaaaataatcaaaataaaggacgatcagcttcgcgaaaccttggaatacaaaaggcaacatcaaattatattgcttttttagatgctgatgattattatttagaaaatagatttacgaaagatcaattgaaatttgaacaagaccacacggttgaaggtgtttataatgcaattggagcacatttttataaagaaagatctgcagcagaaaaacaaactttagagcttacaacgttaagtaaagctatagaaccagaacagctttttagaatcttgttatctggtagtttagggtatttttctatagatggattaacggttaaacagtctgtgtttggtacaataggtctgtttaataaaagattaaaagtgacagaagatacagatttaatatggaaaatggcattaaaatgtaagttggttgctggagtaatagaccatccagttgccatgaggggtgtacacgataacaatgtgtttgataacgaagcattgtatgaagaatataatattaagttatttgaatctattgccttttggagtactaaaaataatattgaaattgttgaaatagagcgtgttattgaaaaaatttggattttaaaaagcagacaaacccattcagttttaaaaaagattagctattggttttacttaacaataaatatgactagtacattatttacgtatctaactgtaaagtatttttcattagtaagatatagaaaaaacactggttttcattttatgtacaaaacaagaataaaatatggaattttaacgtaa

SEQ ID NO: 26612 - protein, 309 aa, Unknown
  Obtained from environmental sample
  misc_feature (1)..(309): Xaa is any amino acid
MAGLGIESALQQLEVKEVIVVNDGSTDNSLAIIKGLQNTDQRVKIFHHKNNQNKGRSASRNLGIQKATSNYIAFLDADDYYLENRFTKDQLKFEQDHTVEGVYNAIGAHFYKERSAAEKQTLELTTLSKAIEPEQLFRILLSGSLGYFSIDGLTVKQSVFGTIGLFNKRLKVTEDTDLIWKMALKCKLVAGVIDHPVAMRGVHDNNVFDNEALYEEYNIKLFESIAFWSTKNNIEIVEIERVIEKIWILKSRQTHSVLKKISYWFYLTINMTSTLFTYLTVKYFSLVRYRKNTGFHFMYKTRIKYGILT

SEQ ID NO: 26613 - DNA, 681 bp, Unknown
  Obtained from environmental sample
  misc_feature (1)..(681): n is a, c, g, or t
ttgttatttgatggaagcgtcaaacagaaggaaagtgcggcttttttagagaaaaataaagccctgtttgcttatcatgttagtgagccagataaagcgttttattatgcaatgaacaaaggtattgctaaagctagaggagagtatttattatttttaaatgcaggtgatcatttttatgatacttcagttttagaaaaaaatcatcaattattatctaaagaagatattatctattttaatttacaagtcgttgataaagggaatacttttatcaaaacttatccaaataagttgtctttttcttattttgttgaagatacattaccgcatccagcaacatttattaaaaaaaatgcattcaatacagttggaaactataaagaatattttaagattttatctgattggaagttttttattgatgctatttgcaagtataatttaagttataaaaaaattgataggacgctctcaacattttatattggaggtatgagttcggatccaaaaaatagaaatattaagtatacggaaaaacaaagcgttttagagcaagactaccctacttactatcaagatatagaagatgttatagggtataagaagatagttagtaattttaaacgttctcgcattattagtctattggttaagttaaatcttttaaataaattttaa

SEQ ID NO: 26614 - protein, 226 aa, Unknown
  Obtained from environmental sample
  misc_feature (1)..(226): Xaa is any amino acid
MLFDGSVKQKESAAFLEKNKALFAYHVSEPDKAFYYAMNKGIAKARGEYLLFLNAGDHFYDTSVLEKNHQLLSKEDIIYFNLQVVDKGNTFIKTYPNKLSFSYFVEDTLPHPATFIKKNAFNTVGNYKEYFKILSDWKFFIDAICKYNLSYKKIDRTLSTFYIGGMSSDPKNRNIKYTEKQSVLEQDYPTYYQDIEDVIGYKKIVSNFKRSRIISLLVKLNLLNKF

SEQ ID NO: 26615 - DNA, 438 bp, Unknown
  Obtained from environmental sample
  misc_feature (1)..(438): n is a, c, g, or t
atggataaattttatggctgttataaatatgcttcagaattaaggcaacaaattataaaagagagtggactacctatatcttttgggttatctgtgaataaaatagtctctaaagttgccacaggagaagcaaaaccaaacaaccaattacaaatagattcagggtttgagaaatcttttttagctccattatctattagaaaaattccttcagtgggtgaaaaaacgtatcaaattctacgaaatttaggtgtagataaaattgcaattgtgcaaaaaatgcctatagaaatgatgattagtgccttgggagctaacggtcgtactatctggaatcgcgctaacggaatnncggataatcncgccaattattccttttcacgaacgaaaatctatttctacggggaacgcaaacactttacaaaaggatacaattga

SEQ ID NO: 26616 - protein, 145 aa, Unknown
  Obtained from environmental sample
  misc_feature (1)..(145): Xaa is any amino acid
MDKFYGCYKYASELRQQIIKESGLPISFGLSVNKIVSKVATGEAKPNNQLQIDSGFEKSFLAPLSIRKIPSVGEKTYQILRNLGVDKIAIVQKMPIEMMISALGANGRTIWNRANGXXDNXANYSFSRTKIYFYGERKHFTKGYN

SEQ ID NO: 26617 - DNA, 342 bp, Unknown
  Obtained from environmental sample
  misc_feature (1)..(342): n is a, c, g, or t
ttgggatgttnttgggggcttagctggtgtggtccttgcagacgcgaaaacccaaatgtagttagaatgtataatcaataccacgacaaaggtttagaaattgttggaatatctctagataaaaaaggacaagaagaccgttggttaaaagcaattgcacaagaccaattaacttggaaacacgtctctagtttagagggatggcaagaaccaatcgctgtagcatatggtgtaagatctattcctgcaacatacattttagatggtgatggaaaaattattgctaaaaacttacgcggaaaagctttagaagataagattgcagaaattttaactaactaa

SEQ ID NO: 26618 - protein, 113 aa, Unknown
  Obtained from environmental sample
  misc_feature (1)..(113): Xaa is any amino acid
MGCXWGLSWCGPCRRENPNVVRMYNQYHDKGLEIVGISLDKKGQEDRWLKAIAQDQLTWKHVSSLEGWQEPIAVAYGVRSIPATYILDGDGKIIAKNLRGKALEDKIAEILTN

SEQ ID NO: 26619 - DNA, 423 bp, Unknown
  Obtained from environmental sample
  misc_feature (1)..(423): n is a, c, g, or t
atggatcaagaatcggctcgagtatatggtaaaagatattatcgtaaggggagaacctatgaaatatttattaggaaagcatttaaatgtgaaaaagggaaaagacatggagcagatgaatcaataatgattaacttattgttgtgtgaacttaatggtaactgtttattatttgagctttttggtaactgtaaaagtcagagaataccttttgatagacaattttttaaagttaaaattggcatagaaaaggcattgattggaatgtcaaaaagaaaaaagtataaaaattcgcatgatcaattctcgagtttattaataaagctaaaggaagtaaatacagcagagggtttagttaaaattgttcatgccggtatgctcaaaatgattgagttagaaaatcaattaaagaacagtgcatag

SEQ ID NO: 26620 - protein, 140 aa, Unknown
  Obtained from environmental sample
  misc_feature (1)..(140): Xaa is any amino acid
MDQESARVYGKRYYRKGRTYEIFIRKAFKCEKGKRHGADESIMINLLLCELNGNCLLFELFGNCKSQRIPFDRQFFKVKIGIEKALIGMSKRKKYKNSHDQFSSLLIKLKEVNTAEGLVKIVHAGMLKMIELENQLKNSA

SEQ ID NO: 26621 - DNA, 675 bp, Unknown
  Obtained from environmental sample
  misc_feature (1)..(675): n is a, c, g, or t
ttgcctctatcactttcgatggagaaaaaaaaaaatagtagtcggttcataattccaccctcttattttaaaaagttaggtattactcctattccggtaaaacaaccagaagttacagcgcaagtcgctaaaccaactgtcgttgaaaaccgagtgcaaccccaaactgaaaaagcagtaataccaacacctaaaatcactttaaatagtggtaaaaaagcaacgtctggattatcactaaaaagtatccgtgctaaaaaagaacatcttattaagcaaatggatgttgttgtagatgaagagaatttgccacgagaggactttcacgaagacgatttttacgaattttggtatgcctacatcaaacaattagaaaaagatggtaaaatgaatttagcgtctattttatcgatagataaacctaaattagaagacaccacaatacatcttacatttcctaactctacaaacaaagttgaagtcgaacgccaacaatacgatttgatgcagtttttaagacaaaatcttaagaattttgatattagtttagagattacagttaatgaggttatggaaagtaaatttgcctatacgccagacgaaaaatacgaaaagctaaaggaaagaaaccctaatatagaattgcttagaaaaagctttgatttagatctatag

SEQ ID NO: 26622 - protein, 224 aa, Unknown
  Obtained from environmental sample
  misc_feature (1)..(224): Xaa is any amino acid
MPLSLSMEKKKNSSRFIIPPSYFKKLGITPIPVKQPEVTAQVAKPTVVENRVQPQTEKAVIPTPKITLNSGKKATSGLSLKSIRAKKEHLIKQMDVVVDEENLPREDFHEDDFYEFWYAYIKQLEKDGKMNLASILSIDKPKLEDTTIHLTFPNSTNKVEVERQQYDLMQFLRQNLKNFDISLEITVNEVMESKFAYTPDEKYEKLKERNPNIELLRKSFDLDL

SEQ ID NO: 26623 - DNA, 465 bp, Unknown
  Obtained from environmental sample
  misc_feature (1)..(465): n is a, c, g, or t
ttgattaagcttaaattgactatggcaaagaatttacattaccaaatggcattagaccaagctaagaaaagttatgatgaaggaggtatccctattggagccgtcttggttaaaaatgatatcatcattggtaaaggacataaccaaagagttcaacagttaaatccaattttacatggtgaaatggattgtttacaaaatgccggaagattgcagaaatattctgacactacgctgtacacaacgctcagcccatgtatgatgtgttctggtactatcatccaatttaaaataaagaaagtggtcattggcgaaaatcataacttcaaaggaaatatctcttttttaaaagaacatggtgtagaagtcgaagtattaaatgatgaagaaaccattagcttaatgacaaatttcattaataattatccgaaattgtggcatgaagacatttctgaaaccaattaa

SEQ ID NO: 26624 - protein, 154 aa, Unknown
  Obtained from environmental sample
  DOMAIN (8)...(105): Cytidine and deoxycytidylate deaminase zinc-binding region
  misc_feature (1)..(154): Xaa is any amino acid
MIKLKLTMAKNLHYQMALDQAKKSYDEGGIPIGAVLVKNDIIIGKGHNQRVQQLNPILHGEMDCLQNAGRLQKYSDTTLYTTLSPCMMCSGTIIQFKIKKVVIGENHNFKGNISFLKEHGVEVEVLNDEETISLMTNFINNYPKLWHEDISETN

SEQ ID NO: 26625 - DNA, 417 bp, Unknown
  Obtained from environmental sample
  misc_feature (1)..(417): n is a, c, g, or t
atgaaacgctcaaccttaagccttttcttagtaatcaccttgtcactatttcaaataggctgtatgcaacaagaaaaaaagcaagatccttataaagagggtgacatcgtcacttggaagattatagataagaaaggtaaatatgaatcagaaatgtctgatcaatacaatcttcaatgtgacattcgagacgatgttggattaggttgctttggtaactctactaacagtcaagtctctggcatagttttttcattttggaataatgagaaagtcaaagctatttcatacgagcctatttatggtggtatcaaagttgaatggtattttcatcgtagtaacttagagcattggcaagagattgatgctgccatttggcgactattagacacttggaatatatcgccaatagagtaa

SEQ ID NO: 26626 - protein, 138 aa, Unknown
  Obtained from environmental sample
  SIGNAL (1)...(20)
  misc_feature (1)..(138): Xaa is any amino acid
MKRSTLSLFLVITLSLFQIGCMQQEKKQDPYKEGDIVTWKIIDKKGKYESEMSDQYNLQCDIRDDVGLGCFGNSTNSQVSGIVFSFWNNEKVKAISYEPIYGGIKVEWYFHRSNLEHWQEIDAAIWRLLDTWNISPIE

SEQ ID NO: 26627 - DNA, 903 bp, Unknown
  Obtained from environmental sample
  misc_feature (1)..(903): n is a, c, g, or t
atgaacaaatacatcccactattaatgcttgtactttttgctaacctttctttttctcaagataaaaactatgacgaattatggagcgctgttgaatttgaagaatttcaaggtttaccaaaatcggctttaaaaatagtagaaacgattgaagccagagctacagccgataataacgaacctcaacttattaaagtcctactttttaaaagtaaatttgctttagttttagaggaagatgctcaattacaagtcgtaaatgcatttaaggacaacattaaaacaagtacagctcccactaaaaatgtattagaaaatgtcctcgctactctatattggcagtattttcaagcgcaccgctaccagttttacaatcgtaccaaaacatatgaaaaagtaaatgctgacgattttagaacttgggacttaactacgcttattgaagagattcaactgcattttgataattctttacagaacgaaaccctattaaaaaccactaggttaagggaatacaatcttcttttgaatcaagaaaaagattcgaaattatacagacctacgttgttcgactttttaagtcataatgctttagatttttataaagcttcagatgcgagtataacaaaaccagctgagaattttaaaattgacgattcaatttattttagtaatgctgaagtattttcaaagataaacatacaatctaccgattccctttcacctatattaaaagcattaaaaatctatcaaaaattaattgcttttcatttacaggaggttaagaaaacggctttaatcgacattaatattagcagattacattatgtanatacgcaagcaattgtgccgacaaagagaattacttataaaacgtttaaaaaaaaagggataaaatctnna

SEQ ID NO: 26628 - protein, 301 aa, Unknown
  Obtained from environmental sample
  SIGNAL (1)...(19)
  misc_feature (1)..(301): Xaa is any amino acid
MNKYIPLLMLVLFANLSFSQDKNYDELWSAVEFEEFQGLPKSALKIVETIEARATADNNEPQLIKVLLFKSKFALVLEEDAQLQVVNAFKDNIKTSTAPTKNVLENVLATLYWQYFQAHRYQFYNRTKTYEKVNADDFRTWDLTTLIEEIQLHFDNSLQNETLLKTTRLREYNLLLNQEKDSKLYRPTLFDFLSHNALDFYKASDASITKPAENFKIDDSIYFSNAEVFSKINIQSTDSLSPILKALKIYQKLIAFHLQEVKKTALIDINISRLHYVXTQAIVPTKRITYKTFKKKGIKSX

SEQ ID NO: 26629 - DNA, 504 bp, Unknown
  Obtained from environmental sample
  misc_feature (1)..(504): n is a, c, g, or t
ttggacaataatagcttagggaatttagcggcaattgaggaaaccgttttaattggatgtaaatttacttcgggtaatttccatattccgaaaataaaaaatacaacatttattaactgtgatttttataattgtcagtcagaaataacacattcaagagaagatctaaacatacacttcgtcagcagtaatgacaataatggatttattacaaaaattaaccctgaaactgttaatgatacggaaaaaaacgaggattatcttaataaatcagatatatatgttctagaaaagttttacccacgaggaagccaaactttctataaacatcgagctatcggtgcaatttgctcacaaaataaagcatttactcgccatgaaattctacaatcgattgaaaaattaaaaaagctatcatatttgtcagtacctgataaacgctcatttctagagataaatatagaactaatcggtgatattaaaacagtactagggaaagcttaa

SEQ ID NO: 26630 - protein, 167 aa, Unknown
  Obtained from environmental sample
  misc_feature (1)..(167): Xaa is any amino acid
MDNNSLGNLAAIEETVLIGCKFTSGNFHIPKIKNTTFINCDFYNCQSEITHSREDLNIHFVSSNDNNGFITKINPETVNDTEKNEDYLNKSDIYVLEKFYPRGSQTFYKHRAIGAICSQNKAFTRHEILQSIEKLKKLSYLSVPDKRSFLEINIELIGDIKTVLGKA

SEQ ID NO: 26631 - DNA, 879 bp, Unknown
  Obtained from environmental sample
  misc_feature (1)..(879): n is a, c, g, or t
ttgaaaagtgagattaaaaggaaaattaagtactggcttattttctttatggcaaccggttctatgtttgcacaaataccgggagacgagcacgaacacgctgaatcggctaaaagggaagtagattctattattaaaagcaacgccataagcgaagaacacgcggctaaatttggtcgcctggtaattcaagatgccggcggaagaatgaagccagccaacacctactcttcagaattacttcggaaattgagtaaatctgattcttacgaaggtttaagttcagaccaggttttggtatcacttacgcaaaacccaatgatctggtataatgtgccaattatttacgttgaaaaaaataatgatagcttgcataatcttcttggcgtagaacaaggggaaaaataccttacgctaagtagtttctttgacgatatggggaattacaaactttctcccttattagaagaagcctaccaggctgcggttccgaacaaatttcagaaagattttattaataccgataaaaaggtaaatttattatatcgggcgcttcaggggaagattttgagaatttttcctattccagaggacgaaaataataaatgggtttcttatcctgaattagaagatgaagaaggtgcttttaaaggaatggattcggtgtataccaagcaaatccttccactttatatgacttccctttctgatgctactgaaaccggagattatacaaaagcgaatcagtttctggaaagcattaaaggatttcagaaaaaattcggttcagaaatcttgccttcagaagataaaattaacgcagagatcgcgtataacaaatacgatattttcaggaatcttttctggatgtatatgtag

SEQ ID NO: 26632 - protein, 292 aa, Unknown
  Obtained from environmental sample
  misc_feature (1)..(292): Xaa is any amino acid
MKSEIKRKIKYWLIFFMATGSMFAQIPGDEHEHAESAKREVDSIIKSNAISEEHAAKFGRLVIQDAGGRMKPANTYSSELLRKLSKSDSYEGLSSDQVLVSLTQNPMIWYNVPIIYVEKNNDSLHNLLGVEQGEKYLTLSSFFDDMGNYKLSPLLEEAYQAAVPNKFQKDFINTDKKVNLLYRALQGKILRIFPIPEDENNKWVSYPELEDEEGAFKGMDSVYTKQILPLYMTSLSDATETGDYTKANQFLESIKGFQKKFGSEILPSEDKINAEIAYNKYDIFRNLFWMYM

SEQ ID NO: 26633 - DNA, 306 bp, Unknown
  Obtained from environmental sample
  misc_feature (1)..(306): n is a, c, g, or t
atgattataaatagacatcttttaaaagtaaaaataaagaaaaagcctattttaaaagacgttttaatagcacataaagctaatttgcaatcaaaatataatattactgatgcagatgcagactattttgtgtttacaggacagattagtaatcaagcatattcaagaaaaaaacaaaatataaatatcttacataaaaatggtaaagttgaggatatagttaaggcttcagaccaacttagcttaaaagcgttgtcaaaaccagtgactaaatattatatatgctatccaaaagaccaactttag

SEQ ID NO: 26634 - protein, 101 aa, Unknown
  Obtained from environmental sample
  misc_feature (1)..(101): Xaa is any amino acid
MIINRHLLKVKIKKKPILKDVLIAHKANLQSKYNITDADADYFVFTGQISNQAYSRKKQNINILHKNGKVEDIVKASDQLSLKALSKPVTKYYICYPKDQL

SEQ ID NO: 26635 - DNA, 438 bp, Unknown
  Obtained from environmental sample
  misc_feature (1)..(438): n is a, c, g, or t
ttgttgacaatgaaatttaccgcagaacaaatagcaggtattttagatggtgtcgtagaaggcaatcctcaagtagaggtatctaaattatctaaaatagaagaaggtgtagaaggcgctttgacctttttggcaaatccaaaatacacacattatatatatactacaaaagcatcaattgctattgtagcaaaagactttgtacctgagcaaaacgttagttgtactttaattaaggtggatgacgcgtataagtcattttcaaaattattagagtattacaatcaagtaaagctaaataagttggggattgaacaaacaanctccatatctgatacagctaaagttggaaaggatatttacattggtgcatttacagtagtaggtgacaacgtaaaaattggagataatgtacagattttcctaatggtcatatag

SEQ ID NO: 26636 - protein, 145 aa, Unknown
  Obtained from environmental sample
  DOMAIN (6)...(106): UDP-3-O-[3-hydroxymyristoyl] glucosamine N-acyltransferase, LpxD
  misc_feature (1)..(145): Xaa is any amino acid
MLTMKFTAEQIAGILDGVVEGNPQVEVSKLSKIEEGVEGALTFLANPKYTHYIYTTKASIAIVAKDFVPEQNVSCTLIKVDDAYKSFSKLLEYYNQVKLNKLGIEQTXSISDTAKVGKDIYIGAFTVVGDNVKIGDNVQIFLMVI

SEQ ID NO: 26637 - DNA, 543 bp, Unknown
  Obtained from environmental sample
  misc_feature (1)..(543): n is a, c, g, or t
atggatttacaaaatttaaaagcaagctggaacaacataaattattctcccaaaaatgagatggaattggaaaaaatgacagctgtgaaaaatcatcctgttttaaaaagaattaaaaccaagcttgtagtggaaactttggcaataagtcttttttggatgttatattatagtggatttgatggggctgaaaaaccgatatttgccaatgttcttcttatattcggagctattgcatatattttaaatggagtgttaagctttcaggccattcaaaaacctattcaaggagatagtttgaacaattcaattaaaaattactttaacaagatcaaaaccatttcaaaaatatcattgggtatttcaatattctatagtagttgtttactgttgttttttgggagtaccattagtttcaatagtgaaaaaaagtggattttactttttggaataattgtgttaatacaagcatttttttggtcatcaagaatctggagatcttggctgaagaaattagcaatacaaatcaagcatttagaatag

SEQ ID NO: 26638 - protein, 180 aa, Unknown
  Obtained from environmental sample
  misc_feature (1)..(180): Xaa is any amino acid
MDLQNLKASWNNINYSPKNEMELEKMTAVKNHPVLKRIKTKLVVETLAISLFWMLYYSGFDGAEKPIFANVLLIFGAIAYILNGVLSFQAIQKPIQGDSLNNSIKNYFNKIKTISKISLGISIFYSSCLLLFFGSTISFNSEKKWILLFGIIVLIQAFFWSSRIWRSWLKKLAIQIKHLE

SEQ ID NO: 26639 - DNA, 666 bp, Unknown
  Obtained from environmental sample
  misc_feature (1)..(666): n is a, c, g, or t
ttgaaaatggaggcttttgatgcggtagttgctcaatatagaggtaggttgtcaataaataatccaagaaactcagctataattaacctaagtatggttgatcataacaccaaaaaaatagaagattatttaaacgaaacggttagagtcgtctctaaggagcagttagctagaaaaaatttatttgttaccaatacaattaaatttattgatagtcaattaagtcgtgtcaaagattctttaacaggaaatgctgatgcattaaataattatagatctaaaaatggaatttataacttagaccaagaaagcgaattattatcttcaaaattatccgatttagagttgcaacgtgatgacgttaaccgtaaaaaggcatattataccagcttaaaaaagtatcttctaactagtaataattttacaaatttaccagctccttctgtcgcaggtattgatgatggtaatatattggctaacattagtaaaataaacacactatctattcaaaaagccaaatctgaatcaacagttaaaccaggagcctctatctttgatgatttaaacagccaaattgaaagtatcaagttggtattgttggaacctattagttctgcatctgtaggcattgagagagagttaggtattatccctgctcacccttag

SEQ ID NO: 26640 - protein, 221 aa, Unknown
  Obtained from environmental sample
  misc_feature (1)..(221): Xaa is any amino acid
MKMEAFDAVVAQYRGRLSINNPRNSAIINLSMVDHNTKKIEDYLNETVRVVSKEQLARKNLFVTNTIKFIDSQLSRVKDSLTGNADALNNYRSKNGIYNLDQESELLSSKLSDLELQRDDVNRKKAYYTSLKKYLLTSNNFTNLPAPSVAGIDDGNILANISKINTLSIQKAKSESTVKPGASIFDDLNSQIESIKLVLLEPISSASVGIERELGIIPAHP

SEQ ID NO: 26641 - DNA, 651 bp, Unknown
  Obtained from environmental sample
  misc_feature (1)..(651): n is a, c, g, or t
atgagtttaaaaccncaatttgctaccattaatttagcaatgatttctattaagaatccaaaaattattaatgatacagaaaaagtaattcgttatgtaaatatgattcgtgacgaaaataaaagaatgcacaagcaagtagaaaatgttttgcgtatttctaaattagaaaaaaatcaactagatattagtacagaaattatagatattcatgaagtaattgaagatgctattaatcatgttagccttttagttgatgataaaaatggaactgttgagacacattttcaggcattaacatcagaaataaatggaaatgaatttcacttaaccaatgttttggttaatattttagaaaatggaattaaatacactcaaggagcaccaaaaattgatgtgtatacagaaagtgccaataaattttttattatcaaaataaaagatgaaggaataggaatgagtaaaagtgttcagaaacaagtcttcgataagttttacagagagcaaaaaggaaacgtacatgacgtaaaagggcatggtttaggtttagcttatgtaaaagaaattgtagaaaaacatcatggaacagtttttgttgaaagtgtaaaaggagaaggaagcatatttacagtaaaattacctttaatttaa

SEQ ID NO: 26642 - protein, 216 aa, Unknown
  Obtained from environmental sample
  DOMAIN (105)...(216): Histidine kinase-, DNA gyrase B-, and HSP90-like ATPase
  misc_feature (1)..(216): Xaa is any amino acid
MSLKPQFATINLAMISIKNPKIINDTEKVIRYVNMIRDENKRMHKQVENVLRISKLEKNQLDISTEIIDIHEVIEDAINHVSLLVDDKNGTVETHFQALTSEINGNEFHLTNVLVNILENGIKYTQGAPKIDVYTESANKFFIIKIKDEGIGMSKSVQKQVFDKFYREQKGNVHDVKGHGLGLAYVKEIVEKHHGTVFVESVKGEGSIFTVKLPLI

SEQ ID NO: 26643 - DNA, 354 bp, Unknown
  Obtained from environmental sample
  misc_feature (1)..(354): n is a, c, g, or t
ttgttaacgccagaaattacaattgatgcagaaattgaactttctgaaattacacctaaattttttagaatcattcagcaaatggcaccttttggtccaatgaatatgaaaccaacttttacatctacttgtgttagagataatggttatggaaaaaaagttggcaaagaacaaacgcatttaaagttaaacgtttttcaaggtgataataaaaaaacctataatgccattggttttaatttgggtgataaaatggaatttgtagaaaacgattttgatattgcctattctttagatgaaaatgaatggaatggttttaaatcgattcagttgcttttgaaagatttgaaataa

SEQ ID NO: 26644 - protein, 117 aa, Unknown
  Obtained from environmental sample
  misc_feature (1)..(117): Xaa is any amino acid
MLTPEITIDAEIELSEITPKFFRIIQQMAPFGPMNMKPTFTSTCVRDNGYGKKVGKEQTHLKLNVFQGDNKKTYNAIGFNLGDKMEFVENDFDIAYSLDENEWNGFKSIQLLLKDLK

SEQ ID NO: 26645 - DNA, 555 bp, Unknown
  Obtained from environmental sample
  misc_feature (1)..(555): n is a, c, g, or t
ttgcttgttttggcatctatcgtcataaaatctgatggaaaggttgataaacgagaattggagtttgtgcgttctcaatttttatccatgtatggtaaagagcgtgcaaataatgcttttaaactgtttaaaggaatggttaaaaaagatatttctgcacgtcaagtttgtatccagattagagaacacatgtctcacgcttcacgtttacaattattgcattttttgtttggcattgctaaagcagatgaatttgtaagtgaaaaagaaattgatgaaattcaaaagattgctggttatttatatatcaattcttatgattttgagtcgataaaagccatgttttacaattcatcagaaaacgcttataaaattttagagattgataaaactgccacaaatgatgaagtaaaaacttcctacagaaaaatggtgaagaaatatcacccagataaattacaagatttgggcgaagaacatttgcaaggtgcaaaagaaaagtttcaaagcatacaagatgcttatgaaaaaataaaaaatgaaagaggtttgtaa

SEQ ID NO: 26646 - protein, 184 aa, Unknown
  Obtained from environmental sample
  DOMAIN (121)...(184): DnaJ domain
  misc_feature (1)..(184): Xaa is any amino acid
MLVLASIVIKSDGKVDKRELEFVRSQFLSMYGKERANNAFKLFKGMVKKDISARQVCIQIREHMSHASRLQLLHFLFGIAKADEFVSEKEIDEIQKIAGYLYINSYDFESIKAMFYNSSENAYKILEIDKTATNDEVKTSYRKMVKKYHPDKLQDLGEEHLQGAKEKFQSIQDAYEKIKNERGL

SEQ ID NO: 26647 - DNA, 498 bp, Unknown
  Obtained from environmental sample
  misc_feature (1)..(498): n is a, c, g, or t
atgaaaatgatatataagtttttattttttagtgccctaatactttttacctcttgcagtaatatttctaaacaagatcagattaatagaaatttaattgataataaaaatatctcattattaaacattgatgaagaaaataaaataatcatcagaaaagattattatggtacttattcttttagtagctggaatgcttataatgtagctaatatacaagttcatcaagttgaaaatttagaatttaatagctctgtagatcgtatagagaatctacaaaaaaacatttctacattatcttcaacaattcctgattggttagaaactaatgaagttttaaaggaaatagaagatgtaaaagaagagtatgcaaccttacttaatgagaaagataaatctaccaaagatataagagaaaattgggaagagttaagtaacgaatttgatgatttacgtgcagaattaagtgaaactgtaaaagattacagaactgagtag

SEQ ID NO: 26648 - protein, 165 aa, Unknown
  Obtained from environmental sample
  misc_feature (1)..(165): Xaa is any amino acid
MKMIYKFLFFSALILFTSCSNISKQDQINRNLIDNKNISLLNIDEENKIIIRKDYYGTYSFSSWNAYNVANIQVHQVENLEFNSSVDRIENLQKNISTLSSTIPDWLETNEVLKEIEDVKEEYATLLNEKDKSTKDIRENWEELSNEFDDLRAELSETVKDYRTE

SEQ ID NO: 26649 - DNA, 867 bp, Unknown
  Obtained from environmental sample
  misc_feature (1)..(867): n is a, c, g, or t
atggaacactccattacagaagctaaaactgccaaatcagtaataagaaaagggtataaatctacgccattaaaaagggtattcatccccaagaagaatggaaagaaacgccttcttggtattcccacgatgtatgatagagctatgcaggcactgtatctgatggctctcaatcctgtttccgagactaaggcggatagctgttcatacggctttcgtcataaaagaagttgtgctgatgccattgcaaggtgttttattcacctagctagaaatagcagtgcaacttgggtattggaagcagacattaaaggatgctttgaccatattagccatagttggatgttagataacattcttatggataaaatgattcttaaacagtggcttaatgctggtttcattgataacaaacggttatttcctaccaaagaaggaactccacaaggtggtattatctctcctacccttgccaatatgacgcttgacggacttcaggccactatcaacaaggctttgaaaatcaagtcagataaaggtggtaggctaagcaataacaagcacaaaattcatttggtaaggtatgccgatgattttattgttactggagatagcaaagaagtactcactgataaagttctgccagttattgaaaaattcttgacagaaagaggacttcaactatcagaggagaaaacaggtattacccatatttataatgggttagacttcttaggacagcatattaggaaatacactaatagtactttactgataaaaccatcgaaagatagctgtaaatcagtaaaaactaaaattaagttagttgtcaataaaaacagctcgagccgattcttgatcccctag

SEQ ID NO: 26650 - protein, 288 aa, Unknown
  Obtained from environmental sample
  DOMAIN (20)...(249): Reverse transcriptase (RNA-dependent DNA polymerase)
  misc_feature (1)..(288): Xaa is any amino acid
MEHSITEAKTAKSVIRKGYKSTPLKRVFIPKKNGKKRLLGIPTMYDRAMQALYLMALNPVSETKADSCSYGFRHKRSCADAIARCFIHLARNSSATWVLEADIKGCFDHISHSWMLDNILMDKMILKQWLNAGFIDNKRLFPTKEGTPQGGIISPTLANMTLDGLQATINKALKIKSDKGGRLSNNKHKIHLVRYADDFIVTGDSKEVLTDKVLPVIEKFLTERGLQLSEEKTGITHIYNGLDFLGQHIRKYTNSTLLIKPSKDSCKSVKTKIKLVVNKNSSSRFLIP

SEQ ID NO: 26651 - DNA, 309 bp, Unknown; identical to SEQ ID NO: 21677
  Obtained from environmental sample
  misc_feature (1)..(309): n is a, c, g, or t

SEQ ID NO: 26652 - protein, 102 aa, Unknown; identical to SEQ ID NO: 21678
  Obtained from environmental sample
  misc_feature (1)..(102): Xaa is any amino acid

SEQ ID NO: 26653 - DNA, 312 bp, Unknown
  Obtained from environmental sample
  misc_feature (1)..(312): n is a, c, g, or t
ttggacgagtttccgcaattttataatgtattaaaaggtgacatgagtgttgttggaccaagaccacacatgctatcttatacagatgattattcaaaaaaaattgataagtacaattttatatttagacacaacgttaagcctggagttactggattagcccaagttaaaggttatagaggtgaaattaaaaatgacgaagacataattaaccgtattaaatacgataatttttatatcgaaaattggtcactagtattagacattagaatcatatttcaaaccatgataaacgtttttaaaggtcaaana

SEQ ID NO: 26654 - protein, 104 aa, Unknown
  Obtained from environmental sample
  DOMAIN (1)...(103): Bacterial sugar transferase
  misc_feature (1)..(104): Xaa is any amino acid
MDEFPQFYNVLKGDMSVVGPRPHMLSYTDDYSKKIDKYNFIFRHNVKPGVTGLAQVKGYRGEIKNDEDIINRIKYDNFYIENWSLVLDIRIIFQTMINVFKGQX

SEQ ID NO: 26655 - DNA, 672 bp, Unknown
  Obtained from environmental sample
  misc_feature (1)..(672): n is a, c, g, or t
atgtttgaaatagaaaatatagataagattttaaatgaatcgcctagcttagagcttttacagactaagcatagaagtttaactattccgtttttggttcacgcttttaaaaaaagtgagacatctcattctcaaaaagtatttgaaagcattctggtagattatctgcaacatataaattacacagaggagtctgaagatttattaattaatacggagtcacttgaaataaaagcaaaaagaaagataaaagaatggagaggagctggtttccttaaccaatatattattgatgatggtacaatactctacgatttatcacaatatagtctcagagcattagattggattgcagatcaaaaaagaaccgaatttgtaggaacagattcaaaatttaaaagtgtttatgaaaaaataaaggatattctcgaatacactgatgataacttgataaagcgtaagcaaatattagaagaaagaaagttaacaatacaacatcaaatagaccagttagaagctggagaaactgtaatattgtatgatgaaagagaaatcatagaacattttcaagacttgctcagaacagcaaaagatcttctaatagattttaatgaagtagaagaaaattttattggaatatctaaagatgtgtattctaaatactcaagttaa

SEQ ID NO: 26656 - protein, 223 aa, Unknown
  Obtained from environmental sample
  misc_feature (1)..(223): Xaa is any amino acid
MFEIENIDKILNESPSLELLQTKHRSLTIPFLVHAFKKSETSHSQKVFESILVDYLQHINYTEESEDLLINTESLEIKAKRKIKEWRGAGFLNQYIIDDGTILYDLSQYSLRALDWIADQKRTEFVGTDSKFKSVYEKIKDILEYTDDNLIKRKQILEERKLTIQHQIDQLEAGETVILYDEREIIEHFQDLLRTAKDLLIDFNEVEENFIGISKDVYSKYSS

SEQ ID NO: 26657 - DNA, 570 bp, Unknown
  Obtained from environmental sample
  misc_feature (1)..(570): n is a, c, g, or t
atgacagctctggctttgttgggcttcatcatatggcacggatacttacagggattacactttcacgaaagtcaacctttacgacacgacccttattataaagaaacaaagaaaccatatacggtaacacccttacgtttaaaagaatatttgaacaggtggtatttaattgcggttccagaaggagaaaataaaatacgaaattttggtattgatagaatttccgatttaaaattaacagattacccaagtgacgcttcaaaggattttgaaacgcaaataaaactctatgaagatatcgtaggtctaaattataatgagtctgaaaaagttgaaagagtaattttgaaagccgataacaaacaattgaagtacttaagaagtttaccgcttcacaaatcacaagtatgtgtagatggattagatggacaatggggaaaagctattttccacattaagccaaactacgagtttgaaacacaaattttaaaactggnaggaatggtagcggttgaagagcctaaatggttgcgagaaacactgacacaggcacatagtaaatataaataa

SEQ ID NO: 26658 - protein, 189 aa, Unknown
  Obtained from environmental sample
  misc_feature (1)..(189): Xaa is any amino acid
MTALALLGFIIWHGYLQGLHFHESQPLRHDPYYKETKKPYTVTPLRLKEYLNRWYLIAVPEGENKIRNFGIDRISDLKLTDYPSDASKDFETQIKLYEDIVGLNYNESEKVERVILKADNKQLKYLRSLPLHKSQVCVDGLDGQWGKAIFHIKPNYEFETQILKLXGMVAVEEPKWLRETLTQAHSKYK

SEQ ID NO: 26659 - DNA, 444 bp, Unknown
  Obtained from environmental sample
  misc_feature (1)..(444): n is a, c, g, or t
atgacgacattaaaaattggcgatgtagcaccagactttagttgtaatgaccaaagcggaaatataattaaattgtcagattataaaggcaaaaaattggtattgttcttttatccaaaggcaagtaccccaggttgtataatggaagggtgtaatttaagagataattaccatacttttttagcaaaaggatatgatgtattaggtgcgagtgcagattctcaaaagagacagcagaattttattaataaatatgattttccttttccattattagcagatgaaaataaagaggtgttaaatgcttatcaagtttggggaccaaagaaatttatgggacgtacttttgatggtatacaccgtacaacattcgtaatagatgaaaatggagtgattgaggatgtgattttaaaggtaaaaactaaagcacatacaggtcaaatt

SEQ ID NO: 26660 - protein, 148 aa, Unknown
  Obtained from environmental sample
  DOMAIN (6)...(147): AhpC/TSA family
  misc_feature (1)..(148): Xaa is any amino acid
MTTLKIGDVAPDFSCNDQSGNIIKLSDYKGKKLVLFFYPKASTPGCIMEGCNLRDNYHTFLAKGYDVLGASADSQKRQQNFINKYDFPFPLLADENKEVLNAYQVWGPKKFMGRTFDGIHRTTFVIDENGVIEDVILKVKTKAHTGQI

SEQ ID NO: 26661 - DNA, 549 bp, Unknown
  Obtained from environmental sample
  misc_feature (1)..(549): n is a, c, g, or t
atgtctaagaaaaatatattggttattggtcgagctaacagtggtaaaacacacttttttggacaactttatggtcgtcttaaagagcctcgaagctcactaaatatcaatggaacaccagcaaatttagaaatgcttggtgaggtttttgaagcactaagcgaaggtaaagcttctgctcatactgtggctgagacttggaatagcctaaaaataccattaatagatgaaaatggtaaagagtttgatataaattggcctgaatacgcaggtgagcaatgggatactattttctctacacgctcgttagatgagaaatggaaaagccaattagatgatagtgataaatggcttatcgtgattagggtggaaagcgaacctacattcccagatttccttgaaaaattggccaataatgaaaaaccagaaaagaagcatgaatcacctaattccacaaattgggacgcaaatccttactgggtagaaaagttacagatactattacaattatcaaaaacgcaaatagctaacaaagttcaaagcccctaa

SEQ ID NO: 26662 - protein, 182 aa, Unknown
  Obtained from environmental sample
  misc_feature (1)..(182): Xaa is any amino acid
MSKKNILVIGRANSGKTHFFGQLYGRLKEPRSSLNINGTPANLEMLGEVFEALSEGKASAHTVAETWNSLKIPLIDENGKEFDINWPEYAGEQWDTIFSTRSLDEKWKSQLDDSDKWLIVIRVESEPTFPDFLEKLANNEKPEKKHESPNSTNWDANPYWVEKLQILLQLSKTQIANKVQSP

SEQ ID NO: 26663 - DNA, 810 bp, Unknown
  Obtained from environmental sample
  misc_feature (1)..(810): n is a, c, g, or t
atgaagaacaccactatacatcaatgtgaacgacagacataccgtaagcaaaggcaattgatgacagtttactacagcttgtatgggcaattattagatattaataacctgtacaagggattcaaaaaagtgaaagcagcgaaaggagcggccggaatagataggcagtccatagccgcgttcgccttgaatttagaagaaaacttgaaacaactgcaaggtgaactgcaaagcaagcagtatcgcgcacagccagtcaaacggatagaaataccgaaagatgatggtggtgtgagactgctgggaattccaacagttcgcgaccgcatagtacaacaaacactattgaacattctccaaccgctcttcgacatcgactttcacccatcaagttatgggtacaggccgaaacgaagttgtcatgacgccatcagcaaagccacggtatttattcgtaaatatcaccgtgagtgggtggttgatatggatctgtcgaagtgttttgacctactcgatcacgacttgatcataagcagcgtcaaacgcaaagtgacagacggtagcatcttaaaactgctcaaacagtttttaaaaagcggagtaatgataggcaataattgggaagcgagtgagctaggaagtccacaaggtggtgttatcagtccattgttggcgaatatctacctagatgcatttgctcaagaaatgaaaaagcgaaatcacagaatagtgaggtacgccgacgacatattgatcttatgctgcacagaaaaagcagccaagaatcactcacctcgagccgattcttga

SEQ ID NO: 26664 - protein, 269 aa, Unknown
  Obtained from environmental sample
  DOMAIN (82)...(267): Reverse transcriptase (RNA-dependent DNA polymerase)
  misc_feature (1)..(269): Xaa is any amino acid
MKNTTIHQCERQTYRKQRQLMTVYYSLYGQLLDINNLYKGFKKVKAAKGAAGIDRQSIAAFALNLEENLKQLQGELQSKQYRAQPVKRIEIPKDDGGVRLLGIPTVRDRIVQQTLLNILQPLFDIDFHPSSYGYRPKRSCHDAISKATVFIRKYHREWVVDMDLSKCFDLLDHDLIISSVKRKVTDGSILKLLKQFLKSGVMIGNNWEASELGSPQGGVISPLLANIYLDAFAQEMKKRNHRIVRYADDILILCCTEKAAKNHSPRADS

SEQ ID NO: 26665 - DNA, 567 bp, Unknown
  Obtained from environmental sample
  misc_feature (1)..(567): n is a, c, g, or t
gtgtttaaaaacggaaagcctagtaaaaaagattatcgtcactttaatatcaaaacagtagaaggtcctgatgattttgcctcaatggaagaagtggtatttagacgctacaaacgtttgttagaagaaaaacaacctttaccacaattgataattattgatggaggaaaagggcaattatcttcagctttaaaaagtttagatgctttagggttaagaggaaaaatagccattataggaattgcaaaacgattagaagaattattctatccagacgatccaattcccttatatttagataaaaaatcagaaacactaaaaataatacaacaattacgtaatgaagcccatcgctttgggatagagcatcatcgtaacaaacgaagcaaacaagcattaaatacagaaatggaaaccattcctggtattggagaaaaaacaattatagaattattaaaagtatttaagtccgcaaagcgaatttcaaatgctaaaattgacgagctagaagaggttgtcggaaattctagagcaacaaaaatttataattattaccataaagaatga

SEQ ID NO: 26666 - protein, 188 aa, Unknown
  Obtained from environmental sample
  misc_feature (1)..(188): Xaa is any amino acid
MFKNGKPSKKDYRHFNIKTVEGPDDFASMEEVVFRRYKRLLEEKQPLPQLIIIDGGKGQLSSALKSLDALGLRGKIAIIGIAKRLEELFYPDDPIPLYLDKKSETLKIIQQLRNEAHRFGIEHHRNKRSKQALNTEMETIPGIGEKTIIELLKVFKSAKRISNAKIDELEEVVGNSRATKIYNYYHKE

SEQ ID NO: 26667 - DNA, 402 bp, Unknown
  Obtained from environmental sample
  misc_feature (1)..(402): n is a, c, g, or t
atgaaaaacatacaaacagtaggacatgcaaaatttgggaaagatgataataatattataaatcttaaatttaatagtattgaggactattacatttttgatttaactgcagcaaaaaaatatgtaagcgtaataatggacttgtgtaacggtagaccaatgtcttttataatagacttaagagggtttcatggtacattctctacagaggctgcaaactttatagctaaatctagtgacttaattaaattaagaatatctgaagcatttatattaaattcaataggaaccaaattattaatagcgtcttataaaagaatatacgatcccttaacaccacatataacgtgcaatgatattgagacagcaaagcaatattctattgaaaatattgaattatan

SEQ ID NO: 26668 - protein, 134 aa, Unknown
  Obtained from environmental sample
  misc_feature (1)..(134): Xaa is any amino acid
MKNIQTVGHAKFGKDDNNIINLKFNSIEDYYIFDLTAAKKYVSVIMDLCNGRPMSFIIDLRGFHGTFSTEAANFIAKSSDLIKLRISEAFILNSIGTKLLIASYKRIYDPLTPHITCNDIETAKQYSIENIELX

SEQ ID NO: 26669 - DNA, 345 bp, Unknown
  Obtained from environmental sample
  misc_feature (1)..(345): n is a, c, g, or t
ttggtaaatatggctaaaaatgttactgaagcattcgatttcatggaagacacctcagcattttctcattacgacatgcgatttgtaaaaccattggatgtagacctgcttcataaaatatttaaaacacatacgactattgttactattgaagatgcttcagttataggtggatttggtagtgcaatagctgaattttcagcaaaacataattataaaaatatgctaatcctaaaagggattccggatcagtttattgaacacggaaccgttttacaattgcaacaatctattcagcttgactctaaaagtctaagtgaattactaaaaaaaatggcagactaa

SEQ ID NO: 26670 - protein, 114 aa, Unknown
  Obtained from environmental sample
  DOMAIN (1)...(105): Transketolase, C-terminal domain
  misc_feature (1)..(114): Xaa is any amino acid
MVNMAKNVTEAFDFMEDTSAFSHYDMRFVKPLDVDLLHKIFKTHTTIVTIEDASVIGGFGSAIAEFSAKHNYKNMLILKGIPDQFIEHGTVLQLQQSIQLDSKSLSELLKKMAD

SEQ ID NO: 26671 - DNA, 735 bp, Unknown
  Obtained from environmental sample
  misc_feature (1)..(735): n is a, c, g, or t
ttggccagcatttctaaatggaatttacagtatataaaagaagttgctggagataaaaccgtaccgctttacgacgatagacctgtagactataaagatggttttaacgaaccacacgcgatgatgaaaatgagcgattatatcgatttattaaagcgggaacctacaaaatttaggatttttttatggaatattcttaaagaagtccctgttttacaaaaggatttttcttttcctgattttggaatccgtttaatgaagggattaccaatgctctttttcggcggaaaaaactcgtacacatttatgcattacgatattgatttggctaatatttttcattttcattttgaaggtaaaaaagaaattattcttttcgatcagacgcaaaacaagtttttatataaaattccgcattcgttaatcacaagagaagatattgatttctctaatccagatttagacaaatggccagatttaaaaaaagcgaaaggatgggaatgtgaattaaaccacggagaagtactctatatgcccgaaggatattggcattatatgcgttatattactcctggtttttcaatgagtttaagagccattgcacgacaccctaaaaatttaggaaaagcaatatataatataattgtaatgcgtaattttgacactctaatgagacgtttaaaaggtccgaaatggattgattgcaaaaacgaaaaagcattaactaaaacataa

SEQ ID NO: 26672 - protein, 244 aa, Unknown
  Obtained from environmental sample
  misc_feature (1)..(244): Xaa is any amino acid
MASISKWNLQYIKEVAGDKTVPLYDDRPVDYKDGFNEPHAMMKMSDYIDLLKREPTKFRIFLWNILKEVPVLQKDFSFPDFGIRLMKGLPMLFFGGKNSYTFMHYDIDLANIFHFHFEGKKEIILFDQTQNKFLYKIPHSLITREDIDFSNPDLDKWPDLKKAKGWECELNHGEVLYMPEGYWHYMRYITPGFSMSLRAIARHPKNLGKAIYNIIVMRNFDTLMRRLKGPKWIDCKNEKALTKT

SEQ ID NO: 26673 - DNA, 843 bp, Unknown
  Obtained from environmental sample
  misc_feature (1)..(843): n is a, c, g, or t
atggcatttattgatagtgaagaagaaacaaatactattcaagaaacaaattattcgcaaattagatcttggattgttaatttagttcaaaaaggaattaccaacagaagtataaatagaaagatctctgcattaaatggcttctttaaattcctacttaaaattgaagaagtaaagctaaatccactttcaaaacataaggcattaaaaacaagtaaaaaagttcaaatccccttttcagaaaatgaaattaatacagttctagatcaaattaaccacaatcaagattttgaaggtgttagaaataaattaataatagaattattttactctacaggaattagacgtatagagttgataaacattaaattaaaagatattgatttagaaaataagacaattaaaattttaggtaaaagaaataaagaacgtattattcctttgttaaacatggtaatggatagtgtagatatttataagttagaaagaaataaattagaaactattacagataatgagtatttgtttttaacaaaaaaaggagttaaagtatatgaaactcttgtctacagaattataaatgattactttagtaaagcttcaactaaggtgaagaaaagtccacatattctaagacattctttcgctacgcatttattacatcaaggtgcagagctaaacgcagtccaagagctattagggcattctagtctagcagctactcaagtttatacgcacaatagtatagctgagttaaaaaaagtatacgcaaaagcaaacctagaagtaaacataattgttaaccacaaaatttacgttgaaggtaaccgcggcgtaacttaa

SEQ ID NO: 26674 - protein, 280 aa, Unknown
  Obtained from environmental sample
  DOMAIN (79)...(254): Phage integrase family
  misc_feature (1)..(280): Xaa is any amino acid
MAFIDSEEETNTIQETNYSQIRSWIVNLVQKGITNRSINRKISALNGFFKFLLKIEEVKLNPLSKHKALKTSKKVQIPFSENEINTVLDQINHNQDFEGVRNKLIIELFYSTGIRRIELINIKLKDIDLENKTIKILGKRNKERIIPLLNMVMDSVDIYKLERNKLETITDNEYLFLTKKGVKVYETLVYRIINDYFSKASTKVKKSPHILRHSFATHLLHQGAELNAVQELLGHSSLAATQVYTHNSIAELKKVYAKANLEVNIIVNHKIYVEGNRGVT

SEQ ID NO: 26675 - DNA, 639 bp, Unknown
  Obtained from environmental sample
  misc_feature (1)..(639): n is a, c, g, or t
atgaaaaaactattaatatgtatgtctgcattagctattgtagcttgcaaagatgatgtagcaaaaaaagaggaaacaccaaaggattatgtaacgctttcaggaaagataacagataaaagtagtgattctcttgtagtaagaaatcgtgctttttcgaaaactataaaagtaaataaagacggaacgttttctgatactttaaaagttgaaacaggtttgtattctatttatgatggtaacgaacaaacggtagcatacttaaaaaatggttacgatttaaacttaatattagacacaaaaatgtttgatgaaacagtaaaattttcaggaaatggtgctgaacacagtaattttttagctgaaaaatcaatattagaagagcgtcttttagatattgataaattagcagaattggattctgtaggcttagaaacaaaaatgaatgagatcgaaaaagaacttgttactttttatggttctaaccaagctatcgatacgtcgcttactaacagcgctactaatgatgtaaagccgatgcttaatttttacaaaggttacgttggagaaaaaattgcattaaaaagagatttacntaaaggagctccatctccaacatttataattacgagattttaa

SEQ ID NO: 26676 - protein, 212 aa, Unknown
  Obtained from environmental sample
  SIGNAL (1)...(17)
  misc_feature (1)..(212): Xaa is any amino acid
MKKLLICMSALAIVACKDDVAKKEETPKDYVTLSGKITDKSSDSLVVRNRAFSKTIKVNKDGTFSDTLKVETGLYSIYDGNEQTVAYLKNGYDLNLILDTKMFDETVKFSGNGAEHSNFLAEKSILEERLLDIDKLAELDSVGLETKMNEIEKELVTFYGSNQAIDTSLTNSATNDVKPMLNFYKGYVGEKIALKRDLXKGAPSPTFIITRF

SEQ ID NO: 26677 - DNA, 456 bp, Unknown
  Obtained from environmental sample
  misc_feature (1)..(456): n is a, c, g, or t
atgagtaaaaaagcattcatattcgatttagatggtgttattgtagatactgcaaaatatcattacaaagcgtggagaaaattggcaaatgatttaggatttgattttaccgaaactcaaaacgaattacttaaaggagtgagtagagtacgatctttagaaatattattggagattggaaatgtaaatcttccaaatgatgaaaaggtgaaaataatgcaagataagaatgagcattatttgcaatacatcaccaaaatggggcaagaagaaatattagaaggcatgcatggggtattaatttatctcaaagaaaataacattcctttttccttagggtcagcaagtaaaaatgcgagattgattttaacgcaattagatttaatcgatttatttgatgccattgttgatggcaatgatgtgtcaaaagcaaaaccagaacgtgaagtgttttga

SEQ ID NO: 26678 - protein, 151 aa, Unknown
  Obtained from environmental sample
  misc_feature (1)..(151): Xaa is any amino acid
MSKKAFIFDLDGVIVDTAKYHYKAWRKLANDLGFDFTETQNELLKGVSRVRSLEILLEIGNVNLPNDEKVKIMQDKNEHYLQYITKMGQEEILEGMHGVLIYLKENNIPFSLGSASKNARLILTQLDLIDLFDAIVDGNDVSKAKPEREVF

SEQ ID NO: 26679 - DNA, 423 bp, Unknown
  Obtained from environmental sample
  misc_feature (1)..(423): n is a, c, g, or t
ttgcgtagagttaatattaagcttaaaaataaaatggcagaacagatttttgcttcaaatgattatgtctcaatattaatcgcattggatttgaaaagtagaggtcaaataaatgcatcagttagcacagatgtacttttgactgaattaacggaagagtctttgatgaatgaaaattggttatttacctacgaatctattaagaaaggttggcttgcacccactgacaaccctgttgacaataacaagtattttgaaatacttttggccaatgggatatatttttacaaagaagacgctaaagtaaaaacgtttactgtaaagaaagcaactgaagaaataaatgaaactaccaaaaaaccagaaaccgaggaggcaaaaacaattatttctggaggtggcggcggaggtagttcgtactaa

SEQ ID NO: 26680 - protein, 140 aa, Unknown
  Obtained from environmental sample
  misc_feature (1)..(140): Xaa is any amino acid
MRRVNIKLKNKMAEQIFASNDYVSILIALDLKSRGQINASVSTDVLLTELTEESLMNENWLFTYESIKKGWLAPTDNPVDNNKYFEILLANGIYFYKEDAKVKTFTVKKATEEINETTKKPETEEAKTIISGGGGGGSSY

SEQ ID NO: 26681 - DNA, 498 bp, Unknown
  Obtained from environmental sample
  misc_feature (1)..(498): n is a, c, g, or t
atgaaaagaacagtaatattaacattagtatttttacctctgattttaattggacaaaattcagagagttattttccgattgaaattggaaaagaaaaaaccctgacttggtataaagacaaatacgtggaatcttttactgactcaacagaaattggcggagaaaaatattatttgtattcccagaaatttaaaaataacttaatggaaatgcaaattcgaataagtaacgatactgtatatcattggaatgatgttaaaaaaaagcatcaagtgtttttcggaataaacccaaaagttggtgaaacaattggtaacggaacaattaaaaaagttggagcaaaactaaaaacacctaaaggaaaacttacggatttattagtaatcgaaatgaattattcaaacggaatgtctgatacaagatattaccaaaaaggacttggactcgttgctgtgaaaaataagagaggattaatctgttattatattcctgattaa

SEQ ID NO: 26682 - protein, 165 aa, Unknown
  Obtained from environmental sample
  SIGNAL (1)...(18)
  misc_feature (1)..(165): Xaa is any amino acid
MKRTVILTLVFLPLILIGQNSESYFPIEIGKEKTLTWYKDKYVESFTDSTEIGGEKYYLYSQKFKNNLMEMQIRISNDTVYHWNDVKKKHQVFFGINPKVGETIGNGTIKKVGAKLKTPKGKLTDLLVIEMNYSNGMSDTRYYQKGLGLVAVKNKRGLICYYIPD

SEQ ID NO: 26683 - DNA, 321 bp, Unknown
  Obtained from environmental sample
  misc_feature (1)..(321): n is a, c, g, or t
gtgctggttttttggagtagtgaatgttcccattgtttaacggaattgccccaagttagggacgtggttgatcagatgccgaaaaacaaagtgaagnttgtggcgtacgggttggaagataatgacgttaactggaaaaaggaaattcaaaactatcctgattttattcaggttttaggagtgggcaagtgggacaatttcattacagatatctatggcattgaagcaacaccaacgtattttgtgctggacaaggataaaaacatcattgccaaaccacagtctttgctagaactaaaaacctttttaaacacgctataa

SEQ ID NO: 26684 - protein, 106 aa, Unknown
  Obtained from environmental sample
  misc_feature (1)..(106): Xaa is any amino acid
MLVFWSSECSHCLTELPQVRDVVDQMPKNKVKXVAYGLEDNDVNWKKEIQNYPDFIQVLGVGKWDNFITDIYGIEATPTYFVLDKDKNIIAKPQSLLELKTFLNTL

SEQ ID NO: 26685 - DNA, 558 bp, Unknown
  Obtained from environmental sample
  misc_feature (1)..(558): n is a, c, g, or t
atgccaattcctttagtaaattctattgcttcgtggtttttaaagaaacgttttcatcaaattgaactctttttaaaatacccaaacgaagtacaaaacgagttactttttagcttacttaatacggcaaaagacactcaaattggcaagcaatacggttttgattccataaaaagctacaacgagttttcagaacgggtacccatttctacgtacgaagaatatcaaactaatattgaacgcgcgcgtcagggcgaaaacaacatcttttggccgagtccgataaagtggtttgctaaatctagcggaaccaccaacgcaaaaagtaagtttatacctgtaagttcagagtctttagaagactgccattatgctgctagtaaagatttactgtgtatgtatttaaataataatgaagactcacaactgtttactggcaagagtttacgcttgggaggtagcaaggaattatacaaagaaaacggcaccgcatttggtgatttaagtgctattttacttgatcattatgccttttgggcccaattaatagtacactag

SEQ ID NO: 26686 - protein, 185 aa, Unknown
  Obtained from environmental sample
  misc_feature (1)..(185): Xaa is any amino acid
MPIPLVNSIASWFLKKRFHQIELFLKYPNEVQNELLFSLLNTAKDTQIGKQYGFDSIKSYNEFSERVPISTYEEYQTNIERARQGENNIFWPSPIKWFAKSSGTTNAKSKFIPVSSESLEDCHYAASKDLLCMYLNNNEDSQLFTGKSLRLGGSKELYKENGTAFGDLSAILLDHYAFWAQLIVH

SEQ ID NO: 26687 - DNA, 732 bp, Unknown
  Obtained from environmental sample
  misc_feature (1)..(732): n is a, c, g, or t
atgagcaacaataaaataacttgtgttattgtagacgatgagcctatggctttaaatttagtagaaagttatgtggaaaaaacaccatttttagatctaaaacaaaagtgtagtagtgcaattgaagctatggagtttataaaaaacaatcctgtagacttattgtttttagacatacaaatgccagatttaacaggtctagaattttctaaaatgttaccaaaagatacgcgtgttattttcactacagcttttgatcattatgctttagaaggttttaaagtagaagctatagattatttattaaaaccttttgattatgctgagttcctagctgcagccaataaagcagctacttggtttgagttggtaaaagggaagaagcagtctgtattatctgaagaaaaagaatttttatttgtaaaatcggaatacaaacaacttcgcataaaactagcagatgttttatattttgaaggtttaaaagactacattaaaatctggttaaaagataatcctaaagcagttttaacgttaatgagtttaaagtcgttagaagaagaattgccagaaacacaatttatgcgtgtgcatcgctcttttatagtatcactaaaaaatatagatataatagagcgtagtcaaattataattaacgaccaacgtataacagtttcagagcaatataaacctaagtttttagagtatattcataataatcctttgcattaa

SEQ ID NO: 26688 - protein, 243 aa, Unknown
  Obtained from environmental sample
  DOMAIN (145)...(238): LytTr DNA-binding domain
  misc_feature (1)..(243): Xaa is any amino acid
MSNNKITCVIVDDEPMALNLVESYVEKTPFLDLKQKCSSAIEAMEFIKNNPVDLLFLDIQMPDLTGLEFSKMLPKDTRVIFTTAFDHYALEGFKVEAIDYLLKPFDYAEFLAAANKAATWFELVKGKKQSVLSEEKEFLFVKSEYKQLRIKLADVLYFEGLKDYIKIWLKDNPKAVLTLMSLKSLEEELPETQFMRVHRSFIVSLKNIDIIERSQIIINDQRITVSEQYKPKFLEYIHNNPLH

SEQ ID NO: 26689 - DNA, 585 bp, Unknown
  Obtained from environmental sample
  misc_feature (1)..(585): n is a, c, g, or t
gtggcgatcgctgctcaaaacactatagaaacagctgtagagcctgctttacctctagcaacattggaggctgagaaagaaaatcctaaaatgactttacgagaggctttcgattttagtttaaagctaaaagccaaagtaatcaacgaacgttcgcttcaagattacctttacagtaccaatgcggtggtaaaatgggctaaagacaagcgaccagaaataaaaaccatcgatcaatttgataaaaaagctgctttagcttttctgaattttatattactaagatcgagttctagaaatagaaacaattatcgccttaacctaagtagtttaatgcaaacgctagaggataatgagattattgaacacaaacctattaaaaagatttctgttcttaaaagcacccctaaacgaaaccaaacctatagtctcacggaacaagaaaaaatatctgaatacttacaaaaggaagatcctatactgttgtcgtctatcaaattcatttcttacaacctcctaagaccaatagaggtgtgcaggttgaacgtacaagatttgaattggagaataacacattacagttaa

SEQ ID NO: 26690 - protein, 194 aa, Unknown
  Obtained from environmental sample
  misc_feature (1)..(194): Xaa is any amino acid
MAIAAQNTIETAVEPALPLATLEAEKENPKMTLREAFDFSLKLKAKVINERSLQDYLYSTNAVVKWAKDKRPEIKTIDQFDKKAALAFLNFILLRSSSRNRNNYRLNLSSLMQTLEDNEIIEHKPIKKISVLKSTPKRNQTYSLTEQEKISEYLQKEDPILLSSIKFISYNLLRPIEVCRLNVQDLNWRITHYS

SEQ ID NO: 26691 - DNA, 381 bp, Unknown
  Obtained from environmental sample
  misc_feature (1)..(381): n is a, c, g, or t
gtgccaacttacgttaacataacagtacaaccaaacttacctagtataaatggtaatgcttggcgatttaaacaagtgtttcaagatttaatacaaaatgccataaaatatggtaatccagaaaaaggaagtatacaagttggttacacagatcatgatgatcattatcagttttttgtcaaagacaatggtattggtattaaatctgattattacgacaaaatttttaaagtctttactaaattagaaagtacaggatcatcttctggtataggtttgtccattgtaaaaaaaattattacttactataaagggactatttgggttgacagtcaagaaggtgttggaaccactttttattttacgttattaaaaaactaa

SEQ ID NO: 26692 - protein, 126 aa, Unknown
  Obtained from environmental sample
  DOMAIN (18)...(126): Histidine kinase-, DNA gyrase B-, and HSP90-like ATPase
  misc_feature (1)..(126): Xaa is any amino acid
MPTYVNITVQPNLPSINGNAWRFKQVFQDLIQNAIKYGNPEKGSIQVGYTDHDDHYQFFVKDNGIGIKSDYYDKIFKVFTKLESTGSSSGIGLSIVKKIITYYKGTIWVDSQEGVGTTFYFTLLKN

SEQ ID NO: 26693 - DNA, 318 bp, Unknown
  Obtained from environmental sample
  misc_feature (1)..(318): n is a, c, g, or t
ttggggggaccacagctgaagagtttagactttcaacttttagatgaaaatgataatgttatatatacgcattcgactttttcaaccagttatatttctaaagggcaaagatatagaaatggcacatctggtcctcttgattatctttatgagttcaaacctaatgagaatcaaaagaatattttagccaatttatcaacatcaaaaataaagtttaaagtagatatcgttgaattagtttataataatgatccaggcttatcgcttatcaatatatttttttggcggagtaatcaaaagtatatcggaaacatataa

SEQ ID NO: 26694 - protein, 105 aa, Unknown
  Obtained from environmental sample
  misc_feature (1)..(105): Xaa is any amino acid
MGGPQLKSLDFQLLDENDNVIYTHSTFSTSYISKGQRYRNGTSGPLDYLYEFKPNENQKNILANLSTSKIKFKVDIVELVYNNDPGLSLINIFFWRSNQKYIGNI

SEQ ID NO: 26695 - DNA, 435 bp, Unknown
  Obtained from environmental sample
  misc_feature (1)..(435): n is a, c, g, or t
ttgattcggtcgagaaatggaatgaagtttgaagctgtttgcttattgcaggctacaagcccgtttagaactgttgattttttagatagagctatcaaaaagtttgagtatacaaataccgactctttgatatcggtacttgaagtgccacatgaatataatccacattgggtttttgaaaagaacaatgaagataatcttaaaattagtactggagaatcaaaaatcatttcaagaagacaagagttgccaaaatcctattttcgagatggatcaatttaccttacaaaagttgatgtaattctaaatcaaaaatctttatatggtaatactatctcatatattgaatcttcaaaagaaacatatgtgaatattgatactatagaagattgggaaaaggctgaatctatgattaaccccaaaggtttaatttaa

SEQ ID NO: 26696 - protein, 144 aa, Unknown
  Obtained from environmental sample
  misc_feature (1)..(144): Xaa is any amino acid
MIRSRNGMKFEAVCLLQATSPFRTVDFLDRAIKKFEYTNTDSLISVLEVPHEYNPHWVFEKNNEDNLKISTGESKIISRRQELPKSYFRDGSIYLTKVDVILNQKSLYGNTISYIESSKETYVNIDTIEDWEKAESMINPKGLI

SEQ ID NO: 26697 - DNA, 300 bp, Unknown
  Obtained from environmental sample
  misc_feature (1)..(300): n is a, c, g, or t
ttgcagaggatcaaaagtagtaactccgagatagatatcagaacatatcctgaaggagacaaaggattgacgtccttatcgagtgaaaaagcgcttttacagaagtcaaaattaatggaagtggttaagatatataatgccattccattggataataaatttgccataactgtctggggcgttagggatccagaatcttggttgctcaatttttggggtgttccagattggccgttgttatttgatgctagttataataaaaaaccaatgtattacggttttttagaagggcttaaatag

SEQ ID NO: 26698 - protein, 99 aa, Unknown
  Obtained from environmental sample
  misc_feature (1)..(99): Xaa is any amino acid
MQRIKSSNSEIDIRTYPEGDKGLTSLSSEKALLQKSKLMEVVKIYNAIPLDNKFAITVWGVRDPESWLLNFWGVPDWPLLFDASYNKKPMYYGFLEGLK

SEQ ID NO: 26699 - DNA, 408 bp, Unknown
  Obtained from environmental sample
  misc_feature (1)..(408): n is a, c, g, or t
ttggctacacagcaaatagatgtatcagaatgggaaatcattaaaaaggaaaaaccagacgtagctttagaagaactcaacttgtttagtgatctggtttgggaaaatgtactatcgaaaaccaattacttagagcatttttccgaacagaacatcaacttatttaagtgtgagaaaaatgagatatttagagtagtagttcaaattacgaaagaaaattttaatttttttaacgataaggatttccaatggtttattgataataccaatgacgaatctattcaatttttaaaaggcataaagaaatatgaccaagaaagaagtttagaattgttcgatctcattcaaaagggtagtgtaatatctgatggaaaattgtacgaaaatatttataatttaatcacttaa

SEQ ID NO: 26700 - protein, 135 aa, Unknown
  Obtained from environmental sample
  misc_feature (1)..(135): Xaa is any amino acid
MATQQIDVSEWEIIKKEKPDVALEELNLFSDLVWENVLSKTNYLEHFSEQNINLFKCEKNEIFRVVVQITKENFNFFNDKDFQWFIDNTNDESIQFLKGIKKYDQERSLELFDLIQKGSVISDGKLYENIYNLIT

SEQ ID NO: 26701 - DNA, 789 bp, Unknown
  Obtained from environmental sample
  misc_feature (1)..(789): n is a, c, g, or t
ttggattttagtataaccccaaccgaagctttgcgcaaagtaaaagacaaagttgacgcagccaaatccgacaaagatttcccaacagatctaccggctgaccctacagttcaagaattgaattttgcagaattaatacccataatgaatattaatttatctggtgatttctcaatggatcaattaaaagaatatggtgaatatttagaagacgagatagaaaaagtacctgaaatttctaaagttgatattcgtggtattcaagataaagaaatggaaattagtgttgatttatacaaaatggaaatttccaaaatcagctttaatgacattgcaacggccattcagaacgaaaatacaactatttccggtggtgacttattagaaaatggaattcgtagaaatgttagaattattggagaatttaaatcagctaaagaaattgaagatatcatcataaaacaagaagatggcaatatagtttacttacgtgatattgcaaatgttagttttaaggaacaagaaaaagaaagttatgctcgcgaattttctcaacctgttgtaatgttagacgtcacaaaacgaggtggagaaaatcttataaatgcctcctctcaaattgataaaattatcaatgaagctaaagaaagttattttcctgctaacctatatatttctaaaactaatgatcaaaccaacgatactaaaactatgttcgccgacttggaaaatagcataattttaggagttatattagtgttcttctcgagccgattcttgatccactag

SEQ ID NO: 26702 - protein, 262 aa, Unknown
  Obtained from environmental sample
  misc_feature (1)..(262): Xaa is any amino acid
MDFSITPTEALRKVKDKVDAAKSDKDFPTDLPADPTVQELNFAELIPIMNINLSGDFSMDQLKEYGEYLEDEIEKVPEISKVDIRGIQDKEMEISVDLYKMEISKISFNDIATAIQNENTTISGGDLLENGIRRNVRIIGEFKSAKEIEDIIIKQEDGNIVYLRDIANVSFKEQEKESYAREFSQPVVMLDVTKRGGENLINASSQIDKIINEAKESYFPANLYISKTNDQTNDTKTMFADLENSIILGVILVFFSSRFLIH

SEQ ID NO: 26703 - DNA, 666 bp, Unknown
  Obtained from environmental sample
  misc_feature (1)..(666): n is a, c, g, or t
ttgatggacgatttttctattggaggcgatttaatacgagatactttagataaattagagaatataacaagatggttaggaggaaataaagtaactataaaaggtttaaaatcgatcttgaaaaatcacccaaaagataaagaaattacgattgtagatgttgnctgtggacatggagatattttgagagatgttgccaaattcgggagaaaacataattataaattcaaattaattggaattgatgcaaacccaacagccatagaatatgcaaatgaattatctttagagtataaagagttaacgtttgaaacgcaagatattttctctgacgattttaaaaaccgtgaatttgatgttgttttagcaaccttattttttcatcattttaaagaaccagaattagtttcatttttaaaaaacacattaaaacaaacaaaaattggcattgttgtaaacgatttacacagacataaattagcgtactatttgtttatgttgttgtccatttttatcagcaataaaatgataattgaagatggattaacctcagttttaagaggatttaaaagaaaagatttagttgaaatgtcaaataaattaaacgtaaaatcagatatttcatggaaatgggcttttcgttttctatggattctgaagagttaa

SEQ ID NO: 26704 - protein, 221 aa, Unknown
  Obtained from environmental sample
  misc_feature (1)..(221): Xaa is any amino acid
MMDDFSIGGDLIRDTLDKLENITRWLGGNKVTIKGLKSILKNHPKDKEITIVDVXCGHGDILRDVAKFGRKHNYKFKLIGIDANPTAIEYANELSLEYKELTFETQDIFSDDFKNREFDVVLATLFFHHFKEPELVSFLKNTLKQTKIGIVVNDLHRHKLAYYLFMLLSIFISNKMIIEDGLTSVLRGFKRKDLVEMSNKLNVKSDISWKWAFRFLWILKS

SEQ ID NO: 26705 - DNA, 879 bp, Unknown
  Obtained from environmental sample
  misc_feature (1)..(879): n is a, c, g, or t
ttgattcggtcgagtctaaaatatcatgataggngcatcggtattagcaagaaaataggaaatggggagtccgattattacacgtccatccacaataaagcctttgttttaagaaaacagggtgcttatggagccgcaattaaattgtatgaggagatattgcaacaaaaggatttatttattgaagatcccagtttttatcccctaatccttgataatattgcctttactaaatttgaatcacaggataaggattatggagctatggaaaatatgtttatggaagcctataggctcagtgatagtttggacgatcccactacaacattagccgttagcattgatctttcaaaattttataaagggcaaggaaaaaatgatcaggcactacactttgctcaggagtcctatgatttggctggagatatctcatcaaatgacattcttttagaatctatgatccttctgtctgagcctaaagcaggcgatgaagggaaaagtcattttaaagagtacattcgtttgagtgatagtttattggcacatgagcggggcatccgtaataaatttgcacgtgtacattttgaaaccgatcagattgaacttgaaaatgaacggattgctactgaaaaaatgtggtggataataagttctgtcgtactcttactaacgtcaatattggtgtacatcatcattacacagcgaaataaaaatagggaattaaaatttaaacaagatcagcaggaggctaatgaagagatctataatttaatgctctcgcagcaagataaggtagatggccgcaaggctgaagaaacaaaaggtatttcccaagaataccttatggtggtttggggcggttattggggacgcggttaa

SEQ ID NO: 26706 - protein, 292 aa, Unknown
  Obtained from environmental sample
  misc_feature (1)..(292): Xaa is any amino acid
MIRSSLKYHDRXIGISKKIGNGESDYYTSIHNKAFVLRKQGAYGAAIKLYEEILQQKDLFIEDPSFYPLILDNIAFTKFESQDKDYGAMENMFMEAYRLSDSLDDPTTTLAVSIDLSKFYKGQGKNDQALHFAQESYDLAGDISSNDILLESMILLSEPKAGDEGKSHFKEYIRLSDSLLAHERGIRNKFARVHFETDQIELENERIATEKMWWIISSVVLLLTSILVYIIITQRNKNRELKFKQDQQEANEEIYNLMLSQQDKVDGRKAEETKGISQEYLMVVWGGYWGRG

SEQ ID NO: 26707 - DNA, 540 bp, Unknown
  Obtained from environmental sample
  misc_feature (1)..(540): n is a, c, g, or t
ttgtttgatgacaaagatgctttgtccaatgcttttagcattaaaaagcagaatttaattacagaaataacccaaatagataagaagcttaatagtataaaaaaactggaacaaggtctattagatagtatagaatctcttgatttagattttaattgggatgtaaatatcccagaccaaagaaaagttaaagagtataaatcctctgtaattatgattcagaacctagatacttttaaagctgatataaaagcttccattgcagacaaaaaagaaaaactagatgcattgtctttgaaaattcctttcaagttttcaaatgaaaatctagatgaagaaataaacaaatgtagtgcagaacaaagtaaactcaacaccggccaacttgaggcaaatggagcatttgagagcacaaaaacccgattaaatactaaaactgaagaactagaaaaggttaactacaatcctaaagagattgacgatttaaaaattgaagggctcaaaaaaatcgaagcagaagagaacagctatatcgattaa

SEQ ID NO: 26708 - protein, 179 aa, Unknown
  Obtained from environmental sample
  misc_feature (1)..(179): Xaa is any amino acid
MFDDKDALSNAFSIKKQNLITEITQIDKKLNSIKKLEQGLLDSIESLDLDFNWDVNIPDQRKVKEYKSSVIMIQNLDTFKADIKASIADKKEKLDALSLKIPFKFSNENLDEEINKCSAEQSKLNTGQLEANGAFESTKTRLNTKTEELEKVNYNPKEIDDLKIEGLKKIEAEENSYID

SEQ ID NO: 26709 - DNA, 474 bp, Unknown
  Obtained from environmental sample
  misc_feature (1)..(474): n is a, c, g, or t
gtgaagcctcaacttaggtttgaagaaaacgatataaaattactaatagactttaaagaaggtattaaagatggaagtctaaaaaaactaaaagcggatcttgtagaagctcaagagagtgtaaaaggtttttcactaatgttttttaaaaatgaaaagtatttagataagcatccttctctggtcgacgccatcaattctatatttaatataaaactggtagataaaaagagccaacagttcttgtacgttttacaatgctatgatccgaaacttattattctacgtgagaacgggaattttttaaacagagataaattaccaagagaaaatgggtatgaactgtggtatgctggtggtaagaatgttccaaagttagagtatacttatgaattaagaagaggattgcccatttattattcagcagattgggaaaaagatgctttagaaatatatcttacggcgaagggttga

SEQ ID NO: 26710 - protein, 157 aa, Unknown
  Obtained from environmental sample
  misc_feature (1)..(157): Xaa is any amino acid
MKPQLRFEENDIKLLIDFKEGIKDGSLKKLKADLVEAQESVKGFSLMFFKNEKYLDKHPSLVDAINSIFNIKLVDKKSQQFLYVLQCYDPKLIILRENGNFLNRDKLPRENGYELWYAGGKNVPKLEYTYELRRGLPIYYSADWEKDALEIYLTAKG

SEQ ID NO: 26711 - DNA, 321 bp, Unknown
  Obtained from environmental sample
  misc_feature (1)..(321): n is a, c, g, or t
atgcccattaaaacgagatttattactatgaacaaaataattggtactctactggtcgctttgattggagcagtatcgccaaacggttattcagaaagcgaagttgagagcctatcacctgagttgagggcactgctcaagcaagagatgttggcgattcaagaaggcatgaaaaacatcgttcctgcctttgcttctggaaatttagaagaggtttctgatattgctggaaaaattaacagaagctttattctgaagcaaaaaattacagattcacaaaagcatgagattcatgaaaactctcgaaaggatttatactaa

SEQ ID NO: 26712 - protein, 106 aa, Unknown
  Obtained from environmental sample
  misc_feature (1)..(106): Xaa is any amino acid
MPIKTRFITMNKIIGTLLVALIGAVSPNGYSESEVESLSPELRALLKQEMLAIQEGMKNIVPAFASGNLEEVSDIAGKINRSFILKQKITDSQKHEIHENSRKDLY

SEQ ID NO: 26713 - DNA, 333 bp, Unknown
  Obtained from environmental sample
  misc_feature (1)..(333): n is a, c, g, or t
atgattcgtatggatacaccacttattaaagataaaattatcaacataataaataacaataattctttagaagataaattacaaacgatttgcgattacttaaaagaaaaaataaattattacgatggggtgggtttctattttaaaaacggacaaaaacaggaattaaaactcgctagatttgctggtgaaccaacagagcatattattatcccttttggtaaaggtatttgtggtcaagttgctgtaactaatanaaactttgttgttcaagatgtatctgaacnaaataattatatatcatgcggttggaaggttaccgtgacattgtaa

SEQ ID NO: 26714 - protein, 110 aa, Unknown
  Obtained from environmental sample
  misc_feature (1)..(110): Xaa is any amino acid
MIRMDTPLIKDKIINIINNNNSLEDKLQTICDYLKEKINYYDGVGFYFKNGQKQELKLARFAGEPTEHIIIPFGKGICGQVAVTNXNFVVQDVSEXNNYISCGWKVTVTL

SEQ ID NO: 26715 - DNA, 576 bp, Unknown
  Obtained from environmental sample
  misc_feature (1)..(576): n is a, c, g, or t
atggttgtgnacaggagatttttaaaaactgcattaaataatggatggcatgtttccggaattgaacctaatgaggaagcaagattaatagcaaatcaaaaaactaaaaacgctgtattagatctgtcacaaataaaaactttaaaaactcaaagttttgatgttatcaccttgtggcatgttttagaacatattccaaatttagaagaacaaatcacactgcttaaaacgttacttaaaccaaacggtgttttaattattgcggtacccaattacaatagttacgacgctaaacattataaacaattttgggcagcttttgatgtgccaagacatttatggcattttaatcaaacttctatttcaaatttatttaagacagttaatttaaaagttcaatttactaagcctatgctttttgattcatattatgttagtctattatctgaaaaatataaatctggacgaatgaatatatttaaagctttttggattggttgtgtctcaaattttaaagcaaggtcttctgggcaatattcttcattgatttatacgcttaaaacagctaaaaagtaa

SEQ ID NO: 26716 - protein, 191 aa, Unknown
  Obtained from environmental sample
  misc_feature (1)..(191): Xaa is any amino acid
MVVXRRFLKTALNNGWHVSGIEPNEEARLIANQKTKNAVLDLSQIKTLKTQSFDVITLWHVLEHIPNLEEQITLLKTLLKPNGVLIIAVPNYNSYDAKHYKQFWAAFDVPRHLWHFNQTSISNLFKTVNLKVQFTKPMLFDSYYVSLLSEKYKSGRMNIFKAFWIGCVSNFKARSSGQYSSLIYTLKTAKK

SEQ ID NO: 26717 - DNA, 774 bp, Unknown
  Obtained from environmental sample
  misc_feature (1)..(774): n is a, c, g, or t
atggtatcatctgaagtggtgccttatgtaccggaaacagaaatttcttcaatgtcatttgaaacacctaggatgatcaatcagcaaggtggacaaataagaattttcatgcctagatatggaaatatcaacgaaagaagacatcaattacatgaagttatccgtctttctggtattaatttagttgtgaatgatttagacatgcctttaattattaaagtagcctctatacctaaagaacgtattcaagtttactttatagataacgatgaatattttaaaagaaaagcaacacttacagatgaggatggaaatttattttctgataatgatgaaagagctatcttttttgctaaaggtgttattgaaaccgttaaaaaattaaattggtcaccagatattattcacgttcatggatggttagcctctttactaccactatatttaaagcaattttacaaagacgaacctttatttaacgaaagtaaaattgttacttcagtatataaaagtggctttgaaaacgagttaaattcaaaattagttgataaaattaaatttgataatattgatgaagatcaaataaaggatttagttaagcctacttataataatctaatgaaggtagcaatagacaactctgatgccttgattgttggatcagaagatttacctgaagagctaacatcctatttaaaagaatctaaaaaacctgttctagattttcatgntaaagacgaatttagcgaagcatacctcgagccgattctgtga

SEQ ID NO: 26718 - protein, 257 aa, Unknown
  Obtained from environmental sample
  misc_feature (1)..(257): Xaa is any amino acid
MVSSEVVPYVPETEISSMSFETPRMINQQGGQIRIFMPRYGNINERRHQLHEVIRLSGINLVVNDLDMPLIIKVASIPKERIQVYFIDNDEYFKRKATLTDEDGNLFSDNDERAIFFAKGVIETVKKLNWSPDIIHVHGWLASLLPLYLKQFYKDEPLFNESKIVTSVYKSGFENELNSKLVDKIKFDNIDEDQIKDLVKPTYNNLMKVAIDNSDALIVGSEDLPEELTSYLKESKKPVLDFHXKDEFSEAYLEPIL

SEQ ID NO: 26719 - DNA, 360 bp, Unknown
  Obtained from environmental sample
  misc_feature (1)..(360): n is a, c, g, or t
atgaataaatttattctgcttatcggactttgtgtttgttcaaatattttctcacaagaaataccaagttataaggatattacatctgaattaatcaatcctgaaaactcattaaacattgagtttcggctctttaattcagatttttatatcgtcatcgaagatgatattaagctattaagacaacttgatgttgatccctgcgtagaattaaaatcaaatgttgaaacgaataaaattattcaggaaataatccttaaaaatgaattattgaaagttatttatgtgcttaaggaagagcaggtagtaagaatagattcaaaagaaaaaatcaaatatcctttatattggattaatatc

SEQ ID NO: 26720 - protein, 120 aa, Unknown
  Obtained from environmental sample
  SIGNAL (1)...(18)
  misc_feature (1)..(120): Xaa is any amino acid
MNKFILLIGLCVCSNIFSQEIPSYKDITSELINPENSLNIEFRLFNSDFYIVIEDDIKLLRQLDVDPCVELKSNVETNKIIQEIILKNELLKVIYVLKEEQVVRIDSKEKIKYPLYWINI

SEQ ID NO: 26721 - DNA, 351 bp, Unknown
  Obtained from environmental sample
  misc_feature (1)..(351): n is a, c, g, or t
ttgtattttgcaactatagctattaatcatagcgtaagtaatccttataaacttaacattatgattagaaatttttacaatgaaaaatggaaacctgtccagtttgatgacaatgtttctgaaaatatgtcttttaaaatatcaaaccatggacgacttagtaaagttgaagatggagttgatgttttgatagaaaaccaataccctattaatgggtatagtacagttcctgttataaaaaaagatggtaagcgtacagcaagatatattcacaaattagttgcacaacatcatttagataaaccagaagacgcaaaatttgtgatccacttagattacgataaacagtaa

SEQ ID NO: 26722 - protein, 116 aa, Unknown
  Obtained from environmental sample
  misc_feature (1)..(116): Xaa is any amino acid
MYFATIAINHSVSNPYKLNIMIRNFYNEKWKPVQFDDNVSENMSFKISNHGRLSKVEDGVDVLIENQYPINGYSTVPVIKKDGKRTARYIHKLVAQHHLDKPEDAKFVIHLDYDKQ

SEQ ID NO: 26723 - DNA, 504 bp, Unknown
  Obtained from environmental sample
  misc_feature (1)..(504): n is a, c, g, or t
atggcgacttccgtttctgattttaaagaagataagaactttatagcagatgtgttcagtgagattgtagcgcctaatgacaagctctatgattatattgaagacaagagattgacttggttagacgatttgccagtagtcaatactggaattctcaaaatgcttaataaagtaaaaaaggaaaacagttcaaattactttaccccaaaactttttaaagatacagaggataaagaatttgcgacaaccttgtttaagaaatccatactcaataagtctaaatttaaccaagaagtagcggcaaaaaccaaaaattgggatgctgaccgtattgccagtttagatgctgtgttgcttcaaatggcgatttgcgaatttcaaaaattcccgtccattcccgtaaaagtaaccattaacgaatatattgatattgcaaaggagtactctaaccctaagagcagtttctttattactggaatcttagataagattgttaaggaatag

SEQ ID NO: 26724 - protein, 167 aa, Unknown
  Obtained from environmental sample
  DOMAIN (51)...(167): NusB family
  misc_feature (1)..(167): Xaa is any amino acid
MATSVSDFKEDKNFIADVFSEIVAPNDKLYDYIEDKRLTWLDDLPVVNTGILKMLNKVKKENSSNYFTPKLFKDTEDKEFATTLFKKSILNKSKFNQEVAAKTKNWDADRIASLDAVLLQMAICEFQKFPSIPVKVTINEYIDIAKEYSNPKSSFFITGILDKIVKE

SEQ ID NO: 26725 - DNA, 498 bp, Unknown
  Obtained from environmental sample
  misc_feature (1)..(498): n is a, c, g, or t
atggaaatgattaagtttcaatttcctaactctaaccctaaagctccagatattagagtaagccacgtcgtaaaaggtagagtgccaagtgctattggtaagccagcaaaagagcttttagaacatgaaaaaaccatttattatgagcgttgtgcttttgttattgaaataccagaatttaaacaagttattaatggaaatgaaatatccttatgcgttggaggtgtaagggcttataatcaagaaaacctttatagtaagaaaagtttagagaaatttaaaatgtttgttggattccaaaataaggtatgtactaatttatgtatatctacagatggttttacaaatgaaataagaataggctctattttagatttaaatcaaaatatcagaaatctactaagcaattacgataaagacacccatttaactacaatggaaacgatgtctaattacagtctaacagaaaatcaatttgctcatttagtaggtacataa

SEQ ID NO: 26726 - protein, 165 aa, Unknown
  Obtained from environmental sample
  misc_feature (1)..(165): Xaa is any amino acid
MEMIKFQFPNSNPKAPDIRVSHVVKGRVPSAIGKPAKELLEHEKTIYYERCAFVIEIPEFKQVINGNEISLCVGGVRAYNQENLYSKKSLEKFKMFVGFQNKVCTNLCISTDGFTNEIRIGSILDLNQNIRNLLSNYDKDTHLTTMETMSNYSLTENQFAHLVGT

SEQ ID NO: 26727 - DNA, 756 bp, Unknown
  Obtained from environmental sample
  misc_feature (1)..(756): n is a, c, g, or t
gtggatcaagaatcggtcgagtctagaaaatgctataaaattacagaagaaggtactattacctttaacgcgtctttaaatcaaatcagagctcaaaaagcaagcatacacttccaaataatagatacgggaataggaatccctcaagacaaaatagaagatgtcttcacaagttttacacaattaaacaactctcaaacctacaaaggtgcaggattaggattggcaatagctaaacatttagtaagcttaacacatagcaaaattagcgtagacagtacagaaggggaaggtagcacgttttctaccaatatcaattttagcttagataaaaaccataaactaaagactaaaaagaaagacgctgtaacttcaccacaatcaaataaaaaatacagtattttattagttgaagattcagaaattactcaattatccatactaaaaatattagcctctagaggtaattactttttagacatagtaacaaaaggagaagacgttattccaagaatagaaaactctgagtttgacctaatacttatggatataaaattacctaatagttatggtgacgagattaccaaactaattagaaaaatgccagaacgcgaacataaaaaaatcccagtaatagcactaaccgctcgtgtcatgaaagacgatttaaaacgctataaaaaagcaggaattaacgatgtcatccaaaaaccatttgacgacaacgccttaattaccaaaatagaagaatattaa

SEQ ID NO: 26728 - protein, 251 aa, Unknown
  Obtained from environmental sample
  DOMAIN (6)...(108): Histidine kinase-, DNA gyrase B-, and HSP90-like ATPase
  misc_feature (1)..(251): Xaa is any amino acid
MDQESVESRKCYKITEEGTITFNASLNQIRAQKASIHFQIIDTGIGIPQDKIEDVFTSFTQLNNSQTYKGAGLGLAIAKHLVSLTHSKISVDSTEGEGSTFSTNINFSLDKNHKLKTKKKDAVTSPQSNKKYSILLVEDSEITQLSILKILASRGNYFLDIVTKGEDVIPRIENSEFDLILMDIKLPNSYGDEITKLIRKMPEREHKKIPVIALTARVMKDDLKRYKKAGINDVIQKPFDDNALITKIEEY

SEQ ID NO: 26729 - DNA, 513 bp, Unknown
  Obtained from environmental sample
  misc_feature (1)..(513): n is a, c, g, or t
atgctggaaattccgtttagggatgtttgtaatgcgtttcctgttatcaagtttatgggagttaattcggattttaccaaagatgagccgattggaatgtcggtgaccgttgtgactttatcgcgtacacttagtgttctgctgatctactcgattgtggatttggacacgctgaaaagaatcaaaggtttatccagaggacaagacacagatctgagtaaaaaaattgcggagaaaaataattggaatatctattcaagcaatcaacaaatgacaattctaaatttgacttggaaagaatcagncggatttgattggggaaaacaattgacaataatttatgatggaactgatgtactcgtgaattgcatatcgttcggacttcactcaagtccttcaccttttcattggtttgcgaataaaagaaaaataaataaactgaaaacggaatttgaaagcggaataaaaaacgttttacaacaaagaactgagttaaaaaacaagccattttaa

SEQ ID NO: 26730 - protein, 170 aa, Unknown
  Obtained from environmental sample
  misc_feature (1)..(170): Xaa is any amino acid
MLEIPFRDVCNAFPVIKFMGVNSDFTKDEPIGMSVTVVTLSRTLSVLLIYSIVDLDTLKRIKGLSRGQDTDLSKKIAEKNNWNIYSSNQQMTILNLTWKESXGFDWGKQLTIIYDGTDVLVNCISFGLHSSPSPFHWFANKRKINKLKTEFESGIKNVLQQRTELKNKPF

SEQ ID NO: 26731 - DNA, 393 bp, Unknown
  Obtained from environmental sample
  misc_feature (1)..(393): n is a, c, g, or t
ttgagtaaaacatacaacatactactaaatggacttctaatcggaacaactgaattagaaaaagctgatgcacctatgggagtagtatttggactgattgaatttgacggaattgaatcgccttacgaattcttcaaagattattgcttaaaaaacaatatcgtgataaatactgacgacccagaatatgaatttattgacactcaagtaatgtcggaattaaaagtatttagacaagacggaatggaaataaaaggagttgctggaaatgcaattacaggaatgaaagaagatggatatgaaatttcaattttaggaatcagttatcctttttacgaaaaggagtttccacatcacgtaaaggaatatgaaaatatgttcggaaaagaataa

SEQ ID NO: 26732 - protein, 130 aa, Unknown
  Obtained from environmental sample
  misc_feature (1)..(130): Xaa is any amino acid
MSKTYNILLNGLLIGTTELEKADAPMGVVFGLIEFDGIESPYEFFKDYCLKNNIVINTDDPEYEFIDTQVMSELKVFRQDGMEIKGVAGNAITGMKEDGYEISILGISYPFYEKEFPHHVKEYENMFGKE

SEQ ID NO: 26733 - DNA, 693 bp, Unknown
  Obtained from environmental sample
  misc_feature (1)..(693): n is a, c, g, or t
atgaaaatagtcatatcaccggcaaagtctttagatttcgaatcaaaagtacctactgacaagcatactcaaccagcttttttagagcaatcagaaaaattgagtaaggtacttaaaaagaaaagtgcaaggcagctttctaagctaatgagtatttctgataacttaggccagttgaattatgaacgaaatcaaaactggagtttgccgtttaccttggagaattccaggcaagctatttttgcttttagtggagcggtttttcaggggttagatgttgctacaattccaaataataaattagatcagcttcaaaaaaaactgcgtattatatcgggtcaatatggcttattaaaaccattagatattatgcaaccttaccgattagaaatgggcacgagattaaaaattggcagaaaaaataatttgtatcaattttgggatactgctattacagaagccttaaataatgagttggaagaaggagaaccatttgtcaatttggcaagtgcagaatactttaaggccatcaaaccgaaattattaaaagctccagttattacgcctgtttttaaagattttaagaacggtgaatacaaaactataatgacctttgcaaaattagccagaggttatatggtacgatacattattgataatgatatgataccgctgatgctcggccgatcttga

SEQ ID NO: 26734 - protein, 230 aa, Unknown
  Obtained from environmental sample
  DOMAIN (1)...(229): Protein of unknown function (DUF328)
  misc_feature (1)..(230): Xaa is any amino acid
MKIVISPAKSLDFESKVPTDKHTQPAFLEQSEKLSKVLKKKSARQLSKLMSISDNLGQLNYERNQNWSLPFTLENSRQAIFAFSGAVFQGLDVATIPNNKLDQLQKKLRIISGQYGLLKPLDIMQPYRLEMGTRLKIGRKNNLYQFWDTAITEALNNELEEGEPFVNLASAEYFKAIKPKLLKAPVITPVFKDFKNGEYKTIMTFAKLARGYMVRYIIDNDMIPLMLGRS

SEQ ID NO: 26735 - DNA, 741 bp, Unknown
  Obtained from environmental sample
  misc_feature (1)..(741): n is a, c, g, or t
atgacaggttttgtgtttaaaatccatgcaaatatggatcctaaacacagagatagattggcttttatcaaaatagtttctggaacttttaaaagaaattcgccatatttacatgttagaaatggtaaaaaagtaaaattttcaagtccgaatgctttttttgctgaaaagaaagaaattgtagatgaatcttttcctggtgatattgtaggtattcatgatacaggtaattttaaaattggagatacgttaactgaaggtgaagatttgaattttagaggaattccaagtttttctcctgaacattttagatatgtaaacaatgcagatccaatgaaatctaaacaactttacaaaggtttagatcagttgatggatgaaggtgttgcccaattatttattctagaaatgaatggaagaagagtaattggtactgttggtgctttacaatttgaagttattcaatatagattagaacacgaatatggtgcaaaatgtacgtatgaaaatttgagtgttcataaagcttgttgggttgaaccaacagataaaaagaatgatgagttcaaagagtttaaacgtgtaaaacaacgatatttagcaaaagacaaacaaggtcaattggtatttttagcagattctgctttgacaattcaaatgacacaaagcaaatatccgactgtaaaattgcatttacaagtgaatttaaaaataatttatggagaaaatctaatttattag

SEQ ID NO: 26736 - protein, 246 aa, Unknown
  Obtained from environmental sample
  DOMAIN (18)...(85): Elongation factor Tu domain 2
  misc_feature (1)..(246): Xaa is any amino acid
MTGFVFKIHANMDPKHRDRLAFIKIVSGTFKRNSPYLHVRNGKKVKFSSPNAFFAEKKEIVDESFPGDIVGIHDTGNFKIGDTLTEGEDLNFRGIPSFSPEHFRYVNNADPMKSKQLYKGLDQLMDEGVAQLFILEMNGRRVIGTVGALQFEVIQYRLEHEYGAKCTYENLSVHKACWVEPTDKKNDEFKEFKRVKQRYLAKDKQGQLVFLADSALTIQMTQSKYPTVKLHLQVNLKIIYGENLIY

SEQ ID NO: 26737 - DNA, 714 bp, Unknown
  Obtained from environmental sample
  misc_feature (1)..(714): n is a, c, g, or t
atgtcaactgacgaactaaatatcaattatacacgtgaagcttttatgaatcccattaatttgggaggattacttattgcaacacttactgcattctttatcagtgattatggagatgcatcaagcgtgatgttgactaccgtctttggtttagaattaatgtatttgggcattgtgcctaagttgcctcgtttcagaaagaaaacggaattaaagaagatcaaagaacgtcatgcttccagcaatgaaaaagatttgtttcaatcattggattcagcaagccaaaaaagatttttagtgcttaagcatcttgcaaaaatggtgcaagagaactttgaaaaacttccatacagctctcaaggattgttagataatattggaaagaagattgaagagttactgggtaattatctaacacttttagatttgatcaaacgctatgaggtgtatttaaatactactctagaaacaaatctcaaagaagaagtaattaagcaaattgaagaaattaagacgctagaatctgaaaaattgaagcgcacaaaagcacgaagagtcgctatcatgcaaaagcgacttcaaaaatttaagattgcaaaagaaaaatatttagtatgtgaaactcatttagaaaccatagaagatgcggttagatatatctatgagcagtctatgacaatgagtaatcccagaagaaattggatttccaattag

SEQ ID NO: 26738 - protein, 237 aa, Unknown
  Obtained from environmental sample
  misc_feature (1)..(237): Xaa is any amino acid
MSTDELNINYTREAFMNPINLGGLLIATLTAFFISDYGDASSVMLTTVFGLELMYLGIVPKLPRFRKKTELKKIKERHASSNEKDLFQSLDSASQKRFLVLKHLAKMVQENFEKLPYSSQGLLDNIGKKIEELLGNYLTLLDLIKRYEVYLNTTLETNLKEEVIKQIEEIKTLESEKLKRTKARRVAIMQKRLQKFKIAKEKYLVCETHLETIEDAVRYIYEQSMTMSNPRRNWISN

SEQ ID NO: 26739 - DNA, 573 bp, Unknown
  Obtained from environmental sample
  misc_feature (1)..(573): n is a, c, g, or t
ttgggattacatgacaatgtggggcagttgctatctgttggcgatagtcaattgaaggtattgatgaatacagtcccagagacgtatcacaacccgataaaggaaataaaggttttggtgcaggaaactgtccaggaaatacgatcgctttctaaagtactcaataacgatgtagtcttgaaaaatggactaataaaatcacttcaagtggaactggaccgatttaaccgtttggactatttgaaagcttccttggaaatctccggagatatagtaccattgaacaatgctagcgaaatcattatcttccgcatcatccaggaattcctttcaaacgttatcaaacacgcaaaggcttcaaaattattcgtacatttagattataaagataaaacacttgaaatatcagccaaagatgatggggttggtttcaatacctcaaagaaaacagacagttccggaatggaaacaatgaatagtcgtgctgagctactgaacgctgaactttctattgtttcagagataggaaagggtacaaggttatttataaaatatccctataaaagcatataa

SEQ ID NO: 26740 - protein, 190 aa, Unknown
  Obtained from environmental sample
  DOMAIN (97)...(188): Histidine kinase-, DNA gyrase B-, and HSP90-like ATPase
  misc_feature (1)..(190): Xaa is any amino acid
MGLHDNVGQLLSVGDSQLKVLMNTVPETYHNPIKEIKVLVQETVQEIRSLSKVLNNDVVLKNGLIKSLQVELDRFNRLDYLKASLEISGDIVPLNNASEIIIFRIIQEFLSNVIKHAKASKLFVHLDYKDKTLEISAKDDGVGFNTSKKTDSSGMETMNSRAELLNAELSIVSEIGKGTRLFIKYPYKSI

SEQ ID NO: 26741 - DNA, 729 bp, Unknown
  Obtained from environmental sample
  misc_feature (1)..(729): n is a, c, g, or t
atgaggaagctaaaggattataaagcgtatgattttcaagaaatttcttatgaaatagaaggagatattagagaaacagaatttaatggaattatagaggaagcagcaagtaaatacaattttgatgtaaaaaaacaaattttattacaagaagaagaaaataaaagactaaaagatcaaagaattttttggatcattggaattatagcattaataataatattgtcattaacatataaaattaagctaaaaactctaaaacaaaataacttagccttagaattaacacaagtagagttactccaaaatcaaaatttagataagttaaaatcggaatctcaagtccgtattttaaatgctactttagatggaaaagaatctgaaaggaagcaaattgcagaaactttacatgatagtgtaagtgcattattgtcttcagcaaaccttcatttacaagcaacaagaaagcagtttaatggaagtactcctgtagaaatcgaaaaaactcaagaaataattcaagaagcatctcaaaaaattagagatctatctcatacattagtgtcatcagtattgctgaaatttgggcttaagtttgcaataaaagatattgccgaaaaatattctaattcagttttaaatatagatacgaatatcaaaaatacaagaaggtatgagcagaatttcgaaattaacgtatataatattagttcagaaatttgccaataa

SEQ ID NO: 26742 - protein, 242 aa, Unknown
  Obtained from environmental sample
  misc_feature (1)..(242): Xaa is any amino acid
MRKLKDYKAYDFQEISYEIEGDIRETEFNGIIEEAASKYNFDVKKQILLQEEENKRLKDQRIFWIIGIIALIIILSLTYKIKLKTLKQNNLALELTQVELLQNQNLDKLKSESQVRILNATLDGKESERKQIAETLHDSVSALLSSANLHLQATRKQFNGSTPVEIEKTQEIIQEASQKIRDLSHTLVSSVLLKFGLKFAIKDIAEKYSNSVLNIDTNIKNTRRYEQNFEINVYNISSEICQ

SEQ ID NO: 26743 - DNA, 738 bp, Unknown
  Obtained from environmental sample
  misc_feature (1)..(738): n is a, c, g, or t
gtgtttatgcaacgtgaaacttggaaagcgtattcctttggtttatggataaccttaagtattgtaagcgtttttcatattatctatttctataaccgttaccaaaaaaataagataaaagagcaaaaagtaatagcaggtacggcaagtgctaaattcgatgctttaaaaaatcaattagacccacatttcttatttaatagtttaaatgtattaaccagtttaattgaagaaaatccggaaaatgcccaaaaattcacaacgtcattatcaaaagtgtaccgttatgtattagagcaaaaaaataaggaattagtaaccgtagatgaagaattaaaatttgccagaacttatatgtccttattaaaaatgcgttttgaggacagtattattttcgaaattccggatcaagcatccaatccagaaagtaaagtagtgcctttatcattgcaactacttttagaaaatgcagtaaaacataatatggtaacttcgagtaaaccgttgcatgttaaaatatatgaagatggtaaccatttggtggttatgaataatcttcaacccaagcaaattgtaaagaaaagtagtggcgtgggtttagagaacataaaacaacgttatcagctactttcaaataaaaaagtgatcatcaatcaacgagaaaaggattttgcagtcgctatcccaatgctcacaacacatttcaattatacatctgctcagccgattcaaagctga

SEQ ID NO: 26744 - protein, 245 aa, Unknown
  Obtained from environmental sample
  DOMAIN (52)...(135): Histidine kinase
  misc_feature (1)..(245): Xaa is any amino acid
MFMQRETWKAYSFGLWITLSIVSVFHIIYFYNRYQKNKIKEQKVIAGTASAKFDALKNQLDPHFLFNSLNVLTSLIEENPENAQKFTTSLSKVYRYVLEQKNKELVTVDEELKFARTYMSLLKMRFEDSIIFEIPDQASNPESKVVPLSLQLLLENAVKHNMVTSSKPLHVKIYEDGNHLVVMNNLQPKQIVKKSSGVGLENIKQRYQLLSNKKVIINQREKDFAVAIPMLTTHFNYTSAQPIQS

SEQ ID NO: 26745 - DNA, 873 bp, Unknown
  Obtained from environmental sample
  misc_feature (1)..(873): n is a, c, g, or t
gtggttgcttatgagctattatttcgtgatagtgataaaaactattttccagaaatatctgatggccaagcaacggcaaggttgatcatggaaaatcagcttaacttaggaacccgccatataacgtcaggtaaaaaagcgctgattaatataggaccagagtcgttaaaactcgatttatgtgcatttttaccctgtaaagatgtggtgattgagttactcgaaaccatagagcccacagacgataattatgagttatgccgtgatttatttcatagtaattataaattagcgttagatgattttgtgtacaccccacagtgggagcgttttttaaagctggtaaatctgattaagtttgatatacgccaaaccccattacctgaaattgcccaggttgttaaaaaactaaaaaaacataaaagaataaaaatacttgctgaaaaaatagaaacgcccgaggagtttgagcttgcctttaaaatgggcttcgattactttcaaggttatttttttgcaaagccaaccatgcttaaacaaaacgacatagactataattacgcgctggtaattgcaatttatgcagaagttatgaaacctaatccagatataactgtaatttctgggttatttgagcttgatgctgcgctggcatacaaactattgcgcttaattaatagtggtgtgtttcctattaaaagccaaatatcttcccttaaacaagcattagtatacttaggtcaggaacggttaaaaaagtttgtaagtttgatcgttactgcttatacagttaagtctaaccctgccgaaattaaggaaaatggtgctaagtcctggctcgccttttgtgaactaaatggcccccgcaaataa

SEQ ID NO: 26746 - protein, 290 aa, Unknown
  Obtained from environmental sample
  DOMAIN (1)...(175): EAL domain
  misc_feature (1)..(290): Xaa is any amino acid
MVAYELLFRDSDKNYFPEISDGQATARLIMENQLNLGTRHITSGKKALINIGPESLKLDLCAFLPCKDVVIELLETIEPTDDNYELCRDLFHSNYKLALDDFVYTPQWERFLKLVNLIKFDIRQTPLPEIAQVVKKLKKHKRIKILAEKIETPEEFELAFKMGFDYFQGYFFAKPTMLKQNDIDYNYALVIAIYAEVMKPNPDITVISGLFELDAALAYKLLRLINSGVFPIKSQISSLKQALVYLGQERLKKFVSLIVTAYTVKSNPAEIKENGAKSWLAFCELNGPRK

SEQ ID NO: 26747 - DNA, 534 bp, Unknown
  Obtained from environmental sample
  misc_feature (1)..(534): n is a, c, g, or t
atgataaaagtatttaaattagtagtagtcgcattgctatgtttggcttgtaaagaagaaaacaaggaagtagttaagcttgacacaaagttggacaacaataatcaagtgtttaactttatagatcaatttgatgggacgcaattaaacgatgctaattggaattacgatttaggagatggttgtccaaatttatgtggttggggtaataatgaaagacaaatttatactaaagaaaatgtatctgtaaaagacggtaatttaataataacagctactaaagattcgactggatattattcgggaaaaatcactagtaaagacaaaattgaatttcaatatggcacagtagaggttagcgctaaattgccaaaaggatcaggattatggcctgcattttggatgttaggtaatgatattgatactaatacttggccagcttgcggtgaaattgatattttagaatatgtaggtaaggcaccacatcaaattcatacgacgttacatacgcctgacagttatgtaaatctgtaa

SEQ ID NO: 26748 - protein, 177 aa, Unknown
  Obtained from environmental sample
  SIGNAL (1)...(18)
  misc_feature (1)..(177): Xaa is any amino acid
MIKVFKLVVVALLCLACKEENKEVVKLDTKLDNNNQVFNFIDQFDGTQLNDANWNYDLGDGCPNLCGWGNNERQIYTKENVSVKDGNLIITATKDSTGYYSGKITSKDKIEFQYGTVEVSAKLPKGSGLWPAFWMLGNDIDTNTWPACGEIDILEYVGKAPHQIHTTLHTPDSYVNL

SEQ ID NO: 26749 - DNA, 729 bp, Unknown
  Obtained from environmental sample
  misc_feature (1)..(729): n is a, c, g, or t
ttggatatgtttatttatcaagctggtaaaaagaaaaataaagccatttatagcttagaagatattgaagagtctcgctatttagtatcgaaagcacaacgtaacgcaagaaaaaacaaaatagacccttggttaactaaattgtatgaaaaagaaaacccatatctagttcaagaaaacacttatagagatcgcaatttagctttgttagactctatcggagttgcttccaacactgagtattttagagaaaacatgttgtacatacgcaatgccaatatggtacatgttttagactcattaatgctatcacaatccgtatttgcaggtgttggcgctgcacatttaccaggaaataaagggatgctaaaaatgcttgaagacaaaggttacacagtaaaacctttactatctaaacaaacgaccgtcgcacaaaccaaaaaagaacaaattgaagcatttattgcaccaactagcattacaaaacaaagtacacctgacggttttttaaccctaaaggcttttacggaactttatgagttttattatggtggtcaaaaatattacatatctccagacatgaccaatggtgcgtatttaactattagtaggtttaatacttttgattatttaccaaacgacaaagaaatttctttagatagattagataattttttatttgaggatattcctggagatattatcaaaaaagaaatactatccaatngn

SEQ ID NO: 26750 - protein, 243 aa, Unknown
  Obtained from environmental sample
  misc_feature (1)..(243): Xaa is any amino acid
MDMFIYQAGKKKNKAIYSLEDIEESRYLVSKAQRNARKNKIDPWLTKLYEKENPYLVQENTYRDRNLALLDSIGVASNTEYFRENMLYIRNANMVHVLDSLMLSQSVFAGVGAAHLPGNKGMLKMLEDKGYTVKPLLSKQTTVAQTKKEQIEAFIAPTSITKQSTPDGFLTLKAFTELYEFYYGGQKYYISPDMTNGAYLTISRFNTFDYLPNDKEISLDRLDNFLFEDIPGDIIKKEILSNX

SEQ ID NO: 26751 - DNA, 708 bp, Unknown
  Obtained from environmental sample
  misc_feature (1)..(708): n is a, c, g, or t
ttgctcggtgcattggtaattttatttttttatgacaataagattaaaaaacgcatccaaaaaatgaatttaacgttaaaggagtccaataagaagttgaaaattattgacaaagaacgtctcgaattcttctctatcttaagtcatgagctcagaactcctatttatggcattaatggtcttgccacattaattgaacaggaacaatcacctgaaaaaagaaaaggatacttgaacgcacttatttcttccagtaattatatttcagtacttatcgacaatgttttacaaatctcaaaattaaagtttgaaaataaaaaactacatctcaaacccaccgacatactaaagttggttaatagaatttcgaattcaataaaagtttcggcggatgaaaaaggactgatactttacaccaatgtagaaaaaaataattgggatgaatatttactcatcgacaaagtggttttaagtcaaatattaatcaacctatcttataatgccattagatatacctccaaaggctctgtatctattgaacttactgaacaaaagcgtaccaacactcatgttaatatactttttgagattaaagactcaggaataggaattccaaataaacccagggatatcattcttaatgcttttgaaaacaaaacctttctagaaaaaaacagtccggatcaggtccaggactctatattgtaa

SEQ ID NO: 26752 - protein, 235 aa, Unknown
  Obtained from environmental sample
  DOMAIN (152)...(230): Histidine kinase-, DNA gyrase B-, and HSP90-like ATPase
  misc_feature (1)..(235): Xaa is any amino acid
MLGALVILFFYDNKIKKRIQKMNLTLKESNKKLKIIDKERLEFFSILSHELRTPIYGINGLATLIEQEQSPEKRKGYLNALISSSNYISVLIDNVLQISKLKFENKKLHLKPTDILKLVNRISNSIKVSADEKGLILYTNVEKNNWDEYLLIDKVVLSQILINLSYNAIRYTSKGSVSIELTEQKRTNTHVNILFEIKDSGIGIPNKPRDIILNAFENKTFLEKNSPDQVQDSIL

SEQ ID NO: 26753 - DNA, 663 bp, Unknown
  Obtained from environmental sample
  misc_feature (1)..(663): n is a, c, g, or t
gtgacccacgctgaatttatcccttctgaattggtcttgaactaccctagaggtgaaaaggaactgttaggtcctttccataagtttatgactggagataccatcgattggtttgaaaaacgaggagttgcacttaaaatagaagaggatgggcggatgttcccgatttccgattcttcgcaaaccatcatcgattgttttttaaccgaggcggataagcataaggttgaggtgtgctataatgaaagtgtaaaaaagatagaaccgtcttctcagaatgaatccggagatatagagcatcattttaaaatcgaaacacaatccgacacatttttctgtaacaaactggttattgctacaggaagtaattctaaaatatggaaattgttagaagatatggggcatagtatttctaaagccgttccctcactttttacatttaatataaaagacgaacgaattaatgacattccgggcgtggtcgctcaaaacgtggacattaaagttgtcggtacagatttgttttctgaaggcccattactgatgacacatgtgggcatgagtgcgcccgccattttaaagctttctgcctatggtgcgattgaactggcacagcggaattataaatctgaaattgaaattattttgtcaaacaacttttga

SEQ ID NO: 26754 - protein, 220 aa, Unknown
  Obtained from environmental sample
  DOMAIN (2)...(220): HI0933-like protein
  misc_feature (1)..(220): Xaa is any amino acid
MTHAEFIPSELVLNYPRGEKELLGPFHKFMTGDTIDWFEKRGVALKIEEDGRMFPISDSSQTIIDCFLTEADKHKVEVCYNESVKKIEPSSQNESGDIEHHFKIETQSDTFFCNKLVIATGSNSKIWKLLEDMGHSISKAVPSLFTFNIKDERINDIPGVVAQNVDIKVVGTDLFSEGPLLMTHVGMSAPAILKLSAYGAIELAQRNYKSEIEIILSNNF

SEQ ID NO: 26755 - DNA, 537 bp, Unknown
  Obtained from environmental sample
  misc_feature (1)..(537): n is a, c, g, or t
ttgcccaaaaagtcgattgatgtggctatgtttaatggcttaaagccatggncggtaatggtaactatgatgcaaattgagtttcaaaatgccggttattcagataaaacaggtattgataagcaagtactcgcttacgccaaaaataaagatattaaagtaggggagctggagactcttgaacaacaactacaaatgtttgatggtatggaattattaagtaatgaaatgatcgcagaaacctttgagcagcttgccgacattaatacctactttattaagctagttgatgcctggaaaaatggcgatatgcaaactctaaccaattattacaatactagttttgatgatagtaattacggtgaaattagtgagcaagtaatgctcattaaccgcaacaacaactggattaaacaactaacaccacgtttagtaaacgagcaactatttattgccgtcggcgcactgcacttacctgaacaacacggcttacttaaacaattaaaagataaaggttttaacgttactcgtctttaa

SEQ ID NO: 26756 - protein, 178 aa, Unknown
  Obtained from environmental sample
  DOMAIN (1)...(173): GumN protein
  misc_feature (1)..(178): Xaa is any amino acid
MPKKSIDVAMFNGLKPWXVMVTMMQIEFQNAGYSDKTGIDKQVLAYAKNKDIKVGELETLEQQLQMFDGMELLSNEMIAETFEQLADINTYFIKLVDAWKNGDMQTLTNYYNTSFDDSNYGEISEQVMLINRNNNWIKQLTPRLVNEQLFIAVGALHLPEQHGLLKQLKDKGFNVTRL

SEQ ID NO: 26757 - DNA, 513 bp, Unknown
  Obtained from environmental sample
  misc_feature (1)..(513): n is a, c, g, or t
gtgcagttaaaagaaaatgttaccatcctttgtgttttaggcgatgatatacaaaaaactaaaactggtttattaaacttaaatgaaaaaatttataagaaatttatagattataaaaaattccaaattgtagctgtttatcctgaagaaagggaagaggaagttaaaaatctaaaggaagaaataggaacttttacagatatgcaaaagtggaattttatagcaagttcaaaacaagaaattgaaggtttttatgtgtcttttggtttaaatgaacctttaacaaacttatattcttcaaaagcatttttaattgataaagatgttaatctaagaggaagagtaactgataaagatagcaaagatggtaaactttatgggtataatatgaactctgttgctgttttaaacggaaaattaatagatgatattaaagttttgtattacgaatattatgctgcttttaaagaaaaaaataaaaataaagcagatagaaaagaagtagggttatga

SEQ ID NO: 26758 - protein, 170 aa, Unknown
  Obtained from environmental sample
  misc_feature (1)..(170): Xaa is any amino acid
MQLKENVTILCVLGDDIQKTKTGLLNLNEKIYKKFIDYKKFQIVAVYPEEREEEVKNLKEEIGTFTDMQKWNFIASSKQEIEGFYVSFGLNEPLTNLYSSKAFLIDKDVNLRGRVTDKDSKDGKLYGYNMNSVAVLNGKLIDDIKVLYYEYYAAFKEKNKNKADRKEVGL

SEQ ID NO: 26759 - DNA, 654 bp, Unknown
  Obtained from environmental sample
  misc_feature (1)..(654): n is a, c, g, or t
ttgaaaatgaaaaaagtgcttaaaagtgtcagttttgtctttttgcttctaaaaatgtgtatcgtttttggacaagaaatgagtgctcaaaaacgaataattatagacgttggacacggtggaaaagatgctggtgcaattggtataaataaaatccaagaaaaggacattgtaatgaatatagcgaatgccattttgaaactgaataatgaactagataacccattagatatttatttatccaggtataaggacacacttatttcattatcggatagagccaaacttgctcagcttctaaaagctgatttgtttgtgtctttgcattgcaatcattcggacaatccggatgctaaaggaattgaagtttatgctccaaagaaacacggggaatactctaaggaatctgtttttgtaggctatcaaattgaaaaaatgctctgtatagcgataggatatgaaagtaggggtgtgaagtttgcaaactttcaagtgcttcgagaaacagttggtttttgtccttcggtgcttttagaattgggatttttgagtaataaagatgagaacttttatctaagaaaacctgaaacgcttagaactatagcattgattattttagtgggattgaacaactatttaaatgctggattatga

SEQ ID NO: 26760 - protein, 217 aa, Unknown
  Obtained from environmental sample
  DOMAIN (94)...(214): N-acetylmuramoyl-L-alanine amidase
  misc_feature (1)..(217): Xaa is any amino acid
MKMKKVLKSVSFVFLLLKMCIVFGQEMSAQKRIIIDVGHGGKDAGAIGINKIQEKDIVMNIANAILKLNNELDNPLDIYLSRYKDTLISLSDRAKLAQLLKADLFVSLHCNHSDNPDAKGIEVYAPKKHGEYSKESVFVGYQIEKMLCIAIGYESRGVKFANFQVLRETVGFCPSVLLELGFLSNKDENFYLRKPETLRTIALIILVGLNNYLNAGL

SEQ ID NO: 26761 - DNA, 552 bp, Unknown
  Obtained from environmental sample
  misc_feature (1)..(552): n is a, c, g, or t
gtgccatttacaagctctgttcttttaggatatattcaaaaaaagcggtttaaaacgaaactttggatgcatattcaagattttgaatttgatgcagctctacaaacaggtgtcggtaataataaaaatatagtattttcattattatttaggctagagaaatggcttttttctaaagcagatcttgcgagtactattagttatagtatgctcgacaggctttcagaaaaaacgaaatccgagcagtattttttacctaattggattgatgaagaaaaaattaatccgctaaattctaaaacacatcattatctaaaatcagaaaaaactaaaattctgtattccggtaatattggtgataagcaagactgggatgcgttcattcagttttgtaaagacataaataaaagtaaatatgaaattgttatcgtaggtgatggctctaaaaaagattggatttgtaaagaaattcaatcttttgattatgtcaaatattatccaccagttccttttgatgaactatccgatctgctatgcagtgccgatgttccn

SEQ ID NO: 26762 - protein, 184 aa, Unknown
  Obtained from environmental sample
  misc_feature (1)..(184): Xaa is any amino acid
MPFTSSVLLGYIQKKRFKTKLWMHIQDFEFDAALQTGVGNNKNIVFSLLFRLEKWLFSKADLASTISYSMLDRLSEKTKSEQYFLPNWIDEEKINPLNSKTHHYLKSEKTKILYSGNIGDKQDWDAFIQFCKDINKSKYEIVIVGDGSKKDWICKEIQSFDYVKYYPPVPFDELSDLLCSADVP

SEQ ID NO: 26763 - DNA, 819 bp, Unknown
  Obtained from environmental sample
  misc_feature (1)..(819): n is a, c, g, or t
ttgtgttttttacttatcactattcttaagtttactgtatattatttattgcaaaagtatagaacctcttttgntggtaattttaggtctacggtcattttggggttgaacaaaaaaaccatagccttagagagcttttttaataaaaacccagaatatggttattcacaccaaaaaaccttcaattttaaaaataaagaacgttcgttagaggagtgttttcaatatattctagatgaaggtgtagatgaaatttattgttcaatttcagagttgagcaatgctcaaattgcagatattgtagattttgctgataataatcttaaaatcttaaagtttattccagatagtaaggagatttatgctaaaaaattacgttacgagtattatgactatattccaattttaacgttaagaaatattccattagaggattctgtaaatacgtttataaaacgcggttttgatattttgttctctagtatagtgattgtctttgtattatcttggctaacaccaataattgctattttgataaaattagaatccaaaggcaatgtgttttttaaacaatctagaaatgggttcaattataaagagtttgattgttacaaatttaggtctatgatgcccaataaagatgcacatttatatcaagcgacaagaggggatcaacgtgtaaccaaagtgggtaaatttattaggaaaactagtattgatgagcttcctcaatttttcaatgtattgtttggcgatatgtcagttgttggaccaagcncacacatggttagtcatacaaccatctcggccgattcttga

SEQ ID NO: 26764 - protein, 272 aa, Unknown
  Obtained from environmental sample
  DOMAIN (152)...(271): Bacterial sugar transferase
  misc_feature (1)..(272): Xaa is any amino acid
MCFLLITILKFTVYYLLQKYRTSFXGNFRSTVILGLNKKTIALESFFNKNPEYGYSHQKTFNFKNKERSLEECFQYILDEGVDEIYCSISELSNAQIADIVDFADNNLKILKFIPDSKEIYAKKLRYEYYDYIPILTLRNIPLEDSVNTFIKRGFDILFSSIVIVFVLSWLTPIIAILIKLESKGNVFFKQSRNGFNYKEFDCYKFRSMMPNKDAHLYQATRGDQRVTKVGKFIRKTSIDELPQFFNVLFGDMSVVGPSXHMVSHTTISADS

SEQ ID NO: 26765 - DNA, 345 bp, Unknown
  Obtained from environmental sample
  misc_feature (1)..(345): n is a, c, g, or t
ttggaattaataaattacataaaaggagacgcaacaagtcctgttggaattgacaaaaagttaattgttcatatctgtaatgatattggagcttggggaaaaggatttgttttggcaatttccaaaagatggaaaaaacctgaaaaagaatatcgtgaatggtttaaatcacaagaaaaatttgaattgggagaagtacaatttgtgaatgttgaatctgatataacaattgcaaatatgattggacaacataaaataaagaaaacgaatagacaaattccaattcgttacgaagcagtaaaaagttgtcttgagaaagtttctgttttttcgagagnaaaataa

SEQ ID NO: 26766 - protein, 114 aa, Unknown
  Obtained from environmental sample
  misc_feature (1)..(114): Xaa is any amino acid
MELINYIKGDATSPVGIDKKLIVHICNDIGAWGKGFVLAISKRWKKPEKEYREWFKSQEKFELGEVQFVNVESDITIANMIGQHKIKKTNRQIPIRYEAVKSCLEKVSVFSRXK

SEQ ID NO: 26767 - DNA, 483 bp, Unknown
  Obtained from environmental sample
  misc_feature (1)..(483): n is a, c, g, or t
gtgagggaaataactggcagcaatgttgagaaaattgtccgaaaggccaatgccccgattattgtggtcaaagaagaggaagtaacatttccctttaaggacattctattcgtatcagattttgaagaagatgtgagtcatccgtttcaagaagtactttcgatagctgaaaaatgtgatgcaaaaattcatttgttacgcataaatacagaaacagactttaacagtatagaagttggattaaaccctgttaaggaattccttgaaaaatttcccgacctaaaaaaattttctatgagtgttcataacgaatcttcagtagaggcaggtattaatacatttctaaaacatcagccatcagatttaattgcgatgagtacccacggaaagacaggatttttgagcttattttcaaaaagtattgccgaaggtgtaaccaatcattcagaacttcctgtaatgaccatacatattacaaaatga

SEQ ID NO: 26768 - protein, 160 aa, Unknown
  Obtained from environmental sample
  DOMAIN (31)...(157): Universal stress protein family
  misc_feature (1)..(160): Xaa is any amino acid
MREITGSNVEKIVRKANAPIIVVKEEEVTFPFKDILFVSDFEEDVSHPFQEVLSIAEKCDAKIHLLRINTETDFNSIEVGLNPVKEFLEKFPDLKKFSMSVHNESSVEAGINTFLKHQPSDLIAMSTHGKTGFLSLFSKSIAEGVTNHSELPVMTIHITK

SEQ ID NO: 26769 - DNA, 741 bp, Unknown
  Obtained from environmental sample
  misc_feature (1)..(741): n is a, c, g, or t
ttggatagtgattgtttattgccaagtcattacttgcaggaagtagaagctagcttaaaacttaactatgtagattgttttggtggaccagataaagcacaccattcgtttactaatctacaaaaagcaatagattttagtatgacgtctgtaattacaacaggaggtattagaggcaataaaactagtttagataagtttcagcctagaagctttaatatgggattatcaaaaaaggcttttaatgctacaaaggggtttggaaatattcatcctggagaagatcccgatttatccattagattatgggatttaggttttaatacaatgttaatacctgaagcttatgtgtaccataaaagacgtatatcttggagcaaattttataaacaagttaataagtttggatcagtcagacctattttaaatacatggcatccacaaactaaaaaagtcacctattggtttccaacaatgttttttattggagttattatagctttggttttaacactgtttaatctatttttaccattatacttagtgttattttattattgtctaatctttgttgtagcagtattaaaaactaaaaatattattattgcttttcaggctttattagcagtatccattcagttttttggatatggttacggatttttaaagtcaacaatattattacattttaagtcagaaaaacccgaagtaatttttcctcatttattttttaaaaattaa

SEQ ID NO: 26770 - protein, 246 aa, Unknown
  Obtained from environmental sample
  misc_feature (1)..(246): Xaa is any amino acid
MDSDCLLPSHYLQEVEASLKLNYVDCFGGPDKAHHSFTNLQKAIDFSMTSVITTGGIRGNKTSLDKFQPRSFNMGLSKKAFNATKGFGNIHPGEDPDLSIRLWDLGFNTMLIPEAYVYHKRRISWSKFYKQVNKFGSVRPILNTWHPQTKKVTYWFPTMFFIGVIIALVLTLFNLFLPLYLVLFYYCLIFVVAVLKTKNIIIAFQALLAVSIQFFGYGYGFLKSTILLHFKSEKPEVIFPHLFFKN

SEQ ID NO: 26771 - DNA, 768 bp, Unknown
  Obtained from environmental sample
  misc_feature (1)..(768): n is a, c, g, or t
gtgattctaaactcacatccaatggttgagttattgaatgaagaaaactcgatagttggttttccttattctaaatatgtatcatcagcaaaaacaagagctttaattgatgcaggaaaaatacaagaaattggaaaagaaagttcgctaaacacagaaatcttattggatttacaaccagaattagtggttggctatagtgtttcttctgctgataaatctctaacaaccattcaaaaatctggcataaaagtaatttataatggagattggctagaagaaactcctctaggaagagctgaatggattaagttttttggagttttgtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggacgtttatctttgagttttgaaagtgtttttgataaaggccaaaatgccgattattggattactcctggttatttttcatcaaaagaacagcttttacatagtcatgaactctataagacatttactgcttttcaaaacgacaaaatctatacaccaatccttacaacccgtgacccaggtggcgcaatttactatgaattagcacgcaacagaccanna

SEQ ID NO: 26772 - protein, 256 aa, Unknown
  Obtained from environmental sample
  DOMAIN (5)...(239): Periplasmic binding protein
  misc_feature (1)..(256): Xaa is any amino acid
MILNSHPMVELLNEENSIVGFPYSKYVSSAKTRALIDAGKIQEIGKESSLNTEILLDLQPELVVGYSVSSADKSLTTIQKSGIKVIYNGDWLEETPLGRAEWIKFFGVLFDKEKQADSIFKVIEANYLDAKQIALKSTKKPTILSGAIMSKDIWNLPAGESFVAQFLIDANLDYLWKNTEGKGRLSLSFESVFDKGQNADYWITPGYFSSKEQLLHSHELYKTFTAFQNDKIYTPILTTRDPGGAIYYELARNRPX

SEQ ID NO: 26773 - DNA, 570 bp, Unknown
  Obtained from environmental sample
  misc_feature (1)..(570): n is a, c, g, or t
ttgctttctaataaatatgatataactgcctatcgaaaatctggattaagacatcatttatttaaaggaaaaataacagactcagcaatattaaatcttgaaaatcaaaaatcaacggctctactaaaattaattaaacaacgtaggaagattaaaaatgactctttaaattctaaatttaaaaggaactttatgaaagggtttaatgcaggtaaatacgataaaagcatattgaatctagacgattatatgatgtataaaagggatagtacgataaagatgtggaataaaagaattgatattgaaaaagagaaaaaaatattacaaatacaaacatcattattagacgctaatcaaatacttattgatggtatctcgtataatgattcattaaaatgtaaattttatacccatcctaatatgaatgagaaggggttgctgtgctatttccctactgatagcataaacaaaggagaacaccttttaacccttcattataaaacatatgataaagaagcaatagattcgcttaaaacaagatctattcatattcctttttggaaattttaa

SEQ ID NO: 26774 - protein, 189 aa, Unknown
  Obtained from environmental sample
  misc_feature (1)..(189): Xaa is any amino acid
MLSNKYDITAYRKSGLRHHLFKGKITDSAILNLENQKSTALLKLIKQRRKIKNDSLNSKFKRNFMKGFNAGKYDKSILNLDDYMMYKRDSTIKMWNKRIDIEKEKKILQIQTSLLDANQILIDGISYNDSLKCKFYTHPNMNEKGLLCYFPTDSINKGEHLLTLHYKTYDKEAIDSLKTRSIHIPFWKF

SEQ ID NO: 26775 - DNA, 738 bp, Unknown
  Obtained from environmental sample
  misc_feature (1)..(738): n is a, c, g, or t
ttggagcttgatcggctcgagcggatgatacagagtatcgaaagaaaaatattaattgatgttctaaatcataatgaagaacaagcatataatcttttgaacaaagctttaaaaatatctaaagattttttaaaaaccccaagactaaaaagcacagaaactgaatactttggtaattttcttgatggagctagagagcaagcacaattgtattcaagaataaagtctataattttaaataaaaattcggagaacctttactctccagttttcaaaagtatttattccaattctacagaactaatgaatgaaaaaacaagtacagttctaaatgtagtgatgaagaaatttccagatatttcaaaaaatgtggaaatagagaaatttattgaatttaaacaagacccagaaactaaattaaaattatcaagattgagaaattgggttttagaaataagccaaaaacaatataataataaagagatagagcaaaaaattgactacttactatcagaatattcaaatcatcttgaattacataagataaagtacgaaatgaataccctgcaaactttagtagttacatcgctagaagttttagaaaacgctttgcagttaaaatttagtaaagctgctaaagtaatttttgacttgaaaaaacaggatattactctgctggaatctgaagaaaaattcacaggaaatgcgcttgctttaatacataaaataaataaataa

SEQ ID NO: 26776 - protein, 245 aa, Unknown
  Obtained from environmental sample
  misc_feature (1)..(245): Xaa is any amino acid
MELDRLERMIQSIERKILIDVLNHNEEQAYNLLNKALKISKDFLKTPRLKSTETEYFGNFLDGAREQAQLYSRIKSIILNKNSENLYSPVFKSIYSNSTELMNEKTSTVLNVVMKKFPDISKNVEIEKFIEFKQDPETKLKLSRLRNWVLEISQKQYNNKEIEQKIDYLLSEYSNHLELHKIKYEMNTLQTLVVTSLEVLENALQLKFSKAAKVIFDLKKQDITLLESEEKFTGNALALIHKINK

SEQ ID NO: 26777 - DNA, 561 bp, Unknown
  Obtained from environmental sample
  misc_feature (1)..(561): n is a, c, g, or t
ttgattggaggtaaactgattgctggagacagcaccaagatgcgagctcagaatagtaaaaaaaataattttaacccaaagaaaatagatcgccatattgcttacatagaccgaaagttagaagtgcatagtaaagaattagcaattgctgatgatgattctaaaaagaaaataaatcaagaaatagaaaaacatactaagcgaagagaaaattacaaacaaatcgataaacagctcgaagagagtggaactactcaggtatcaacatctgatccagaaagtcgccaaatgaccatccgcaataacattaccgaggtcgcctataatattcaaacctccgtagatcacaaacactgcattcctatagatttcaaagtcaccaacaccaacgacagtaaagctatgggtgctatgctaaggcgttccaaaactatcttgcgcagtaatgaatttacagcactttacgacaaaggctaccatacgggaagtgagtttaaacagcggatatttagctataacgtgctagtagctataccaggtgtagcctcgagccgatcttga

SEQ ID NO: 26778 - protein, 186 aa, Unknown
  Obtained from environmental sample
  misc_feature (1)..(186): Xaa is any amino acid
MIGGKLIAGDSTKMRAQNSKKNNFNPKKIDRHIAYIDRKLEVHSKELAIADDDSKKKINQEIEKHTKRRENYKQIDKQLEESGTTQVSTSDPESRQMTIRNNITEVAYNIQTSVDHKHCIPIDFKVTNTNDSKAMGAMLRRSKTILRSNEFTALYDKGYHTGSEFKQRIFSYNVLVAIPGVASSRS

SEQ ID NO: 26779 - DNA, 384 bp, Unknown
  Obtained from environmental sample
  misc_feature (1)..(384): n is a, c, g, or t
ttgtattcttcaggaatatgtttgtacattttacgattgtaccacgataaaaacttacgtaaaaacttctgtttaccttccgaagggactaattctcttattttatttaaaaaaacagcttcttgtttatacattaagctatccgataaaagacctgtgattaagcctatttctaacggatttccttcaacatataattcccaaagtccctgtttgtttttggttaaaaaattatttcctacaaaaaaagtagaatcgtttatgctttgttttattggaatagtggttttgtatttggaaatatctggacggttattaaccgatttattaataccgcaagaacacaaaaagctcgctaagacagcaagtacaaacaccttgtaa

SEQ ID NO: 26780 - protein, 127 aa, Unknown
  Obtained from environmental sample
  misc_feature (1)..(127): Xaa is any amino acid
MYSSGICLYILRLYHDKNLRKNFCLPSEGTNSLILFKKTASCLYIKLSDKRPVIKPISNGFPSTYNSQSPCLFLVKKLFPTKKVESFMLCFIGIVVLYLEISGRLLTDLLIPQEHKKLAKTASTNTL

SEQ ID NO: 26781 - DNA, 360 bp, Unknown
  Obtained from environmental sample
  misc_feature (1)..(360): n is a, c, g, or t
atgttaatcattggattaatagaagctggattatttataactggttactttttagtaaacaatcaaaataacgtaaataaaaaaatagaacaatttgaaagtaataaagacaactatttaaagactgacaaaatagttgtggataaaaacctgaaagccttttttatccttaaattaatttatgccataacgtttataaccttagctattgtgttatctaagattaaccttaaacccatctattttggcatatttacagctttaatgatccatctagctgctgctattgtaattgatacatttggagaacgttatactaaaatatataagaccaatattgaaactacattaacattataa

SEQ ID NO: 26782 - protein, 119 aa, Unknown
  Obtained from environmental sample
  misc_feature (1)..(119): Xaa is any amino acid
MLIIGLIEAGLFITGYFLVNNQNNVNKKIEQFESNKDNYLKTDKIVVDKNLKAFFILKLIYAITFITLAIVLSKINLKPIYFGIFTALMIHLAAAIVIDTFGERYTKIYKTNIETTLTL

SEQ ID NO: 26783 - DNA, 330 bp, Unknown
  Obtained from environmental sample
  misc_feature (1)..(330): n is a, c, g, or t
atgccctgtaccttggaatgtgcattacttgccaaaataatggaattttcagggacttccggcaacttcatcataatgaatacacagggcggtaaacggcgtttttcgatgtttaaaaaatggacgttccattccatatgcagttacttcaatgggcttggatatcccaaactccaatccattgtcactaagtgccacctttccacctgccactaccgtggctacctgcatcccccaacaactgccgtagaacggtacgccactttcaaaaacctcatcggcaaaattcaattgtccatgaacatccggaatatcatcaagaacacttag

SEQ ID NO: 26784 - protein, 109 aa, Unknown
  Obtained from environmental sample
  misc_feature (1)..(109): Xaa is any amino acid
MPCTLECALLAKIMEFSGTSGNFIIMNTQGGKRRFSMFKKWTFHSICSYFNGLGYPKLQSIVTKCHLSTCHYRGYLHPPTTAVERYATFKNLIGKIQLSMNIRNIIKNT

SEQ ID NO: 26785 - DNA, 711 bp, Unknown
  Obtained from environmental sample
  misc_feature (1)..(711): n is a, c, g, or t
atgcccacaatttgtttggaatctcataatattgataatctcttctttggttttggtcagtttaactaccaccttattaaagggttttatgagaatcaagctattttagaagcattggatttccatatcacccttattagtaaacatcctgaaaagctggaagatgaatttggcagtacgttttcatataaaaaatataattcattacagcgaagaaaactattccgaattaaaaaacaattcgacttatggcattccttaaatcaaaataccaaagttgaaccctttaaaaatataccatatgtattaacggttcatgatgtcaacttcatggaagaattatcgggaaagaagttagataaacgcgttgcactttttaatgctaaactaaagcgaagtcatgcaattacctatatttcagaatatgcaaaaagaatgacacatacctattttaaagtaccaaatattcctgaatatgttatttataatggtagctccaaaccttttgagttagctaaaaaccatacccctgaattacttccaaaaggcgaatttctatttacaattggtgaacttttagaaaaaaagaattttcacacattagtaaatatgcttgctcatcttcccgaattgagtttgataatttctgggaaaaacacaacggattacgctaaaaagctcatgaaattatttgctgatttaaacctttga

SEQ ID NO: 26786 - protein, 236 aa, Unknown
  Obtained from environmental sample
  misc_feature (1)..(236): Xaa is any amino acid
MPTICLESHNIDNLFFGFGQFNYHLIKGFYENQAILEALDFHITLISKHPEKLEDEFGSTFSYKKYNSLQRRKLFRIKKQFDLWHSLNQNTKVEPFKNIPYVLTVHDVNFMEELSGKKLDKRVALFNAKLKRSHAITYISEYAKRMTHTYFKVPNIPEYVIYNGSSKPFELAKNHTPELLPKGEFLFTIGELLEKKNFHTLVNMLAHLPELSLIISGKNTTDYAKKLMKLFADLNL

SEQ ID NO: 26787 - DNA, 480 bp, Unknown
  Obtained from environmental sample
  misc_feature (1)..(480): n is a, c, g, or t
atgaactcagtattagaaacctcaaaaaaactccgaaaatcaaaaccctcagaacttcaagaaattgtagcattagcaaataaaacattcgatactttttaccgcccttttttaggcgaacataatgttgattggtatgtcggtagtggtgagcttaaacgagagattgttaaacattctaatgatttacatgttctactgattaataatgaaattaaggggtttgccatttattttgatgactttatccatatcatgatgattgatgaagatgcacatcgcttaggaatgggatcatttttaatgactgcagttgaagatcaattgtttaaaaatcatgacaacataaaactacaatcttttgttggaaataaaattgcaacagcattctatttaaaaaatggatggaaaaaaggagctgtaaacaacaatgctcgtaaagatatagccatgatgtattttgaaaaggaaagacgttaa

SEQ ID NO: 26788 - protein, 159 aa, Unknown
  Obtained from environmental sample
  DOMAIN (64)...(137): Acetyltransferase (GNAT) family
  misc_feature (1)..(159): Xaa is any amino acid
MNSVLETSKKLRKSKPSELQEIVALANKTFDTFYRPFLGEHNVDWYVGSGELKREIVKHSNDLHVLLINNEIKGFAIYFDDFIHIMMIDEDAHRLGMGSFLMTAVEDQLFKNHDNIKLQSFVGNKIATAFYLKNGWKKGAVNNNARKDIAMMYFEKERR

SEQ ID NO: 26789 - DNA, 414 bp, Unknown
  Obtained from environmental sample
  misc_feature (1)..(414): n is a, c, g, or t
ttgatacaaatgaaagaaattaaattcaaatttgaagatttaaaactttatcaaaaagctttagattttgttgataatacttataaagtaactgaaaattttcaaagtaatgaaaactttagtcttacatctcaatttagaagagcttcaatatctattgctttaaatatagctgaagtttcaggagatactaatgcacaattcaatagatttttaaatattgccaatggctcaattaaagaatgtgttgtttgttcatctattgctaaacgtctaaattatgttagtaatgaaatagattatagtaatagactaaaattagaagagttatcaaaaatgacagcaagtttaaagaaatacttaatgtcaaacaataaaaagactaacgaccaaagactatcaactaatgactaa

SEQ ID NO: 26790 - protein, 137 aa, Unknown
  Obtained from environmental sample
  DOMAIN (10)...(120): S23 ribosomal protein
  misc_feature (1)..(137): Xaa is any amino acid
MIQMKEIKFKFEDLKLYQKALDFVDNTYKVTENFQSNENFSLTSQFRRASISIALNIAEVSGDTNAQFNRFLNIANGSIKECVVCSSIAKRLNYVSNEIDYSNRLKLEELSKMTASLKKYLMSNNKKTNDQRLSTND

SEQ ID NO: 26791 - DNA, 864 bp, Unknown
  Obtained from environmental sample
  misc_feature (1)..(864): n is a, c, g, or t
gtgtttttcacatcttcgattatggttaatcaagaaaaaagagaaagaagagatgaaaagaccgattcactttcactttcaaagaagaccaaactgcttaagccaagagataagttaaagccagatactataagtattactataaaagattataaaataatcactttcgagagagacacaatctttttagataccacacttaccattcaaaaagaatacaagtataattatttgcgtgaagatgattttgaactaatgtcattctctaatattgggcaggcgtataataatcttggtgttgatttagagagaataaatatttatccaagtttgggagcaacggcaaaggatagaaaatatcttgaaaaggagcagataaattattacaatgttgccactccaatgaccgaactattctttaaaacgacactagaacaaggtcagttgttagatgcgaatttaacgttcaatacttccagaaggcttaatttttccataggttatacaggccatcgttctttgggtaagtataataaaagtcaaatactatcgggtaattttattacaacttccaactatttatcaaaaaatggaaggtattccttaagggggcacatcgctgcccaagatattttatcccaagagaatggtggtctttcaaacaaagtaactcaatttgaatctggtgacaagaatttcatcaatagacctagggtagatgtatttatatacaacgcctacaattatatattagctaatctatattactcggatcatatatacatattggtcagtaatcaattagatccaactcgttctgaaaaacatcactttccatactcgagccgattcttgatcccgtag

SEQ ID NO: 26792 - protein, 287 aa, Unknown
  Obtained from environmental sample
  misc_feature (1)..(287): Xaa is any amino acid
MFFTSSIMVNQEKRERRDEKTDSLSLSKKTKLLKPRDKLKPDTISITIKDYKIITFERDTIFLDTTLTIQKEYKYNYLREDDFELMSFSNIGQAYNNLGVDLERINIYPSLGATAKDRKYLEKEQINYYNVATPMTELFFKTTLEQGQLLDANLTFNTSRRLNFSIGYTGHRSLGKYNKSQILSGNFITTSNYLSKNGRYSLRGHIAAQDILSQENGGLSNKVTQFESGDKNFINRPRVDVFIYNAYNYILANLYYSDHIYILVSNQLDPTRSEKHHFPYSSRFLIP

SEQ ID NO: 26793 - DNA, 516 bp, Unknown
  Obtained from environmental sample
  misc_feature (1)..(516): n is a, c, g, or t
atgaaagaaatctacgagcctaaatttgttgaaaaactatgtgacaaaatgagtagttcgtattcaaaaatgaattacataacttcatttggatttagcgaaagatggagaagacaatgcgttgaggaaattgaaatcgagaaaggtaaaacagttgtcgatttaatgactggaatgggagaatgttggaaacatattctaaaaaaatcggacaaaaactcaaaattaatcggacttgacttctcaaccgaaatgataaatcgtgcggagaaaaataaaggaaagttcgaaaaatcaaagattgaaattcttaaagaaaacgtctttgaaaactcaatagcaaacgaaacagcggattttgtcatttcgggttttggattaaagacatttaatgatgaacaacttggaaaagtagcaaacgaaattgaccgaattctaaaaccaaacggaaaattttcgctaattgatgtttctgttccaaatagtaaatttctaaaaccattttatatgttttaa

SEQ ID NO: 26794 - protein, 171 aa, Unknown
  Obtained from environmental sample
  DOMAIN (1)...(171): ubiE/COQ5 methyltransferase family
  misc_feature (1)..(171): Xaa is any amino acid
MKEIYEPKFVEKLCDKMSSSYSKMNYITSFGFSERWRRQCVEEIEIEKGKTVVDLMTGMGECWKHILKKSDKNSKLIGLDFSTEMINRAEKNKGKFEKSKIEILKENVFENSIANETADFVISGFGLKTFNDEQLGKVANEIDRILKPNGKFSLIDVSVPNSKFLKPFYMF

SEQ ID NO: 26795 - DNA, 324 bp, Unknown
  Obtained from environmental sample
  misc_feature (1)..(324): n is a, c, g, or t
atgatagaaattttatcacacatctccaattatttaaacagcctggattgggcttacattttcacattcatcgtcattgcttatggtctcaaccattaccgctcaactaacttcttttatgaagtttttaagctgaaaatagccacgcgttatcgcgttcttatcattggcattatttacggagtcgctttgtatttcataagaggttatcagatcaagatgattgaatgtttattacaatcgtttgcttttgcgctggtgtttcataaactcctattagagaaatttttaaacaaactatttcaaacgaaacccaaggagtaa

SEQ ID NO: 26796 - protein, 107 aa, Unknown
  Obtained from environmental sample
  misc_feature (1)..(107): Xaa is any amino acid
MIEILSHISNYLNSLDWAYIFTFIVIAYGLNHYRSTNFFYEVFKLKIATRYRVLIIGIIYGVALYFIRGYQIKMIECLLQSFAFALVFHKLLLEKFLNKLFQTKPKE

SEQ ID NO: 26797 - DNA, 339 bp, Unknown
  Obtained from environmental sample
  misc_feature (1)..(339): n is a, c, g, or t
gtggatccaagaancggctccagagcatcacgtggaactaagactataatactcagcattgttcaccatgacaaattaaaagcgtattttaagtcaggattgcaggtttataatgaaaaagacattttagcctccggaggtcttattttaaggccagaccggattgtagtcaacaacgcgcgtcaagcggttatcattgattacaaaacgggtactgcccatataaaccatcataatcaacttaacgaataccaaactattctcgaagaaatgggttttagtgtggcaaaaaaaatacttgtttacataaatgaggacattcaaataaaagaattttaa

SEQ ID NO: 26798 - protein, 112 aa, Unknown
  Obtained from environmental sample
  misc_feature (1)..(112): Xaa is any amino acid
MDPRXGSRASRGTKTIILSIVHHDKLKAYFKSGLQVYNEKDILASGGLILRPDRIVVNNARQAVIIDYKTGTAHINHHNQLNEYQTILEEMGFSVAKKILVYINEDIQIKEF

SEQ ID NO: 26799 - DNA, 729 bp, Unknown
  Obtained from environmental sample
  misc_feature (1)..(729): n is a, c, g, or t
gtgccttacaaattaaatgggtattggtatataactagatacgaaattggaaaggattacccaatttacactagaaaaaagattaatcttgacgttgaagaagaaattctttttgattgtaataaaatggctaaaggctatagctattttaaactaggtggtatctcaattagtccagataacacattagtaagctattctattgatactgttagcagacgacaatacacattgtttattaaaaacttagttacaaatgaagtttttgaggataaaatagaaaataccacaggaagctcaacttgggctaatgataacaaaacactgttttattctaaaaaagacgaagttactttacgatcggataaaatatataagcataaactaggtcaaaatagtgttgatgacactgtcgtttttcatgaagaggatgacacctttaatacatttgtgtataaaaccaagtcaaaaaagtatttagtaattggaagttcaagtacgcaaacaaccgagtatagatttttagatgccgatacacctgatggtgaatttaaaatttttcaagagcgcgaaagaaaccttgaatattcaatagctcactatcaagatcatttttacatcattacaaataaggatgaagcaaccaattttaaacttcaaaaagtagccgaaaccaatacagataaggtaattgggaggatgtattncgctcctcaagattattattag

SEQ ID NO: 26800 - protein, 242 aa, Unknown
  Obtained from environmental sample
  DOMAIN (1)...(238): Prolyl oligopeptidase, N-terminal beta-propeller domain
  misc_feature (1)..(242): Xaa is any amino acid
MPYKLNGYWYITRYEIGKDYPIYTRKKINLDVEEEILFDCNKMAKGYSYFKLGGISISPDNTLVSYSIDTVSRRQYTLFIKNLVTNEVFEDKIENTTGSSTWANDNKTLFYSKKDEVTLRSDKIYKHKLGQNSVDDTVVFHEEDDTFNTFVYKTKSKKYLVIGSSSTQTTEYRFLDADTPDGEFKIFQERERNLEYSIAHYQDHFYIITNKDEATNFKLQKVAETNTDKVIGRMYXAPQDYY

SEQ ID NO: 26801 - DNA, 798 bp, Unknown
  Obtained from environmental sample
  misc_feature (1)..(798): n is a, c, g, or t
ttgtgctatactaaaaactatttcgcccaaaatagtacagcagataaaaatgcaataaaattaaagaaatttgatagccaaactaattataaaatatttaagccaaatagtttagtgtttgacgatttgggttggttatggatatcaggtatcaatttaaaactggtaaatgaagaaataaacaatcgctcagcaattattcaacgttatgatggaaatagattttacaccgttaaagtcccttttttcttaaatactaaacctacagaaatagaacttattaagagacaagatggtaaattctattgtatttttaaattcaaaaatcaaaaaaaactctttcttcttaatccagaaacattagtttttcaagaaataaaacttcctttttctgaaaaacaccaagacatttgtctcttttcttataaaaattattttatagtttttttaagaagcaatgaggaaacaaaaatttatcgtttaaataagcagttacagttttctcttttcaacaaaaaacctattatttctaaagataaaaaaacaattgcttatttcaataattttattggtttagatactcattttttagttagcgatttacgatctggaatttacatttacaaagaaaatggagatcttttaaagatgataacaccattagatatcggttttaaaaacaatgaaattggttcttttttacatattaaaacttggtttaaaaaagacaataaaatttttatttcttttttaggggttgataaactttatcaatatcacccagaaaaaatgccataa

SEQ ID NO: 26802 - protein, 265 aa, Unknown
  Obtained from environmental sample
  misc_feature (1)..(265): Xaa is any amino acid
MCYTKNYFAQNSTADKNAIKLKKFDSQTNYKIFKPNSLVFDDLGWLWISGINLKLVNEEINNRSAIIQRYDGNRFYTVKVPFFLNTKPTEIELIKRQDGKFYCIFKFKNQKKLFLLNPETLVFQEIKLPFSEKHQDICLFSYKNYFIVFLRSNEETKIYRLNKQLQFSLFNKKPIISKDKKTIAYFNNFIGLDTHFLVSDLRSGIYIYKENGDLLKMITPLDIGFKNNEIGSFLHIKTWFKKDNKIFISFLGVDKLYQYHPEKMP

SEQ ID NO: 26803 - DNA, 591 bp, Unknown
  Obtained from environmental sample
  misc_feature (1)..(591): n is a, c, g, or t
ttgtctattgtaaatcatcctaaatatggagttttattgggcaatcattcaggaaaattattccaattcaatttaaaaaatagtagcttttcattgctttatgaagatgaattaaaatcgagtattgccactattttatttgatgataaagatactatttggctaaatacgtttaatggtcttgttttattagatgaaaataaaaatttaatttccagatttacaatgaacgatggtttaagtttttatgaagcaaatagatacagtgcattaaaaacaactgatgggcattttttagtaggcactttgctaggattaaattattttgatccaaatgaaatttctaaaattgaaattgatgcaaccttaaaattaaccgctacaagttatttcgataaaaaaaataagaaagaaattgaggaaaaatcaccacaaaaattggcggaattaaaatcaatttcactatctccagaaagcaacaatttacagttccagtttagtttatttggaatttataattcagaaaaaataagttatagatatcgattaaatgaaaattcttggataagtttgctaatcaatcagaattga

SEQ ID NO: 26804 - protein, 196 aa, Unknown
  Obtained from environmental sample
  misc_feature (1)..(196): Xaa is any amino acid
MSIVNHPKYGVLLGNHSGKLFQFNLKNSSFSLLYEDELKSSIATILFDDKDTIWLNTFNGLVLLDENKNLISRFTMNDGLSFYEANRYSALKTTDGHFLVGTLLGLNYFDPNEISKIEIDATLKLTATSYFDKKNKKEIEEKSPQKLAELKSISLSPESNNLQFQFSLFGIYNSEKISYRYRLNENSWISLLINQN

SEQ ID NO: 26805 - DNA, 543 bp, Unknown
  Obtained from environmental sample
  misc_feature (1)..(543): n is a, c, g, or t
ttggctaagatgaattataaaccacctagaatagcagagaagatcctatctaaacttcagtacgatgatgtttggaaaaccaccctaggggatttcgaagaatattataaacacctcttagctaaaaaaggaaaagcacatgctaatcgatggtactggaatcaagtgctgagatatgcaccatcaaaaatcatacataaactttattggagtggtgagatgttcaaaaactatcttaaagtcgcttatcgaagtatttctaaaaacaaaagttattcttttatcaatatctttgggcttggcattgggcttgccagcttcttaatgattggaatttatattaaccaagaacttagctatgacgatttccacgaagactctgatcaaatttatcgaattgttcgacaaatacccgacagtcggtttctgcgaacaaactgctatggggtaagccaactccctctttctattggcttgtccgataattctcacgtattgaatcttcgactgctttggaaacgactggcgctcatcaaatcccng

SEQ ID NO: 26806 - protein, 181 aa, Unknown
  Obtained from environmental sample
  misc_feature (1)..(181): Xaa is any amino acid
MAKMNYKPPRIAEKILSKLQYDDVWKTTLGDFEEYYKHLLAKKGKAHANRWYWNQVLRYAPSKIIHKLYWSGEMFKNYLKVAYRSISKNKSYSFINIFGLGIGLASFLMIGIYINQELSYDDFHEDSDQIYRIVRQIPDSRFLRTNCYGVSQLPLSIGLSDNSHVLNLRLLWKRLALIKSX

SEQ ID NO: 26807 - DNA, 378 bp, Unknown
  Obtained from environmental sample
  misc_feature (1)..(378): n is a, c, g, or t
gtgagacaaaaaaatgatactcaaaataaaataagaatccatttctacaagcgcgcagaaaatggtaaacctacaaaagaaagattttttaaagatgatttaattttcgaacttccgtataaatctaaagaattaagtgttgatctttcttacttaaattttaaaattcctaaaaatggtttctatcttggtatcgaatttatgggtaataaaactaatcagttgaatagtgaaacaactatattttatactgacgatttaaaaggctatagaacatatattagaacttggggaaatgattggttaaacacaagtaaatatacatcaagaagaacaaaatactataatttaaagtatagctatagtattatagaatga

SEQ ID NO: 26808 - protein, 125 aa, Unknown
  Obtained from environmental sample
  misc_feature (1)..(125): Xaa is any amino acid
MRQKNDTQNKIRIHFYKRAENGKPTKERFFKDDLIFELPYKSKELSVDLSYLNFKIPKNGFYLGIEFMGNKTNQLNSETTIFYTDDLKGYRTYIRTWGNDWLNTSKYTSRRTKYYNLKYSYSIIE

SEQ ID NO: 26809 - DNA, 381 bp, Unknown
  Obtained from environmental sample
  misc_feature (1)..(381): n is a, c, g, or t
ttggatgccaaacgtcctaatgatgttgttaacgtaactttattacgtgatggacaaactaaggaggttgctgttactttactaaaaaacaacacctatattttacctgttattggtgttattaaaaatgcaaaaccagaagacttaaaaaaatacaaaactaaaaatggtgtaaaaattactaaagtaaatggtacctatggtcaatatttacaaagggaaggtattgaagctggtaacataattactgccattaataacgtaaaagtaaatactattgaagatgttgataacgttttaaaaaacagagacacgtatcaaccattaagcatcgagctaataaactccaaaggagagaaaaacagatatggtctaagataa

SEQ ID NO: 26810 - protein, 126 aa, Unknown
  Obtained from environmental sample
  misc_feature (1)..(126): Xaa is any amino acid
MDAKRPNDVVNVTLLRDGQTKEVAVTLLKNNTYILPVIGVIKNAKPEDLKKYKTKNGVKITKVNGTYGQYLQREGIEAGNIITAINNVKVNTIEDVDNVLKNRDTYQPLSIELINSKGEKNRYGLR

SEQ ID NO: 26811 - DNA, 585 bp, Unknown
  Obtained from environmental sample
  misc_feature (1)..(585): n is a, c, g, or t
ttgaacattgcacttggtaaaaacaagcaatctgcagatttctggagaggtgaagaagctattgttataaactctgaattagagtctataaaaaatcgtttagataatgctgaaaaagaaattgaagttttaaaaacagaacaaagttctcctaacaaagaacttattatgactgaattagataatagatacgttaaaaaaggcgaaactaattatggtgatgttgtaacaagctctaacgtagattttattaaagaacttttaaatagaggatatgtaaatgtattttttgacataaacagtactaaaattcagaaagaatctttatcatctgtaaattatttaagacaatttttatatgacaatccttatgtaaatgcttcattaattggttttacagacgaaactggtagcgaagaacgaaaacaaactttatctaacaatagagcaaaagctgtttttgatatgttagttgcttctggaattagtccaaatagattgtcttatggtggtgttggtgaagacaaaacaatgtcaaaaggtgctagacaattagcaagaaaagttacttttaaaattaactaa

SEQ ID NO: 26812 - protein, 194 aa, Unknown
  Obtained from environmental sample
  DOMAIN (96)...(191): OmpA family
  misc_feature (1)..(194): Xaa is any amino acid
MNIALGKNKQSADFWRGEEAIVINSELESIKNRLDNAEKEIEVLKTEQSSPNKELIMTELDNRYVKKGETNYGDVVTSSNVDFIKELLNRGYVNVFFDINSTKIQKESLSSVNYLRQFLYDNPYVNASLIGFTDETGSEERKQTLSNNRAKAVFDMLVASGISPNRLSYGGVGEDKTMSKGARQLARKVTFKIN

SEQ ID NO: 26813 - DNA, 696 bp, Unknown
  Obtained from environmental sample
  misc_feature (1)..(696): n is a, c, g, or t
atgtcggggaaacctgttgctgaacaagaaattggacaggcattactacaagaagttgttgcatttgccgagacttctatttctagacgtaaatttatattgcattattttggggaagagtttgataatgaaacaggtgaaggtggcgacttagacgataacatgcgttttcctaaaaagcaacacgaagctaaggagaatgttaaattattacttgaaatagttaagaaaactatggaaaagtacaagtctaaagatttggtaaatgttattataggtaaagaaaatgccttaataaaatctcataaaactgaatccaaacctttttttggaactggtaaacataaagaaaacacttattggatggctttaatacgccaaatattagtggctggatatcttaaaaaagatattgaaacttatggtgttataaaaattacgaaagcaggcttggattttataaagaatccgacatcatttatgatgacagaagatcatttatttaacgaaactcgcgacgatagtattgttaccgcatctaaaggtggcggtgcagtagtagacgagcagttaataaaattgcttaaaaatttacgtaaaaccaatgcgaaaaaacttggagttccaccttttgtgatatttcaagatccgtctttagaagatatggctttaaatatccctcgagccgattcttga

SEQ ID NO: 26814 - protein, 231 aa, Unknown
  Obtained from environmental sample
  misc_feature (1)..(231): Xaa is any amino acid
MSGKPVAEQEIGQALLQEVVAFAETSISRRKFILHYFGEEFDNETGEGGDLDDNMRFPKKQHEAKENVKLLLEIVKKTMEKYKSKDLVNVIIGKENALIKSHKTESKPFFGTGKHKENTYWMALIRQILVAGYLKKDIETYGVIKITKAGLDFIKNPTSFMMTEDHLFNETRDDSIVTASKGGGAVVDEQLIKLLKNLRKTNAKKLGVPPFVIFQDPSLEDMALNIPRADS

SEQ ID NO: 26815 - DNA, 669 bp, Unknown
  Obtained from environmental sample
  misc_feature (1)..(669): n is a, c, g, or t
ttgagaacggatttctatttcggaacacctaaagagaaaatgtatttaggaaaattgttaaaagtagattatccccaattgtattttgtagttgatgaagaaagaattgatgaagtaaaagagaatgtttcagagagaaccataaaagcaattttcccagacctaaaaggcgaaaaagataaaataaaacgattagaagatacggttcttaaacttgattcaaaagaaaaactaccgaacaacaacgcaaaagaatttttatacgattcatcaaaagcaaaaggcattgaaaacattgattacttgctaaataaaacaagtctcgaatggcgggaatttgaagataacctcttttcagtatctctaaatgaatcgcaaagacaagcgatttacaaatcactatatgctgaagaattggctttgatacaaggtccgccaggaacaggaaaatcaactgccattgccgaaattatttggcaacatataagaaaagaacaaaatcaaaacattcttttgacttctgaaaccaatcttgctgttgataatgcgattgacagacttaaaaacgaacagaacaatctcgttaaaccaattcgttttggaaatgaagaaaagttggattcagaaggatatttttactcactttctgccattgaaagttgggaangn

SEQ ID NO: 26816 - protein, 223 aa, Unknown
  Obtained from environmental sample
  misc_feature (1)..(223): Xaa is any amino acid
MRTDFYFGTPKEKMYLGKLLKVDYPQLYFVVDEERIDEVKENVSERTIKAIFPDLKGEKDKIKRLEDTVLKLDSKEKLPNNNAKEFLYDSSKAKGIENIDYLLNKTSLEWREFEDNLFSVSLNESQRQAIYKSLYAEELALIQGPPGTGKSTAIAEIIWQHIRKEQNQNILLTSETNLAVDNAIDRLKNEQNNLVKPIRFGNEEKLDSEGYFYSLSAIESWEX

SEQ ID NO: 26817 - DNA, 315 bp, Unknown; identical to SEQ ID NO: 24389
  Obtained from environmental sample
  misc_feature (1)..(315): n is a, c, g, or t

SEQ ID NO: 26818 - protein, 104 aa, Unknown; identical to SEQ ID NO: 24390
  Obtained from environmental sample
  misc_feature (1)..(104): Xaa is any amino acid

SEQ ID NO: 26819 - DNA, 774 bp, Unknown
  Obtained from environmental sample
  misc_feature (1)..(774): n is a, c, g, or t
atgaactatcaaacatttcaaccaaattctgatttggaatcgcttgtcagttgctattggactttagaagttcctgctgaacctgatgtgcaaaaacaacgaattattcctgatggcacaattgaaatggcttttatacttggagacgacattaaaagatacacttcggaagatgaattcattatacaacctcgtgcaatggtcctcggacagacaattgaacccttttacattgaaccaacaggatttgtaaacacttttgcaattcgtttttacccttacggttttgcaaattttgtaaatattccaattaagaatttggcaaataaggaaacacctattagcctattgttcggagaaaaaaccgctaatgaattggagcgaaaaataattgaggcaacaaatagtgttgaacgaatagaaattattgaaaactttcttttagataagttaaacaaaaaaactacagttgacagtattgtaaaaactacgattgatgcacttttagcaacaaaaggaagttcttcaataagcagaattcttaaagaagatttatcaaaacgtagacaacttgaacgaaattttaaaaaacaaattggcgttagcccaaaacagttgggtaaagtaatccgactgcaaactgcactaaaaatacttcttaataaaaagtcagaaanactgaccgacattgcttacgaaagtgaatactttgaacaagcacattttacaaaagactttaaagagtttaccggaattaatccgaaggaattttnn

SEQ ID NO: 26820 - protein, 258 aa, Unknown
  Obtained from environmental sample
  misc_feature (1)..(258): Xaa is any amino acid
MNYQTFQPNSDLESLVSCYWTLEVPAEPDVQKQRIIPDGTIEMAFILGDDIKRYTSEDEFIIQPRAMVLGQTIEPFYIEPTGFVNTFAIRFYPYGFANFVNIPIKNLANKETPISLLFGEKTANELERKIIEATNSVERIEIIENFLLDKLNKKTTVDSIVKTTIDALLATKGSSSISRILKEDLSKRRQLERNFKKQIGVSPKQLGKVIRLQTALKILLNKKSEXLTDIAYESEYFEQAHFTKDFKEFTGINPKEFX

SEQ ID NO: 26821 - DNA, 558 bp, Unknown
  Obtained from environmental sample
  misc_feature (1)..(558): n is a, c, g, or t
gtggctattgaaaatgaaaataatagttgggaattaaatgaaaccacttcgcatttaataaacaatacagatgttaatcatttaattgaaagactaacctacacgtttactaacaacaacaaatctaaagatgttttattagatttaatgatacaagaattgattgttaggctacttcaaactaaagcaaaatcattaattataaacgatcctaatcagatttttaacgatactagaattggaacggttattaaatttattaaagacaatttaaccaataaagatatcagcgtagacttattggcaaaaaaagcatacatgagtacgtctcacttccataaacagtttaaaaacaccttaggcatctctcctattgattatataaattcagaaaaaattaaattttctaaaaaactgattaaagaatctaaagattttagaatgtccgaaattgcatttaaatctggatttaataacaccagttattttaaccgacagtttaaaaaaatggaactaatgacgccacaggaatttaaggcctctatcaataaatcttaa

SEQ ID NO: 26822 - protein, 185 aa, Unknown
  Obtained from environmental sample
  DOMAIN (135)...(180): Bacterial regulatory helix-turn-helix proteins, AraC family
  misc_feature (1)..(185): Xaa is any amino acid
MAIENENNSWELNETTSHLINNTDVNHLIERLTYTFTNNNKSKDVLLDLMIQELIVRLLQTKAKSLIINDPNQIFNDTRIGTVIKFIKDNLTNKDISVDLLAKKAYMSTSHFHKQFKNTLGISPIDYINSEKIKFSKKLIKESKDFRMSEIAFKSGFNNTSYFNRQFKKMELMTPQEFKASINKS

SEQ ID NO: 26823 - DNA, 633 bp, Unknown; identical to SEQ ID NO: 22403
  Obtained from environmental sample
  misc_feature (1)..(633): n is a, c, g, or t

SEQ ID NO: 26824 - protein, 210 aa, Unknown; identical to SEQ ID NO: 22404
  Obtained from environmental sample
  DOMAIN (15)...(208): LysE type translocator
  misc_feature (1)..(210): Xaa is any amino acid

SEQ ID NO: 26825 - DNA, 486 bp, Unknown
  Obtained from environmental sample
  misc_feature (1)..(486): n is a, c, g, or t
gtgattaacaaatcaaatttaaatattgaccttaaacttaagttaaatatttatggtgatcaatttgtatacccagactttcaaagatttagatacaaaggcgtgcctaaactttttgaaatgcatcggggtactttgcttaaccgagacaaccaaattattaagtggtatcaagcattcaaagctaatacagaatatactgacacaacaatgaataccctttttagaacatttacacggtatgtgaatatttgtgacagtattccagtaaatccagattcaaaagagggtatcaatgcatttgaaacagctctagttcacagcgttagaattggcagcaaaagttcaaacacagcaaaaggtgaattaagtagtataagaacaataatgaagatgctagatcaccctgttgatgagtggttttctaaattcaaactatttcgcagccaaataatccaactcaagcatactcagaatctgaattga

SEQ ID NO: 26826 - protein, 161 aa, Unknown
  Obtained from environmental sample
  misc_feature (1)..(161): Xaa is any amino acid
MINKSNLNIDLKLKLNIYGDQFVYPDFQRFRYKGVPKLFEMHRGTLLNRDNQIIKWYQAFKANTEYTDTTMNTLFRTFTRYVNICDSIPVNPDSKEGINAFETALVHSVRIGSKSSNTAKGELSSIRTIMKMLDHPVDEWFSKFKLFRSQIIQLKHTQNLN

SEQ ID NO: 26827 - DNA, 612 bp, Unknown
  Obtained from environmental sample
  misc_feature (1)..(612): n is a, c, g, or t
atgaaatcaaataaaaaagtgtttttattaaaaaacagtaccttatcatctaaaaattttttaaattttaggaatgatactacaactgtgtttaagaagaacaactattctttctggttattaaaaaatataatacacacaaacattgcacctgatattgcattttgtaaaaaacgaaaaaactctataattattccttatgaatacaaagaaactattacaaatagtaaactaactactaacgtaatagaaaagaatttaaaattttattatacttttttttatgataattatttttcatctgctagcacaacatccagatctagtgattggtacttccctaaactatcaaaaagtctagaattaatattcctaaatttaaaggatgttgcgcaagtagaaaagtatagaaaaaacataaaagaaaaagatatttttaaatttgaattgattaccaataaaagagatacctcatccataggaaacacaaaaaatgtaaattattttaacgacatccctaatgttcttaaggaaaatacatatatgggtgaggatatctttattaattttaatagtaacataaacaataatagaggtattttattctgctga

SEQ ID NO: 26828 - protein, 203 aa, Unknown
  Obtained from environmental sample
  misc_feature (1)..(203): Xaa is any amino acid
MKSNKKVFLLKNSTLSSKNFLNFRNDTTTVFKKNNYSFWLLKNIIHTNIAPDIAFCKKRKNSIIIPYEYKETITNSKLTTNVIEKNLKFYYTFFYDNYFSSASTTSRSSDWYFPKLSKSLELIFLNLKDVAQVEKYRKNIKEKDIFKFELITNKRDTSSIGNTKNVNYFNDIPNVLKENTYMGEDIFINFNSNINNNRGILFC

SEQ ID NO: 26829 - DNA, 432 bp, Unknown
  Obtained from environmental sample
  misc_feature (1)..(432): n is a, c, g, or t
atgaagaaaaaagcaattatagtttcaggatattttaatccaattcacaaaggtcatttagagtattttaatagcgcaaaagcattggcagatgaattatttgtcattgtgaatagcgatttacaacgaggtttaaagggatctaaagaatttcaagatcaagatgagcgtttatttattgttcaaaatataaaaggagtagataaagctatcatatctatagatacagatagaactgtttgtgaatcgattcgaagtcttgttgaaaactacaaaaatgaatatgattttggctttgcaaatggtggagatcaaaataacaattctatcccagaagctccaatttgtaaggagttgaatattgaattgattgatgggttaggagataaaatacaatcatcatcttggttattaggaaaaaaatacatatga

SEQ ID NO: 26830 - protein, 143 aa, Unknown
  Obtained from environmental sample
  DOMAIN (7)...(140): Cytidylyltransferase
  misc_feature (1)..(143): Xaa is any amino acid
MKKKAIIVSGYFNPIHKGHLEYFNSAKALADELFVIVNSDLQRGLKGSKEFQDQDERLFIVQNIKGVDKAIISIDTDRTVCESIRSLVENYKNEYDFGFANGGDQNNNSIPEAPICKELNIELIDGLGDKIQSSSWLLGKKYI

SEQ ID NO: 26831 - DNA, 546 bp, Unknown
  Obtained from environmental sample
  misc_feature (1)..(546): n is a, c, g, or t
ttgaaaaaattaggtactaaaattggctctaacgagagtagcatttatcgttattttgaaagcaaacacaaactactaatctacctgacttcttggtattggagctggttagaatatcaattggtttttgctactaacagtattgcaaatccgagacaaaaaattgaaaaagctattgaggtccttacacaatcagcaactttagactctaatttctctcatatcgatgaggtacttttaaaacgtattgtaattaacgaatactctaaatcatacctaactaaagaggtcgataacgaaaataaggaaggttactttctagtatacaaaagactggttacacgactacatgatatggtattaaccattgataaggattattcgtatgcctttagtttatcaagtactgttattgatggtgcattgcatcaacattttttaaaagaccattttactactatatctgatcttaaaaaatcagacgatcctactaactattttaaagatttagttttcaaaacccttaacatctcaacaaatgagtaa

SEQ ID NO: 26832 - protein, 181 aa, Unknown
  Obtained from environmental sample
  misc_feature (1)..(181): Xaa is any amino acid
MKKLGTKIGSNESSIYRYFESKHKLLIYLTSWYWSWLEYQLVFATNSIANPRQKIEKAIEVLTQSATLDSNFSHIDEVLLKRIVINEYSKSYLTKEVDNENKEGYFLVYKRLVTRLHDMVLTIDKDYSYAFSLSSTVIDGALHQHFLKDHFTTISDLKKSDDPTNYFKDLVFKTLNISTNE

SEQ ID NO: 26833 - DNA, 669 bp, Unknown
  Obtained from environmental sample
  misc_feature (1)..(669): n is a, c, g, or t
gtggatagaggtcttacggattttgttgatggtaaaagtgttgctatttataaattaacaagcaatgaaattaaagacttaggacatcacttaatctcaaaaatcagatataatgttagttataactcaagaggagattattcatctacagctataaatgaaatttctaattttaaaaaggattatagatacccggataagccaaattattttttaacatctaatgaagtaagtagtttgtttgttaaagattatagtggtgaatacacaagtaataaaactgtatttaaaaatgaagtaaatccaaaacagaattttattgaagaaacacgctttaatattgctttagcgttcaaaaacaacaatgacggtatgataattatacaagacccaagaattcctgatagaccattatcttatagaataacaggatttgttgaagaaaaagaacttgatggatataatatgattatataccattgtgtaagtgatgtcacagacttaaaaaatgaagctattttattttccaatgaaaatggtcttagcttgatgattaatactaagacgaatatgcaggcttggtataacttaaagaataattactgtggatgcattttagaagacaaaaaaaacatcgtggtagtattcgagctatcgcgtaagttgtag

SEQ ID NO: 26834 - protein, 222 aa, Unknown
  Obtained from environmental sample
  misc_feature (1)..(222): Xaa is any amino acid
MDRGLTDFVDGKSVAIYKLTSNEIKDLGHHLISKIRYNVSYNSRGDYSSTAINEISNFKKDYRYPDKPNYFLTSNEVSSLFVKDYSGEYTSNKTVFKNEVNPKQNFIEETRFNIALAFKNNNDGMIIIQDPRIPDRPLSYRITGFVEEKELDGYNMIIYHCVSDVTDLKNEAILFSNENGLSLMINTKTNMQAWYNLKNNYCGCILEDKKNIVVVFELSRKL

SEQ ID NO: 26835 - DNA, 708 bp, Unknown
  Obtained from environmental sample
  misc_feature (1)..(708): n is a, c, g, or t
atgttggaaaagattattttcatgcaagcgagtgaatttttaagaaaagaactggaattacaaaacgtaaataaatatacgactagcgaatggttagacgaaaatatcgaagtactttctaaaaagcaccgttattattcggcttacgctataaaaaattggtcgacgaaaaagaataaaaatctaattgatttattagaaacaaaaaacaaaaagaaacgaaaagcggataaagaaaaactaaaagcaaaatataaagcacattataaaaatgaaagcccagaacgtggtattcaaacattttatcgcgtagctttaagaaaccatattaaacttagtgatattgccgatacaaaagccaatattttactgtcggtaaatgctattattatttcggtagtattagctaatttaatttctaaattagattctaatccttatttaacaacaccaactgttatatttaccttgtttagtgtaacctctatgatactctctattattgctacacgcccgaatataacgagtggcgagttcactaaagaagatgttgaaaaccaagatgtaaaccttactttntttgggaacttccataaaatggatcttaaagaatttgaatgggctatatcagaattactcacggataaaaactatgtatacacttctttaactaaggatttatacttcttaggaacagtcttagattga

SEQ ID NO: 26836 - protein, 235 aa, Unknown
  Obtained from environmental sample
  misc_feature (1)..(235): Xaa is any amino acid
MLEKIIFMQASEFLRKELELQNVNKYTTSEWLDENIEVLSKKHRYYSAYAIKNWSTKKNKNLIDLLETKNKKKRKADKEKLKAKYKAHYKNESPERGIQTFYRVALRNHIKLSDIADTKANILLSVNAIIISVVLANLISKLDSNPYLTTPTVIFTLFSVTSMILSIIATRPNITSGEFTKEDVENQDVNLTXFGNFHKMDLKEFEWAISELLTDKNYVYTSLTKDLYFLGTVLD

SEQ ID NO: 26837 - DNA, 474 bp, Unknown
  Obtained from environmental sample
  misc_feature (1)..(474): n is a, c, g, or t
atggtcgatataaatcttagaaatttcacactgaaggattcagacaataatctggtctttatccctaataagaccatcttggagacaccaatgagaaactattcattgacgccatatattagagtggatgtgtcttntgggttaggttatgaatcggatctggaatttgtagaaacattaaccaagagaacgctagaacagacgtttaaaaaaattgacgacatgaaacctgttgaattctttttcaccgaatttggagacagttctatcaactttaaatgtcgtttctggattgaaggcaccaaaaatgtccataaactcaatgccaccaataaagcgataatcgccattaaaaaagcgtttgatgctgaaggcatcaatataccattccctattagaacgctgcagtttaacaatcaattgacggtgaacaaaaaccctgataaaagcgaggaagaatccaccaacgagtaa

SEQ ID NO: 26838 - protein, 157 aa, Unknown
  Obtained from environmental sample
  DOMAIN (2)...(129): Mechanosensitive ion channel
  misc_feature (1)..(157): Xaa is any amino acid
MVDINLRNFTLKDSDNNLVFIPNKTILETPMRNYSLTPYIRVDVSXGLGYESDLEFVETLTKRTLEQTFKKIDDMKPVEFFFTEFGDSSINFKCRFWIEGTKNVHKLNATNKAIIAIKKAFDAEGINIPFPIRTLQFNNQLTVNKNPDKSEEESTNE

SEQ ID NO: 26839 - DNA, 387 bp, Unknown
  Obtained from environmental sample
  misc_feature (1)..(387): n is a, c, g, or t
atggaattcaaaaatgtaaaaaaaagaaaagcagatattttgtctgccgtactttggatggtatttggattatctttctttttaattgaaaatcacgaaaactatgtactacaattattagccatacctatggtaatattttatttgtattcttatttttttgataaaagagatttatataaaatagaggacgatactattaaaatcgttggttggtttgctaaatcttttgatttaaatgaattaaatagagttaatcgaaatgattatggattaaaattagtctctgataatcgaaatgattttttaattgacagaagactattatctattcaggactttaaaactattgaatacattatagttaaatatgagtctaagacttaa

SEQ ID NO: 26840 - protein, 128 aa, Unknown
  Obtained from environmental sample
  misc_feature (1)..(128): Xaa is any amino acid
MEFKNVKKRKADILSAVLWMVFGLSFFLIENHENYVLQLLAIPMVIFYLYSYFFDKRDLYKIEDDTIKIVGWFAKSFDLNELNRVNRNDYGLKLVSDNRNDFLIDRRLLSIQDFKTIEYIIVKYESKT

SEQ ID NO: 26841 - DNA, 651 bp, Unknown
  Obtained from environmental sample
  misc_feature (1)..(651): n is a, c, g, or t
atgatctgtcagttatactataaaaaagtagttgtgattacactatgtgtggttgtattcatgggttcatgccggcaatcggcagaaaagcaattgcctgtgtacaatccttcagattttaatcaggtcttagttgataaaagtttacacaatatcagtaaagatcatacagttgcagatttcaacttaataaatcaaaacggaaaaacggttacgcaagaagattatcaagacaagatctatgttgccgatttcttttttacgagttgccagggtccttgtccaattatgaccggtaatatggcaaaagttcaggaggcctttgtaacgaatgatgacatcatgttcttatcactgtcggtaacgccggatatagacagcatccctaaacttcgtgaatatgcttcgcaaaaaggggtgattgattcaaaatggaatgttaccaccggagaaaaaaaacatatctatgaactggcacgaaaaagctattttgccgtggaagagcgaggtgatggaggcttacaggattttattcatacgtctaattttatcctggtcgataaaaagaaacgaattcggggcatttatgacggtaccgataataaagaaatacgtcgattaatttatgatatcaacatgttgataaattga

SEQ ID NO: 26842 - protein, 216 aa, Unknown
  Obtained from environmental sample
  DOMAIN (17)...(199): SCO1/SenC
  misc_feature (1)..(216): Xaa is any amino acid
MICQLYYKKVVVITLCVVVFMGSCRQSAEKQLPVYNPSDFNQVLVDKSLHNISKDHTVADFNLINQNGKTVTQEDYQDKIYVADFFFTSCQGPCPIMTGNMAKVQEAFVTNDDIMFLSLSVTPDIDSIPKLREYASQKGVIDSKWNVTTGEKKHIYELARKSYFAVEERGDGGLQDFIHTSNFILVDKKKRIRGIYDGTDNKEIRRLIYDINMLIN

SEQ ID NO: 26843 - DNA, 603 bp, Unknown
  Obtained from environmental sample
  misc_feature (1)..(603): n is a, c, g, or t
gtgttaggtaaaaaatcgttgccaaaagatcactataatctttttaaagccaccaccaaattttcatatgtcaagttaaacgatttgagaactaaaaatggacattttgatgagaaagaattatcaaaattgaaaaaacaaggtaaacatactttctttgaaagcattcacaaccttttagattccgatattataattcataaaaatcaaatacaaaacattgaaaaagaattagttgggattcctcaaggcttaccgataagtgctttactagctaatatctatatgttacctttcgatgaagctattaccgaagaactaacaaaaaagcatgacgttttctacagaaggtattctgatgatataatagttatctgtaaagaaaatcaaattaaaagaattgaatcattcgttaaaaaagaaataaataaaatcaatctaacaatttccttagataaaactgaaaaatcactttttaaaattaataatggacgccttcagtcatacaaaattgatggcgaagatttgatagaaaatatcccgttgaactacttagggtttgaatttaatggttatcaaacattgataaaatcaaaaaattag

SEQ ID NO: 26844 - protein, 200 aa, Unknown
  Obtained from environmental sample
  DOMAIN (1)...(189): Reverse transcriptase (RNA-dependent DNA polymerase)
  misc_feature (1)..(200): Xaa is any amino acid
MLGKKSLPKDHYNLFKATTKFSYVKLNDLRTKNGHFDEKELSKLKKQGKHTFFESIHNLLDSDIIIHKNQIQNIEKELVGIPQGLPISALLANIYMLPFDEAITEELTKKHDVFYRRYSDDIIVICKENQIKRIESFVKKEINKINLTISLDKTEKSLFKINNGRLQSYKIDGEDLIENIPLNYLGFEFNGYQTLIKSKN

SEQ ID NO: 26845 - DNA, 360 bp, Unknown
  Obtained from environmental sample
  misc_feature (1)..(360): n is a, c, g, or t
atgaattggatagaaataaaggcattgcacaggctctatgagactggagaagtaaaactgaataagacaataagtaaaagtcccgtttttaaaaatcacgagacagctttagaaattaagcgtaatagaaaaacatttagtcgaaatcaagattttatagaggtctatgaaaataagtatctagaaaaatacaagcactataatacttttttagatagtgaaaacctattgaagcctcaacttaggtttgaagaaaacgatataaaattactaatagactttaaagaaggtattaaagatggaagtctaaaaaaactaaaaacggatcttgtagaagctcaagagagtttcacgttctga

SEQ ID NO: 26846 - protein, 119 aa, Unknown
  Obtained from environmental sample
  misc_feature (1)..(119): Xaa is any amino acid
MNWIEIKALHRLYETGEVKLNKTISKSPVFKNHETALEIKRNRKTFSRNQDFIEVYENKYLEKYKHYNTFLDSENLLKPQLRFEENDIKLLIDFKEGIKDGSLKKLKTDLVEAQESFTF

SEQ ID NO: 26847 - DNA, 318 bp, Unknown
  Obtained from environmental sample
  misc_feature (1)..(318): n is a, c, g, or t
ttgggcattggcaggttgtctataacatccaaagaaaaaagagacggtttacgatttttaatactggaggaagtatctaatttagatgatgacaatttcaacaccttccctcaaattgctcaaaaatatggttatcaaattataacaatgacaccagagccatttggttctaatacagaagatggttggtatttgcatcaacttcttgaaggtaaaacagacaaaaatcgtaattatcccattcctaatagtagctttaaaacaaactataaaaacgaacagttacaggggtatttaaaaagaaaggctactaaatga

SEQ ID NO: 26848 - protein, 105 aa, Unknown
  Obtained from environmental sample
  misc_feature (1)..(105): Xaa is any amino acid
MGIGRLSITSKEKRDGLRFLILEEVSNLDDDNFNTFPQIAQKYGYQIITMTPEPFGSNTEDGWYLHQLLEGKTDKNRNYPIPNSSFKTNYKNEQLQGYLKRKATK

SEQ ID NO: 26849 - DNA, 378 bp, Unknown
  Obtained from environmental sample
  misc_feature (1)..(378): n is a, c, g, or t
atggggagtgctgttggcgatgctatgctatatccttcgattcccttagctgtcgctatttctgttattactttaattgcggcttttcaaaagttatatgtttatatcgggataaaaaatagtaatgttcgaaaagttacacatccacgcgtcctgaaattagttcaagatggaaagcttttaaaggaaaattttatagtagatgaaattgacaaaaatgaagtttttatgcttttaagagaagctgggattaaatatctttcggaagtggaatatgcatattatgaacaatcaggtagattaagtgtttttaaatataacgatcctaaattagagcattccattctgcccgagaatattgaagattttgaattttaa

SEQ ID NO: 26850 - protein, 125 aa, Unknown
  Obtained from environmental sample
  DOMAIN (43)...(125): Protein of unknown function (DUF421)
  misc_feature (1)..(125): Xaa is any amino acid
MGSAVGDAMLYPSIPLAVAISVITLIAAFQKLYVYIGIKNSNVRKVTHPRVLKLVQDGKLLKENFIVDEIDKNEVFMLLREAGIKYLSEVEYAYYEQSGRLSVFKYNDPKLEHSILPENIEDFEF

SEQ ID NO: 26851 - DNA, 396 bp, Unknown
  Obtained from environmental sample
  misc_feature (1)..(396): n is a, c, g, or t
atgatgtattatgctaatgatataacttcagaaaacaccattgaaaatttcacaaaaaaagttaccgaaaaaaatgagtttaattacaatttaaatttgaactcagaagtttatgaaatgatagttaaacgatttcttgctgaatatgctttaggaatgagagcatctgaaatctggaaaagagattatcaagctgatggtggctatttgattgtaagagaagacggcgaaattatttgctaccatttctattttgtgaaaaatttcgaaaattatttattccaaaacacaaaattggaaacaccagataaaaatcggtaccatatggcagaagtttttgaagaagatggaaagcagaaaataagattaaatcttcaaattagatttattacataa

SEQ ID NO: 26852 - protein, 131 aa, Unknown
  Obtained from environmental sample
  misc_feature (1)..(131): Xaa is any amino acid
MMYYANDITSENTIENFTKKVTEKNEFNYNLNLNSEVYEMIVKRFLAEYALGMRASEIWKRDYQADGGYLIVREDGEIICYHFYFVKNFENYLFQNTKLETPDKNRYHMAEVFEEDGKQKIRLNLQIRFIT

SEQ ID NO: 26853 - DNA, 390 bp, Unknown
  Obtained from environmental sample
  misc_feature (1)..(390): n is a, c, g, or t
atgaagatcttgatcctgaacggcagccccaaaggtgaattcagtattacccttcagtatatgaatttcattgaacggaaatacgataagcatgatttccagattatccatgtgtcacaaaaaatcaagaagattgagaaggacgaaggatatttcaatgacataattcaggagatcaatcaatctgatgcagttatctggtctttcggactgtgggtgctagctgttccggcgcaatatatgagattcatagaattgatctcggaaaggaaggtcgagtacgtatatagtgataaatatgcagctgcaatatccacatctatccggttttatgatcatacaggccataattacatcaggcgagtttgcgaagatatgggtatgcactaa

SEQ ID NO: 26854 - protein, 129 aa, Unknown
  Obtained from environmental sample
  misc_feature (1)..(129): Xaa is any amino acid
MKILILNGSPKGEFSITLQYMNFIERKYDKHDFQIIHVSQKIKKIEKDEGYFNDIIQEINQSDAVIWSFGLWVLAVPAQYMRFIELISERKVEYVYSDKYAAAISTSIRFYDHTGHNYIRRVCEDMGMH

SEQ ID NO: 26855 - DNA, 492 bp, Unknown
  Obtained from environmental sample
  misc_feature (1)..(492): n is a, c, g, or t
atgaataaattaggaattataattggactgttaataggattggggctttttggtgcctataatgtaaaaaccaaagcaaaactaaaatcaaatcaggaggtatcagcaactcaatttgtgacaaaaattgaggagttgggttattataaatacactgacaaaaaaaatattgatagtttaaaaaatcaactaattaaaaattatgatccaacaaacgagttggtgtcgatttgggatgatcaaactggtgttcctcttgattatagatattattggtgtgatggcgaaaccgtgtttgaacttggaggatttacagagctattagaacaagttaaaccaacttttaataaaattgggttgacaataaatataacggaccatatcgaagaatgggatgataaaaataaatggttaaatcataggataacaataaacggaactaaatatgtaatttttaaaaactttaaaaattatgnttgggagaatcagtga

SEQ ID NO: 26856 - protein, 163 aa, Unknown
  Obtained from environmental sample
  SIGNAL (1)...(18)
  misc_feature (1)..(163): Xaa is any amino acid
MNKLGIIIGLLIGLGLFGAYNVKTKAKLKSNQEVSATQFVTKIEELGYYKYTDKKNIDSLKNQLIKNYDPTNELVSIWDDQTGVPLDYRYYWCDGETVFELGGFTELLEQVKPTFNKIGLTINITDHIEEWDDKNKWLNHRITINGTKYVIFKNFKNYXWENQ

SEQ ID NO: 26857 - DNA, 465 bp, Unknown
  Obtained from environmental sample
  misc_feature (1)..(465): n is a, c, g, or t
ttgtatgtaatgaaatcaatcttttttctatttttcttgatgtgtatgaacatatcaaattctcaagctggctctgctaaagatgacaatgcagctggaacttctatgtggccaatttacaataaggcaaaaacgtatataaaactgctagaagagaagaaattagaaatagtaagaatggaatatgacattgtaactatgactaaaaagaactcttggagaaaacttgtaaaggatataaaatatagtgttattgtttttggtgactatcgagttaaagatatagatgtaagtatttttaagtatagagataaaaaatgggttcgtgtagttaaagataaaaaagaagccagttttgctattgtttcatttattcctgataaaacggaagaatataaaataganatatcgtatactcaatttaaagataatatcaagccgctcaactgctggaccgaatcttga

SEQ ID NO: 26858 - protein, 154 aa, Unknown
  Obtained from environmental sample
  SIGNAL (1)...(20)
  misc_feature (1)..(154): Xaa is any amino acid
MYVMKSIFFLFFLMCMNISNSQAGSAKDDNAAGTSMWPIYNKAKTYIKLLEEKKLEIVRMEYDIVTMTKKNSWRKLVKDIKYSVIVFGDYRVKDIDVSIFKYRDKKWVRVVKDKKEASFAIVSFIPDKTEEYKIXISYTQFKDNIKPLNCWTES

SEQ ID NO: 26859 - DNA, 429 bp, Unknown
  Obtained from environmental sample
  misc_feature (1)..(429): n is a, c, g, or t
atggaagatatagagaatatagaattagagtatttaaaaatagaagattacgaggagctcaaggaagcaatgatagaatcttattcatcaatgccagacctcttttggaaaaaacatcacatacaaaaattaataaccatttatccagaagggcaagtggttataaaaatcaataatcaaattgctggttgtgcgctgtctattattgtggattataataaattagacaatcaccatacatataaagatattacaggaaatgatacgtttagtacgcacaaacccgatggtgatgttatttatggtatagatgtttttatacgacctaaatttagaggtttacgtttagggcgtcgtttatacgactatagaaaagagcttgtgaacgttctatcttcgtggtttagcctttggcggacgtattcttaa

SEQ ID NO: 26860 - protein, 142 aa, Unknown
  Obtained from environmental sample
  misc_feature (1)..(142): Xaa is any amino acid
MEDIENIELEYLKIEDYEELKEAMIESYSSMPDLFWKKHHIQKLITIYPEGQVVIKINNQIAGCALSIIVDYNKLDNHHTYKDITGNDTFSTHKPDGDVIYGIDVFIRPKFRGLRLGRRLYDYRKELVNVLSSWFSLWRTYS

SEQ ID NO: 26861 - DNA, 483 bp, Unknown
  Obtained from environmental sample
  misc_feature (1)..(483): n is a, c, g, or t
atggggagcttgatcctattttacaatacggcgtggaagcattttgtaaatcgtgcccaagaagttggtatcgatggtttaattattcccgatttacctgtagatgtatatgatgaaaagtacaagcaaattttcaaaaaatatggcttaattaatgtctttttaattacaccccaaacttccgaagaacgcattcgttatatcgactctatttccgaaggcttcatttatatggtaagtagcgcaagtgtaacaggaggcagttctggatttcaaaaggaacaaatagattattttaaacgcatatctaatatgaaattgcaagccccacaaattataggctttggcatctctgataacgaaagttttaggcaagccacaaaaaatacaaaaggcgccattattggatcggcatttattaaacacctcactgtgaatggtgttaaaaatatagatacttttgtaaacacaattttacaataa

SEQ ID NO: 26862 - protein, 160 aa, Unknown
  Obtained from environmental sample
  DOMAIN (1)...(158): Tryptophan synthase alpha chain
  misc_feature (1)..(160): Xaa is any amino acid
MGSLILFYNTAWKHFVNRAQEVGIDGLIIPDLPVDVYDEKYKQIFKKYGLINVFLITPQTSEERIRYIDSISEGFIYMVSSASVTGGSSGFQKEQIDYFKRISNMKLQAPQIIGFGISDNESFRQATKNTKGAIIGSAFIKHLTVNGVKNIDTFVNTILQ

SEQ ID NO: 26863 - DNA, 579 bp, Unknown
  Obtained from environmental sample
  misc_feature (1)..(579): n is a, c, g, or t
gtgagcggcgttgatgatgtggataaaattcttaatgacctacaaaataaccgtcgcaatcaatttaatacagctattcatatagacgctggcattctcgatggagaaaataaaaaagttattgtaatcaaagttttcgaacttgatgcagcttctaagccttgtggttttataagtagtggcaaaaaaagcaaaaactttactaaaactggtatatggcggcgcggcatcaatggtgattatgaagctaaaattgaagatctttatgacattattgcttctaaaactggtcaatcatttgaaaatatagttctaccagaagcttcttggtcggacattgatcccgatgtgattgcattttatcgaaagcaacgagctaaagtacagcctgatgcagttgaactagattatagtgatactgacttacttctttcttttaatttgattcaagaaaagaatggagtattcaaaccgaatattgctggcttattattgttcggctcttcattagcacttcgtcgtcatcttcctatggctcgtgttgactacattcgtagtgcaggaaccacaatgggttga

SEQ ID NO: 26864 - protein, 192 aa, Unknown
  Obtained from environmental sample
  misc_feature (1)..(192): Xaa is any amino acid
MSGVDDVDKILNDLQNNRRNQFNTAIHIDAGILDGENKKVIVIKVFELDAASKPCGFISSGKKSKNFTKTGIWRRGINGDYEAKIEDLYDIIASKTGQSFENIVLPEASWSDIDPDVIAFYRKQRAKVQPDAVELDYSDTDLLLSFNLIQEKNGVFKPNIAGLLLFGSSLALRRHLPMARVDYIRSAGTTMG

SEQ ID NO: 26865 - DNA, 816 bp, Unknown
  Obtained from environmental sample
  misc_feature (1)..(816): n is a, c, g, or t
ttggagcttttgaatcggctcgagtgcgttgtatctgctaatggaaattggtggtggggtatatttataggtattgttttgctcgttttagcaacattaggcaaccattttgacatggaaaagtcagaagaaaaaatctcagatctcgaggaaaaattagaggctgagaaggttaaagtaagagatggggcagaagaatctgaaagaacaggtattaaactacaagaaaccaagttaaagttagtagagactcatgaacaactagttacttctatattgaaaagtatatttaaaaatttagagcttgatacctatactagaatttcgatatattttgaaaaagatggtcagttcttgatactaggtcgctattctcaaaacccaaaattcaaagaaattcacactagagcctttcctataaataaaggagctttgagtaaagcatgggagcatggagaatactttgatgataaatgttgttcttatgaaggtaataagtcaaattatgagcgttaccagctagaaaactttgactataatcaaaagcaaactgaaagattaacaatgaagagttgtgagtatgttggagtcgctttgacacacattgatgaacatattggcgtaatactatttgaaagtgaaagtaagaaatttgttgatattagaagggctggtattcttgagcaagtcaataattaccatactcagctttcggatagaataataagtggcaaactcatacacagtgaaagtaaacctacaagagatgttgatgaagagttcatgtcgacaatgcaaggtcagtctaaggagtag

SEQ ID NO: 26866 - protein, 271 aa, Unknown
  Obtained from environmental sample
  misc_feature (1)..(271): Xaa is any amino acid
MELLNRLECVVSANGNWWWGIFIGIVLLVLATLGNHFDMEKSEEKISDLEEKLEAEKVKVRDGAEESERTGIKLQETKLKLVETHEQLVTSILKSIFKNLELDTYTRISIYFEKDGQFLILGRYSQNPKFKEIHTRAFPINKGALSKAWEHGEYFDDKCCSYEGNKSNYERYQLENFDYNQKQTERLTMKSCEYVGVALTHIDEHIGVILFESESKKFVDIRRAGILEQVNNYHTQLSDRIISGKLIHSESKPTRDVDEEFMSTMQGQSKE

SEQ ID NO: 26867 - DNA, 483 bp, Unknown
  Obtained from environmental sample
  misc_feature (1)..(483): n is a, c, g, or t
atggattttcccgatagtgcaaataatgccatatttgcagatatcgttctgaaaaaggacaccgtaagggtatataaccttcatttggagtcgcataggatctcaccaagtgtaagacgattatcaaatgagcccaaggggaggttgctaaaaaggttaagtaaatcctttgcgaaacagggagagcaggcgcaattggttgagaagaatattgaagccactccctataagaaaattgtatgtggggactttaacaacacccagttttccaatgtctataaggtaattaaaggggatatgaaagactcctttacggagcagggaactggttatggccggacctttaattttagatattatccggttagaattgattttattttggccgatgaagcttttgaaattgcggcccataagaattttgacataaaattatcggaccatttcccggtcatgacatcgattaaaattgactccaaatag

SEQ ID NO: 26868 - protein, 160 aa, Unknown
  Obtained from environmental sample
  misc_feature (1)..(160): Xaa is any amino acid
MDFPDSANNAIFADIVLKKDTVRVYNLHLESHRISPSVRRLSNEPKGRLLKRLSKSFAKQGEQAQLVEKNIEATPYKKIVCGDFNNTQFSNVYKVIKGDMKDSFTEQGTGYGRTFNFRYYPVRIDFILADEAFEIAAHKNFDIKLSDHFPVMTSIKIDSK

SEQ ID NO: 26869 - DNA, 633 bp, Unknown
  Obtained from environmental sample
  misc_feature (1)..(633): n is a, c, g, or t
atggctgacaggatgaaatacaaagggatttcattggatattgagcatttagaaaaagaattacaaactaaaatagctgttattagtaccagaaaaaatgaaggtatagataacttaaaacagttaatttctaattataaagaactatcaactacgccttgcttaaatgcatcggaaatagataaagaatattttgacaaattaagaaaagccttccctaaccaattactttacaaattatggttagtaattacccaagatgtaaattttggtaagatggaccgtaatgaagtcgaagctattgctagttttaaaactaaatctaaaagcgacttaaaacgtttacaacaaaaagaaaccattaagcgctatcaatttataaataacacgcttaaaaaaggacaaaccattgatgctagtcaagctaaggatttacgcactaaatttgatcgcatacttacgcacaaaatttggggttatgttattttcttttttatactactaactatttttcaagccatttatgactggtcaacagtaccaatggactttattgatagcgtgtttgcaagtctaagtgattgggttaaaaacactcttcctgaaagtgcattactaatttataagacgaan

SEQ ID NO: 26870 - protein, 211 aa, Unknown
  Obtained from environmental sample
  DOMAIN (1)...(208): Ferrous iron transport protein B
  misc_feature (1)..(211): Xaa is any amino acid
MADRMKYKGISLDIEHLEKELQTKIAVISTRKNEGIDNLKQLISNYKELSTTPCLNASEIDKEYFDKLRKAFPNQLLYKLWLVITQDVNFGKMDRNEVEAIASFKTKSKSDLKRLQQKETIKRYQFINNTLKKGQTIDASQAKDLRTKFDRILTHKIWGYVIFFFILLTIFQAIYDWSTVPMDFIDSVFASLSDWVKNTLPESALLIYKTX

SEQ ID NO: 26871 - DNA, 588 bp, Unknown
  Obtained from environmental sample
  misc_feature (1)..(588): n is a, c, g, or t
atgaaaattataaatataataaagtactatcgaggtaatttcttcttttgnctgttagcaggtcttaccctaacccttgggtgttcagacgataatggcgaaggttgggcagatgaaagatatttggaaaactttgaattttatgtatatcataccaatccaaacacgggattggactatacggaagaggaattagccgaattaacctatgatcctatggtcaaagaatcatacgccgagggtcagtctgtagatttagctatagttacttctaaattaccttctgaaataaaggtgcttttaggaacagatttatctgtattagagaccttaacagattttccaacttttggcgataaatttaagtccaaaagttttgtatctagtttggaggaacttaatttattggaaataggggataaaactacccttaaatttgatattttatatacggatggctcaataggagctgtgaattttgaaattaagaaagcgaagttttttgatccaaatgctatcatagatacttttgtttatttaaaaaagagtactggagaactattcctttgctctcgagccgattcttga

SEQ ID NO: 26872 - protein, 195 aa, Unknown
  Obtained from environmental sample
  misc_feature (1)..(195): Xaa is any amino acid
MKIINIIKYYRGNFFFXLLAGLTLTLGCSDDNGEGWADERYLENFEFYVYHTNPNTGLDYTEEELAELTYDPMVKESYAEGQSVDLAIVTSKLPSEIKVLLGTDLSVLETLTDFPTFGDKFKSKSFVSSLEELNLLEIGDKTTLKFDILYTDGSIGAVNFEIKKAKFFDPNAIIDTFVYLKKSTGELFLCSRADS

SEQ ID NO: 26873 - DNA, 924 bp, Unknown
  Obtained from environmental sample
  misc_feature (1)..(924): n is a, c, g, or t
atggatcaaagaatcggctcgaggtcaagctacatttcagattataaaatagatactattattaccacaggaccacctcacagcttgcatataatagggttacagcttaaagaagcgcttggtgtgcaatggatagccgattttcgtgatccgtggacgtcgatagggtatcataaaaaattaaaactgactaaggtctctcagagaaagcataaaaaattagaaaaacaagtgctaactacagctgataaaataattgtaaccagcaataacacaaaaaaagagtttcagcagttaacagagcaaccaataaccgtcataactaatggttatgatgttgtcaaatcatctgttattattagggattcaaagtttactctgtctcatattggctcttttttgtctgaaaggaatccaaaaatattgtgggaagttcttcaagatttgcgaaatgaagatgccggttttaaattggacttcgaattgaaactagttggagctgttagtgattctgtactgaaatctattcagaaatataatttaactaattgtttaaataatataggctatgtgtctcataatgaagcattaaaaattcaaaaagaaacacagttgttgctgttggttgaaattgattccgaagaaacaaaagcaattattccaggaaagttatttgagtatatggtttcagagcgtcccatagttgctatcgggccaactagaagtgatgttgaagttatcttaaaagaaacgaatacaggaacttattttaactacaccgactctgaaggcttaaaatctgtaattaaaacatattacccaaactataaaacgggcgatttaaaaacgaatgctattggggtgcccaataccgtagaaagaattaacaaaaaattagcgcaatcaataatgggaatagcgtaa

SEQ ID NO: 26874 - protein, 307 aa, Unknown
  Obtained from environmental sample
  DOMAIN (111)...(294): Glycosyl transferases group 1
  misc_feature (1)..(307): Xaa is any amino acid
MDQRIGSRSSYISDYKIDTIITTGPPHSLHIIGLQLKEALGVQWIADFRDPWTSIGYHKKLKLTKVSQRKHKKLEKQVLTTADKIIVTSNNTKKEFQQLTEQPITVITNGYDVVKSSVIIRDSKFTLSHIGSFLSERNPKILWEVLQDLRNEDAGFKLDFELKLVGAVSDSVLKSIQKYNLTNCLNNIGYVSHNEALKIQKETQLLLLVEIDSEETKAIIPGKLFEYMVSERPIVAIGPTRSDVEVILKETNTGTYFNYTDSEGLKSVIKTYYPNYKTGDLKTNAIGVPNTVERINKKLAQSIMGIA

SEQ ID NO: 26875 - DNA, 705 bp, Unknown
  Obtained from environmental sample
  misc_feature (1)..(705): n is a, c, g, or t
gtgccgttaataaacccagaaggttaccccttaggaacgttatgtgttttcgacattaaaccgcgtaagctaacagctttacaaaagcaagtgttaatatctatggctaaacaagttgttaatttgtttgaattgagaaaacgtaatattcaacttcgagaaacaaaagaagagttacatattcagaatgagaatttaaagaattttgctggacacgtttctcatgatatgaaaatgccattggcaaatatgattgtcactaccgatattttaagaaaaaaatacaactcggtgttagacgcaaaaggtattgaatacttagattatttaaaacaatcttcttttaccttaagcgactatatctctggacttcttaatcattatgaaagtgataaattaggaggagaatcagaaagcttcgatttacatgtattgctcgaagaaattgtcgatttattaaatataaatattgattgtgaaataaatttccccgaaattaatgaggaattatattgtaaccgttcagctttagaacaagtttttctaaacttaataggaaatagtataaagtacaacgacaaggaaaaagttgttatttccatagaatgtaaaaaagaaaagaaattcttagaatttaaaatttctgacaatggtattgggattcctcaagataaacaaaaggaatttttaactatttctacctag

SEQ ID NO: 26876 - protein, 234 aa, Unknown
  Obtained from environmental sample
  DOMAIN (65)...(131): His Kinase A (phosphoacceptor) domain
  misc_feature (1)..(234): Xaa is any amino acid
MPLINPEGYPLGTLCVFDIKPRKLTALQKQVLISMAKQVVNLFELRKRNIQLRETKEELHIQNENLKNFAGHVSHDMKMPLANMIVTTDILRKKYNSVLDAKGIEYLDYLKQSSFTLSDYISGLLNHYESDKLGGESESFDLHVLLEEIVDLLNINIDCEINFPEINEELYCNRSALEQVFLNLIGNSIKYNDKEKVVISIECKKEKKFLEFKISDNGIGIPQDKQKEFLTIST

SEQ ID NO: 26877 - DNA, 723 bp, Unknown
  Obtained from environmental sample
  misc_feature (1)..(723): n is a, c, g, or t
ttggtgaatgcctatttagataaccctccattgattgcttatgagaatatcccgtttccgcatttagaggaaggtagggttgtgggtttggtcactataaaatccaatggtagggtatgcgcccttcgtaagaatatctggaagtattatggaggctcggtcttttttagagagggaagtattagtatgccaaaggcctttgacgttgaattaaaggatatgaattcaaaagcagtggcaaccattgaacaacatgctaggaacaacattgaattgactttggatggcgttattgactttctcaataatcgacataaagatcttgaaagcaactacaaggtatttaaagaacaatttgtggtctgttgggctggaaatgcgaaaaaagtcaaggatgaaacctatttctcgagggttgatattgagctgatcaacgaacaagttaaattattcttttctactttagatgaggttacggtagaattcgatgatgatacctttacaacaacagagtatgtgcgtttggggctggccaataaattaaagtattaccccttggagaaaatgaacattacttttgaggagaatggcacttatcagattcaaagcgaattgatttttgatcctcccaagtacgataaaaagatattgtaccatattttaaatgcgaacaatgctttgctccaaaaactggaaaaaaatatggcccctgaaatctattga

SEQ ID NO: 26878 - protein, 240 aa, Unknown
  Obtained from environmental sample
  misc_feature (1)..(240): Xaa is any amino acid
MVNAYLDNPPLIAYENIPFPHLEEGRVVGLVTIKSNGRVCALRKNIWKYYGGSVFFREGSISMPKAFDVELKDMNSKAVATIEQHARNNIELTLDGVIDFLNNRHKDLESNYKVFKEQFVVCWAGNAKKVKDETYFSRVDIELINEQVKLFFSTLDEVTVEFDDDTFTTTEYVRLGLANKLKYYPLEKMNITFEENGTYQIQSELIFDPPKYDKKILYHILNANNALLQKLEKNMAPEIY

SEQ ID NO: 26879 - DNA, 429 bp, Unknown
  Obtained from environmental sample
  misc_feature (1)..(429): n is a, c, g, or t
ttgaatatatttttaccgtataaacatacactttttataagactgaatagaattataaaaaaagaacttacgagaataaacaatcaacaatttgtttatttcacaaaccacgatgatgtcgcgactttaaacaaagtcttactatacatttctgaaaatgaatctacaaaaaacgtgaaaattgtaaatgttttatatgaaggagaaaccgttgcaaaaaatcttgagaaggatattgaaacattaaacagagcgtaccctttaatggatgttaaatttattaaagagcctggtgttttcggtcctaaaaaaattgaagaattgtctaagcgttggaaaattccaaccaattttatgtttattgcttctccaggacttaaatttacctataaaattcacgaattaggagaggttaggcttatcgtttaa

SEQ ID NO: 26880 - protein, 142 aa, Unknown
  Obtained from environmental sample
  misc_feature (1)..(142): Xaa is any amino acid
MNIFLPYKHTLFIRLNRIIKKELTRINNQQFVYFTNHDDVATLNKVLLYISENESTKNVKIVNVLYEGETVAKNLEKDIETLNRAYPLMDVKFIKEPGVFGPKKIEELSKRWKIPTNFMFIASPGLKFTYKIHELGEVRLIV

SEQ ID NO: 26881 - DNA, 711 bp, Unknown
  Obtained from environmental sample
  misc_feature (1)..(711): n is a, c, g, or t
gtggatatattagcctttggtgcacatcctgacgatgtcgagttaggagctggtggaaccttagcaaaagccattcacgaagggaaaaaagtgggaataatcgatttaacacgtggtgaattaggaacacgcggaaccgaacagactagaaaagaggaagctaaagctgcaggagatgttttaggagtttcaatacgagaaaatttaggttttgctgatggatttttcataaatgataaacagcatcagttggaggtaattaaaatgattagaaaataccaacctgaaatagtcttatgtaatgctatagatgatagacatatcgaccacggtaaaggaagtaaattagtaagcgatgcgtgttttttaagtggattactaaaaattgaaactgaaaatgattgctaccaacaagaacgctggagaccaaaacaagtttaccattatatacaatggaaaaattgtgaaccggattttgttgtggacgttagcggatttatggaagtcaaactaaaatcggtttttgcctataaaacccagttttatgataaaaacagtaaacagccagaaacacctattaccagtaagaattttaccgatagtatagaatatagagcacgagatttaggacgcttaattaatgtggattatgcagagggctttaccacagaacgttacgtagcggtgaagagtttgttcgatttgatttag

SEQ ID NO: 26882 - protein, 236 aa, Unknown
  Obtained from environmental sample
  DOMAIN (4)...(121): Uncharacterised LmbE-like protein, COG2120
  misc_feature (1)..(236): Xaa is any amino acid
MDILAFGAHPDDVELGAGGTLAKAIHEGKKVGIIDLTRGELGTRGTEQTRKEEAKAAGDVLGVSIRENLGFADGFFINDKQHQLEVIKMIRKYQPEIVLCNAIDDRHIDHGKGSKLVSDACFLSGLLKIETENDCYQQERWRPKQVYHYIQWKNCEPDFVVDVSGFMEVKLKSVFAYKTQFYDKNSKQPETPITSKNFTDSIEYRARDLGRLINVDYAEGFTTERYVAVKSLFDLI

SEQ ID NO: 26883 - DNA, 702 bp, Unknown
  Obtained from environmental sample
  misc_feature (1)..(702): n is a, c, g, or t
atgcaacgcgctttggatgctaatgtaacacgtttatttattcccgctatcgattctacatatacggcagcgatgcttcagcttgaaaaagactaccctgatcacgtgttcttaatgtctggtgtacatcctacacacgtaaaagacaattataaagaggaattggcgcacgtagaagagatgttaaacagtcataaattttatgcggtaggagaaattggcattgatttgtattgggataaggacacgttggagattcaaaaagaagcgtttaagtatcaaatacagttagcgaaacaacataaattacccattgtaatacattgtcgcgatgctttcgatgaagttttcgacgtcttagaagaggaaaagagtgacgatttatttgggatttttcattgttttacggggacgttagaacacgcaaaactagctatttcttataatatgaaattaggaattggtggtgtggcaaccttcaaaaatggtaaaatcgataaatttctcaatactatcgatttaaaacatattgttttagaaaccgacgcaccctacttagccccgcatcctttccgcggaaaaagaactgacagtagtttcattgttaaagttctcgaaaaattatcggagatttacaatgttacagaagaagacattgcaaccattactactgcaaactcaaaaagccgtttcggtatttaa

SEQ ID NO: 26884 - protein, 233 aa, Unknown
  Obtained from environmental sample
  DOMAIN (1)...(232): TatD related DNase
  misc_feature (1)..(233): Xaa is any amino acid
MQRALDANVTRLFIPAIDSTYTAAMLQLEKDYPDHVFLMSGVHPTHVKDNYKEELAHVEEMLNSHKFYAVGEIGIDLYWDKDTLEIQKEAFKYQIQLAKQHKLPIVIHCRDAFDEVFDVLEEEKSDDLFGIFHCFTGTLEHAKLAISYNMKLGIGGVATFKNGKIDKFLNTIDLKHIVLETDAPYLAPHPFRGKRTDSSFIVKVLEKLSEIYNVTEEDIATITTANSKSRFGI

SEQ ID NO: 26885 - DNA, 657 bp, Unknown
  Obtained from environmental sample
  misc_feature (1)..(657): n is a, c, g, or t
atgcagcactttaaaacaaaaaaacaaaagtattggttagtaatgttgtgctttatttgcataacgttttcttgggcacaaacacctgagaaaaacctaaaagttagtgacactaccaaatctagtgaacttttaaaacaaatagggaatggttttttccctaccaaagtatggaattttgacctgaggtatcttattaaatttaatcaatacgaagggtttagaacaggtttaggcggaattactaatgattcgttttctgaaaaatacagaatagattcttatttagtttatggatttagagatgatagttttaaatataaaattggtggtggttttagagtaaacgaaaaatcaaaaacctggataaacatttcttacattgatgatttaaaagaaactggtagctctgactttttaacagacagtagatctttttcattttttgaacctagattgttaaacatagatttatttcataaacacattacatctgcaatatctttagaacacgaaataaccgcaaaactatactcaaaatctgaaatagcaataagtaacataagacctacttacacttataactacgacttagaaggcaatacttttagcggatttggaccactacagcaaaatcgcgttacatggatccattaa

SEQ ID NO: 26886 - protein, 218 aa, Unknown
  Obtained from environmental sample
  misc_feature (1)..(218): Xaa is any amino acid
MQHFKTKKQKYWLVMLCFICITFSWAQTPEKNLKVSDTTKSSELLKQIGNGFFPTKVWNFDLRYLIKFNQYEGFRTGLGGITNDSFSEKYRIDSYLVYGFRDDSFKYKIGGGFRVNEKSKTWINISYIDDLKETGSSDFLTDSRSFSFFEPRLLNIDLFHKHITSAISLEHEITAKLYSKSEIAISNIRPTYTYNYDLEGNTFSGFGPLQQNRVTWIH

SEQ ID NO: 26887 - DNA, 408 bp, Unknown
  Obtained from environmental sample
  misc_feature (1)..(408): n is a, c, g, or t
atgaatttagaaaaaatagtagctgtttcaggtaagcctggtttatatgaaattatttcacagactaaaggaggcataatcgtacaatcatttgttgataaaaaaagattaccaattaatgctatgcataatgtaagtgtattaaacgatattgcaatttacacccatgatgatgaaattccgttaagaaacatttttaaaactattgcagaaaaaggcattgaagtaattagtcacaaaggaagtaacgataagttaatttcattttttaacgaagtacttcccaattatgatgaagagagagtatatccttccaatattaaaaaagtagttcaatggtataatatattagccacagctaattttgatttttctctaatcaaagaaggctctgaagaggaagaataa

SEQ ID NO: 26888 - protein, 135 aa, Unknown
  Obtained from environmental sample
  misc_feature (1)..(135): Xaa is any amino acid
MNLEKIVAVSGKPGLYEIISQTKGGIIVQSFVDKKRLPINAMHNVSVLNDIAIYTHDDEIPLRNIFKTIAEKGIEVISHKGSNDKLISFFNEVLPNYDEERVYPSNIKKVVQWYNILATANFDFSLIKEGSEEEE

SEQ ID NO: 26889 - DNA, 624 bp, Unknown
  Obtained from environmental sample
  misc_feature (1)..(624): n is a, c, g, or t
ttggatagcccaactctaaagtttgcacagtcttgtggtatgcaatttaaatttataagtcgtgaagcatttagactaaaaggaacacagtcgttttacgaaaaaattaaaaaagaatttggtgacttttatttaattcctgaaggcggaaccaatgatttggctgtaaaaggatgcgaagaaattttgacggaaacagaccgtaaatttaattacatatgtgcttccgtaggaacaggaggtaccttatcaggcttgattaataattcaaacacagcacaaaaagttttaggtttttcagctttaaaaggtgactttttaaaagaagatattagtaaatttgcaaaacaagataattggcaattaatgacagattaccattttggtggttatgctaaaataaacacagaattagtaacgtttattaatagctttaaaaagcaaaataatattgcattagatcctgtttacaccggaaaaatgatgtctggtatttacgatttaattaaacgtgattattttaagccaaattctgaaatattagtgattcatactggaggtttgcaaggtattgtaggtatgactaacagattaaaacaaaaacaacaacagttaattttataa

SEQ ID NO: 26890 - protein, 207 aa, Unknown
  Obtained from environmental sample
  misc_feature (1)..(207): Xaa is any amino acid
MDSPTLKFAQSCGMQFKFISREAFRLKGTQSFYEKIKKEFGDFYLIPEGGTNDLAVKGCEEILTETDRKFNYICASVGTGGTLSGLINNSNTAQKVLGFSALKGDFLKEDISKFAKQDNWQLMTDYHFGGYAKINTELVTFINSFKKQNNIALDPVYTGKMMSGIYDLIKRDYFKPNSEILVIHTGGLQGIVGMTNRLKQKQQQLIL

SEQ ID NO: 26891 - DNA, 462 bp, Unknown
  Obtained from environmental sample
  misc_feature (1)..(462): n is a, c, g, or t
atgataacgtatttaaccagaaatgaattaaacgtagcgaaatatgatacttgcattgctaatgcaataaatacacgcgtatacgctaatagctggtttcttgatattgtatgtgatgattgggatgtcttggttgaaggtgattatcagtcagttatgccattgcccaaaagaaaaaaatatggcattcattatatttatcaaccaccatggacacagcaattgggagttttttcactcgaaactatcaatgaatttgatgtgctgaagttcgtaaaaaaaatccctaaaaaatttagattaattgatatttttttgaattcggataattttataagttctcaacgaattaagatgagagacaattttatattgtcgttagataagtcgtatgaatcattacaaaaacaatacagtaagggtcgtaaaagtagttgcaaacaagccaaacaattaatttaa

SEQ ID NO: 26892 - protein, 153 aa, Unknown
  Obtained from environmental sample
  misc_feature (1)..(153): Xaa is any amino acid
MITYLTRNELNVAKYDTCIANAINTRVYANSWFLDIVCDDWDVLVEGDYQSVMPLPKRKKYGIHYIYQPPWTQQLGVFSLETINEFDVLKFVKKIPKKFRLIDIFLNSDNFISSQRIKMRDNFILSLDKSYESLQKQYSKGRKSSCKQAKQLI

SEQ ID NO: 26893 - DNA, 315 bp, Unknown
  Obtained from environmental sample
  misc_feature (1)..(315): n is a, c, g, or t
atgccgcccaatatggatttagagcgagtaacgtgtacgccattttatttttatgatttagattatgaaattcaaacgccattaaagatttatccttttgcagttatggatggcaccctaagggattatttacaattatctaacaaaagagcctatgaagttatcataaaattggctcaagaggttaagaaagttgatggcacattcattactatttttcataatgaaacactcagtaacagaggtcgatggaaacgatggaaaaaactctacatagatatttttaaacaactaactgaattacgatctgtttag

SEQ ID NO: 26894 - protein, 104 aa, Unknown
  Obtained from environmental sample
  misc_feature (1)..(104): Xaa is any amino acid
MPPNMDLERVTCTPFYFYDLDYEIQTPLKIYPFAVMDGTLRDYLQLSNKRAYEVIIKLAQEVKKVDGTFITIFHNETLSNRGRWKRWKKLYIDIFKQLTELRSV

SEQ ID NO: 26895 - DNA, 393 bp, Unknown
  Obtained from environmental sample
  misc_feature (1)..(393): n is a, c, g, or t
atgcgcgttacgccaaaaacgatgcaatcattagctcagtatgatgatcttttacaggatataatctactatttttctaataaagtaactgaagctagaagttttgggattcacgatattatcctagatccaggctttggatttgctaaaactacttctcaaaattttgaattacttaaaaatctttctttattaaacgtgttagaacttcctatcctcgcaggactttctagaaaatctatgatctacaaaactttagaaatttcagctaaagaagctcttaacggaaccagcgttttaaacaccttagctttgcaacaaggcgcaaaaattttaagagtacacgacgtaaaagaagcaaaagaatgtattgatttagttgggcaactttag

SEQ ID NO: 26896 - protein, 130 aa, Unknown
  Obtained from environmental sample
  misc_feature (1)..(130): Xaa is any amino acid
MRVTPKTMQSLAQYDDLLQDIIYYFSNKVTEARSFGIHDIILDPGFGFAKTTSQNFELLKNLSLLNVLELPILAGLSRKSMIYKTLEISAKEALNGTSVLNTLALQQGAKILRVHDVKEAKECIDLVGQL

SEQ ID NO: 26897 - DNA, 654 bp, Unknown
  Obtained from environmental sample
  misc_feature (1)..(654): n is a, c, g, or t
gtgtcttatgtaggttataggacctatttaaaaaaaatgcttatagataaagagatcatagatttaaagagaattgctcttcagctagataaccagcttggtgaagttttagtgaaatctacggcaccaataactattaaaaaagacacgttagagtttaatgtgaaatcttttaaaactaaaaaagatgcaacagttgaggacttattaaagcaattacctggtgttgaggttgatgatgaaggtaagattacagtaaatggaaaggaagtaaataaaattctggtaaatggaaaaccatttttcggaaatgatcctacaataactactaagaatttaactaaggatattattgagaaaattcaagttgtagatactaaaacaaaagcagaagcatttacaggtgaagtcggtgatagcgagaataaaacgattaaccttactataaaagaagaaaataacaaaggtgtatttggacgcgtatctgctggcgctggtacagatgaacgctacgaatttgctgggatggtaaacctctttgataacgaccgaagaattagcgtgctagcaggtggacataataacaactcaccaggtttcagtcttggcgaactttccacaatgttcgcaaatgacgcccgagtaaactcttaa

SEQ ID NO: 26898 - protein, 217 aa, Unknown
  Obtained from environmental sample
  misc_feature (1)..(217): Xaa is any amino acid
MSYVGYRTYLKKMLIDKEIIDLKRIALQLDNQLGEVLVKSTAPITIKKDTLEFNVKSFKTKKDATVEDLLKQLPGVEVDDEGKITVNGKEVNKILVNGKPFFGNDPTITTKNLTKDIIEKIQVVDTKTKAEAFTGEVGDSENKTINLTIKEENNKGVFGRVSAGAGTDERYEFAGMVNLFDNDRRISVLAGGHNNNSPGFSLGELSTMFANDARVNS
